United States Patent 7,745,391 (HUMAN THROMBOSPONDIN POLYPEPTIDE) - sequence listing, part 58

SEQ ID NO: 186616 - DNA, 627 bp, Homo sapiens
  misc_feature (39)..(39): n is a, c, g, or t
gctctagagtatccccccttgccgtctttcttgagacanagcctggctctgtcaccaaggctggagtacaatggcgtgaacacagctcactgcagcctcaaccttctgggctcaagtgatcctcctgcctcagcctcccaagcagctggaaccacaggttcataccatcatgcctggctaatttttttgtagagacagagtcttgccatgttacctaggctggtcttgaactcctaggctcatgcaatcttactgcctcggcctcccaaagtgctgaagttataaaatggataagccattagactcgatgtagggtgtgagagaagaaaggaggcaagggtaacacttacttccctgagcacattaaaagactgaattgccgccgggcgtggtggctcacgcctgtaatcccagcactttaggaggctgaggcgggcagatcacgaggtcaggagatcgagaccagcctggccaagatggtgaaaccctgtctctagccgggcatggtggcgcgcgcctttagtcctggctactcggaaggctgaggcaggagaatcacttgaaccagggaggtggaggttgcagtgggctaagatcacgtcactgcactccagcctgggtgacaga

SEQ ID NO: 186617 - DNA, 105 bp, Homo sapiens
ggcctgctagagccaggagctagtgggagaaggaaacagtgttgcttatgaattataaacagacactcccgcaactttctctgacgtgatacaatctcaaagtgg

SEQ ID NO: 186618 - DNA, 353 bp, Homo sapiens
tctggacttctgccctacacattatgttcttattttattgtgcccttgctatataagtgtaaaacccaccatttcactggaaaaagataaatacttcatttttcactctaagaagtagcatatctaaatggtccatccaggaataatggagagtctcaaaaacaaacatcagaacttaacttcttagcacaccacacaaacaagaaaggcttcatttctagacagtctcctcatatgtctaattggccatgacaatatggtactggtatctcccttctttcctttaatgctatattttaaaaagtctgcattcattcaatatttagagtgtccctgttaaatgttgaataatg

SEQ ID NO: 186619 - DNA, 265 bp, Homo sapiens
acacggctcacacacatacacgccacacacacatacacgccacacacacatacacgccacacacacagagatagatagggcatggaacagaagacaaaatgcagccaatatactacaaaccactagatggagcgcagatgtacagtggagggtgggcacagtgggaaaagactacacagaaggtaaaacattggggatctacatagtaattccaaataaaatattagatcagttacataataaaatttcctgtgagcagcgttgg

SEQ ID NO: 186620 - DNA, 288 bp, Homo sapiens
cagccacaaaccaaaaatcctttgatttttattaacacactgaagtacttaccattgtccccattttacaggacagaaaaccaaggcttagagagttgttatttgcccactcagtcaccctttcagcttacagatgaagctgttagtgacagggtcagccctagaagctaatttgtaagcaggctatgaggtactcaaatatccacatactaaatgcagaatattcaaagctaaattccaggtttgttcacctctcacgttaccaaaatgtactcgtttcctctaaag

SEQ ID NO: 186621 - DNA, 352 bp, Homo sapiens
ttgccacctctcctcacccctcccaacaggcgacagagagaactaaagatggtagggagtcacaaggcagcagcccaaccctctccactccaagaccgcctccagcagtgtgctgttccaacacctgtcactggctggaccaacagcagagctgcactgggggacatttttagcacctggggctcccttcttttgagaactagcacaccaaagaaggcagcagctagggcaaggcctatgtgcccatgccctggggcttacaacacctcttacccccttgccccatacttctggcgctgaagttttatcaagaaatagccagataaaagatttgtgccaggccgggtgtggt

SEQ ID NO: 186622 - DNA, 774 bp, Homo sapiens
aaaaggcaaagaatacacccatattacatataattagtgtcccggaagaagaagattaaagcattgagacagaagtagtgttaaaaactataatcctgctgggcatggtgactcatgcctgttataccagcactttgggaggcagaggtgggtagatctcttgagcccaggaattcgagaccaatctgggcaacatagcgaaaccccatctctacaaatagtacaaaaattagctgggcttggtggcgtgcacctctggtcccagatactcaggggactgaggcaagaggcttgcttgagtccaggaggtcaaggctgcagtgaaccatgatagtccactgcactccagcctgggtgacagagagcaagactttgtctcaaaaaaaaaacaacaaaacagctataatccaagaagacttcactgaaataaaagtctcgaatctgtatattgaaagagctttccagctctttcaatctggaaaattgacctagaataatcaagacatatcttagtacaactattagactttaaagacaaggaaaaatcctcagttcctgaatcaaaaagatgaaataacttacaagggcaacagaaatagtctggcatcagacttctcaaaatcatcatgcaaagcaggataacactaacatcattttcaagaaactcaatgaaaggaggtgtgaaacaaagatttcatgccaagccaagatgtcaaatatgcaagctagagaaaaaaggtttggagtataagaacttggaatactatacacaca

SEQ ID NO: 186623 - DNA, 177 bp, Homo sapiens
gttattaacttcctaactattctcaaagatgaattttcttactactgttaactttgacagtggaagttagtggatgtagaattcaaagtacaaaataattgtcaagaattattttgaaggcctcgttccacagttctgtagcatctcttattacccttgagaagtcttatgctatcc

SEQ ID NO: 186624 - DNA, 516 bp, Homo sapiens
tcttcccctgacaaacactacccatgccatgtgaccaagttcaacatcggtagtgctaagtcacattgatatcgtggatctttgctatgatgtgataagaatggccctttccatctggggtcttcttcccaaaaacacatgaccacagtcaaatcatgaggggggaaaaacagaaggtgaaggttgaaaaattaccttttagatacaatgttcaatatttgcgtgatgagtacactagaagctcaatccccaccattatgcaatatacccatgtaacagacatgcacatgtaccttcaaatctaaaactttaaaaataaaaaatggtatccactagaattatgaaatgcaggactctgacacaccactggaaatctattgcttaatagtattagctacatagacaacatttgtctttcttactaaaaaaaactgtttcccagaccaaattctgcccaaggatgattcctcaaagagctgttctcatggccgatgatcagaggaaggaggaggtgct

SEQ ID NO: 186625 - DNA, 388 bp, Homo sapiens
atggctgtgcctatccgaggagtataaagacaggaaaacagtcctctggcttatctgccacacctgtaggagcaatagtgacacctacttccaaaactaccatacaaacgaagcttctcaaagtgtccaaaagcacatacatttaaacaagaccaagttcttttaagcattaagaagtggtttatcaacacctgtgaaaagaaggggaaaaaatgggaaaaaaaaaagtggactaaaatgccatgattgaggtttgggagacaactgtccctaagaccaaaataaagaaacaagtgggaacagcatgtcaaaatctacttccctaataaagaattactgctttaaaaactcaggcaacaaaaatacaaaaaacaaaaacaaatagaag

SEQ ID NO: 186626 - DNA, 204 bp, Homo sapiens
gctcagcagactgtggagtttctgttcttggttatggtcgggggggggcggtctcagaaatcttattcaaaattttgctttcctcccccactggttgtccttttcatagacatctcacccatgatagcagggaaatgaaacaagctgcatagaccacagagctcagagcctggcctttaggaagccctcagtaagggttcaggc

SEQ ID NO: 186627 - DNA, 153 bp, Homo sapiens
aagcttgaaagaagacagaattccatctggccttggtaccacgtttctcctaacatgaggggctagtgaccagacacgatagggcagtgattgctttgtcactgccttccctccccatgccctgccatttttatttttgatcttctcagaatc

SEQ ID NO: 186628 - DNA, 345 bp, Homo sapiens
attctttcttgttgaaatgatattctttctcccttttgggtgaggcccaatagcctggacacacaataaaggccttatacttccatgggttcaaccacctttgtaggctgtgctaagagattttaagtgagggttgtctgcattagacagcttccctctggccaatgagagtagggggtgtagaggccgagaggtttctttggagttttcttctctctcttttcttctaagagttctttagatgcaaagtcagggcctctcttctttcttctgggccaggtaaagtgctgctgattaaagcctgccttggattgaatgagcttccttctcatggcttctctgttg

SEQ ID NO: 186629 - DNA, 467 bp, Homo sapiens
cttcaaaggaacatggatacaaatatgtaacacccaatcaaatgttactaactcaatcaccatgatcctgtgtgacagcaaatagtgaccaaatctaaagaattcccaaagttgtatttaaatatatttttctgaaggtttttaagcaagttacaaaacagccttacttcagttttactatttcccagtaaataaaaatgaaaataaataaatgggtaatagtaattaagcagaaaatgagaaacaaagtgataatcacaaaatgtaaaattggcaccaaaaatccaattaactaaagaccttaaaaatataaagtttcctacagattaattttttcactaaatgtataccaacattcactatcaatatttatatattttctttttttttttctttttttttttttttttgagacggagtctcactcttgtttcccaggctggagtgtaatggcaggatctcggctc

SEQ ID NO: 186630 - DNA, 169 bp, Homo sapiens
ggggtgttgactcttgtcctgctttctgctgacctttgacgggaatcccagagtgcctgggcccacggaagccgtttttgatggttgggtgcacttcatgcccttaggttcctcgcctttcttctagagccgtgacttttattataatcatcgtatgcaccagatttga

SEQ ID NO: 186631 - DNA, 157 bp, Homo sapiens
aaactttaaaattgactttcagatttctttagccctaactgaaaattagtgtgtttcaccacaactaaggtaaggcctttaacagtttgtcagacaataaaaccagaagattctgactatttctagtaaggtcagtagtctacttagtggtaatcta

SEQ ID NO: 186632 - DNA, 375 bp, Homo sapiens
caagagaaataacagtactaaggaattctactaatatacatcaggaacagttatgtccactgcatcctaaattctatatcaaaacaaaaagatgtcatcctaaaggaacagcattaatatctgtttgcaaaatggagagaccctgtatggattgttacgggcaatacaggttccctcctccttccctcctcccccacaccttctgttacaaatctactttgatctagatatttgtaaaataatcctacaatttcgctcctaacttagaatgtgtggaactggtcaatggtatcaatgaaggagaagtgtctacacttatttctcatgcactaaaatattgtgtgtgtgaaaatgtgcaggtactactatgttgag

SEQ ID NO: 186633 - DNA, 480 bp, Homo sapiens
attatagtaagctcaaatcttgaaggttcataatatacagataaaatgtgtccgtgagactgagaaaggatcctgaaagacagactttcaatgatttcctgcattttatttctgttgtactttatctttacctttattaaacactaataaggttcttcttatagggcctcacaggcctttttagttttccaacctattcatacttggtgcaaacctagtaattttttgcatgatagtattgggattttactctgaggctaggtttcaaaactgtaagaacagctttctggaattgtatcattttcagtctttccatgtgttccattgtcccagccacacacacaccagataacaaaacgaaaagcaacctcaaaaggtaacacacctatagtagatgtttttacctcttgtaaaatctaaggaaaatatactaaaaatgaaggcatcagtaaaatagtatcactttaggttgacctcgag

SEQ ID NO: 186634 - DNA, 403 bp, Homo sapiens
ggtcaccgttctccccgttgatatatattccatttttttttcacgaaacacataatcttgattttcatagctgtagagtaattctggaaataggtagtgaattcattcaccattattcttttataatattgctattttattattctcgatcattacattaccttataaatggtagaatcagcttgtaaatttctaccaatatgccggttggaatttttattagaattgcattggatctggagatcaatttacgaagaactgactttttaaacataacaactcttctgatccatgacaaggtttatctccccactaatttagttctttcataatttctcaaagcaattttttgtagtttttggtgtactggcctactggccttacataaattttgttgactttc

SEQ ID NO: 186635 - DNA, 307 bp, Homo sapiens
ctctgctgatatttattaagctttaaaataatcgtactataatcttgaaacactgatttgtaaaaactaagaatgagtaggaatacaagagatctggaggaacaaatcagattgttattagggtttgactttttttttacatgggcttatggaagcaaggcattctagggtctagagggatgtgtgtgtgtgcttgtgtgtccatgtgtgcgcatgcgcacgtgtgtatctgtttgagacatactttctctgttcacttaaaagagctcatgttttcatttgtttattcttttctttcagggtattt

SEQ ID NO: 186636 - DNA, 432 bp, Homo sapiens
ccagtgtcactggcagagagtgagtggagaagggtggagttgagggccaggttgcagagcactcacggcactgggaggaccctgctttgggcaagttgggggggctgtctttaggaagcaaagggccagggccagctgacattcggtgggctctgcctggctgccacatcatcggtttgctgtggggagttgtgcctgtacatatacttgcaaaccaaatgtgttgatttttttatcgtgatttcagggccttcactttctcatgcctgagcatcagtcagtttgtctccgctctgatctcctgtccaccccacccaccgtgcttttacctgggtcctgtacaggcctgtgggctggcccttaagaggttttcaatgaatgcttgtcacctaaatcaatgaattgtttggatccattctccatctcccagct

SEQ ID NO: 186637 - DNA, 726 bp, Homo sapiens
gtgtctttgtatatgaaattaagttcaggttcccaagaaaagatcatcctggatttagggtgggacctaaatctagtgactggtgtcttaataaaagagaaggagatatgacataaacagagaagagacacaggcaagaatgccatgtgaagatgaaggcaaagatttcagtgatgtatctccaagccaatggagcaacaactaccaacagctaccagaagttaggaaagaatcatggaatgaactttcccccagagcctccagaagaaactaatcctgccaacacctggatttcaaacttctggcctccagaactgtgacagaatacatgtttgctgttttaagccatcaaatcttggcaatgtgttacacaaggtctaagaaactaatacaggcctttacttcacactatatacaaaaataagctcaaaatggaagaaagatctaaatgttagtggtgaaattacaaaattcttggaggaaaacctaggtgataaatctttatgaactggccgggtgcggtggctcatgcctgtaatcccagcactttgggaggccgaggcaggtggatcacaaggtcaggagtttgagaccagcctgaccaacatggtgaaactccgtctctactaaaaatataaaaattagccgggtgtggtggtgcacacctataatcccagctactcagaaggctgaggcaggagaatggcttgaacccaggaggcagag

SEQ ID NO: 186638 - DNA, 483 bp, Homo sapiens
tgtattatatgttgcattttatgtacatgtgggtaatatacgtacacatattagtgagtactcatatatgtaaaacacccctacctgacccaataaaagcatacaataaaatgttagctactgttgttgctgttgtcgggcttgttaatatcatccaaatgcctttctctgagctttatgcttccttacacatggaaataatttcttcccttatcttatttatgaatcttggcacaacagaatacactttctctctgaaaactaaactgtggtttacagctaccaaaaaaaaatgtaatacagttcataaactctatgtaaacagtttatagactgaacagaggaggtaagattgaacagaggaggtaaaaaggttaaaatctaggtatattaagacaaagaaactgcttatatgataactttggaaaaagaaacatccactctctaagtatggtggtagagcctgcaacaccaaatccagcc

SEQ ID NO: 186639 - DNA, 251 bp, Homo sapiens
ctgaagtccttccaaagacctttatgggatgggcctggacacctctccaaccttacctcctgccatcctcctcctgttattccactccagccatgctcgcctccttgcagcttctggaccacaccaggcactctctacctcaggaattttgtcctactgttgtctttatatcgatacctgcatggtgcaggcatctgctgaaatgcctactcagcagagatttttctgaccatcttatctgaaataatagc

SEQ ID NO: 186640 - DNA, 219 bp, Homo sapiens
gggcctgcgctttgtggaggcccccagggcacagcatccttgagcacccaaaatccctcatgcttgctgaagaggcccagtttgcagcaacagaggtcaaaacaaaaaaaattctggtgagctttggctcaacaagaactggacgtgaggttgacgtgtgtctggtctctctggccctgaggctggggttggtgtgcctttggcctctctgctccttgg

SEQ ID NO: 186641 - DNA, 130 bp, Homo sapiens
cttgacattctttgtagcctctcccgctctggttcagggcccagctagggatccagatctgggtgatttaggctccctctgtctggatcagtcctccttttcccttggaccccagggaggccgggaatgg

SEQ ID NO: 186642 - DNA, 529 bp, Homo sapiens
caggcagtgcgtctataatggcaaataataaaggaaataaagccgatgcccaaaaatgggagattagttaaatgaagtatatgatacatcttttttgttgggttgtttgttttgagacagggtctggctctgttgcccaggctggagtacagtggtatgttctcagctcactgcaacctctgcatcccaggttcaagcagttctcctgccccagcccacaagtagctgggattacaggtgcccgccactatgcccggctaattttttgtatttttagtagagacggggtttcaccatgttggccagactggtcttgaactcctgacctcaagtgatctgcctgtctcagcctcccaaagtgctgggattacaggcgtgagccaccgcgcccagctagtagtaccaatttatattctccctatccgtttactatgagaatgcctatgtttgtaaagcctcggtattattatttttgtctgtttaatggttatggaaacaccatcttattttacatttgcatttctttgat

SEQ ID NO: 186643 - DNA, 917 bp, Homo sapiens
cattaagctgattttccccctggcagctgacaaataagttcattgttcttgtagaagtgagctcacaaggttaaatgtgaatgttctcaaaggtacacagccttgtttcagaagaattttaatgcccgctgtaaaatcaatcatgcagagccaatttgaggtatgactccagggtatgcaaggtatgacttctctggaagccaagtcttttcacagggcactgtggtaatacccatagcactaatcctcagtgtgctggttgaagaaataaaatgtttttaaagaaggataaaggaggaattaattagaaaatttttttccacatattagcaaataaatgaaatgtcattttcatattaagtaagtatagttatgatcttcgtttctacctactctccttttgaaatattctttattactaaataatattttaggaggagttaacagaaataattacctgtaacatctgcagataaacttacatagctaacattgtgtgctgacttttttaaatggtgaagtggcattaatgagatgttcagtttacagaatttgaagtttgagttctattttaatagtctgccgtgtcccccaaatcccatttagataaattgaggttgatttttcacatagacttgcaatttttagacaccacattttttttatagtaacagcctcatttgcctgtacaataactaataatacagtatttcataggtacattgtatgtgcacaggaaatttttctttaaatcttaagagcctttaataaacgggatattttaatattttaatgttactacatttaaaaaatagtgttttcctacaaaattttctgtattcagtatacgttaactatgaaaatgtcaaacaatgaaatcattgaaatatatttaaggaaaaattaccaaccaaaag

SEQ ID NO: 186644 - DNA, 196 bp, Homo sapiens
ttagaggatccctgaacacccgcttaccatgtaggtacaagtaagactaaatgtgggagttggtggctgaaggaggtagaagacaagatcattggtgaagaggaggtcagtgacttgatgattcaagtataggaaaggttatctgtatgggtattgaaatcattaagaatgatgacaggaaaagtattggagagtg

SEQ ID NO: 186645 - DNA, 425 bp, Homo sapiens
ctgaaagctacaaattcaaaaactcaattcatcctgaatattttaagtttggcttacagttcttgtttttctatttataagacctgcaaatcttaagagtcacctttttagagcttttggataccataaatttagttctttaaataacttcaaacatttaaaattgcaataagaagtggaatacactcaaatttctcctgcggcatttcagctgtctaatgagaaaaccctccttagcactaattaatctttaaaaatctaataatttaacttaaatcttaagaaatctaataatttaacttagaaatgcaatgagctcaaagtctcttaaatatgccaataccgtgtataaacgcactaagatttccatgtaatattacaagatgattttgattagttagttccacattttatattggatttgt

SEQ ID NO: 186646 - DNA, 336 bp, Homo sapiens
tctggagaggtgaggtgggaggagggagccccttcccgcgcagagctcagcccgtcctatgagcatagccggtcctcttcagatccggggactcagggtccagcacatcttgccccacagcctgggacagggtcagggctgaagttgctgcacccggggacctagggcctcatttaactcaccccattcccaaagggagaagccttgttccagtgcccccagccctgggagcctggtgttctgtgagctcaggagggccagcgttctgactgggaggcaggactggactcttaggctgagcaggactaagttctgtggccaaggagcccgggcgtt

SEQ ID NO: 186647 - DNA, 333 bp, Homo sapiens
ttttccactgacaagtgtggggatggtttggagacgaaacggttccatctcagatcatcagtattagattctcataagcggggcataacctagatccttcgcatgcgcagttcacgacaggattccactcctatgagaatctaatgccaccactgatctgacaggaggcggggctcacacagcaatgatatgacagggggcggagctcacacagcaatgatatgacagggggcggagctcacacagtaatgatctgacagggggcggagctcacacagtaatgatatgacgggggcggagctcacacagtaatgctctggcagggggcagagc

SEQ ID NO: 186648 - DNA, 593 bp, Homo sapiens
gtgtactgacagtgtcctggagagaaagcaaagaaacccactgtgtgttttcctcacttgctgtcaggtttgttttctttccacattgatgttgattatggtcaaataggaaagtgctgttgccacatttgctttccagtgttttaacacttgctaacttagatggttctgagttctctagctttgttagcgaaagattggttcatcattgggttcagattctttggtaaacaaattccttagaaaatatcctcctggcagtattttccacaaggttaaatcgtcttaagcacactgagaactgtgttagcagtgggcctcagtttccttaggatgtctctttgtctacctggccccccatcccagtccgtcttccgcacagctgccagaatctcctcctttgctttaacatcctctaagcaaaatgctgcagcactcagggcaagcttcttccctttgtcattagacccttcctgttctctagccttccctgttccctccagtccctctcacattccctgccatattgaattagttgctttccctgctattttgtgcttatgtgactttttatacatggggcttcctctgcc

SEQ ID NO: 186649 - DNA, 564 bp, Homo sapiens
actgattgcataggttgtcctgaggtataaattatgtattagtatctaaagcacttgtaatagtgcctggtacatagtgagcactcaataaatatttgcttttttcactatagttatttgtttattgtctctagcctttcaccaaatacatgctctataaggatagagccttagtctggttcattactgagtgaccagcaactaaaatagtgtcaaacataggctgggtgccatggctcatgcctgtaatcgcagcactttgggaggccgaggcaggcggatcacgaggtcaggagttcaagaccagcctgatcaacatggtgaaaccccgtctctcctaaaaatacaaaaattagctgggtgtggtggcacacacctgtaatcccagccactcgggaggctgaggcagtaggatcacttgaacctgggaggcagagtttgcagtgagacgagattgcaccactgcattccagcctgggtgatagagcaagactccgtcttaaataataataataataataataataataataataataataatgtcgaacaccttatatatat

SEQ ID NO: 186650 - DNA, 297 bp, Homo sapiens
ggccgtggtcgtgcttctctcccattgccacagctgggcagcacatcacaccccgcagagcaacacctaagatcctggcatggtccccagggactggggttcggcctaccccacctcatcctatattctggcctcacaagcaccttaattcttcccacaatactatacaggaggcacctctctctatgctgctccctctgtgcagagtgtgcttcctcccccttccggtctatcaaatgttgctcatcctttaagtcccagctctgttcctttttcgggaagccttcccagagttcc

SEQ ID NO: 186651 - DNA, 394 bp, Homo sapiens
ctggaaagtctggtagagctcctcgggctcctttcttttctacccgcaaaacaatcttctgggcacaatcttaggagctgaatgctttgccgctgaataacatacgctctcaataggcttcgactgcagtctctgtcactttgctctctgcctggctcctggccaatgcaaaacatacagaagggggctttctcccccactgcccccttgtttagacggatctataccttcacttatccttggggcatgtggcccaagttcaaagctgaacaccaacaccacctgctcctcctcttccttcagggagagtgattgaactgcacgcctaatgcaaactaaagggggagttttcagggctcgtgagaaatccttggctatttgcatgcagttagaa

SEQ ID NO: 186652 - DNA, 438 bp, Homo sapiens
tccaagaggaaactccaaaacggctgctcagcaaaacggcagtggaggccaaatgagaaaggttgaaagggctcctttcttttctacccgcaaaacaatcttctgggcacaatcttaggagctgaatgctttgccgctgaataacatacgctctcaataggcttcgactgcagtctctgtcactttgctctctgcctggctcctggccaatgcaaaacatacagaagggggctttctcccccactgcccccttgtttagacggatctataccttcacttatccttggggcatgtggcccaagttcaaagctgaacaccaacaccacctgctcctcctcttccttcagggagagtgattgaactgcacgcctaatgcaaactaaagggggagttttcagggctcgtgagaaatccttggctatttgcatgcagttagaa

SEQ ID NO: 186653 - DNA, 589 bp, Homo sapiens
tgagacagagatctcggccctcacagagctgacatcctaaccagagagttggacaaaaatcacgataaatgagttggttaaatagcgatttgtgagtagaaaacgcagggacggtgagagagcagtttcaattttcagggggatctcactgagagggcaacatttgatctgaaggaggtggggaaggagccaagtgggcagacatctgggggaagagcattccaggcagaggaacagccagtgcaaaggccctgagacagaaatgtgcctggccggctgggtacagtaactcacatctgtagtcccagcactttgggaggccgaggcgggcagatcacttgagcccaggagtttgagaccagcctgggcaacacagcgaaaccctttctctaccaaaaatatgaaatttagctgggcatggtggtgtgtgcctgtagtcccagctgctcaggaggctgaggcgggaggatggcttgagcccaggaggttgaggctgcagtgagccatgattgcgccactgcaccccagcctgggcaacagagcaagaccctgtctcaaaaaatatatataaataaaaaagttttaaaaa

SEQ ID NO: 186654 - DNA, 288 bp, Homo sapiens
ataagggaatcaaataactgctacttcaatgtgtttcctgctcagccacacctggagtggctgtacagcagcgaccaagtgcaccaggcatcagtatgcctgggctcaactcctagttctggctcccaccatgtgtccctggggcaaggcgagctaatgtgtgtttcagtctcttcatctgtaacatggaaatgccatgtgtctgcttaatagggctgctggaaactttacatgagataaggcataaattactaattacagcgcctggcatatagtgagtgctcaata

SEQ ID NO: 186655 - DNA, 412 bp, Homo sapiens
ggacaaaagggacaacttaagactaacatacaaaatccacaaggtatcaactgcggtgagggaaagggagagttctcagcaagtctacgtagcaggcttctgtcagttcagccaactctgtgtgtgatgaactatttcagttatttccaaactgtaactgtattctttaatttttaaaataggtaatacagtcatatgtttcaatattcaaaacgtacaaaacaaggatagacccaaacatctcccaccttccttttccagccattgaattcctctccctggaagtttgatcttagcagtttcttagacctcctttcagaaatacattaggtttagataaagcacatgcatatacagtttccccatatgctcttttatttttaaacacagatggcaatacatactacatacc

SEQ ID NO: 186656 - DNA, 675 bp, Homo sapiens
agcagccaatgtttactgagcacctactatgggctggtgctgtccttggtgctggagtcacagtggcaaaaaccggagctcactgtctgatggggaaggcagatagatacggatcaatcacgctggagtgcatgtgggggaacgtgtgctccgaggcagggaactgctatgggaatgcagagaacagaaggcactgagctgagctcacactgggaggaggtgattcctgaggtcttcctggaggcagcaatgtttcagctgaaattggcagaatgaaaccaacctggcgacatctcagaaacctattctggagcagaaaaggcattttgcaggagtatacccacagcttgacgctgtttgtttaaggttacattcctgccaaacagtgctaatgagagtgcgagcaaacaggtcctttcatacacggctggggcaagtagaacctggaacattcttaccgagccagcaattccaggaatttattcttcagaggcatctactcggaactgcacaaaataatgtctgcaccaggttaatcattgcagtactgcacatcactgcaaacagctgaaaccaatctaaacacccatctgtaggagagctgagtaataaatcatgactgatccacccagtggaatactaggtgtccatagaaaagaacaaagaagctcaccg

SEQ ID NO: 186657 - DNA, 496 bp, Homo sapiens
ctccaagtacgaagttgaatagttgtggtgaaagtagatatccctgtcgtcttcttgatctcagagataacatgacttagcctttcaccatatgtataatgctagctgtaggatttttgcagatgccctttatcagcttgagaaaattcccttcctctatttctagtttgctgagattattttttttatcaggaatagatgctggtttttttccccttttcatcaattgacatgtactttttcaatatagtgaattatactgattaactttgtaatgttatactagctctgcattctaggaataaatcccacttggtctactattcaatttgctaaaatagagaaattctgcatctatgttcgtgagacatattagtctgtaggttttattttattgtaatacctttgtctgatttggcgatgattataattctgacctcacagaatgagttaagaatgatttctcttaaattttctggaaaggtttacatagaaa

SEQ ID NO: 186658 - DNA, 458 bp, Homo sapiens
tggcttcctgctgagcaatatctgcttctctttctgactcaggctgatgcatctgtatacttagcttcacttctccagtaaataagggagagctttattataaaagacaacttctattgattttcaagggggtgggtggttgtcaagctcactcctttctatgctctgagggaaaattattgtaagcgatctgtaaaacaatagatgaaaaaagaggagataaaaattaaataaaatttaaataaaaactaggatcctaagtgggaaaatagctttaaattagaaattgataccaaaaaataatgatatgtaatctaagatgaaaatattttgaagactatcagcatatctcccttaaatgttatttagttctgaaaaatatgtattgaagaactgttatattttactttatgtcttatattaaatgtgctaaaattaaaaagaaacaagtagataaa

SEQ ID NO: 186659 - DNA, 304 bp, Homo sapiens
ctaggtgttcccccaggcctctgagatgggactgagggaggggagccgatcacctgatacctactactataggaaggcattttagacaaaaacagaggactatgccagcaaagacagagtggggtccttgtagtatcagcatcagaaaacagcacaggtctgagaattatttaaactctgccttagatattcctgagttcatatccatgaaattgtggctttatttacctttcctttcattttcatgcttttaaaaattatagtaacttctctgtcttaacaaataagcttcatttaactatag

SEQ ID NO: 186660 - DNA, 402 bp, Homo sapiens
ccgttccacaggaatggatgagagggtccctctctggttctgccacagctgccttgagcagcagcagttccccagccccaagctgtcaccgcaaacagcagcatcaacctgtgatgacagactttagagtctgccatcccagaagtgataaaaaatgacccactggctgcatagcccaagtcagaggatgtgccaccctccttccctggtgcctcctgccccattcaccaacccccgcctcacacggccatgtggtccacagtaaccaacaagcaggccaaataaatgaaaccagccgtgagacctgtgggagctcactccaccttgaggacatttatacattcttctgggccaggcacagtggctcatacctataatcctagcactttgggaggctgaggc

SEQ ID NO: 186661 - DNA, 333 bp, Homo sapiens
actccctcttttgaagttattgagtcacgggaaggaccctgtggtgtatgttgtaaatttcctctgccgagcttggtgcgacctagtatttgcctgaatggagcaggcaagagtggtggggtgaggagattccatcgtggctgctcatgcattagtcattgcttcaccttagggagagacccagaaccctaatgtttagtgttgggatctcttgttaactatattcctctttttttttttttttttttggtaagacagtcttgctctgtcgccaggctggagtgcagtggcatgatctcgtctcactgcaccctccgccctcccgagttcaag

SEQ ID NO: 186662 - DNA, 634 bp, Homo sapiens
ttcccgtgctgggccctcctgggcgggttctctcttgctgccgccagtaccctgcccctctcgtcctcctgggtagcctgggaggaatggcagaagaaagcagtgaagccaggtagcagtagcccggccaccccaccaggctctgctgtaggctgggctctcaaggcagctgctccaggaggggccccctaggaagggactgccacactcctgggagcgttcctggccccctccagtgcaaatgaccctgggccccaaggctccgaacacccgcccctctgctccaggttaaaatctggattgaaaaagcaagtggggtttgttggcctctcaaaaagtggagcataggccgggtgcggtggctcacgcctgtaacgccagcactttgggaggtcaaggtgggcggatcacctgaggtcagaagtttgagaccagcctggccaacatggtgaaaccccatctccactaaaaagacaaaagttagccaggcgtggtggtgaacacctgtaatcccagctacttgggaggctgaggcaggagaatcgcttgaacccgggaggtggaggttgcagggagccaagatcgcaccactgcactccagcctgggtgagagagcaagactctgtctcaagaa

SEQ ID NO: 186663 - DNA, 370 bp, Homo sapiens
tcctccttccacagattgttctagaactgccaagactgtgggcaccctgctcctttctcctcatcttgccagccctgtagggaggggcaggataggttgcagtccatccttcagccccttgggggatgtctttctcaaatgtacaacagagacggggcagtcacagctaatgtgccacgcactcgcttggtgcccagctctctgctgaaggcattccgtgtttgtcctctgcctccaggtctcatgtcctggatgaggatgatactgggggtctgtggtgcctgcgtgtgctggggtgtggaggttgtagtgtgtgtgtgttgctggagtgagctgtttgtgtgtttatgtgtgtgtcttgcccgagcgt

SEQ ID NO: 186664 - DNA, 503 bp, Homo sapiens
accaacgagggtgggtgctgaaaggcagaggttgtgttctctctattcccagggtgcctgcggagccgcagaacctggcatctggtttctggaattcagccatgcccttggtttcctgcctcccatgtcagccctccagtgccacaaagaccatctcactttgagcctccatagacttccttctttccatccatccactcgtgtttgctgagcaccccttttatgccaggggttgttctggcactaggggtacagtagtgaacagacacggaaggacagagatgccgtttgtggaggtgaggcaagctgcaggaagagctctgttctggcgagttaaatttgagatgctgatttgatatccagtaaagacatcaagtaggcaggtctgaactacagacataccatgggagttgttgccatttagagggtctttaaagccaccagactggctgaaatcatctagggaatgaatggagaagaggccgaaggactgggccctgaga

SEQ ID NO: 186665 - DNA, 404 bp, Homo sapiens
aaaaaaaaaaaccctcatctgatttgcacttctatctctgacttaaggttgatccaaatagggcatcaaaaaacatggaagacataccctcagcctttgcacttacaggagaatttattacagattgtttcattaaggtattggaacttatacctctgtaaagaaaaaaaaaaaaaaagcaaacatttactgaccatatccaaatatggcatgtccaatataaaagtgaaaagcaatggctctggggctttcctgcaaagaggtactttatatacattttcttcgtttcaccaacatatgttctcactctctcccttttaaacttaggacttctaagtatattgtataaataaatatcgaatttcctttccagggacattgaaaatgccaccagtcccactacc

SEQ ID NO: 186666 - DNA, 651 bp, Homo sapiens
tctgaatctgaccactctaaggacctcatataagtggaatcatatatagtgtttgcccttcagtgactggtttattcacttagcacagttttcagggttcatccatgttgtagcatgtgtcagagtttccatcccttttaaggctgaatatttaacattctgttgtgttcatatactatattttgttaatccattcctctgacaatggacacttggattgcttccatctttttgctgttgtgaagattgctgctgtgaacatgggtgtgcaattatctctttgagactcaatgtaagacttttctgatgaagatccatcccgtggagtgaagctagagaggctgtcagggatgggcttttctatctccatgtggagaagttgtcgatgtaaggatcagttggagaagagcaaggcaaaccaagagacacacatgaaggaaatggcattcatccagacagaagcgccaactcaccagagagctgggaagacagtgaggtggaggaaaagagttttgtgtgtcttgtcttcctactcacatactcaatgtgttcacagattggagcataacttaaacagttatcagaaaagtaaagagtgagaagccatgtagaaataatgagagtgagaaacctctcagagcattcacttta

SEQ ID NO: 186667 - DNA, 341 bp, Homo sapiens
cactactaaaagtatagctacatttttctaatctgaccacttacttatattttgcataacggtctatttgaattcacataccatagtttaaaaaattaatgattaaatacagaaaataaacttattaactaatgcaatccattgtattttcaaagtctatttctggaagcttctcccaaaacattttgaagtgtaacaggcaatgtttaatcatcccccattctccccttcttcagtagacccaaattttcagccaaatagtcacctatcaaagaccacatatcccagactcctttgtatctaaacatggccacatgactaagttatgaccaatagggtat

SEQ ID NO: 186668 - DNA, 323 bp, Homo sapiens
ggctgcttgtcagggaaaaaccaaacttctctactgatttgggatttttttttaccataaattcagggtgcagttgttcttgaagtggttccattttgtgattaggctgagtatttttaagcacaactctctcccttgtccttagaattatctccagtatcctcaaaacaaagagcaaatgatgcaattaggatgcaatcccttgcctgtggatttcaaggaaaattattttccacactacttggaagctcatggacaaagtcaagctttctttagatctggtgaacttagaaaaaataacttgatgaagtgagattcttacc

SEQ ID NO: 186669 - DNA, 175 bp, Homo sapiens
gtactgacgagtgttactgaatttttctgtaggtaatatcacaatggagacggggtggacagaagtgttccttgtgtccatggcttgccttagttgtggcagcaatctagaattgctaaatagaaacactgaatcaaagaacctagacctggctgggcgctgtggcttatgcctg

SEQ ID NO: 186670 - DNA, 403 bp, Homo sapiens
caacatttattgagtttatttatttatagactttctacatgttattgacgtagaagtagaaagtatgggaaatcaagggccagattttatctgacccgtgttttatcagacctagaagctagcaataaaagtccaaagagtaacagtttacaacttcccacagtttaaagtaacttcttcagtgaatcgtctgtcttctgcgcttgtcacagttttaatgtcttaggtgatgagtagtagtagcagccagtcctaacagcagggcattttaggacattcaacacactgtatggaggaggttctaaataaatgactactgaactgagctttagaatttataaataaatgtcattattattgctttcaagtacacaacgtaaccaggattaggctaagaaaatac

SEQ ID NO: 186671 - DNA, 328 bp, Homo sapiens
tcaatccccaagcacatctagtttttaaagtgaagtacagcaaatataaataactggaaaatttccccccttttattaatctttcaaagaccagagcatgtcaatgctttagaatcattacaattccattaaaaagccgtaagacaaaaatgaaagtttcacattactgattttccacatccacacaatgaaaagtatcaatgcacatggttaggtttcaagaatactacagagcagtatagggtagctcttcgcagtattctaatttctctgcttctaaatctaagggcatattatttcccttcatccaaaagaacaagagggcact

SEQ ID NO: 186672 - DNA, 536 bp, Homo sapiens
cctacatatgtaaacaatttttaaataattttgaaaaaaaaatgtccatgggacatcagcataatttatttttgtgctgctgacattttggtcatgtagtaatcaagctgttaataactagtcacatttattgcatcattctcttagtaaaaagctatttttaaagcaaattaatacctcctttggagttatagtttctaaagaaggatcaaggatgaacatttaaaatggaaaacagcagggtgaaataaaccatgaacagaacgttcaaattagttgtgatctcaacatggattctttgattatggagagagaaaaaagcattttttaaaaggacaagctgtctttaaacatgtacattgggaagataccaaaagctactgaaaaaatgacactgtcaagatgaaagtgatttaaaatcctctatctgttattgcataatagactagaggtagcagtcaaatatgctcttctaaccaggcagcatccgggttcatcagcctgtgagagaaccatcctcaactccgtgcttcctc

SEQ ID NO: 186673 - DNA, 293 bp, Homo sapiens
gtcagtcaatgacatcatttcttgtgtggattttttcactagaataggtaaaatacttatctgaggtgctttcaaccagatggcttagtttctaattaaggtataaagactattattttacttgcacgcaaagtatttctttactcgctttattactttactcacacacaaagtatttcatgatttgaccttataaaataaggatttatatacttacctctaccctccccaaatttaaagataaacaaacacaaacacagaaaggttaaatattttgttccaagtttacagac

SEQ ID NO: 186674 - DNA, 359 bp, Homo sapiens
agactgacaaggtccagctctaaacaaaacttcccttcaacactgcgcccgggccttctctttctcttgtctctctcagactaagttatagtctccacagcttcagcgacagcacttaggagcgtcttgaaggctggtgccttcccttccacttcctcgtacctacacccacttccccacctatccaagtccgcgtgaagatgccactgtttcctgccaattggatttcttttttacgtccttcaggagactagtgcgttttccttacatttcaattctgatgaagtttcttattatgtgttcaatatctggtttccccattagactataaacttcttggttgcaggaattatgttgtg

SEQ ID NO: 186675 - DNA, 295 bp, Homo sapiens
cagaaagggaaagcagtcaggggagagcaggcggctttgctggaagggattctaccatgtgttctcttgtggccacacagattagaatctgtgctttcttcctgaactctccttgctttgttggaaagtatccttctttctgctgctttttgttactggcctgtccgggcccagaaccacccagtgtgcagtgctttgggtccatctgtggtcttcctcctcctcttctctccccttggctccagatgagaggtctgttgtggggagagagcctttttggagatgggctttctca

SEQ ID NO: 186676 - DNA, 649 bp, Homo sapiens
gacagagagagtgctttgaatgtgtgcacagtgaaaaaccatggaaagccatagcaaggttactgggagagtagatgctaagctccctggtactggcagtgaggagaggacacaggttcacagtgcctgtgtctagctcctcctgttggcatggctggtcacatctgggtgtacttcaaaaaaccttgtcagtctgatgaaaaactgcaatggcaaagccctagggaaagagaatacaactgccctatctccaatacctcttgtttatactcctccctttcattctatgcctttgaaaactacaaagacagcattatctagaggttctactctacaattgtccccatctcctcttgtcttgtttctatgctacattaacctaaactgctattgcagtattccaaatgctgtatctcagaatccaaattttcagcttgctgttcattaatggtctataagaacaagtgccattattgccccagtcccccatgccacaatggagttgggaatagttatcacctcagctgtacaatgcagaggatgactcctttattacaaagaaccaaacaaagatctatgaggggggccttcctttcatagaatgaaacatgttttgtagtccagtcactgacatttcaaagaactcaaa

SEQ ID NO: 186677 - DNA, 486 bp, Homo sapiens
tgagacagagtctcgctctgttgccaggctggagcgcagtggtgcgatctcggctcactgcagcctccgccttctgatttcaagcaattctcctgccgcagcctcccgagtagctgggactacagacgcgcgccatcatgccccgctaatttttatatttttagtagagatggggtttcaccatgttggccaggttggtctcgatctcttgacctcgtgatccacccgccttggcctcccaaagtgctgggattacgggcgtaagccaccacacctggcttgatcgcagtttcttaataccatttctgtgccattttcgggaatgttgtgtgtggtgtggttcttggacttggccatgtctgcaccctaagccatggctcctgaagcacctagaaccggaagctatattcagcaatttttaagttgaatttctgttaatacctttagatttaagaatattttttaaatataaaacttagtgggata

SEQ ID NO: 186678 - DNA, 665 bp, Homo sapiens
gatgaccccaagaagagagggtggccaagcaggcttagtacgacatgcattaataaaggccacattgcagggatgatgaaatgagaatattaaatccaatggaggtccattttgctcactatggtaaacacagaaattcatcctggtatctagaacagagtaaatcctcaataaacacttgttgaatgaacaaaggaacaaaccaatgaattaatgaaacatctttaccttgtgtctcatttcttatcacttatcatttcaatatgtgcaagaactcagagtacatttttcattttgtgtatgtgaaacttaccaacaaaatagtagctaaaaagttgtaaaacttacaagttttcaacaacaaagttgaaatgtaaatgaacatctgtgctccccgaaatacataataggcaagtagagaaatctagaaaggaaaggccacaggctgagggagttaacagatgcgatagtctattaacattaattttctgaagtgtatatttcagaaatttgctcagcctcgctgagtctcagtttcctcaactgtatactgaagacaatttctttatttaccaacctgaaatattcatagtgagtctaagatggaagaacagatgagtaaatactttaaaagtgtaataagaggccaggcgttgtggctcaca

SEQ ID NO: 186679 - DNA, 485 bp, Homo sapiens
gatgccatcatttggtagtaccctcattttatacttggataggatcccatgtaggattccaatattttacccttcaggccccaattaactgatttatactctacagacgactaaaatacaataattcagctgcaaatcacttccaatttaattcagtgagttatttaccatttaagttagaccactgtcagtcctctctcgaaccctccaatggcttaccatcccactccaggtaaaagccacacctggctcacctctttcaggccctgacttaaatgttactttctcagccttcccaactctgtaactgcaacagctccccttccacctcccaccctcatatttctctattgcttctctgctttttttttttttttttgagaaggagtctcactctatcgcccaggctggagtgctgcggtgcaatcttggctcactgccacctccaactccctggttcaagcgattctcctacctcagcctcc

SEQ ID NO: 186680 - DNA, 284 bp, Homo sapiens
tgacttatttaatctacctagtgactctctgaaggacacaacaggttatcactgccattttacagaggaggaaactcaggccctgagaagtaaatttccccagtgtgacacagttaagggacggaagtggtgttcaaattcaggcaatacagctccagaatccatcctcctaccctctgcacttgctttctctctagatggataagtgccattctctttgtgaaggtggcatctgtcctcagtctcactcaaggatggtctcctatttcccacagttgtgaaag

SEQ ID NO: 186681 - DNA, 349 bp, Homo sapiens
ggccgtgcattcaaacaatatcaatcggccctcagagaaagcacacaatggtcaaggtggcatttcaataaagcagacagctgccttctggcctgcatgtcagcctccctgcagcctggagagtcacttctctctctgtgggaaagcctgctggaggcatattggctacaagatgaggtttctttttccattttcttcttcttttttgcaaaaatcagcttgaagctcgttaatgtcaggaatgagagtgaagcgctcttacgaaatatgaaaggtggggtgcaggccagggaaaggactaagagggtggaggtgttggaaaggtgggataaaagcatggtggagggga

SEQ ID NO: 186682 - DNA, 176 bp, Homo sapiens
atcgagggggaaagcggagacagcaatggacaggaaacccaaagatggtgaaaaacagatacagcggaagtgactcaagtggctggaagtggaagagattgtggctggggacatcaaaggaggtgcagatgctgttgataaggttcccagtgtggccccggagtgggaggctgatg

SEQ ID NO: 186683 - DNA, 396 bp, Homo sapiens
cagttttccatccatggataattagtgctcttgtgaatgtgagggtaggaacatccttgcaaacgtcttttcctgtttacatgcaggagatgcttggcttatatttagagctagaatttctgggttattgggtttgtgaaagggctactccaaaaagataaatcctgaaataagccctgctgagataatccactttgaagataaagggggtgggggaacccataattatccttgtactgatacacagtcttaattactgtagctttataataagtctttatatctgatgggacaaaccggtcctccttgttcttgctcttcagaagctggctatttcaggaggttctttccttttccagagccattttagaataaacatttcagattttgctacaa

SEQ ID NO: 186684 - DNA, 631 bp, Homo sapiens
  misc_feature (29)..(29): n is a, c, g, or t
gtaccgcttgcgtctttctcctttctggntgttgaaacccccacaccaggaagtcctgctcctcgggctgctgactgctcctctcctcctccttttctcttcctcctcccatgagtgtgctcttgcatcgtggagtgacttggcaagaatgccctcaaatgcaggccccttgaacttgggctttcgcagcctccagacctgcaagaaataaatctctgttctttacttgtctcaggtattctgtcatagcagcacaaattggaatgaaacaggtatgtaggcatccttatatcttgctagctatatcttgctagttttggggatgtaaatcagtacaattttactgaaagaaacatgggatatcactgctacacaagcctaaaaatcctcgtattattgtatcagataattcctttgctctaaggaaatatacagaggtatgatatacaaatgtaggagtgaaagactattgcattactttttaaaatttttttatttttttatttttatttttattacttttttaaatagaaaaattgaacaaattaaatgcctagtactgtgggattatttaagtaaaacatgcaattactacttagcttttaaattgtggtaaaatatttatcatggg

SEQ ID NO: 186685 - DNA, 744 bp, Homo sapiens
aacagaagtctggcctgggctcctctcttgggtgaatttgcaatgccagatcctctctatcagtttggttttgtttcttgtatctctgggaaggcaggcagacagcacggtcacctgtgaatgcagctacaattggcttagctgcctcactgataaatgtgcccccagtaagctacaaagggattaccagcgttctcagcagctaaaggaactggtgaagatttccccagcaaaaagtagaagctcagtgtttcatagatgaagactggggagattgcaaaagacccatccaggtactgatgcggtcttctgggaccaggaaccctactcatgcctcaagctacctgtgatgaaaagtccattgtctgccacctgtctggtagatctgtcctgaggattaatgagataatgtctggagagccatgtgaagcctttggaaggagattacagataaaagtctagttccagtgaattaggctactgataagagtactgaataacaaagctgtgatcaggcttttaaaacgttattttgttgatatttggttacagctacttttagacactgaactagccagtggaacaagttctttctgaggtccctgaactttaaacagtcactctagaacagtctttctcaaagtctcaacccgaggagaattgtctatatcaccagtgtgtttgttaaaaatataatttcctggccttcaacttcagaactacaaatttgcaaaacttcaggaa

SEQ ID NO: 186686 - DNA, 375 bp, Homo sapiens
agaaaaaaatatcatgcatcacattaacagaataaaagaaaaccatattatctcaataactatagaaaaaaccctattaatactattaatatattcaacccctatttatatacactcggcaagcaaggaataaaagaaaatttgcttgatctgatggatatctatgaaaaactacaactaatatcttacttgatgtttaagcatgaataatttctcaagattaagaacaaagcaagaatattagctctcaacatttaacattttactgaacgttttacccaatgcaataaggcaagaaagaggtcagagatttcggaggaagaagataaattgtctttattcattgtcaacattattacaaactatacaataagg

SEQ ID NO: 186687 - DNA, 302 bp, Homo sapiens
gtgccatgttttccagggtggtcttgaacttccgagctcaagtgatccgcctgccttggcctcccaaagtgctgggagtgtaggcatgagccacctcgccagagtgctcagtgcttacctctttaacctcatttctaaccatggtctcccttgctcaccgtactccagccacagtgtcctttccgctggtccttgaacacatcgagttcatttcttccttaagacattttctccagatgtttttctctgctatggcttctttcctttcttttcattttttagtctctgtctaaatgcaatca

SEQ ID NO: 186688 - DNA, 1325 bp, Homo sapiens
gtttctaggaatttgtctgtttcatctaggttatccaattttttgacatatagctcttatactaattctcttacaatcctttttattcctataaatcagtagtagtgtctttcatttctgattttagtagttgagtattctttttccttaatctagttaaagctttgtcaactttgttgatctcttcaaagaactaattttttgtttcattgattctattgtttttctattctctatttcatttatttttgctctaatccttattatttccttcctctttatggcttcaaactcaattgaacataaagtattaagaaatttgacttttttctcaaatgtctaaaatgtaacaagaaatatgtctagagtcatcaaaaagcagcctgtttgtcagatttactgtttaatccatgtaaacagctttcatataattcatgatagaatattactatgtgctttggaagacactgaaggaaagacaaaaggtcattgggcagaaccaccctagattgactgttaaggccatcttctagtttgcaggacttgtggtagacagacagaataatatcctggacctcttgggtgtatacaggacaaactgaaataaactctcatttttagatcataatgtcatcatgaaacatatcaattcggtctaattctgaagaaaacaagcacaatgataaagtttgaatgtttgtctcctccaaatctcatgctgacatttgatccccaatgttggaggtggggcgcactgggaggtgttttcgttacgggggcagatccctcatgaatggcttggtgctgtcttcatgggattaagttctcactcctacttcctgtgagatcttattgttaaaaagaatctgataccttcctcccctctcttgctctcttcctccctgatcatgtgacacacgggttcccctttgccttccaccacgatggaggcttcctgaggccctcaacagaagcagatgctggcgccatgcttctcgtacagcctgcagaattgtgtgagccaaataaacctcttttccttatatattacccagcctcaggtatttgtttatagcaataaaaacagactgagacacatgatgaagaccctttgatatcctataaatattgatttctctccctgagagaagagcatgaatctaagtgatgccattactctaatgtgaattccacaactcttctcaaagatgtggcccatatgttcctaataatggctttctaagaatctgttctgaaggggtaccttctctctgattttcatttgcatttcctgcttagcttacacacttcaccttgcctatcca

SEQ ID NO: 186689 - DNA, 506 bp, Homo sapiens
taataaaaaaggtattctaaatcttaaaacaaggcaaaacaaatgtatttcctagaatgcaagtggtaactttagaatggggttggtattcattaattttcaaaccctagaagccttatctaataaatattaaaaagctatatgcaaatatttgcagtctataaatcacaacagcaaacgtgccaaaaaatgagctaagtgctctatgcaattgttacatttatttcttcaaaacttaaggcaagtattattattattataccattttacagctgaaggaactaaatttaggaaatctaaggaacattcctaaggtcacacagctattaggttgaaaaacaatggagtgtcagtaatcccttacggcttaacccaaaagtagggtgcacagccaggactccaaaccaggtctatgtaatatgaaaatcagtactcttaactacttctacagggcctcaccccaaaacataagagtgtatcatgtaaagcaaggaacaccaagccaa

SEQ ID NO: 186690 - DNA, 471 bp, Homo sapiens
aaccagaaaacaatgaagctgtttatctacaagagtaatgagagtatgatggaatggcaatggagtaggagggatatatatttcagggaagggagtgacactgctctgaatatatctttttctatagttttaactcttttggaagcacattcatgctctacatattttaaaaattagaagcaacaaaagaggaaggagaaaaagaaaacctaaaattgaaagcaaatggagacaaatcaactgtacttcaaacgaatattataaccacactaggagtggggaagggagctaatccaagtaccttatgaacacagtattgactatatactcccagtgttgcttggagatgacaagaggttgggaaggcaaagaattctgcaaacaaatcgtgacctcatttggtttgttttgatactggtttcagtgaagcaattccataacaatttattacaggattagcaaatgagaaaa

SEQ ID NO: 186691 - DNA, 428 bp, Homo sapiens
ggttccgcggccactgccctcctgcattagatggggcaccaattcctggttgaaacatggcagatgacaatttccaaaggctgtgaactttccaatagcagtaaactcctctgaagaggactgggatgtggaagtgggatccctgtgccgctggcagtgccggcagcaacccttctccggctcttactgagctagggaagctgttgctctgcgccttcttgtttagtttacaagatttaggacaagtgcctcggtttctgatgctgtcagagacttggtcaaggtgaaatctggtagctcagtttatagaactatgacgaggctagtgtggtggtgtgacattggtgaatgtttgtgagatggaaaagtactactagactttagcagagccagtggcataagaaacttaagtttaaggccaagtgctt

SEQ ID NO: 186692 - DNA, 403 bp, Homo sapiens
gagatttgggcggggacacaaatagaaaccttatcagtataggtaaagtatattatctacatataatcattttcaattcactgaattcgcgactgtccgttgataaggcattaaaagaactgactgtcgaaagtggtacatgtaaaagatattaatatactgtcgtgtactagatgtaaattcagcagttaagatctcgacattttcatatattccaaaatagttttaaatattttggtgttgcattgacccatgtcatttagctagtagacacatgtgcctttccattttcacagcaacatacgctttgtgtctgtaatgttcattgctttatatctgattttttcattggtttttcatactgtgtttggtttctacacatgagcacacagtgcctagaagg

SEQ ID NO: 186693 - DNA, 207 bp, Homo sapiens
cttagggaggaagcacgccaaagtaggcgcaccttcatacagtctcccaagcccgactgcctgcagattttctgtctgagccgccagaaacaaagatgacagccgaagggctgaaggtcactccagagtagggagagaggggtcttggtgggcccagatctcccagcaccaggcagtgggttctcacaccagccttggtctcctggg

SEQ ID NO: 186694 - DNA, 199 bp, Homo sapiens
agtgagaccagctacactccagcgggagcaagtccgaagacaacaggccaggagctctgcttaggagccacctagggcgtaaacccacgccaccccctgcccgcgcctcctctgtcctgcgaatgacactctggggcgccgtccagcaggtggctgcctctcaaccacctgtgcagtgagcacgagtgtgtgtggcgga

SEQ ID NO: 186695 - DNA, 591 bp, Homo sapiens
ggcatgagccacaacgcctggctaattttgtatttttagtagagatgaggtttctccatgttggtcaggctggtcttgaactcccaacctcaggtgatctgcccgcctcggccttccaaagtgttgggattacaggcgtgagccaccgcgcctagcctgctgtcagcatttttgatgagcctgttcactctggactctaatcttttcttcattagctcttttacaaacagttcatgctcaccaaagaaaatttgtaacatagaacaggaagaaaagttgcccacggtctaccatccaaaccccgtcattgtcaacagtctgtgtgtttccttctaatctcttatggcagtgaacttttgtttttctcctttgcagtcacactgcttttttccattccctggacagtctatggtcagcatttccatgttactgtgtagactggcattagtcgttcagatttgtgccattctcattgtaatccgtctctctcctacatgtgtgccttggtcagttgtgctcacctaaaattcgctaccttctcttttctagggaaccccaggaaatccttattagtgaccggcagtgcaatag

SEQ ID NO: 186696 - DNA, 341 bp, Homo sapiens
tgattccacctcttcgtttccactgccactgccccgatccctcaagccaccatcatctcttgccaggcagctgcaatagtctgtctcataactggtattcctgcctccacctttgctccttagaatccagtctctacacagtggccagaacaatcttttggaacaaatcagactttattctttctctgcttaaaaccctccaatggcctctaactgttcttggaataaaatccaaactctttattacgacctacaaaatctttgttttgatctacaggttctttttctccacccccgcccaagacggagttttgctctgttgcccaggctggagtgcagtg

SEQ ID NO: 186697 - DNA, 420 bp, Homo sapiens
gatgttacggcatttgagggtcttacatacccaaaaagagactgtcccttccagggttagctaattcctaaagatagtaaacaagttacttgagtgcatgtctctcatatgcaagccgaccaccccctttatctaactctcacatacaaagccaatatttcttctgccctaaatcatcccaggaccagtgctatgatttgggtgtggtttgttcctgccaaaactcatgttgaaatttgattcccagtgtggcagtgttgagaggtcgggcctggtaggaggtgtttgggtcagtggggtggatccctcatgaacagatcaatgtccttctgagaaggtgagggagttctcactcttgctaataggttagttcccatgagaacaggttgttaaaaagggtctagcttcttctcctgccat

SEQ ID NO: 186698 - DNA, 333 bp, Homo sapiens
tgtgagtttgttaatttttatttccccgtgaacatttggcagagttaaaattttagccatcatacattttattccctgaaatgtatcagtcacagttcccacagactctagatacacatttccttgtgggtgtatgtgtaaaactaccataacaaaacattttctatttcctcattttgattaaaaggaaagaagaaatgctaaactgcacttacataagtgacagtgcaatagtgacacaccatctgtgtacacaatttgtattctgtttaaatttaaagttataatgataaggtgagaaatgctaagagctaggaaataaaaaatacatat

SEQ ID NO: 186699 - DNA, 874 bp, Homo sapiens
gttcgtggcgccgcgcctccgggtgttggggagtccgggatgatggggaatccggggctcgccctagtcgcggggacaccgccttccaggagctgtccccaggcaaactcacagacatcttcaaagagccttcttggacattctgctttttgctcctcataacaggcttcggcataaataatatacaacagcctgggcactgtggctcatgcctgtaatcccagcactttggaaggctgaggtgggcagatcgcctaaggtcaggagttcaagaccagcctggccaacacggtgaagatggcctatcaaaatcattttgattttcacttctttatttcagatggagtttctctcttattttccaggctgcagtacagtggcgtgatctcggctcactgcaacctccacctcccaggttcaagcgattctcctgtcttagcctcacgagtagccgggattacaggcacatgcccccattcccagctaatttttgtatttttagtagtgacggggtttcatcatattggtcaggctggtctcaaactcctgacctcaggtgatccgcctcggcctcccaaagtgttgggattacaggcgtgagccacccactgtatctcttgttcggaggaatatctaatcaagaaaaatccatgctactggtggatatgaggggggacgtttcctgtgagatggggttcactcatgtgtgcccacctggtggtaaagggggcaacttcggctcaattaaacctcggctcccaggggccggaatggggggctgggcacacggatcagaagtgatgggcacctccagaacacagtggcagacaactggcgcaacacagttggagagtggagaaacgggacaaaggag

SEQ ID NO: 186700 - DNA, 665 bp, Homo sapiens
gttcgtggcgccgcgcctccgggtgttggggagtccgggatgatggggaatccggggctcgccctagtcgcggggacaccgccttccaggagctgtccccaggcaaactcacagacatcttcaaagagccttcttggacattctgctttttgctcctcataacaggcttcgatggagtttctctcttattttccaggctgcagtacagtggcgtgatctcggctcactgcaacctccacctcccaggttcaagcgattctcctgtcttagcctcacgagtagccgggattacaggcacatgcccccattcccagctaatttttgtatttttagtagtgacggggtttcatcatattggtcaggctggtctcaaactcctgacctcaggtgatccgcctcggcctcccaaagtgttgggattacaggcgtgagccacccactgtatctcttgttcggaggaatatctaatcaagaaaatcatttttactgtttttattttggtggtctcgtttttttcctgtgagatggagtttcactcttgttgcccatcctggtgtacaatggcgcgatctcggctcacttcaacctccgcctcccagtgcgtccggaattggtgggttcttggtctcactgacttcaagaatgaagctgcgcaccctcacggt

SEQ ID NO: 186701 - DNA, 356 bp, Homo sapiens
aacataaatgatactttattataaatattactctagtgtttgttttttgtacataatatgtgctggaaatttttttatgtcagtatgtcattcatattattattgttattataaaaatactacatgcacaaggaaataaaaattgaaagatttaaaatggaaagttgaggaagatctaaaatggaaagtgaaaaactccacctatccccaagttccatcccttagaggtaactgcttttcactgtatttgcgttttattctttgattacctccctaacccttaaacatatatatacttgtacttttatttctttaataactttaagcattcttggttgttgatcagttaagaatga

SEQ ID NO: 186702 - DNA, 365 bp, Homo sapiens
catcatctcggattcattcattcatccatctagtaagcacctcccatcatcagtaagcaacttgacacacacattcacagcaatgtgttccctcgaatatttaataacatgccaattttgtgccatcacttgtccaaggccacataactaagaagggcagcaccagaatctgaactggctccttctgacttcaaagttgtccattccctttttaacatcccatctgctggtcctataggttttatttaaaataataggtcggtcacagtggctcacgcctgtaatcccaacaccttgggaggctgaggcgggcagatcacttgagctcaggagtttgagactagcctgggcaacatggtgagacc

SEQ ID NO: 186703 - DNA, 510 bp, Homo sapiens
tgggattacaggcgtgagccaccgcgcccggccaatactattttcttttaggacacatgctcaagcaatgataggtgttatttaatagtaaagctgaattctagcttctgggagtggactaaaagctagaattcagctataaagcaacaggcagccccccgcccccccgccgcccctgtgtgagttgatgagttacttttttagggcttcttgatacataaggcaaccatacttccctctttgctctggctcacccctgttttcctggcagaattgtcagtagtgtcactttcattcttagatttattaattttgatgataaattctatgtaaccctagttattattttcatgcagcatgtgaggcatgttttatttctgtttttcctgtctagggaaaccaagaataccaactcactttgccttgtctgtgatgagaactgaaaaacctacagagtaatgaattcttacagttgcattagaaattcagtagccagggtggatttttcac

SEQ ID NO: 186704 - DNA, 347 bp, Homo sapiens
ctccactaaaaatacaaaaattagatgggtgtgatggcatgtccctatagttccaactacttaggaggctgaggtgggaacatcacttgagcccaggaggcagaggctaaagtgagctgagatcacgccactgcatactccagcttgggtaacagagcaaggccttatctcagaaaaaaaaaaaaaaagaaagaaaaggaaatgcagttgagacagagtggaaatgttagaaacttgagtaaatgttattctatcctgtgtgtaaaaattaacttaagagaggtgggggaaaggagagttgtttaatgggtatagacttacagttttgcaagttaaaaaagttctgg

SEQ ID NO: 186705 - DNA, 222 bp, Homo sapiens
gaaagaaaaagaggctctgacacatctttcagcctccttttgggctaggattggaattcattctagtggtgaatgaaccaactattgccaaagttgcttttttggacaatgctgctttttaaaaaatctcagtaccaggtcatttgaatatctaattggaaaaaatacatgtatctttaactgtaattataccatatacaaaaatcaattcctaactgactg

SEQ ID NO: 186706 - DNA, 270 bp, Homo sapiens
aggatcaagtgattctcctgtctcagcctcccgagtagctgggattacaggtgtgtgccaccaagcccagctaggaggcttttaatgtttattttgtttaatttgtagtctggcctctttaccaccgtgcttttctgaggctgtatttgtggagataaccagggatttccaaaatgccaaagccagaacctttttctcagttctcctttccttgatctctctgcagtatttaatactgttaatcacctacctttactttttttttttttt

SEQ ID NO: 186707 - DNA, 437 bp, Homo sapiens
tctctttccatagtccatactccaacaaagagaaatctgagcacacgtacatatttttctccagattctcatctgaaaccatggggagagatacgtttctcttttgccttttgatgtactcagtaaagtgctgagttcataatgttggctctcatttaaaataaaaggaaacaaggcaagcaacattaaacatttgaaatcgacaggaagggaatgttaggttcatctatacattaaagaattaaggaaggcagagaacagttcatagaatgggctatggagacttaattctcacaggaaaaaggcagtcatggtaattaatttccattaggttctattataaaatggtaatggaaaatgagtttagctatatggaattgtatgtcatgtacaattatgtgggaacaaatttataacatttatcagatggtatctgc

SEQ ID NO: 186708 - DNA, 373 bp, Homo sapiens
gtttgggtgctgacacttaactcaggggcttctcccttcatcttctggggaggaaggatcttctcacccatttacctttttgccaggcctcttctctaagggatggggcaggacccaatgctccccaccccagggtagcagatggggcacaagcagctgcttcctttgccagtgccacttcctgcctttcccccaccactccctcagtatccttcccagggaaggggaggctagacctccagaaagagcatttgtgaaggagaaaaaggttttggttgtgtttagctgaagccccagggatggaggcagagaatgggagtctgtccccaacagctggagcagagcgccggtgggcgtgggaggcctcccagct

SEQ ID NO: 186709 - DNA, 312 bp, Homo sapiens
aaattttcatgttattaattagtgttctcttccttcagcttgaagaactccttttagcatttcctgtaatgcaggtctagtggtgataaagttagctattgattgaaaaagtctttatcatccatttggttttgaaatacagggttgctgggtatagtattcttggttggcagtttttttttctctctctttcttctctttctttttctttcttctctctcctctcctgccctgtcctgtccctgtctctctttcttttcttttccttccttccttcttttcttttcttttccttccttccttttcttttct

SEQ ID NO: 186710 - DNA, 387 bp, Homo sapiens
gtaggcagggtgggcattatttccctccttaggcagtcagaaaggttccttcccaaatcacacagctggttggtgacaactgaggagagaatcagccaagattctccagcactgaatttgggttcttcccatgacccagttctgcgcctctcggcctactaacttaccaagggagcaacgccaacacacagaagattcaaacatcagggagcacggctgagtcaaagggaaacatttcctcgctgggaataacactaaggagccctactttgcctcaacattagaggattcgttctcttgttatacgtggtgatttcgtattgacctagatgttcttttgtgtaataaattgtaggaaaacattgcttgtgaaaagaagcaccattt

SEQ ID NO: 186711 - DNA, 530 bp, Homo sapiens
caggtagggtttggtacaggacctaggttctactaagaagatactcctacacaaaacttagaatgcagacaggaaacatgtgcagtggagggtcacacacagagcaagaaaatcttctgggcagctgtcacgatgagtctgctgtctagtcccatcctaggtggtaagcagtagatgataatgacagttttctgatgggacagtctcatgttgagcatttattttggctgcaattttcttggttatgaatgtaggtttggttctggccctctcagaattctgtaagatcccatactttatagtaaatttctttctgttttaataacagagttgattctgtagtctgcagtgaagaatcctgatttatgtagttgttagtaccaagaggattgcagggaacagactctcaagaaaatgcaaatctatgattgattatccaactccatttggctttaaaccagtggaaactgtcagccttagagaatggtattcaataataaaacagatttttattgtggttcccttgagca

SEQ ID NO: 186712 - DNA, 333 bp, Homo sapiens
tcttttgctcagcctgctgttttcaaggttcatccatgccctagcatgtatcagtccttcattcttttttattgtggaataatattccattgcatgcctatacctcatttgattcagcagttcatggtcttttgcgttgtttcccactttatggcagataggaataatgctgctgtgaacgttcatatacggcttctgtgtggacctacaagttttgatttctctcagttacagacccaagagtatatactctgggagcagaattgctaattgctgtgccatgtgttaactctgtatttaaccttttgcagaactacctgttttccaaagtgc

SEQ ID NO: 186713 - DNA, 376 bp, Homo sapiens
gcctttgcctcctaaaatgttgggattacaggtgtgaaccactgcaccagggtttgtgtggtttattatatgtcgattttacctcaataaagctgtttaaaacataaaaaccaagtttccatcaaattttaaattactctcttaaaaaatttaacttagaccttgaaaaatagtcatatgtttctatgaaaagttttaaaagcattatctttcaaaatcctgggtaaattaaatacaaggtcactaagatgtcagcaaacttttatattaaaaaccctttgaaaacatctcactgatcctactataatcaaatgagtgtcttcttttatgtaataaatctcacaaatgtgtggagtataacaatgattagcctcag

SEQ ID NO: 186714 - DNA, 354 bp, Homo sapiens
tctatgcatttgtaaaaacacatggtgtcatgtgctaaaatgagtgacttttactgtatagaaatttttggggccaggcgaggtggctcacacctgtaatcccagcactttgggaggccgaggtgggtggatcatctgaggtcaggtgttcaagaccagcctggccaacatggcgaaaccccgtctctactaaaaaatccaaaaattagctgggcatggtggcaggcgcctgtaatcacagttacttgggatgctgaggcagggagaatttcttgaacctgggtggcagaagctgcagtgagacgagatcacaccactgcactccagcctgggtgacagagcgaggctccatct

SEQ ID NO: 186715 - DNA, 339 bp, Homo sapiens
ctcaaatagctagaatatatgatggttagataaataagatgcagtgttcatacaatgtaatttttttcagcaataataaggaatacattctggaaatggatagtggtgatggttgcacaacactgcaaatgttgtcagtgccaccgaattgtacacacaaaaaatggttaaaatgataaatttggtgttatgtgtatttaaccaccattctaagaactgaaaaaggaggagattagaaatgaagtactgattcacggaacatggagaaacataatactaagtgaaagacgccatacacgtatggccacatagcatatgattccatttatatgaagtggc

SEQ ID NO: 186716 - DNA, 253 bp, Homo sapiens
aacttaataatgggaaggcaacctaattatgtttaatggagaaaaatatctgaacagatactctacctaagaatatatataaatggcaaaaagaagtgtatgaaaagatattcaacatagtaatgccattttggaaatgcaaattaaaaccttgagatactagtacaatttcactaggatgtcaaaaatttgagatactgacaatgccatgtgttaacaaggatgtggagcagcgggaaccctggtacgttat

SEQ ID NO: 186717 - DNA, 763 bp, Homo sapiens
gaagtgatttgcccgtcttggcctcccagagtgctgggattacaggcgtgaagcgccacacccatccaggttcacctcttgagtagagtgctgagatgctttctcacatgagattggtttctagtaataatagagggtttttttgctagttactttcttattgtatttatcttatagagtcttggttcttacaaaatcataatttgctttcaaaaatacatattttaaactacctaataagatctttatttagtgtcacatttacgaagggttgatgcttattttagtgatgatttgtcattaaaattatgtcaaaatgtcttaaaatgttgttgaaactgtaagcaaactcaacacgcacaaagctaattatgggtgccatctgtttatttttacaaagctttttttttaagactatggcattgtctgcttatgataagcttcaagattattataatgactaagtcctgtccttcaattagtgtagttgaagatgggaagataattcgtttgttcactgaccttttcctgtgtcagagtgtatgaaatatgacatgtcatgataaagaaactattgtgaagtgcatttagaagatacttaatttttatgagaaaaaaatgacatcaaagcagcagatgtggccaaagttttgtttaaattcttagaacttattcaaggttttagatgaacggtagacttttccagtgacttaagtggcttcattttaactcaaggttaagaatttctaagtgatcgaccaag

SEQ ID NO: 186718 - DNA, 318 bp, Homo sapiens
aatttatttgattcttctgttcttggatattttagtccttaactattttccgctattttataatagataatgctgtgatgatctttagagcaaagacttttatccttaggatgaatttctgcaaaagagggtctgattcaaagggtataattatttgtaaggctttttgatgcatcataccaaattggctctcagaaaggatagttttggcttccctgattcttctttgatattagacattttaattttttaatacttgataatttgataggtgaaaaaatagttgttttgatttggatttctttgattgctactgag

SEQ ID NO: 186719 - DNA, 362 bp, Homo sapiens
agtgttccgtactagtgttggcggtggctgtgacaggttgggcaggccagtccctagacttgcaggttgcatgtacaggttggtgccagctatggtggtagcagcagattgagtaggcccaagtttagactctaggaggagtgctcaggcaccactggtgatgaactgaactgggcaatcctcaggcctcccagagggtgtgcttgggtagtggcgtgtatgaagccaggctaggtggaactgccctcagtgaccctggtggtgcatgcaggtgctggctatggaaggcaggggtggggtgatccccaggcttccagtggaatgctcaggtaaggggcagcagcagctatgctgcagtactg

SEQ ID NO: 186720 - DNA, 268 bp, Homo sapiens
acaccgtactgcctcatgatgtgatgcactgaggatataccatcacttacatgggatttttgccaaaaatgcaaaacctgaatctaattacaaagaagcacctggacaaatccaaactgatggacatcctacaaaacaaagggtctgtactctacaaaacccaaaaattaaaaaggctgaagaactgtttcagattaaacaatacaagggatataattaaaatgcattgtataatattggaatgggaaaaatattaaaggatattatt

SEQ ID NO: 186721 - DNA, 417 bp, Homo sapiens
cagaggcaactgaggttggagatcatttttagggtcttaagttcagagctgtatctgtaatatcaacaacagatattctggctcttaccaccttgcccatttctcctcttagcactgtaagagtagttcttgctgagaaggcactagcctgtagtggcgatgaacatcagctttgagtatagcttccccacgtaaggactgtatgaccttggaaaactttctttacttgttgtgataaataaacttccttacagcaaattgatcctcaagttattcccctgtaaagtggaaaacataatggaaactaccttctaggcttgatatgaagattaaatgaggtaatgtacccaaagcacttagtacagtggctggaacatggtaaatatttgatcagtgttgttcttattattgttatgg

SEQ ID NO: 186722 - DNA, 887 bp, Homo sapiens
aaaagtcatagtccagtaatgcaaggatggtttaacatgagaaacattagaaaatcagtacaaaatgtgacattaacagattgaaagaaaaacgaatgtgattactccaatatggagactaaaagcattggataaaatacaacatcataaatatgccaaaaatatttggaaaaatttagcatcaattcatgtcatacaattcttaacaaactctaaataaaaacatttttccttaatttcataagcaatagtataaagaaaacaagctaacattacacaaacatgaaaccttgaaagcgttgcctttgagattggaaacagaacaaggacaccatccatcaccacttcttccaacattgtatagcagacagaggaggaaaagaaagtacaaggtggaaaacttggaaaataaaacatgcacctcacagatgatatggttattaatttagaaagccccaaaaaagtaattattagtaagagatttgggaatggttaccacataaaagaatcaatatacagaaaacatttctagatctatgtaccagaaacaagcagatggaaaataatgttttaagagatttccagtaccatccaaaatcttgtagttaccaactgcaagcctaacaaaagacctttagatggtttgtggggggaaattattaaacattgttgagagacagtaaaaaatatctcaataaatggttagaaagctgtaggagacctgaaagtgtaaatcccagtcaaccatagttctgttgggtaagagaatgctgacaagcgcatagcaaaggccaagctgcccttgaggaatgcagtgtgggggcctttgctgtaccagacagcagggtgtcctctaaagcagcagtgctccagatacctggacccaa

SEQ ID NO: 186723 - DNA, 438 bp, Homo sapiens
aattatttccatagaaaggagacaatatattcaaagaactagcacatgaaacaataacaacaagcataaccacaagcataaacctctcactatcaccaatattacctacttcaaaaataaaaaggcactgttcttcaaaccagagaataagtggtagatgtgcagtcatacagacacagcactaaaaacttctccctaagcaaaaatatctcaatatcacctactgggttccaatcaaagcaggtagctaagctttaaaaaagaagagagtatggaaagggaaaaacactaactttagagaaggccacctgtccctctcttgcagtggctcacgcctgcaaacccagcattttgggaggccaaggcaggtagatcacctgagctcaggagtttgagaccagcctggccaatatggcgaaatgccatccccactaaaaa

SEQ ID NO: 186724 - DNA, 830 bp, Homo sapiens
tcaagagggcaggccctggagacggagcacatggatttgaatcccagcctctcataggcaggttaattaatttccctgaatctcagtttcttcatctctcaatggagaaaataatagaagccacctcacgggaattaaatgagattatttacgcacagcaccaaggctgtggctactgtatttgacccctgaaacagttaatttttcttgacatcccttccttggtatatgtattagtcagggttctctagagggacagaactaataggatatctctctctctatagatttatataaaggggagtttattaagtattaacttacacaatcacaaggtcctgcaataggtcgtctgcaggctgaggagcaaggagagccagttcaagtcccaaaactgaagaacttggagtctgatgttcgagtccaggaagcatccagcacaggagaaagatggaagctgggaggccaggcctgactctccttttcatgtttttctgcctgctttatatccgctggcagctgattaggtggtgcccaccagattaagggtggatctgccttccccagcccactgactcaaatgttaatctcttttggcaacaccctcacagacacacccaggatcaatactgtcagttcaatcaagttgacactcagtatgaaccatcgcaatacaataggattactttctgtgataacctgtgtaaaaataggcagtcatgattttcctgttgtgttcttcaggtgtaaaacaaaaaatttaaaagaagaacttcaattttaaagatattattcaaactaagttaaacattttgtgtataaattaaaac

SEQ ID NO: 186725 - DNA, 354 bp, Homo sapiens
agtggatgaggcccctcataccagcagatctttccatagtcctcctgtagaaacaccaagtgtctgggtatgccttgtacagtaagttcttggaacctccccagaccctctcactgcactttggacagtgagtggcagagtgggtgggtgtttggtgtttggtttttgtttttgttttttagactgatcgctgcccattatgagtccccattactgactccaaaatagaaaagcttgtggtcagtcaggaaaatgatcatccagcttttttggctcttgaccctgactcctgtcaactaattaggggcattaggcaagatcttgtttcaccatctgtacaagtgttggaattat

SEQ ID NO: 186726 - DNA, 531 bp, Homo sapiens
ccaatccccatgaacaattctctcagaacacatactgaaactaattcttcatatctccatggctatcacacaagtcctagtctctatcttctcttatgtgaacttctgaaatgttttattactcccatttttgtcccatcatccatttttccatcagacacagtgattgtgattgctccaactcactgagcagtctggttctttgaactggccatgtttgtttggcgttctcaccattccctctggctggaaactcagtgctaggcatctttggctccttctgccattgaactcctgtttatcatctcctcaccccctcaccatctgaaattatcttttttttctgtttattatttatctcataactagaatatataagcactgtgggagcagagtcttgcccacagctgtatctctggcacctggaacagtgccaattatgtagtaagttctttcaatgatgtgtcataggaatatcagcccgctaatgagggagttctgaaatcccatagggtgcatagaaaataaaag

SEQ ID NO: 186727 - DNA, 600 bp, Homo sapiens
gaaaagggaatctaatcaggtcaagcaatttactcatagtctcccgaccatcaaatggcagagatgggattcaaatgtaagctttaaaaaaacattagcttcagttcactttcctctctaccacaatatctcccatgagatacagacactggaaattcttgaaatcccagcttaatttcacacaggagttgatcttcatgattaacttaatttctactcataggtatgtttctcaccttaaagtataattatgagactcctcagtgaagtattgggtctttactgattggtggctgcactaaagtctagtgaagataaagcatttaagcactgcatgtataagagttgcaaagaaggctggtagctgcccagcatcattggccttgtatcttgtatcattattcaactgtatgcactgttggtgcctaaccatttattgattgttgatgtgtctttccagtgaagaagacatggattttagagctagagatgccttaattctaatccactttgcttcttgctaccaagttatttaaactcctgagttatggagataataataactacctccaaaaaaattcttttttggtttaaatgaaa

SEQ ID NO: 186728 - DNA, 263 bp, Homo sapiens
tccccaaagtactgtccaggtctttgctagattatctctaaattgcaaaatgcctttcactgcatggagaggaaaataaattcataagtaaacaaaaagtacattctctaccttgtgggacgccgaaatcatgcacatttagtatagcccagaaacaaatgcttcctacgactctgcaggaccatgtctaagaaggaatatcctcaaatcctgaaatatttcaaacgactacttaagaatggagtacatcgacctcctcctac

SEQ ID NO: 186729 - DNA, 382 bp, Homo sapiens
ataagacagagataaggatacaatcagcagcatgcactgatcatgaaatccagagaccagcattctcagacagcgtgcagtacggatgcttctggctggcagggaggtcgtggcagtgggctgactaatgcgcgcgcatagattcacacacattgcacacacacattcacacacagtgcacacatacatattcacaaaatgcacatatacattcacattgcacacacacatcacacacaccacacacattcacacactgcacacacacactgcacacacatacacatatacacacattcacacactgcacacagtcacacattcacacacactgcacacacattcacacacactgcacatgcggtacctgtgtgcacccgca

SEQ ID NO: 186730 - DNA, 811 bp, Homo sapiens
cacaaagtgttaaacacatctggaaagggattctgacatcatcctgagaatctttggggaatacatatagcctgtagacccattcctctttgaccctataaagattctttaaagagtaataccctgagtggttttctggccagcttgcctgctcatttatctttgaggagatggaaggagacaatatgcctcgtggagatccacaggccctagaggtgtatggattgtgcatttggaagtgctgaagctgagagactgggtctcttggtggaccccaagggatctgcttttcctctactcattgtccctacacaacttttcctggcagccggcattgctgtttagatgggttgttctttgctgtttaagttgtttggcagtggtgtgtcaggatgcgggttttctgaatactttcccagctggttacttgagtggtggttagggaggggctgttctggggctgctctggagctgttgaggtcgggtgtctgtctggatactcacagctggtctgtcgaggagaacgctgttctcattctgctgcctttggtggtgctgtgtgtggctctttagatgtgggtggagatgagttgggggagttaatgagatctttttttagctgcttttgataaagtagtctgtactacaggattcattgtgactttttcccttaacctgtgcatacttctttgctagcctttgtgaaagagagttcaggccctcttgccctcttgctctttcgctctctcttgcccttctgccttctgccatgggatgatgcagcaagaagaccctcaccagaggcaggttc

SEQ ID NO: 186731 - DNA, 271 bp, Homo sapiens
acctttcttgctgagatgcattaaaaattctggcttttcagagcaaatgtaattagttcacattagtaacttcaccagcagcagcgacagaagcaaagtgaactaacaggatatggattaatgtaatcaaaatatcatctcccatcatcgccactctttaggcagctggctacacttcctctcttggttggattgtttttctttttaataaaaatgatacatcaatgaaatggatgcataactacttgtaatcccccctcagggcagtact

SEQ ID NO: 186732 - DNA, 337 bp, Homo sapiens
aaagaaaaccggttaggaaaagagacactgaggaacagctttttgaaaactttccaaggaaaaaaaaagactaactaaaagaacaaagtatctaacataaccaagagccacaaacatgggaagttacttttatttggtattaacaattttagctaagtagttttcatctgacacagtagtttggttatagacagcaatttccattccactttaacatctgggaaagatctaatattgaaaactgaactataatttgcataccatctttaagtgaaatgtataagagtttctttcagtagctcctcaagagtatttagcctttaaaaataatcctgta

SEQ ID NO: 186733 - DNA, 375 bp, Homo sapiens
ggaagaactcgatttgtcccctagcttagaggatgactcttgcaaaaatgggtggcgagcctttgccacagttgctggagaacaggaggcaggacacctctgggactgcgcgaccagcctggagcgagagtctttgctggcaggggttccccgacacacagggtgctgcttacagagggccacagacagcagtggtcctgagccagtacagggggtggctgttcaagacctcagagggctctccagtgtttctcttcagaaatccaggtctgagagctatctgggcatcccagtggtctggcccttccttctctggtgctgtgaactgggtcggagttggccacatatccacaacagggccagggcaccggtgct

SEQ ID NO: 186734 - DNA, 301 bp, Homo sapiens
tggtacatacctgtggtcccagctattcgggaagctgaggtgggaagattgcttaaacccggcaggtcaaggctgtagtgagccatgatcatgccaccgcacttcagcctgggtgacagcgagactcttgtctcaaaaagaggaaacaatacaaaggactagggaagatgccaagtacttcacatttaatagcaactgctaccctttgaagtaaacctgattattcctattagttagatgaggaaacaggcacagaatggttgagtaactttcacaagattacaaagctaccatatttcat

SEQ ID NO: 186735 - DNA, 323 bp, Homo sapiens
tttctacctggtggccagcaacttggacatattcccttactggtgatgttaactctcatcactgggctaaggtgatatctgccaagttcctgcactgcaagttaactcttttcccttttgtagttaagaagtgtcttgctgagagacaacggtggctcgaaagcctatcacgtctccagctttcacccaagcgtttcgtgtccactgattctgacagcattttgaattttttggtggcagttgcttttttaaggttgtgtgagatactcaatgttcaggggaagtccctgtgtttaagaagtccctttctactctgtcttagc

SEQ ID NO: 186736 - DNA, 431 bp, Homo sapiens
catctcctcccacctcttactctcctcccacctcttcctctcctcccacctcatgtgaatcacattctgtagagctgacaactgtgggtacccgaccctgcctgtgtggtgaggggcagcctagtatgaaattgaagaacaagagctctggagctggaccccctaggtcccggttccagctgtaccactcacaggttctgtgtgtcaccttgggcgcactacttgaacttctggtgcctccgtttcctcatctgcgatctgaggataattgtccctaactcacagtgttgctgtgaggaggattgagctaatgtatgtaaaggatttttaaactgtgcctgttcacagtaagtgagatataaatgctactgttgtcattagcaactgaaccaaatacaaaacccttggtctgttgagtaggaggtcccaag

SEQ ID NO: 186737 - DNA, 209 bp, Homo sapiens
tcggcctcccaaggtgttgggattagaggcgtgagcgcttttcttaaaagagttccagggttctatgttggaagagcgagtttgtcagtttttattggaacaaagaaatgaattgacagcattgtgataaacactggaagtgtcgcttctaaaatttgtccatggctgaaagtggtggctcatgcctgtaatcccagcacgttgggaag

SEQ ID NO: 186738 - DNA, 241 bp, Homo sapiens
gtgctattaggttggtgcaattacttttgcaaatactttattttggcagcctcaagaaactaacagaggcactttacttcttttcttctattatatatcagtagtaatacgcaaattggtgacttgctgtcagaattccaacatggctgttggccccagcatgagacagctttctgagttgaatgtttcacaaggttcttttggaaattccgtattgaaaaatttttggatggcactcaaa

SEQ ID NO: 186739 - DNA, 333 bp, Homo sapiens
gggctttggtgggactggaaaaatgggccactccgggcagacctagccccaagaacatagcagaaggggtcttttgctccaggactcttaggttggagagctgagtgtggactgcatttcaggtcctctcaaccctcagctgggcaccttggtacaatgcacaaaatgcaagcccacctacggcagccctgacaggtgaatgctggtgcgtgacagaagcctgggaacagtcacgggcttgtagaagtggaccaggtcctgcagctgcattggtaataataaccaagtattctagctgctcctcgggaagcaggtcccctcgattcccctcgc

SEQ ID NO: 186740 - DNA, 599 bp, Homo sapiens
tggctttactctcagcgtgagatgaaacagacaatacagtacacctgctgagtgacagagttgtccctgagttgttagggcctttgcccgccttggagctccacttgcttggtgcacagtaggcagcaaatgggctgtagaatcatggtatttgtgatttcctgtgtccttgacagttgagatattctctaaggctatttatgttctctctaccatgctcgtcacaagcagtcttctgggtcctcacaagcagtctttattgtttatatttctattaacaggtctgttcaaggcaacgtaaacctttcctaccatgttcctcaaaattcttccaagctccttcactacccaattccaaaaccacttccacattttttggtatttgttataacagcaccccacttccaggtactaaagtcttttagttttctattcctgctgtaataaaacccacaaatttcatgcttaaaacagcacgtgtggggcgcggtggctcacatctgtaatcccagcacttcaggaggctgaggtgggcggatcacttgaggtcaggagttaaagaccatcctggttaacatggtgaaactctgtctctacta

SEQ ID NO: 186741 - DNA, 694 bp, Homo sapiens
tggctttactctcagcgtgagatgaaacagacaatacagtacacctgctgagtgacagagttgtccctgagttgttagggcctttgcccgccttggagctccacttgcttggtgcacagtaggcagcaaatgggctgtagaatcatggtatttgtgatttcctgtgtccttgacagttgagatattctctaaggctatttatgttctctctaccatgctcgtcacaagcagtcttctgggtcctcacaagcagtctttattgtttatatttctattaacaggtctgttcaaggcaacgtaaacctttcctaccatgttcctcaaaattcttccaagctccttcactacccaattccaaaaccacttccacattttttggtatttgttataacagcaccccacttccaggtactaaagtcttttagttttctattcctgctgtaataaaacccacaaatttcatgcttaaaacagcacgtgtggggcgcggtggctcacacctcggcctcccaaagtgctgtgattacaggcgtgagccactggcccaatatgacctatatttaccccatcctagcagactaattatttgttgtcttcacttccagtgcttttccatgtctgttcatgtttttatgaagtcacaattctaatattcaattttgtattttgtttcttaacacagtatcttaatatt

SEQ ID NO: 186742 - DNA, 391 bp, Homo sapiens
ccaaagccaataattacttatagaaaacgtcatgtctaggcagcaggtgtcctaggaatgcaagtatgggtcatcattagaacatctatcatttcagtggattaaagaaaaaatgctcagtgatttgagcaaaagagtgttctattagattattctgactgaagtgtggagaaggatgagaaggactagagaagctgcagggcctgctgagcagacagactatggcaacagggagaagaggtgatggtagcttgtactagggtaacagcagtagtggtggtgagaaactgaccaggaatcacagcagtgatatactactttatggccttcataatggcaaagggtacgtgggaggaaaagggctcttttgtactcctggccctgggagtat

SEQ ID NO: 186743 - DNA, 410 bp, Homo sapiens
atcaaagtctgggtggtaaactgttttctacaaattttgtttggacattgaaagtaacacattttgattttttctaattgattcccaaggagattatatagtacttaattaaggcaatctctaaagttcttagccctttttccttatttaggtaaatttctgtttacttatctagttgaatattcatttactgatttttgtaaaatggtctgtaaaataaaattatgttggagttcttggaacacatgtctgtctaggagcatcttgtgctgtccatctctgttcatgcgtcatcccttaactcattgttcctaatcatagacaattagagttagaaggtaacttagcaaactttacaaataaagaaatggagtacttagacaacactgtagtaaaactgcatatatttg

SEQ ID NO: 186744 - DNA, 307 bp, Homo sapiens
cagaaaacctatgagagcagcttcaaaatcagtcttctaagcgcaagagagacttcctgaaccacattctgcttcatcaaccggactctacaacatgaacagcttgtgtctcttacagattctcataggcagatgcataaaacgtgaataagatgtgtccactgttggcacaacttcctgctacagctcagctagtaggaaatcatgtacaagtttcaactaagaaccatttagggagaggacatagaggagagaaaaaaaattcttttggcttggcttggtgttttgtattcagcatcacacctaa

SEQ ID NO: 186745 - DNA, 731 bp, Homo sapiens
aagcctgtaccggtccggaatttcgggatatttttaatcagtggtgacctcgtcatcgcgttaaaatagttctgccctcagcccctctttatctgtagatggcagagcgagcgccggtaaagatgctctgtcgtggagggctcagtggggcggaggagatggggagcctctggcgttgtcggagaatgcaccttaaaaatgactctacccttgagcaacgcaggaagcacgacagtgatacttctgtttgtgatgatggtattggcgaaaaatcactaccaatataatggattttatatatcagattgctttattctggatatcatggtaacaatacagaaagtatacataatttcccatttctgcaagtagtcatgactgctgaagaaagaaaaacttaaagctacggcagaattattttatggaaattctgattttgtttttaatttttgataactttttactaaaggtatgaacacacaaagagcttattttgttaggcaaatacacattaataagaatgcctagaagaggactgattcttcacacccggacccactggttgctgttgggccttgctttgctctgcagtttggtattatttatgtacctcctggaatgtgccccccagactgatggaaatgcatctcttcctggtgttgttggggaaaattatggtaaagagtattatcaagccctcctacaggaacaagaagaacattatcagacca

SEQ ID NO: 186746 - DNA, 735 bp, Homo sapiens
tcatcaccatctctgctcctctcagtggataaactttttaatcagtggtgacctcgtcatcgcgttaaaatagttctgccctcagcccctctttatctgtagatggcagagcgagcgccggtaaagatgctctgtcgtggagggctcagtggggcggaggagatggggagcctctggcgttgtcggagaatgcaccttaaaaatgactctacccttgagcaacgcaggaagcacgacagtgatacttctgtttgtgatgatggtattggcgaaaaatcactaccaatataatggattttatatatcagattgctttattctggatatcatggtaacaatacagaaagtatacataatttcccatttctgcaagtagtcatgactgctgaagaaagaaaaacttaaagctacggcagaattattttatggaaattctgattttgtttttaatttttgataactttttactaaaggtatgaacacacaaagagcttattttgttaggcaaatacacattaataagaatgcctagaagaggactgattcttcacacccggacccactggttgctgttgggccttgctttgctctgcagtttggtattatttatgtacctcctggaatgtgccccccagactgatggaaatgcatctcttcctggtgttgttggggaaaattatggtaaagagtattatcaagccctcctacaggaacaagaagaacattatcagacca

SEQ ID NO: 186747 - DNA, 359 bp, Homo sapiens
cccccccccacacaaaaatacaaaagatcagtaagataaaaagttgactctgaaaagataaacaaaattgacaaactgctagctaaattacccaagagataagatccaaataaacaaaatcagaaatgtaaaagcagacattacaactgatatcacagaaatacaaaagagcatcagagactatgatgatcaactatattctcacaaactagaaaacctagacgaaatggataaattcctggaaacataaaaccttccaagattgaacgaaccactggcctttcttccctatctaactcttccaaatcagaatttaagtatttaagcatgctaaagattcttctattttgaaaatttgt

SEQ ID NO: 186748 - DNA, 888 bp, Homo sapiens
ccccacctcagccagcctcgcctcagccagcctcccaggtagattatcacagcaaattttatcagcttcaaaaataccgtttgcttgttgctccattctttcccctcacagccaggaatggcattccaaagtccccttcttcttcccagatcctcctactctgtctttacagtcagtgcacttaactcagctgtgccagaaatcctttcatccatcagtagaaggctgcctgcttgtttgtccaacttgttttccgagtcttggctaattgtaccagacactggaatgttgaagaaacacaatgaagggctttttcattcagctggcccagcccttctattggttcttcacagttctaacccaaccaggggacagaaaagtccagcctctgtgggtgtcaggacagacactgcagccctgccccacaccactcaaaaaggccccgctgcagataagggcctaatcactggccctctgctctagctccctaaatagaacgacttcttcaggctaatgctgctttcaatcctgttcctgaaggcagggagggaggaggggcagcacctaggaaagcaagtttccagagattagcccaaacgactacaaatgaaaaaaagtaaatgcaagctttcctagcagaccattcagtttaaacaagccctatgacctgcctcagttgcttgacaacttcactcccaagtgggtatccctcccacctacaaactgctaataatcctgttactgcttactaataaaggttctcacagctgactttatcccgcctagactaagctctcagtcaccctgataacctgtgacaactgtactcagtttgtccctcttataagactctttttagccttggagatgaagggtcctcctagaatt

SEQ ID NO: 186749 - DNA, 235 bp, Homo sapiens
ccgctctgtctagggaaggaggggcgggtccctgcagaatgtgcctcctccgctctggctctgggactggctaggaggaggaacccttgcatcatttctggtgaggctgacaagactttggggtgagagttccttaggtgagtacatgggaatcaaagggccagtcattgtccccaccagggcaggaagcttgcttctccccaagcccattttgttcctgattttccatctcctc

SEQ ID NO: 186750 - DNA, 145 bp, Homo sapiens
tctggaacctcctttctctaaccttacccaagcctaaccttatccaagctgagctcttcaaaggcctttgcccttgggtaccacaggttctgagacaagagggctatggagagcccccattatagctggagcctcctgccctgcc

SEQ ID NO: 186751 - DNA, 1080 bp, Homo sapiens
ttacaggaatgagccaccacatccggccaacttgtcatttttgtaacagacataggatttccactgagaacaaatcagtgtaacagttgagtactactcactcgtgcaaagcatttgtttaaaataaactgatgtgtagataattttttcagaaagcctcctcaggaaagttctcaggagacataagtggagctggggagccttactgaaggtctgggtcacagacaggccttcccgcacagaggtctgagtgtgtgccctggtggtggttgacagtagcacagcagtcggtagctaattaagggagtttaagtggaggtgttctggttctgttctgcaccatcagatgcactgaaatgaaactacagccttggtttgtatcccaaatggactgctagtcagctttggtcttaacctttggaactgactgacttgtcatttgtggcattcctgagctgttgtaaaaactgtatcattctcccccagagaaaacagtaatactgataggcatgcagtgaaaactgagttgaagctaggtagtcacaattttgttattttcaaaagccaattggcatattactagatcagtagtttaaggatcaacttttttgattgttgaggccacaaattcaaactgttataagtaggcacaacaaatcttaggtcagcttgagaaagtattcagagaatatttctttgttttttgttttttcttttgagacagagtctcgctgtcacccaggctggagtgcagtggcacaatctcagctcactgcaacctccgcctcctgggttcaagcgattctcctgcttcagcctcccgagtagctgggactacaggcatgccccactacacctggctaatttttgtagttttggtagagatgaggtttcaccatgttggccaggctggtctcgaacccctaacctcaagtgatccacctgccttggcttcccaaagtgctgggattataggcgtgaaccaccactcccagccaaagaatatttcttcaggcagtggaaaaacatgtttgttgggtggtttccatgaaattgcaccatcatagacctgcccaggaa

SEQ ID NO: 186752 - DNA, 724 bp, Homo sapiens
taaaatattccaggaaaacagcttttattaaacaatagaaataagaaagaagattttgagatagtggaatatatagatacagtgtaaattaagacataactgagatcaacagatatgatttagaaagaaggataattgaagtattgctcagtaattcttaggctgaaaacaatgaaatgcaaataatatttatggctttagatatctcagtaccattgagtagaaacaattgtagctaatattgattgaacatctacaaatatgcagttactacttaaatgttgtactcgctgtttttaaattatctgcttctaaaagcaacaatagaaaggaatactattgttatctcagttttccatatgagcaagctatattactcagagtaaccagtgaaatgttgtaaaactaatgaaaggtttagatacaaacgaacttgaaaatttaacatgagaaagtaaaaacgtcctatgcatgttatctgtttttcatgaaatagaatattatacaaatatgtgccagtagataattcaaaacaatcagattacaaggtaccagtggaaaagaaagctgttttctgatcaagcctatgcttcaagtttttaatgaacctatttgattgcccatcccatttcaacaattatacttttaagtactgttggagtcacacaccaattatagactgctagatgctggctatggtaattactaatgtattccaccaacc

SEQ ID NO: 186753 - DNA, 545 bp, Homo sapiens
taaaatattccaggaaaacagcttttattaaacaatagaaataagaaagaagattttgagatagtggaatatatagatacagtgtaaattaagacataactgagatcaacagatatgatttagaaagaaggataattgaagtattgctcagtaattcttaggctgaaaacaatgaaatgcaaataatatttatggctttagatatctcagtaccattgagtagaaacaattgtagctaatattgattgaacatctacaaatatgcagttactacttaaatgttgtactcgctgtttttaaattatctgcttctaaaagcaacaatagaaaggaatactattgttatctcagttttccatatgagcaagctatattactcagagtaaccagtgaaatgttgtaaaactaatgaaaggctagggattctgctaaacatcctacaatgcacaggacagcacccatccccacaacaaagatttacctgagccaatgtaaatagtgctggcattaagaaatcctcttctatgtgattggatcttatgaag

SEQ ID NO: 186754 - DNA, 243 bp, Homo sapiens
aaacagagccgtgtaaagtgaaaagttgcatattcctcaaggttttaatttaactcgcattagattgaaccatttaaaactgccaatattcagctgtcatcgacccacaaaattggcaatttcaaacaggtcaccttaatataagtcaaaaccagatctcattccataatgaaatataaacaaagataggaacatgattaaaattattttggaggttttttttttttctatagcatcaaaagg

SEQ ID NO: 186755 - DNA, 653 bp, Homo sapiens
ttcagtgtcttggtgttcacaaggccccagcacatcgtctaggacgtgagacccacacgccgccctcagtctcctcagttcactgtttcccccggggaaacaaccgccagggcctgtaggaaaacacagcaaactagaaagtccagttggaagagatttcagatgtgctacagcctccacggcaggagtgaagctggacctccaggctcctgatgacactgaggattgtggagctgagtgacaccagccggcaggagaggccatggcaggaagtggagcctcccaccgaactccagggagcaccagcgactgagaggccacatggcgggcggctgtgggttgggggggctgcctgcccgcacactctttacggcagaagcagtgacatttcccttgctgtgcccatggcagggacgggcccgtggcaggtgctgtgagcatgtgcttgccaagttcctgatgcggagcccagccagcccagagggccacattcttgtcactgcttcttggagccgcagctcatgccaagttcctcacacccctctctgggctctaactttgtgctgcctcagatgttcagggtactttgcttcaagccatatcaaaagctggtttgaaaaataaagtcctacagaggtgctaactgaataagg

SEQ ID NO: 186756 - DNA, 543 bp, Homo sapiens
ctgggacccctgtccaggaacatgtaaggattcctgaagagatacacattgcttcattatcagataccttggtttaagtgccttggctggattctgataggtgtgtgtgtaacccgcaataccatagagcatgaagtgaaaaaaatggaaattccctgcgctatttggttcaggagatgcctaacggtactacatagtaaatgtcatgaaactactcaaaagcattggataggtttttagttcttgcttctagcaaaaaaataaaaatgtataaataaagtcacacttttttctatagattgggagcaacagaatatgagtggagtgaccatgtatgtcctggttggctcaggacaatcctaatttattcccattgtttcaatatgaatatttatagtgcccattcttaaaagggttctagtttgatcaagttaaacaatatagtcatgctaaatacggcttgagtttcacaatatacctgattggtttaacatatcatcaggtttcagatttagtcacttttaaaatgggtatgcttcctcc

SEQ ID NO: 186757 - DNA, 476 bp, Homo sapiens
tgtatgtatgtgtgtgtaagagagggggagagagagagggagagagagaaaaccacagcctttgaaatcaggcagattctgcttcaagccttggttgcctcattcataaaatgggcttgataataaatttgcttgtggaattgtggtaattatattaaatgagctgtccatatttattcattatgaaatcttgacatagatgctcaaagacaggagtgcttcaaaaaactttttgtgctgtggacccccttggaagtctggtgaaggcagtgaattcctttttgaaagagtgtttttcaaatacataaaaaataaatagagctaaaagggagccaattgtattgaaatatagttatcaaaatattagtaagcacatttgtgatacagtaatctatgtgttttattgatatattcaacaagatctggtgacagatctaataacagccataattttgaagcagagatgagcgtaaatg

SEQ ID NO: 186758 - DNA, 438 bp, Homo sapiens
ttggccaggctggtcttgaactcctaaccttgtgattcgcctgcctcggcctaccaaagtgctgggattacaggcgtgagccaccgcacccggccttttgagatcatatctcttacagcattgcttattcttcagagggaagtctgtaatattgttattgggttgttattactgttcttttccaaactataccccacataatgcttgtggcattcacagtctagctgggtttcccctggcaaaattatttcaatgcaatggttcattgacgggcggcactcctcaggcatcactgtgacattttgtgggcaggaatttagtggtactcttggcccatgtgtcccttcatctgggatgctgggatgtctcagactgaagggcagatggtggtggtggctccctggggggaggcttttggacaggaggtggctgggtgat

SEQ ID NO: 186759 - DNA, 530 bp, Homo sapiens
gtgtagtcccagctacctgggaggactagaggcaggagaatggcgagaacctgggaggcagagcttgcagtgagcagagatggcgtcactgcactccagcctgggcaactgagcaagactccatctcaaaaacaacaacaacaacaacaacaacaacaacaacaacaacaacaggatttgcctattatgttactctgttgattcagattctgttactgttactttatgatcatgtctctagagaaatctgatttgctttactctctctatggtaccaggctttgccagaatactgaaactgtttcaagtcctaggactcaggctaggacacaatgacgctctcaattgcactgaaccttggggcaaagaagagagtgaggcaagatagtggtcaagccaacagtgaggaagaatgaagagcgaattgcatgaacaccaccactccccgcagtgtgttcactgtgaggagtttgtgagaagggaaggaacctcaggtttatacttcaggattatataggtattcctagggt

SEQ ID NO: 186760 - DNA, 241 bp, Homo sapiens
gcaccaaggatatgacatcaattctaccccaaggcatctgccacgtctcatcacaaacactatccagtcataacctggcaggatggcgatgctcagatttgtccatatttggtccagccacctagcctgctcattggcggggtggcctatagcattctacagcacccgtcatgcgtgacgtcaggagagacactgcttcaggcctggtgaggcccatgggtcacattcaactccatgcctg

SEQ ID NO: 186761 - DNA, 400 bp, Homo sapiens
atttagtccacatcaccgttctgccaaaacacaagtgttttattgtgttttccctcagcccaggaagctggggctgtggaagcccaaaacacagatgaatgctcccagttctgtggcccgagcaacgaagcccagctgcctcacctgggggaagctgaaggagatagacagcaggacctcccagcccagtgagccacaagtcccagccctgcacacagtccccggaacatgcatgaagaagctgaggccatcacctgcggtctgccccgccagctccctctgcctctcggcacatccccaagcccatggcggctggctgcctgactctcgcttgcgccaggcaagaggagaaactgaaaactgctgggaaatcagcatcatctacattccagagacaaaa

SEQ ID NO: 186762 - DNA, 290 bp, Homo sapiens
tatccacaatcttccgctcccaagatgtgacctctccctctctgtgttcctttctctccatcagtatctcctggctatggtcatagcgtatttcagccgggccggcctcccctcctggcaataccaacgcattcatttcttcctggctctgtgagtggtttgctgcctcctatccgtcaatatccaatgccctgggacagcgggggaagtgggattccagcctttcatttattctttcacctatttgtcctctttactctgtgtacaaaaaagacaggattatagtctcg

SEQ ID NO: 186763 - DNA, 562 bp, Homo sapiens
ggaaaacactctgggttttaaacagcagcacctataattatggaggcgtcatcccttccataaaaaaagaaaacaaaacaaagaaagcaaagcccttctactaacaaggtgtagtcatagcatgtgttcagccttttcaaaacctgtctggcatttgtttctggcctggtggagagtatcttccatctttctctgagctctcataaaacaatacaaaggtaaacaattggagggcaattagcagtctctttggggtaacaggagagagaagtcaccggactattaatgtcaaaggaattaattatggtttgcataggtgattgagtgacttaactttgcaaatggttgaaaaataaggaaccaacgaagtttataaaagatgccagtttggagaatcatgtatggcagacttacaggactacctgtgaaatagtttaaggctatcaagatattgagatgcagcctgttgtataaggggccacatgtactatagatcacctttgtccaacttgaatgtgtgtgagacttggctgggtgatttttttaaaatacagatatttga

SEQ ID NO: 186764 - DNA, 246 bp, Homo sapiens
gcctccaacagagacacaaatcaaaacatatcacctggtaacaaacagatatcaggatttacgtaatttcaggcactgggctaccttcttttgaggatacaatgatgaataggacatagttcctgtcctcaatttaccatttattagaggaaataaaccaataaattttaaatcacaacacaatataataagtgctgcagagaattatgttccacatcccacagttgttaagccacttcttttttt

SEQ ID NO: 186765 - DNA, 529 bp, Homo sapiens
ccagggagagacaggttaagaggccattgccatagttcaggcaaggaatgatgacctgaactagggcagaaacaaagggaatggagaggaatagccatgtctgagaaatgttttgagaacttggtgaccaaactggatatggaaggtgaggaagatacaggagagaaggggacaggatgaatagagaggacaacatctaaggtagggagcagtagcaggcttggtggggtggcaggagtagagaaaaggagttcaatgttgaccttaagcttaaagagtctataagataccccaggaaagacagatgttccagtgaacattggagtatggtttagagctcatgaaagatggtcaggactggagatttgaatctcattagcacaagggtgcaaactaaaggcttatagtatgttgtattatattgcccagaaagagcagacaggtcaagtgaagggaggagaatgaaatcctgtgccaaaccaacatttaggcacaagaggaaccagtgaggaggggagagggtggtagg

SEQ ID NO: 186766 - DNA, 628 bp, Homo sapiens
gttttattttgtactctggttcaataatctttttttctgttgtatctcatctgctattaatcccatcacatatactatttatctcacatgtagttttaatctctaaaagtttaatttggttcttttaaaaatatgtatttcatgactctacttaactttttgaacgtatggaatgatgttacaataactgttttcatgtacttgtatgctaattctaacatctgttttatgttagagtcacttttgattgataaaattttgtcctcattatgggtaatttttcttccttatgccttataatctttgattgaatataaaacattgtgagttttacctaggtgtgcattgaggtttttttatgacaaatacatttttgagctttgttctgggatgcagctaaattacttagaaacagctttaacttttgagataatgcttttaaccctttctaaggaatgactggagttgggctaagatacttcatatttgaggcaagattcttctgtgtactctaccaaatgcccaatgactcatgaggttttctaggtggtctcatgggaaaaggtacaatttttggcaccttgtgagcaccaagcactcttccctttaatcctttcacattggtcag

SEQ ID NO: 186767 - DNA, 1834 bp, Homo sapiens
atgaacccatgattcagatctctaaatttataggtctttgttcaaaggtgttgggacctagaaatctattttccaaactttattcacggtttcctgtgtccactgggcaagagaaagggacttaactgggtctaaagtgaaatactcatttgaaccactctttagaactatagagttcaaagatgttatgtgtcaagttagcactgtgcttcctttggctgttttcattcagcatataggaaccttatgttcttagaatatgcttatgttcttagagtatttctctgtgttatttatacttttaccaattatgagctatataattcttttccatttgcagtaaacttatattgtagacagtccacgctgtaaaattatgtagaatctcaaagttaatgagcatggttttgtgctggcaagagaagtcttttgttatgcattttctaaatcttatttttgtgtgtgaacatatttaaaaaaacaaagatcacttaccctaaaatctaagcctcagtaggaacgtgcttttggccctttttatttccattgaaatatacttaaattatctctaggtaaagtgtttcagatgtttttgatgctgtgattgttctagactttataactttccaaagaaaatgtgtcatgttcaaaatccaggtttttttttttctttttaaagaactttgaaccaaaatgtatatttccctgtggtaaatattttaatattttgctttcctcatcaaatgctgaggtttcatatagtccggtatctccagcttgataataggagagttctccctcatttggagttgattatgtccatggcctttggaaagcaatgcttgtagtttactgaatcacaaatactagggaatatatttgaggggcctacttagagtctttttctagtgcagaaacatctgtagtgtaaaaactttgccacaaacagaatctgccttaactatgagacttgtgctccacttgtattctcaggcaagctcttggcagagtcagtgcaactctttatgatgatagagactgaaaatggaaagaaagacagacttctgtgaccatagtcactcttccttcatggagcccacagcgcactaaagtgaaatctggagaacttgctgttagtagtaagcatggtattagattagaattataggcctgttctctgctttctgtcttcctcctcttactataaaaccgtacatagtttttctaatcattgtatcttacattaaatttatattgaacaattcaaaaaccaaaacaacaagctttccttggaagttttctgtgagattggaaaatgttgtcttgcctttgagccacattgttgctggacagtcagggccacagtcaccctaggctttgaattcctgcagacatcccctggcaaggagggctttgtgcattttgagctttcctagattcctttcattgtgagggccaggattcttagggtgttttctttcagttagcaataacagatactgctgtctgtccactcctccccagctgctggggaaactaggatgcctagtgacttattcttgaatgttgctctttatcacaatcctgttttttctcctttgatagccttcatattgcttaccattttaatctaattgactgtccttgggaaaagatgagagtatgctaagactttgatcttgctttcagaaagggatcatttatctttgcattccccagatacccagtgtactctgtccctggcagattaagcttgataaatggcaaataaagtcgggaggcattttgaatgtaattagccataccatgatatactgtaaagtgctgcagctgt

SEQ ID NO: 186768 - DNA, 2023 bp, Homo sapiens
atgtctttgtgcatatgttagagtttttttggagtatatactaggagaagaattggtgggttgtagggatgttgtccttcaaatatttctgcctgtagtatatgtgagttccagctgttccatatccttgttttattttgacagaatttaatttttttagcccatctgataagtatgaagtggtatcctgttgtttaatttgcatctccctgatttgtgatgagattgagaatattttcatatgctcttctacaaattacttgttaatgtcttttgccagttaaaaaaaattaggttgactttcgcgtattgatttttttcataaatcctagatatgaattctaagttgtatgcattgtacatattctttttattgatctgtgacttttctttgtactttttaaattacctctcttgatgaacagatatttctaattttaatgtaattaaatttgttagtcgtttttttatagtttgtaatacttgtcctgaagtgtatttttctttacctagatgttgtgaagaaatacttgtctattttcttcaaaaagttgtaaagttctgcttttcatatttagttctttaatctgctctgtatagtacaaggtggtaatcctttgtttctgtgtgtgtacgtgtgtatgtatttattgattcaaaataattgataaccagctatcctgataccattgattgaatagtctatacttcatccacttgcttgtaatgccacttgtctcaaagatttttcctgcatagtagttccaatgttctccctgtcttttcctgcttcaattgccctttcaataagcttggatctctatttaggaaaggccctttaccttggtaagggttttcaaaaatttcttggctatttctggcctccttttttcatattttagaattaattttttatatgtacaaatacacatacatacttttttcaggaagttgtttgttttatcttatgttttcagatttactgatgtaaaattttttttttatattcttcctttcttccccccacatttcttatttggctggatttgtagttatgctgctctgtaattttttatttatttttgctttctcccttttttttttaattgatcagtctcaccatagatttgtctatttttattaatttttttttttaaagaaccagcttttggttttgttgaatctgtctttgttttctattttctctatttctgctgtttgctttttaatttattggtgtgatgtggaaattgattagatatgggtgagatagggttgaatgaaagattactccaaagtttctttggtagggaccaggtagatggtggtatttaccagctgaagtggaaatagttggaggcaatttgaggggaagatgtgtagtacttctcagcaaatgcaaaagaactgaaatcataataaacagtctcttagatcacagtctagtcaaattagaattcaagattaagaaacacactcaaaaccacaactacatggaaattgaacagcctgctcctgaatgactcctgggtaaataatgaaattaaggcagaaataaagaagtcctttgaaactaatgagaacagagacaacatgtgagaatctctgggactcagctaaagcagtgttaagaatgaaatttatagcaataagtgcccacatcaaaaagctagaaagatctcaaattgacaacctaacatcacaactaagagaactagataaccaagagcaaacaaaccccaaagctagcagaagacaagaaataaccaagatcagagcagacctgaagaagacagagacatgaaaaactcttcaaaaaatcaatgaatccaggagcggtttttttttttttaaactaataaaatagactggtagctaaactaataaagaagaagacagaagaatcaaatagacacaatcagaaataataaggggaatatcaccactgactccacagaaatacaaacaaccatcagagaatactgtaaacacctctatgcacataaactagaaaatctagaag

SEQ ID NO: 186769 - DNA, 796 bp, Homo sapiens
gattgaatatagaatgtggcaaaattatcccaccatattacaaatgtacgaaacaagctcactgatgggcataggagtaaaggtgctgacctaagtaactttgacaatgagtggaatctatgagactaaaggctgaaagaagcacacagaagcactgcactgtggctgataaagttgctgcccaacaggtatgtggattaatgattctgaaacccctatacatgtatactagaattgaacaaaaactaaattaatttaatgtatatgcatgtagaattacaaatatattttcttgctctgtcagcagagggggcctagaagcaatgatattctgggagcagagagcctacctagcccccagattttggtttctgataattattctctaataaaatgaaccaaggttctttggagaagcgactgattgtagaatgaggacaggaaatattcgagatgaacttggagtaatttgtgctgcaagaaaataagaaagtgccaaaaagtagttgaaaaccccacaatgatggggtataccaaagaacgtaggaagtaactgaaagggttcccagtgaaagaagcattggattataaacatatgaaataaaaattcacaaactcatactgatatagaaaattatggaatacaaactatccatctgggaacagatatacacaatggaatattaaaatgaagtcctgtaacttgtagcaacataaatggaactggaagtcattatgttaagtgaaataagccaggtacaaacaaatatggcacgttctcattcatatgtggaag

SEQ ID NO: 186770 - DNA, 729 bp, Homo sapiens
ggtgtctagaggtctcgattgcattgtcttccaactgaaagggactttagcaattacgtaatccaaatacctgcccccatgcaagaatccttctattacatctctgacaaatcacatagtctccacttggatacaaggtctgacagggacctcattactttgctataatgtctactttattactggacagctttaactgttagaaaatgcttttctaaactaaaacaaaagctatcaccagcctcacaccccaactataactttcacataccggttttgattctgttctccaggacaataaaatctacttcccaaggatgatggaattttcatgcaaaattgttagacaaagcatttctttacataaacatttgttgtagatcagcatcatgatgttgttatgagccaaacagtggccttattttacaaaatcctgtcttatatcagtacttgcttgtacctatattcattcataaatatttgtgctgacctcattgtataaacttaacaggctgaataaattatgttgttcaaaattcgcttctgctatctttgcctctcacccctacttccacttccagaccatcttgaagtaatgacgcagtcaagaataaaaactaacaagttaatattagttaagcacttctaaaaacactcttactcggccaggcacagtggctcacgactgtaatcccagcactttgggaggccgaggcaggtggatcgcaa

SEQ ID NO: 186771 - DNA, 392 bp, Homo sapiens
ctggtgtaagtccaagagtccaaaagctgaagaacttggagtctgatgttcaagtgcaggaagcattcagcacgggaggagaaagatggaagctggaaaattcagcaagtctgctcttccactttcttctgcctgctttattctagccgtgttggtagctgattaggtgatgcccacccagatttagggtaggtctgcctcttccagtccactgactcaaatgttaatctcctttggcaacaccctcacggatacacccacgatcaatactttgcatccttcaatccaatcaagttgacactcaatattaaccattacactgatcattattgaaatgaggtgaataatctgtgggcacacattgcattaagcagacaatgtcttttaagtta

SEQ ID NO: 186772 - DNA, 222 bp, Homo sapiens
caagctcttgttgagaaaatccctgttgaaacttctcagtgtcaaaagcccaggtatcacaggatagagtagcaatcagcaaccaaaccatgactgtatgtggagatgacatattcagccccagataatgtattcacatgagtgaagggtggagtcattgcctgtcagattctacagtcatttggattagagagggcaatacagagttaggtgctactgaat

SEQ ID NO: 186773 - DNA, 219 bp, Homo sapiens
cccaaagtgttgggattacaggcataagccaccacgcccagcctaataattgttttaagccacagaattttgggataatttgttactaagaatagaaaatgaataccccaggcatcattatgcttatgttatgatttggcttgttttataacttttcctatgggaacacataatcagaatattctaatatagtatatggggaatagtttctcatcctga

SEQ ID NO: 186774 - DNA, 439 bp, Homo sapiens
acaaaggccatgatgagagtcaatggagatgatgacagtgttgcggccttgagcttcctctatgattactacatgggtcccaaggagaagcggatattgtcctccagcactgggggcaggaatgaccaaggaaagaggtactaccatggcatggaatatgagacggacctcactccccttgaaagccccacacacctcatgaaattcctgacagagaacgtgtctggaaccccagagtacccagatttgctcaagaagaataacctgatgagcttggagggggccttgcccacccctggcaaggcagctcccctccctgcaggccccagcaagctggaggccggctctgtggacagctacctgttacccaccactgatatgtatgataatggctccctcaactccttgtttgagagcattcatggggtgccgcccacac

SEQ ID NO: 186775 - DNA, 418 bp, Homo sapiens
tagccggaccgaacctttaatgcctgcttaggaactagaggctgaatagcgggaggtagacagagaggaagagtgatccgctaccagtcccatctgtctctgggaatgcctcagggtgttgaggatttgtgggggcagaggctgggcagctagtggacagtttggtgggcatagggaccccactcatgtaggatctcacgagggtggcatttaagtggcttggaaggagcactggagtaggagtcaggtggtaagtccgagtcctggccttcccaccttcctttctccaggcctgttttctcatctgtttaatggggaaaacatccttgccctatcatctctttaggaaggtatcagcggcaggtggatctgtgcgggaaagctctgtggaagtggggagctcagggagggagagaaa

SEQ ID NO: 186776 - DNA, 133 bp, Homo sapiens
gagaaggagggacaagagctagtaatttatgggatctagagaagggaggggggtcaagatggagacccacacccaggttctgactttagagatgaggcctctttgtcatctgcaggatgaagaactcacatct

SEQ ID NO: 186777 - DNA, 357 bp, Homo sapiens
agtgagccctgagtcaggtctggaaaattacaaatcatcccctcaaaaaaaaaaaagcaaacattgatccaactttcaactcttccatgttcttaaaaagccaacaatatcaccagtgaaatcagcgaccggtacaggaagagggaagagcttcatcgttacagtaactctagaagtcatggtagaatctactccaactgtaagaaaagtctttgcttttgaaatgctatactttccacaaaggctggctctcaaggataggtactgtcagggactggttttacaaggatgaaatagctccaagaaaaagataaaatttaatcagctcagcttttacattcccgatagtagacacta

SEQ ID NO: 186778 - DNA, 561 bp, Homo sapiens
ggagcctttatcatggttttcagaggaagtgataggcaaggtaaggtaagcaaacagcaggcttcggagtgtgtagtttgaattattctgatgggctaggatacaagagtggtctctagttgtctggtacctggccctggggtgatttagggcaggggaaagaaaatatcccagactgcaggagcctgctgaaaggaagcaggtgggggcatggaatagggaatggtttggtttgcatatcaaaggcagacttgcaggccagttgtttactttctctaggaattagccctgggagagagttatttggatggatatatttgcctatctgagtggctaaaataaaaaaatagtgactatgtagcaggaagagccacagacaaaactcctcagacaccgagttaaagaaggaaggggtttattcggctgggagcatcggcaagactcctgtctcaagagctgagctacctgagtgagcagttcctgtcctgttaagggctcacaactctaagggggtctgcatgagagggtcctgactgattgagcaagcagggggtacgtgac

SEQ ID NO: 186779 - DNA, 591 bp, Homo sapiens
cccggggaaggcatcagggactccctttgccctcccactgacctccctgcaaacctcccccaaaccaaggggcatcctcagctggccagaccctgggggaagggagagagccgaggatcaccggcacctgtggctgggttacccctgccatggaccactgggtgatcaagaagtcattccaaaatgtgaagcgttctgaagatatgcacatagcgtaagaacctggtgtaatgtgctggtcaaggcggtctcagagaggagatgacgtttgagctgacacctgagggatgagaagaaagcagccattcccagggcccaggggaggcatcccaggaagccggatcagcatgagcaaaagccctgaggcctggcacaagttggtctgcttgagaagcaggagagagccctgagcatccggagtgcagcaagcgagatgagcaagtcaagatgcagaaggactctctggcttctccaaggtcacacggctgttaggagcagagcagcgtcctggtgcccaagccctgaggtccccagcacactgcctctgcaatggccacaactgtccaaagactaagctgactctcatacctg

SEQ ID NO: 186780 - DNA, 221 bp, Homo sapiens
atcagctcggtccgggattggagagagaagggggagtggagagagaaggcctaagtttgcagaataaaatgtgtgagtcctgtataccatgacagggaattaaaactaggtgtagagatattaacttgagaaaaaataggtggatctatgacttgagggacttgaacatttagaggacatgacacattgcacactggctgcattcattctcctctccatct

SEQ ID NO: 186781 - DNA, 338 bp, Homo sapiens
gccaggatgtgggtgtaggagaccgtggttgcctgcagggaagccgcaaggatcacctgggctgcctgagtccgcatttctatggtagtggtgctggagcaagagagccctagcgggggtgggatatcacagaagtggttgaggacatcggggctgcggagcctcaggctggagttgagagccgtggacacaaaggaggctgggaagctgctgagctgggcgctgatggccaggtgcaggcagagccagctgcatggagtccatgatgggctgggtagtgcagcaggtggcagatgaccgggtgccagtcacagtccatgttggccgggaggatgcac

SEQ ID NO: 186782 - DNA, 380 bp, Homo sapiens
ggcgggtatcatatatagatatggtaaacaaagggataattcatatcttgccctggatggtgcatgatggcacaagatttcatcactactcagaacagcatgcaatttcaaacttacaaattatttctggaattttccatttaatatttttggactgtagttgactgtgggtaactgaaattgcagaaggcaaagccttgtgtaagggaaaaccgttgtagttgtcactgaattctaacaacttactgacctgaagacagccaaaatcacctgggatatgagaaaattttctcaaagaaacacatatatcaatctatattctgatgtttgtttgtttgttgagatggagtctgtcacccatgctggagtgcagtggcaca

SEQ ID NO: 186783 - DNA, 316 bp, Homo sapiens
cccgcttcggccctccaaagtgttgggattacaggcgtgagccaccgcgcctggctggctaatggattaattctaactttgacatagaattaacatttctgttatttgaacaaggaaggactcttaatctggtttattctagatctgtgatcctgtggtcatttagtaggtgtggagaactattaaccgtttttgagcagtgtgattatgagttaaatgataccagatgattggaaatggttaaatgtcagatgcttaaatggagtcagatggtaggagctagccacaatgtaaaacacaaattggagatgaagag

SEQ ID NO: 186784 - DNA, 332 bp, Homo sapiens
ccgcctcagcttcctaaagtgttgggattataggtgtgagccactgtgccaagccaggattgtcttaataagtgagaacacatctgtaaaaaacctactgtatattgaaaatatgtttttaaggtcacattaatatatattgaccttcacatcctacaaacaagttacaccttctttatagatgtttcacgcacccttaaaaaattgacatagtactcagccacaggacaaaaaaatcaggctccttaatgtcttcaagttagtatgaactaaaatcttcatccactcttaagagaaagtaataaaagtgtaaatgctatgtcttgattggg

SEQ ID NO: 186785 - DNA, 320 bp, Homo sapiens
taaaaagtacagccaccccaaaagggcctctgaggactagatcatgcagtcactgtgtatggggggatggtatgtttattgcatctccaccagcacccccagatccatggttaagagagctgaccggagcaggaacaggagactttgtcaccctctgactcctggtggccaggggcacagtgaaaagggtaggcagcttgcaggaagcaagccttatttgggcttttttttcccagcatgttgcttttgaaaactccagccagtcctctctttgcaccacagtgcagggcttccaaaatgactacacattgaaactgtgt

SEQ ID NO: 186786 - DNA, 335 bp, Homo sapiens
gacccccattgtgtgcggtgactcttttctgtgactcttaagtgtgttgcaggcctgactgtgtgtccctgactgtagcggtgtgggggcttgtgtgggactgtgatgtgtgtagggtctcctgacatgtctctctctgtttggcctggggtgggggtggggacttgtttgatctgtttggtgtctctgacaggctatgagcccactgtgtgtgagtatgcagtgacatgtgttgtgtgtgttggacacctgtctgaacaagggggcccctcttgtttactgcaaagtggcgcccagcacagcgcctggaagtcggcaggtgctcggtcttcact

SEQ ID NO: 186787 - DNA, 649 bp, Homo sapiens
ccaacgcgtgggatagacgcagagaaatctgaaccttcatgcattactggtgggactgtaaaatgctgtagcaattttggaaaaacagtttagcagtttctttaaaagtttaggccaggcgcggtggctcacgcctgtaatcccagcactttgggaggctggggcgggctgatcacctgaggtcgggagttcgagaccagcaaggcaaatctatcatagtcagatatttcaatatgctactctcaataactgataaaacaagcagacagaaaatcagcaaggacatagtatacatacatacacagaatatcaataatatcaacaaaatacatagaaaaatacatagaaaaatacatagaaaaacacatagaaaaatacatagaaaaatacgtagaaaaacaataatatcaacaaaattgacctgatttataaaatattgtacacaacaaaattcacattcttctcaagtgcacacaaactcttcccgaaaattgaagagagaatttttcccaattcactcattctatgaggacagcattaccttgatagcaaaactagacaaagacattacaagaaaagaaaatttcatgccaatatccttcacgaacagggatgcagaaattcccaaaaaaactttagcaaactgaag

SEQ ID NO: 186788 - DNA, 380 bp, Homo sapiens
caaattcatatggacttacgaagaaacccaataaccaaaacattcttgaaaaaggacaaaagttaggagatccaatttcaaaacgtaatacaaagctatagtaatcagaatagcatggtgttggcataaggatagacatattaaccaatggaatagagtcgtaaatcctaaaataaatctctacctctataaccaattgttttttgacaagggtatcaagtccattcaatggggaaggaatcatctcttcaacaaatggtgcttggacaacaggatatccacatgcaaaagaattaagttgcacccctacttcacaccatatacaaaaaaattaactgacaataaatcaacaatctacatataagagctaaaaccataac

SEQ ID NO: 186789 - DNA, 433 bp, Homo sapiens
ataggcttgacctgtacttctagggacctgtggtgggcagttgggttgtccactcttctcctctggctctgacacctggaatagagacacatggccttatttgtcactgacacctttcccttctccttcttttacactctggagcctccattgttgagggcgaggaaacaagattggagttagagggcttactatgctgggtgtgactttcatcctctgtctgttgggtctacctggtcaagcccaggcaacttctgaagatccatttgatgtaccagatatgcacatatacttgcaacaccctatcttatgcttcaggcttctcctctgctgtcctccacccctgctctactgtctctgccttgccatctgtctctacttctctttctggctcagtttctcactcagccaggcagaggggaatatcaaccaa

SEQ ID NO: 186790 - DNA, 265 bp, Homo sapiens
tgtggtaacaatttaactgtgatctagaggaacagaaggagtgattcaaaaggaaaaccttgtaggcagatgactgtgagcacaacagccccgggcagggggaaagctcaacctacacactcccagaaagctgatgtgtctggagctaggcaggatgtagccaggtgtgaacttgcagagcatgataagaagtgtgaattttattccatttgcaataaaaggccattagagtgtttcaagtgagacgtgatgaatacattttaaa

SEQ ID NO: 186791 - DNA, 174 bp, Homo sapiens
aaagaatattaacaaatcacaggatctaggatcacaggaaacttacatggctctcctgtttaatcttcaaacttccttctaaagctgttaggatgttaggaggggcacaggaaggggggcactctaactgtatcctgatcctgcattagcatttcagaggccgttggttccatc

SEQ ID NO: 186792 - DNA, 376 bp, Homo sapiens
gtcacatcccagtgaaggtcaccagcaaactgtccctcctgtctcttgccctcccaagatgagaacacaatggacacaaaatcaatttcacgggtgccacagaatgaaaaatatcagatggcaccttaagataggcattatttcatgaggcaaatacaggtatgtactatggactggatcatgagatgtatttttactgctgtaagagacaaatgattaaaaagtagacaagcacactagactatgtgactcacagcaatgaccaacaatcttacaagtacatgtgaagcagcaatgctgcagggactatcccaagccttgctgaaaaaggatgttcctgcagctccctgaaagtcaggtcctgctggagattaaa

SEQ ID NO: 186793 - DNA, 260 bp, Homo sapiens
acctcttcaagatgctttactgagaaggaaaggcaagagtagtagctcttctttccctccccactttcttgctcaatggatgggtgggtgagaaccaaacatgttttgcatgttctcactgaagaagagttactttggggaggggctaatgatatagaagagagacagaaaatacagcctagacatggaggaaggacgggaagagaaacagacagggtggagtggagaaagcgcagctgagacagttcacgttggaataa

SEQ ID NO: 186794 - DNA, 390 bp, Homo sapiens
agccctcacttgacaactgaacctgccagagccttgatcttggattttccagcctccagaactgtaggaaaataaaattttgtataaacacctgctctcaagtattctgttacagcagcccaaatgaactgaaacaccatccttgcattagccttcctcaaagccatggatcttaggtgatatcaagttcacatgaagacaagagacatatgacatcaattagaagggaataagaaaaagggacaggccatcagcaaggggcacctctgtctggccacacaggattgcacacagaattgaccacacccttggaaattgtcatctctgggaaatggaggctcccagaggctaaaggaatggtctatagtcacataccctaagtggctgagc

SEQ ID NO: 186795 - DNA, 393 bp, Homo sapiens
tcgcagttacgggcacagataagttactctctgaacctcagctatctatagaaaatggggataataattcctgcctaattcaaatcaagaggttataggtagatcaaatgaatatttactaaagtgcttaactacatgtaaaatagtatacaaatgaagatgttactaataacaaagatcagaacactaaaagatcactgatacatgaaaaaactcaaagttatatgaaacttcctagaatactatttgaattcatgagacaaaaaactcaattacagtagttgtatctggagcttatgttattgccaaatattcaacagaatacttagtaggggtctattatgtgcaggcaaggtattaaatgctagaaacgcaaagatgtggcatcaaaac

SEQ ID NO: 186796 - DNA, 705 bp, Homo sapiens
atctggcctcagctgaccctggcttgtggttttcaagaacttaggaaaagaaaacccagcttggggagctgggcagagagcaggagtcccagcctggtggggctgcattagagtcaggtccctgcaatcccaccagggattccacgggtgctctcctgctgtcctctaatgcccaggagctcatggcggggtctgctttacttctaaggagactgaggcagaactgcaagcatctgccctatttgatgcacagagagagtgcaacttactggacttattgcaggagtcgcatccaacaagagagcggtttgccaccaaaacaaagctgcgcgcggctgagggcaggaaggcgctgagaccgagaagaagggacgtcccggagaaagtgcgcccagctgatcttagaaaccagagtcctccgggacttcgccgagattttctgtagggcgttttaatctgttttcctactgcgtgccggcgtcgcagcgcgtgcggctcagggcttggtgactccggcttagcccggcggtcgcggcgaggttcctggcgcagccgcttggaacttcgcattagaatcgggaccgcgcaaatgccctggctgaagtgtcaccctattcaagaaacactgctgtcaggaacaaaatggggtccccggtgctccgaagtatcttctgaaattttcttaaaacaacttacaaaaaatgt

SEQ ID NO: 186797 - DNA, 291 bp, Homo sapiens
ctgagctttaccaggcaagaactcagtagaggactgtgttgtccccagggacatggcctcgggctgccagaagccatattaaagtttggtcaagtctctttggaatggaatgttcttgctgagagtccttgcgtttctcaggacatacgacattttgtttattcattcatgagttgctggacatttgggttggttctcctttttgctattacgaataatattgctgtaaacatttgtgtatagggttttgggtgaacatgttttcagttgtctcaaatagatatcttggag

SEQ ID NO: 186798 - DNA, 287 bp, Homo sapiens
  misc_feature (17)..(18): n is a, c, g, or t
gtggtgatctagaggannccacaagctgactcttcccaaataaattactttcctgaaaacaaagtttacaaagtaaaattcttctctataatcaacatcctatatagaaaatttaaagtaatctttaaaaagctattcataacaaataatgaagtacataaatactatcttgtggttttaaatatctaacattagtttaatatattacagtaaatttcttggtaatgcagtgaattaaaagtagaaaactgggccaggcgtggtggctcacgcctgtaagcctagca

SEQ ID NO: 186799 - DNA, 846 bp, Homo sapiens
cacatatacccacagacacacacagactgactaccaactgagagggcctaggagcaacctaatagcaacaaacacatttaatgattcaaaatatcactctccactaaaaggaaccagagctccttagaacaatgcgagggcttggacaggaaagtttaagaggagcttggaatatcttcttgaggtgctcaatgaatgacagagacatgtcaaaataatacaggggccagagtgaaagactgaggcaggctacatttgagaaaattagaatatcaaactaaataatgataataatggataacggtagcaggcaaactctaacatgccccccgatgtttcccaccgcttggtatgcatgcccttggtaaaggtgatgtgatgccattttcctaattaggttaagactgcaacttccatcttgctaacagactctattgccttcttggtttgcacgctttgatgaaacaagcagtcatactgtagatgtccccatggcacagacctggcggtgacccagtcaacaaacaactaagaattgaggctcagtccaacagcccttgaagaaaagaattccaccaccaccaacaacaataagcttggaagtggctttttctcgaaataaaaccttcaaatgagacctcagccctagacaccaccttgattatggccttgtgagagagattctaaagcagaaggcccaggtcagctgtgcccagactcctgattgaaagaaactgtgaggtactggccagacgaagtggttcacacctgtaatcccagcactttgggaggccgacgtgggtggatcgcctgaggtcaggagttcgagaccagcctggtcaacat

SEQ ID NO: 186800 - DNA, 396 bp, Homo sapiens
agtacaaaatcttgaaaaaaagtcagagtatggatacctttcaaagacatagtgaaaacatcaacccaatgatgaaatttatctggagtctccacttaaaattttttaaaaaatacatggaacttgatggttgggtgcagtggctcacacctgtaatcccagcattttgggagactgaggcaagaaaatcgcttgaggccaggagttcgagaccagccttaccaacatactgagactccccccccatctctaaacatatttaaaaagtaaaaaaatttaaaatgaaaaagaaatggaacttggtataagtgcccaagaaggttgttttgatgtctactgaagctgaacatatgcctaccctatgatcttacaattccattcttggttatacattct

SEQ ID NO: 186801 - DNA, 188 bp, Homo sapiens
ataagaaggaaagagaatagaactggtttatataaacagagcacaggtgattctgtagggccagaagcaattggtcttggacaacacacacacatacacatacacacacacacacacacacacacacactcactatgcaaatagctgcagtaaccacttcataaggtattccatggccaggcgcggtg

SEQ ID NO: 186802 - DNA, 395 bp, Homo sapiens
acaaccagtgtgaatgtacttaatgccactgaccagcacatttaaatatggttaagatggtaaatgctacgtcatgtatattttaccagaactctacaaaataaaagaaagcccaatagaggtgtcatcatacttgatactgaaattgaactccttccccctaagattaagaacaaggtgagaacatcactctcaccatttctatctatcattgtactggaaatcttagccagtgcaataagaaaaataaataagtcataaacatcaaaaaggaagaagtaaactctctttattcacagatgtacacataaaaagtcccaagaaatttattttttaaagttactagaactaacaaatttaacaatgtcacaagatacaaatacataaaaatcaac

SEQ ID NO: 186803 - DNA, 402 bp, Homo sapiens
gactgcaatgaggcaagattgctccactgcgctccagcctgggtgacacagcgagaccttgtctccaaaataaaaaacaaaaacaaaacaagaaacaatactttttgagtacccatcaggtgatatattctactaggtgccttatgcatattaatcaccaaatctctatgaggaggttttattaacatcatcattccatttctgcagatgaggaaatgcatctctcaccaggggtaacacagctacaaagtggtccaggcaggattcaaagctgagtggtctggtcctgagtttgtgatctaaacccataggctgcgcttcttccttgggtggacattgactgtaaagttacctgcatgtggatttcataggagaggaagaaggaagaaatgccagtaaaag

SEQ ID NO: 186804 - DNA, 399 bp, Homo sapiens
gtggtacgtactgttgatcactaaatggaaaagaggattttaaaaaattattgagcagttctgggccttaggatatgtttctcttgttatgcttggtcttcatttgttccatgccagtaatggaaaataaagtaaacatctgcagaagctaaaatcaaaactactccaataggtgaataaatatttcttcagaaattgaagtgtaaattttcattcttattatacacggcttctccaggaaataggagtgtccaatttgggacaacatgaaaatatcattcttcattttcattaatttactttttactagtctgttaactacacctattccatttgcctctaaacatgcactgtgtattttaagaataaataatgcttaggacaaataattactagctg

SEQ ID NO: 186805 - DNA, 172 bp, Homo sapiens
ccaggagactgccaggcctgtggtggggcccgggagcttcacaggaagctgacacaggctcttacccaactcagcttcctgccccacagtgccaacggcggctggagctccaacggctgccgcctgaccccccaagtgacctcatgaccccacaccccttatctcatctcac

SEQ ID NO: 186806 - DNA, 457 bp, Homo sapiens
ccagttcatcctgcacatgcatgctagtgtcaacaaacaacttgtcttttctagaatacaccatgttttttcaaacctccattactattccttgtccccctacagaatcagtcttcaacaactagttcaaatgtcactaccgctgtagggcattctctgaccctctcagagagcatcgttgccccttccttcatcatcccatgacacttcttgcatgccttcgacatagtgcatttctcatcatgtgtaagtctatgttattcatatgtccaccttcttccaccagaaggtgagttctgtgaggacagggactgcattttattcatttcactcatccttgcatctaggctagcactcagtgtgctccttaaaaagttagaaaaaatgagatacagagaaaaaagatgaaggatgctaaagtcagagaaattaagagatttgctcaagatcacccaaa

SEQ ID NO: 186807 - DNA, 174 bp, Homo sapiens
ctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcag

SEQ ID NO: 186808 - DNA, 230 bp, Homo sapiens
gcctggagaagaaccttgggacttctttagaagttccttttagagatgattggtgtgatgatatttctcgtatttctcgctactccattggcctccctgggagggcgaaatacactttggctagccctaaatgaggagaaaaccgaattcatctaagtgctactcaccgtatctttaaaaagttgaaccccaagttaatcctaattaatgcccagagatttttcatgtgg

SEQ ID NO: 186809 - DNA, 395 bp, Homo sapiens
acgttgacacttcaggaataatatttcaaggaaacagtgggtaatgttgctgaacgatcaacaataatacctaatacatcgctttatcatccagacaggaggtacagtggtacaatcatagctcaccgcagcctcaaacctctgagctaaggcaattctcccgcctcagtctcccaaactgctgggaccagaggcgtaaaccaccactcccagctcaatatctatatataatttacaggcaatattttaactgatgtacatgtaataactcaatcttaaaacaaacttacgtgcttaccaataaggaagctgaggcaacaaagtcacaaagctaataatcagtgaagccaggttttaaaactgattcaagagtcaagacagagcttttcttttac

SEQ ID NO: 186810 - DNA, 759 bp, Homo sapiens
cagtactgagggaggccgaggcgggcggatcacctgaggtcaggagttcgagaccagcctggccaacatggagaaacctcatctctactaaaaatataaaaattagcctggcgtggtggcgggcgcagatgacttatgcgaagccggccacaacaaggcactccccacccactcagctgcttgtccggggaccacacagcccactcgctgcccactgatggcaaaagtcggtgcctctcagaagcctcttccggtgatgggtccttgctgctgaccccactagagctcacacagggcaggggcccagaacctggggaaactagccctagagatcctttaaaatccagcctgtgttttcttagaaggggctcaggccttcccctgaagctgccttactcgctgaggagacgacgactggacccaacgccgcctcagagttttgttttgctgaagacctgcggtttccaaactgatgaataaccagaaggactggttaaatgcggattcctgggccccatcccagagttcttgacttggtaggtccaggctggggcccagtagtttgcaattctagcaacagttcccaggcaacccggaagccgtacgtccagggaccagagtttaagaaccgccgcctaggaccaaaacaaggccggtttgggttggtagctgggcaggtagacagactcttcagatcagctttgccttagcttttttttccaggattccaaataattaaacatttctaaaattgttcgt

SEQ ID NO: 186811 - DNA, 239 bp, Homo sapiens
cattgtaattgaccagataccagctccaagctgggtcagttagatacctaagtctatgctcaaaatgaaacttttgtacactactgttgggagtgtcaactacactttggaaaactggcagtatctctaaatacacatatacctaatgacccagaaattctactcctaagtgtaaaccaaaataattaattgcatatgttcttaaaagacaaacaaagtttagagctgcattttacata

SEQ ID NO: 186812 - DNA, 656 bp, Homo sapiens
acacgttacgcagtgtcttgatgatgattctagagaaacaaagtcagcagatttgaaaataacatagcattagaacttcctgttagcttatgataaaataccagggttttaaaagtcacctaagttactttcatacatgagataatatttggctatattttgttacataataaattaaagctgaatatgaaaattgttataaattgtatctagaataaggtgatatgtataaagaagagtatatataccataattgacaggcagtgtccacttagaaaagatcttacacagtatttaaaacataatttaacaaaaagttgcttgatatttggtgagaaacagtaaagaggataaacttggaatgattttcttctttctgtgtaacacagatcaaatttatatcttagaactcattttgtttctcttctttacctatgaatttgttacggaaaatagggttaagtaaagatgctcgttggagagaaaaaaaaaaacacaactcgatgtaaaaggagaaggctaatttttatatcgtgtgttacaaaatttgcctgcatttcttctaaggatacagttttattttcattgttgttttctgaatgactcgaaatttaaaaatgagatattttatgatacaaaaaataaagttaacagag

SEQ ID NO: 186813 - DNA, 330 bp, Homo sapiens
attcacactattgttcattcaacagatgtttgttgagtgtctactgtgtcccaggcactattttgagccttagagataagcagtaagtaaaacagacagaaagttgaatatatttccccatctaagcacaagagctcatgctctgatttctattaattttaactggtaataaaataactctggataatatgacatgataaacttatcaagagtgtgcttgcctttctattgcaattttcatgactatcattttggggctttagacattatgtaaacctgttccatttaaaaaataaatttatggaacataataatccagttttggttatg

SEQ ID NO: 186814 - DNA, 184 bp, Homo sapiens
cccttccctcaaaagtcccttacagaaaaaaaaaagaaaaaaagtctctcccagagattctgatatttatgcttatcttctagcccaagtcaaaacaactgaagagtaaaagatctgaataagcaaatcttaaagaaggggccatttgatgagcttaaaaaaggaaagttcccagaaatagtag

SEQ ID NO: 186815 - DNA, 630 bp, Homo sapiens
gcatgtaccaccacaccggctaattttgtattttagtagagacggggtttcaccatgtttgccaggttggtctcgaactcccgacctcaggtgatccatccacctcggcctcccaaagttctggtattaaaggcatgagccaccgcgcccagccagttcattaatttttaaaataactctgaggtaggcactattatcctcactttatatttgaggaaaccctcaaagagactaagtaaataacttaaagtctttcaactagtacgtggcagaattataattaaaaacctgtttttgccactattgcatattgttagaaggctgtttcttcttgaggctgagctaagagaacatatatccatcctacgtaacttacagttcccattgtctgttcatttgcctatattctactcacatttcctgctttccattcttacttatttctgtccaactagaccaagaacataatattctataccctgtctcccaaacttctaagtcatggatttgttttaacctcctgctatgctcatttagctaggtatcatttatgaatattttcttctcattttcgtacccattctcaagtctaattcattgatgactcagtcacgtcagtagtttctccat

SEQ ID NO: 186816 - DNA, 404 bp, Homo sapiens
gcaggagaatcgcttgaacctgggaggtggaggttgcagtgagccaaaatcgtgccattgcactccagcctgggcaacagagtgagactctgtctcaaacaaacaaacaaaacccaaatttagctgggcatggtggtacatgcctgtggtcccagctactcaggaggctgaagtgagaggattgcttgagcccagaaggttgaggctacagtaagccatgatcaagtcactgcactccagcctgggtgacagagcaggaggactctgtttcaaaaaaagaaaggaagaaagaaaaagaaaaaggggccgggcgcggtggctcacacgtataatcccagcactttgggaggccaaggcaggcagatcacctgaggtcaggagttcgagaccagcctggccaacat

SEQ ID NO: 186817 - DNA, 322 bp, Homo sapiens
tagtattacattccttctcctccttttcatcgcatccagaaatatcaagcttgatatttctggacaaatacttttttagatatgacacaaaaagcaaaatccataattaaatgaacacatatatcagacttcatcaaaatgaaaaacttcttctctttaaaatatattaagaaaacaaaaggtcaagccacaaactgggaaaaaaaatccttccaaaaagcataataaaggaataatatccagaatctattaaaaaaaaaaactcttaaaactcaagaaataagaataaaaactatctaatttttaattctttttttttttt

SEQ ID NO: 186818 - DNA, 111 bp, Homo sapiens
ctccaacacctaatagtatatggcatgtgactgcatgtaaaaaaacaaaagtgtgtccaactggttaactgacttctcaatactcaaataaacattcatgagtgattaata

SEQ ID NO: 186819 - DNA, 335 bp, Homo sapiens
tatggtcacgccactgtactctagcctgtgtgacagagcaaaattctatcttaagaaaaacaaattctggtgaataagtctcttttaactaatcctgtctaaaatggatgatggctaataaaacaatatggcgtggctggaactctagctctagggtggtctccaaagaggacactcaagcattctctgagcagcacggggctgtgtcctggtagcagcctgaaggggtgacagtggagcacagtgtttattttcatttctcaattttgacatatttactggaaaaattaatccctagccacctcacatgacagtacagtgatcgtttttttttt

SEQ ID NO: 186820 - DNA, 440 bp, Homo sapiens
ggagccccggctcactttcagttccttgacatgaataagctctttgatgataccaaaataaaaatagtcttttataaataagtcagcaaagcctggcgatctgtgaaggcagacttccaaacatccaagcgaagtttgttgttcctttttccctttcttctttcaaaaacagttatttgtcaatttaacctccttgatccatggaaaatgacagaggcgtgcagattcagaaagggaagacaataagagcaggtgaagttgaagataggagattgatgccagggaactaaataaccagaaaagacatgtgaaatagagaaccgaatggagagcacaaagaaaatggtaaccaattttctctgaaagtgaaaggtaaagaaagctgaagatgaaactacctatttatttttaatagctgcatcaagagattgcttaggtgg

SEQ ID NO: 186821 - DNA, 671 bp, Homo sapiens
aaagttacaaaaatacaattagtgaacaatctaaaatgatatataattaagtgtgctatagactggaagtgttctaaaagcagtttctcaatatcaacccaatattttataaaagaatgtggagctgtgcccagctgacccatcgaccaaagtgaggagttacattctcaaagcaccgttgttagaagtgaggaaacagcatcttataaacatgcatgtactatcctaaagtctagatttttaaactgagtttccaatatgtatatacagccataagttttaaatgcttcttagtttccagggttttcaccttctttttcttctcctcttccattaatgtgtgcaaatgatttattcctttcaaaaactgattccaaggctggttttcccatgctaaaacagaaatgactcttatgaatttctcagggcaaatgggtgggaaaatcagatagaaccatagctttctgagggcaaattttctaaacctttatgtaaaatactattggatttattctttcatgggtatgtgtatttgtcttatgtatataggttggttccgtaacactttagagaccaagagttggcaaactgccctgctggtcaaatccagctcgctgctagtttttgtgtggcttgtgagctaagagtggttgttacatgttttaatagtt

SEQ ID NO: 186822 - DNA, 549 bp, Homo sapiens
aacattactttctagttatttcttctattgactcttcttcccctaaaaccttcaaatgttagaactgtctgccagtggaagtagaaattgatatgaccattgtgaaaaacacttgatgaaatgtaaggttttttttgttgttttttgagactgggtctcactctgtcacccaggctggtatgatctcagctcactgcaacctctgcctcccaggttccagagattctctcacctcagtctccccagtagctgggactacgggcacatgctaccacacctggctagtttttgtatattttggtagagacggggtttcactatgttgcccaggctggtctcaaagtcctggcctcaagcagtcttcctgcctcggcttcccaaagtgctgggattacaggcatcagttatcactcctgtgcctgacctgtcttgattgtttaaatttttataaatgtttgtctacaaaaggagtaatgttctccacaaagtctacttagataatgtgcttgttaatgtttgtattatcagtctgcttccctttttatttaa

SEQ ID NO: 186823 - DNA, 393 bp, Homo sapiens
aaaatatcagtcaactaagagaatctgcacaactccaaataagagaaatatccaaaagaaaggatctagggcactctttccttaccctttcatttgcattggtttaaattgggggaaactcaaaaagtgaaggctcttttctttagcacagacattcagaaagggatcggggtgaatagtccttagagaatatgtgggaagataaagagccgactctagcattaaaatgtgggtggagcagcgtattttctttttaaaagcagagaaaattttcttatttttccttcagtgttttaatcacaggcaatcctagatagcaactgtattagtcagctcaggctgccaagacagaataccacagtctgggtggctttatcaacagaaatttacttt

SEQ ID NO: 186824 - DNA, 579 bp, Homo sapiens
tgatgcagaatgggaagatgagaggaagtggggtgagtagccacactagttactcttcagaaatagccacactacctaagcagaacaggttggattaaggtctgcacatgagccaaagctgagaattcattgcctttgttggctcatgtcacttctttaattaatgtcactttctctggtttaatatcagagcaagtgacaagagtgcttctggatgaattgtgttttccgaggactgtatggcacactctcctgcagtctgacagagggacgtgccagttttacttggcagttacaatgcaccagctttagttttagtagtttaatttgtggcagttatatgttttgaatacgttgaagtattcacaacggtctcatggaatctgttccatagataaagtttacacagtgaaaaagcaaaagcaacggctataaggcgattaggaaaagcttctcttggccacagctggtcttacaggcattcctgtaaattttagagcatttagaagatatgatcaataaaattggatgttgtgtgtgtaagtatgtttaccctccaattaaagtaacgttttttaa

SEQ ID NO: 186825 - DNA, 440 bp, Homo sapiens
tctctctcccagaaaaggggggatgcacttggcccctcaactccaagttggtggtgcgatgatttttccatattctcccttaacaggctgtgagggagtctgggccaggcactaggccatgagcagggcagactggggtaaacccttagcgagcctctctccagccacgaggaaacctggagtgtgtgcgtgcctgtgtgctgctggtgtgtgtgtgtgaatgcacacgtgtgtgcatgcactgtgagctggtgtgtgcatgtgcactggtgtgtgcgtttgtgtgtgtgtgtgtgtgtgcatgtgtgtgctgggtgcacacatgcatatgtctctgtgtatacatgtgtatgtgtgccagtgggtgcatgtgtttgtacagtgtgcgtgtgtgtgtgtgtttgtgcacatgagctgctgcacacatataagccttgtga

SEQ ID NO: 186826 - DNA, 604 bp, Homo sapiens
ctgttttggtgttttatatatgtgtttcatttaatcttcatgccaaccctgtgggtaatgattgtttttatccccactttacataagaggaaactgaggcacaaagagtataacttgctcaaagtgacacaattaatggtggacttaggattcaaaatcaagaattctgcttccatactctgcttcttaaatattgtatctataataaattatagtggcaagggagaaagaaaattagtgcctaaaataaagttctgagaaacttaattaaaatatagactcctcaatttctattttaaatctataggattttagagccaaaattttactcatttaaagacaaaattcttttaactggcgctacaacttaaagacaaattccatgttcatagaggtttgaggagatagaatgacttaccaaatgcctgatccatgccagcgcctaggtgggtgaactagtgggagccataggcgaacaccgaagtcctggctgttaaaaggggcatctgtagatgtttagggtcagagtctggcactgagtcttctctctgcttgctcctagtagcccctttaccttcctaacagttcccagagaccttttctt

SEQ ID NO: 186827 - DNA, 753 bp, Homo sapiens
atgtcgatcactgtactcgaagggccaaacaataatcctgtatcataatcagtacaatcaatgacaatgattgacatggagaatggccttggcgtccatgccaccatcagggtgagaatgggctgacctcctgagcacctgctcagccgcatgccctgtgcagagcactccatgggcacctggtaacacctacccctgtcaagtgccttgcacattaatcctctgatccaactctatttgtccagtgaacccagtacagtagaggccagcaaactttattcatgatgagccagagatatttttttgccattgagggccagctaactacccagctctctgccatatgggaaaaacagccatagacaacatgtaaatgaatgggcatggttgtgtgccaataaaactttatttgcaaaaacaagcagtgggctggatttggcctaggggccatagttttcaagctcctgcggtagacaaactggaagcagtgaacaggctgttggtctgcatttacgtatttaagtatttaaggtaaatattgaagctatggccagccaggcacagcggctcacacctgtaatcccagcactttgggaggccaaggcaggtgggtcatctgaggtcaggagtttgagaccagcctggccaacacagtgaaaccccatttctactaaaaacacaaaaatcagccgggtgtggtggcctgcgcctgtagtcccagatagttgggaggccaagtcaagagaatcgctt

SEQ ID NO: 186828 - DNA, 309 bp, Homo sapiens
aaaaaaaacacaaaaaaacaaaaaaactaggtggtcattgggggtttgaccaatagtaatacaacaaaaataatgagaatcagataaagaaaaatatcagatttcacactaatccagagggccttagactacaaaaaaaattgaaactgaaaataaaactggatttttacattcttcaagggaatacagggaagatgaaaccaggctaaaaaatggttaagcagggagtaggtagtcaggaaacagaggcaagtatagatgacttaagaagcccagtcatgaagggaaagagaaaaacagaatgacaat

SEQ ID NO: 186829 - DNA, 280 bp, Homo sapiens
gctgggaggggaagggaagtcgagatgcccaagcgggagctctactgagtcacctgcaactgcccgtgcccgaacacagatgcctcgatctccccataaccgggcaatggacccctgctcttgggagctactaggggcctgaaacaataagacgaataataacatttattgatggctccctataagctgtgctaaactttcacatgtattttctcatttctatcctgcaaggcagatactgtcatagacacacctgcacacacacccatgttcagaccag

SEQ ID NO: 186830 - DNA, 563 bp, Homo sapiens
tcttacgatcctttggcatttgtaatcattacataacaaatatcttgccagttaacgttgttattacttctttcccccttcatttattttgcctttttcgtgttgctaaagtgaatcagcctctctggactgccagttcctgatgtttcacctagagatgctaagttgctcaagtggttgctttctaaggacccagctgactgacatttcattttacccaagttaacaaacttacaatgtttgtaaaacattttattttacaaaatgaattataatatgtagacaatatgtttacagatttattcaagttaggaatttcattcatccacctcaatgttaattggtttgattttttaattaaaatagtatattataatagcaatatatttttttaaatgaacctcagaatccatcctcaagggagaaagattaccactaatgttcttttactacgtggataattcatcttaaacatggagtctgagtaatagtgtctgggtggggagctctgtttagggtttaggagtcaaatatttgagattcttacggatgcttgtgttcct

SEQ ID NO: 186831 - DNA, 363 bp, Homo sapiens
aagcacgtattgtaaaatatttgctaaattttgtgtctagtttctttcacacatggattttcaggtgttccagcattatttgttgaaaagactatcctttccccattgaattgtctttgttcctttgtcaatattcagttgaatatatttgtgtgcatctgtttctgagccctcattctgttccattgacctacttgcctgttcttccaccaacaccagaagctagtgattaccaaaagtcttgaagtcaggtaatgtcagttctctcatggttcttctacagtatctccttgcctattctaggtcttttagctttccatgtaagctttagaatcagtttttcaatgtgtaaaaattggcttg

SEQ ID NO: 186832 - DNA, 371 bp, Homo sapiens
tgctgggattacaggcgtgaaccaccgctcctggcctgcttaccattttgaagcatggaatatgaaaaacacatgttcttgagggtcaagatttaataaaattaacaagttttactgtatcaagaatttgtaatttaaaggatggagaaatagaatattgctctttatgataggcgctgaaagcaatttgtagtctttttttcagcgtatcttggacaattctatccacccagtaacaataataagaaataaagatactattaaaaaagatcaaacgtatttgaaaaaataacccattatttttgaaattaggatctcggtggaaactcaggggagaggtaaaacatcctggtacgttctacttcattgta

SEQ ID NO: 186833 - DNA, 217 bp, Homo sapiens
aattctgagaaattatgtatacagcagttggaaagctctctattctgagtgtacttcaagacaataacatcatcaagttttaaacacctgtaaacacatataaatacacacactttcttctgtcaggcaaaaaatgctataatcccttatatccataattactgtttgcttacagatcccttcaactaattccctcttttcctcagaaccctcccaa

SEQ ID NO: 186834 - DNA, 562 bp, Homo sapiens
ttattattattatttttcttcaatacggagtttcactgttgttgcccaggctggagtgcaatgacatgatctcggctcactgcaacctctgtctcctgggttcaagcgattctcctgcctcagcctcctgattagctgggactacgggcacccgccaccatgcccggctaattgttttgtattttcagtagagatggggtttctccatgttggccaggctgatcttcaactcctggcctcaggtgatccccccaacttggcctcccacagtgttgggattacacgcgtgagccagtgcgcccggcctgacccatggattattaagtatgtggttttattttgaagtgtttgcagattgttttgttaatgatttctagtttaataccattgtgattggagaacaaactgcatatgatttcatttcttttaaatttgttaagatttatgtgtcaggttatgttctcagtgaacattctgtatgtgcttaaaaagtatatgtatggtctgtatatgtatggtctgtatatacatatatgtatacatatatgtgtaaaaagtatat

SEQ ID NO: 186835 - DNA, 340 bp, Homo sapiens
tggacagatcgcttgatgcccggagtttgagaccagccttgccaacatggtgaaaccccatatctactcaaaacacaacaacaacaacaaagaggctggagttgtagatccagctccgttatttccattcttctttggtaaaatgagatgtctgataatacctattttattcgttcagagcattgttacattaaatgaaacaaatgtgagagcaccttgtaaagtatgaactgagttttaaaggtgaagtggcatttatgggaggattgatttgattgtgcaggccttttgtaaaaagcaagttcctaataatttatgatttatggaagactttgaaatg

SEQ ID NO: 186836 - DNA, 356 bp, Homo sapiens
tagtccaggtctcctccagtccttagtcactcggacacagagaacacttctgagagagacatttcttattcctgcccaagtggttccaataggaccagaggctcactttcccacttctagaaagcccaagactcattttggagcaagtgcaacttggagcataggaatctctttgtgatggtccatctgcctaagacacaacacctagccatcccctctttgactcctgctgcttcaccagtgccctaacacagaaagcagacacaaggtcccaatgtatctcccctggtcactttctttctttctctcctcattctcttgcatttctctcctctcattcaagtcaaaagaagctc

SEQ ID NO: 186837 - DNA, 452 bp, Homo sapiens
tggaaataaggagctggttagaaggctgcgattttcacctggcaagaggtcagggtggcagaggagacagagcaaatggacagtatgtctatgtcagtgaaggtgcggtgaccggtgccactcacacgtaaggaatgcttatcctggagggctgggagtgatccagtgtcatctcgatgcaaagccccttgcacagcacatccattgtggcactctgttaatagtggctgtcattgcataaagagatggccaaggagatgaaccacatgaaaaatgagcctccttctccccaaatcctcaagtcctggtcagtttactctaaatcaaagtttccagtcgtcatgatgagtatgatcatcatcattattatttttaggcaacagaacccatttctaaattgaaatatgcttcagttgactcaggggtgaggttcctggaactccctcttggtg

SEQ ID NO: 186838 - DNA, 260 bp, Homo sapiens
aagatccagtgtatatatcaacagcctctgatctcctagttatcctgtttttttgagaagagctaagaggaaaaggaataagggtaagccagcatctagtatgaggaatgctttgttattcccataatatagataaggaaactgaagtttagttattgaaccaggagcacctaagagctaagaagcaaagctgaaattgaaactgagacctatctgctgaggtgagcagctccgcaagttagctccattcagaaagctgc

SEQ ID NO: 186839 - DNA, 163 bp, Homo sapiens
tcattctgcctcagggttttgaggtattcaatgctttctggcttctaggcactgttcaatagtgcagtaccattctaatttttgatctttgtacatatttcttctctgaatctcttaggaccacctttttatcactagtattcagaatctgaagataatctgt

SEQ ID NO: 186840 - DNA, 470 bp, Homo sapiens
tatttttgtagagacggggtttcaccaggttggccaggatggtcttgatctcttcaccttgtgatctgctcgcatcggcctcccaaaatgctgggattacaggcgtgagccatgtgcccagccctccctgcttttctttgctctcactcttggcaacctcacttaacacctatggcttaaactatcatctccatgtggatgaagccaatcttgacttcactcctctgagctccaactcaacctgcccagttgcacacaatacaaacttaagtcatcaccatatctccaactggcaaatctcatttccctagatctgtagaaacttgaggaattaggaaagagattagcttcagagagtataagtctaagagaaacatacaatggttcaaagcaatgatgtcaccaagaagagagagaaaggaaacgaagctagtagaactagacatctttaatcaggctgaaggtattca

SEQ ID NO: 186841 - DNA, 337 bp, Homo sapiens
gcaggtcaaagtaaaaatgaaaatttatgcttttacatgtcccaagctcagtattctgtacatttctctaaacacacacacacacacacacacacacacacacacacacacacacacgtttttttttgtagagatggagtttcaccatgttggccaggctagtcataactcctagcctcaagtgatccgcctgcctcagcctcccaaagtgctgggattaccggcatgagccaccgcgcctagccatattctgtacatttcttaaaagtttagaagtatgaacaacatttgacattcatttgaaaaatctgtccaggccgcctgcagcaccacgcat

SEQ ID NO: 186842 - DNA, 351 bp, Homo sapiens
tgttaacccacttgggcagcacgactttaattagtaaaattagccctgttgtttggccaactttcgtctcataaactctgcaaggcagaaacataaccaatcatatgttttaagatgctacctaattatataaaagcactcatcaaactttacccagaagtgtttaaaaatcaaaacataccattaatcctgaagacaaaaatatttgaggttaccttattttttaagattatgtgctcatttactacatgaggaaaaagggcttttgatagtcaaccgccttcttttaatttaattaccagaaaatgcaaactgttttcaggtttacctgaatgttatcagtttgagtgg

SEQ ID NO: 186843 - DNA, 447 bp, Homo sapiens
ttctcctgctgaaagtagtaaatataactgaaaattttaagatcttcaaacattagttacctaatatgctttggcagtagagaacaataaagtctcatttgagatgtgggtactaggtgatctgcttggctttttcattgtttaggggatatcaacatgtaagcattgaggtgtgtaaaatttaggtatttgtcattgcttgttaaaaactttgagatcactttgaaataattatatctgggaatattgtgtgtataaaggcaagggttataatgaaaaaacagttggcaagatttataaaatacagaagtaaggattgattgttgggagaaggggatgggttaaaaactttgagatcactttgaaataattgtatctgggaatgtgtgtgtaaaggcaagggttcctgtgatatatataatgactaaacagttggcaatcaagctt

SEQ ID NO: 186844 - DNA, 601 bp, Homo sapiens
ctatattaccaagacatccttgccacttttatgtcaaatatgtacaagaagaattttctgttgagatgagcaaatgactaatacatttgtaatgtaaaccaccaactagtttacagttacaaggtaattttttaatttcagcttttcttaaaccgaggcgcacctgttttcccacgtgcctatatcattattttccttccacaggcaaagttacaggaaaaataaacattcatataagccatcactataggttcaattcagtcatcttacaatgtaaaggaatagatgttcctctttgccactgatccagtcatatatacagtatatcaatagctatatatctctatctacctgtatcttagcgccctctggcgtttgtcaaaaagaagaggttttcttataggcatgacatttttcagctgtctctcatcacttcaactgaagtttccatatcaaaaaataataagtttaatgacataggaataacaatagagctttactctgaagtatcaagccaaagtaaaaactaggggtgttgtgctttgcaaatataacttaaactggatcaaagatcaactcattaaaaattctaaaattttaa

SEQ ID NO: 186845 - DNA, 516 bp, Homo sapiens
tcctggtttggaagttttcttcactgactataaaactatacaagagaacaaacttactcagaattatcccaattagattgttgttttagcagtcactcactacagggcaagatatagtccaccatggctagtaatgaaaccagctgcatcaccagcttatttctggctgcagagaaaaaaatcaaaaacattagctgagtttgggtttctgagttccccaagaatgatggcagtctcctggactcttctcatacctccttctaaaaactatacacagcaacaagaagaacaaatagaaatacccatgctctgtacctacagagtaagtaggagacagaagagagctaccaacacaaacgtatgagaaagtagggaggtaaacactgaagaacagcaggataagcgctggagctgaccctagtgtggggattatagcaagagcttcacagaggagttaagaggtcagagaactctcagtggctgtaggactcagataacagcagccaggatttctcc

SEQ ID NO: 186846 - DNA, 177 bp, Homo sapiens
gcctgtacgagctttaaatgagttctttgtggacttcggaaagtgcttacattctcagcagttcctgtaatcctgtaaccaaagaagcgttgttgatggccaaggcttattcttcctacaaatatgattgagttctgacacctggtataatgttttctttaaaatgagagccaatgt

SEQ ID NO: 186847 - DNA, 577 bp, Homo sapiens
tttcccatatatctggcatggggcctctcctgaagcctcagtagatgagcccgtcttccagtctggtgctgtttttgggacaaataggagattgaccccaggccgttccacctaccccaggggcttccaccaaccccaaagtcttcccaaggccttggagagccctctttcgaaagcatctcctgttctgggtaatgacaataataaaatcatagcagctgtcaattgcgagcacttgtcatgtacaaagactgtgccccatcggcgcatgacttcatttcacctgtcaacacccctgtgagatggttactgttgttattcccattttatagaggaggaagctgtggcttggagggctaggcatttgcccaaggtcgaccagcttgaatcactggcagagccagggttaactttcagggccccacccatcaccacggtgtggcactgcctctacttcctatccccctccagagagaggcttatgtgaaccgagtattaactctgagccataaccaggagcctgctatgggttctgagcttttataggatgtggtggaaatagcagggctctggtact

SEQ ID NO: 186848 - DNA, 300 bp, Homo sapiens
gctctcccctttcagaagcagaagcttgtgacttggcacctgtttccggaacccactatggcccaaccttctcagaagattttgcaccttgagccaaagaggatgcagggctcttgggacccaagagcctgagtagggcttctgccctccctctccggcctgaagtttcccattcatcagctggaaccttcacacctgcccagaggactgctgactcgcactgacggtggccacaaggtgacagcttgtgtcctgtgggggtagatggtgataaccatctggtaaccaagcagatgaagt

SEQ ID NO: 186849 - DNA, 386 bp, Homo sapiens
gtgacctgtctagggcacagacctgagaccaggcagctcagggtcagcctctggctttactctctgggaaatggggcactcacacctatgccaagagctccagaaagacctgacttgggccaggcagcaaggggagatgcagagcactggccaggcctggtgcggcctggccccagctgtctgggggataggacagggctccagcggcagacagcctcttagcaggtgcgtactcagccgtgggctaaactcattcctggcctgaggggattcatgggtcctcatggtctaccacatgggcccatggagtcggcacagaggggaaagtcctcctttctggcctggtgctattacccctggaactatagagaaacagagtaacacag

SEQ ID NO: 186850 - DNA, 331 bp, Homo sapiens
ttagacgccttcactggcttcagtatccacacgacacaccctcccagttcatttgaggtgctactcataagacaccttctttgtgaggccttcctgaccaccctggctaaaatcacacttcctcccctgtcttttgttgtcacattaccatctttgtttcttgatggtattcatttctcctgattttatattatatagattttgtttattgccatatccttactgacttttgatggcagaaaatctgattggattattgctccattctcagcatctgtttattccacacactaagtactcaatagatatttgtttaatgaatgagaaatga

SEQ ID NO: 186851 - DNA, 530 bp, Homo sapiens
cgtggggtactctgcgtgtgtgttgggagagtatatgttaggggggtgtatgtgtgtatgtgtatatgtatatacatatatgtgttagggttgtgtgtgtgtgtatatattaggtgggtatattatgattatagatgtgtataaatgtgtattcgtggtgtgtgtgagttaggtgagtgtgagtatatgtatatacatatgtgtgctagggttgtgtgtgtgtatatatgtgtgtgtaccaccgcttgagatgatcatcctattcatggtcagtaatgttgccactatcattaagtatgaataatattgtgtggtttatacaatgttttcacctgaatcatgtcatcaaagccatctgattccatgaaataggatagatatgaataaataggtaaatgcatagaatataagtttaaataattcattgacactcagagaatccaaatgcatgcagctggttagaagctgtgtccagatgccaaacaaacctcctaacactgaactccacagaaggcagtccaaggtgcacc

SEQ ID NO: 186852 - DNA, 143 bp, Homo sapiens
caagacatgagttattgacacactttaaagtgtaaaggcagggaaggtgagaaggaaaaacacaaagaaaattgagaattaggaagaaaactagaagaacatgatgacctggaattcaaatgaaaagcagaaagggtgatcag

SEQ ID NO: 186853 - DNA, 317 bp, Homo sapiens
  misc_feature (259)..(259): n is a, c, g, or t
  misc_feature (299)..(299): n is a, c, g, or t
  misc_feature (307)..(307): n is a, c, g, or t
taaacatcctggtatgtctttagcacagcccaattatacctacaggataaattcctaaacatggaattatcaaagggtatgtgtgcattttagattttcatcagtaactaccaaagagattgaatagttgacatcaaatgtatgtatttagaaacgctcccctggtattcatgaaaaatatatttcctctaaaactctgttgcagggtaagacttggtttgactctaataaactgtgagtggctgggcccccaggcttngaaccagaatcctttctcagacccacgtttcggccttctntcctaatncccggtgtcg

SEQ ID NO: 186854 - DNA, 145 bp, Homo sapiens
tcccacctgtgaggctatggtctgccaaggagagttcagcgggctggatcagagagagcagagccatgctggcaagtcggagtctttgtggaaagcagccaaggtcacagctggaaataaaactgtgtattccaaatcagagggg

SEQ ID NO: 186855 - DNA, 328 bp, Homo sapiens
acagaagaggcattgcagcatttggctggcttgccctaacccattcctccacatgaaaacatagtgttcctcccctctgaagaatgcagccctcaccgtacaattgaacctgctggtgcattgatcttggacttcccagcctccagaactatatgatataaatttctgtttttggtaaattacccagcctgtggtattctattatagcagcacaaagaaactaagacaattgtaaactcagcacatccagcactcagctgatatacttctctccctcaatcaaaattttctccctctagtattctctatggcagtcaggggttctacc

SEQ ID NO: 186856 - DNA, 405 bp, Homo sapiens
ccatggagtgcttagctgaggtcctctgaggtgcagagtagagacagtcatcattgcagtgagccatccagcccacctctccacatgctctcgggagaatggctggccaggatctgactattctagttctgcaatgctggagtatacacttgtacaactccaaggacactaatttggcattatatatcaaaattataaatgcacctatccttttcagtctatatctagaaatttatcctacagatacgttggtatatgtaaaataacatatgtaaggttatttattataaaactctttgtaatagcaaagaacataaatagcctaaaagtctgtcatccataagagactgggccaggtgcggtggttcacacctgtaatcccaaatatttggggggccaaggtgg

SEQ ID NO: 186857 - DNA, 496 bp, Homo sapiens
aaacataatcccactaaaaagtgaacaagtgacatgaaaaaacatttctcaaaagaagatacacaaatagccaagaaacatgtgaaaaatgtgcaacatcactaatcatcagagaaattcaaattaaaaccacaatgagatacaaccttaccccagccagaatggccattattaaaaagtcaaaaaacaatagatgttggtgtggatatggcgaaaaaggaacacttatatgctgctggtgggaatgtaaattagtacaacctctataaaaacagtacggagatttaccaaagtgatctatttctttttttaaaaatgtatttatcttaagaaaaacagcctgggcaacatggcgaaaccccatctctacaaaaaaatacaaaatttagccaaatgtggcgcgcgcactacctcacttcgatatagaaatatcattcaatatgatttccagaaggacaagtttcctggagaatacaggcatgaggacaatgcacaa

SEQ ID NO: 186858 - DNA, 635 bp, Homo sapiens
aaacataatcccactaaaaagtgaacaagtgacatgaaaaaacatttctcaaaagaagatacacaaatagccaagaaacatgtgaaaaatgtgcaacatcactaatcatcagagaaattcaaattaaaaccacaatgagatacaaccttaccccagccagaatggccattattaaaaagtcaaaaaacaatagatgttggtgtggatatggcgaaaaaggaacacttatatgctgctggtgggaatgtaaattagtacaacctctataaaaacagtacggagatttaccaaagtgatctatttctttttttaaaaatgtatttatcttaagaaaaacagcctgggcaacatggcgaaaccccatctctacaaaaaaatacaaaatttagccaaatgtggtagtgcgcgcgcatagggagtgctgagggggtgtgtgcacaggcctgggagaagggctgattttacccacagaccccaggctgttctgacctgaaacgaagatttccgaccatgcaggggtgaggcaaataaaggggtgcgacagatgagaacatttaagtacttggggagccaggagagtatgcttggttactaggagaaacaaactggctcagtatccagtatcagagtacaag

SEQ ID NO: 186859 - DNA, 115 bp, Homo sapiens
gtcttatgatcttcacaggagggtcagaaagcccttcctaggttttatgacctacttaaagtgatggtcagaaagttctccatgcacattctgtttctcaaattccctcagctta

SEQ ID NO: 186860 - DNA, 238 bp, Homo sapiens
gcaaggcagaacacactagctggcagaaggcaacatctttgaatgtcagtctgtaagttttagtcttgcattattatgattcataatacagaactaaaactcatgaaataagtggccttccatacaaaaaagtgttctaaactcaagttgaaaatttatgagctcaaaaattcccatttcacacatctgcaagaaccccaccacagccaaagcaccaggtgacataaactctaaaacc

SEQ ID NO: 186861 - DNA, 480 bp, Homo sapiens
cgattgtgaaataggtaggtgaagagaaagacaaaggggtagaaaagttatttaaagaaatattagcagaaaaatttccaaattgggagacaaatataaatatccaggtacaggaaggtcaaaattgtccaatgaaattcaatctaaacaagactacaccaggacatttgataaccaaaccgtcaaaaatcaaggacaaagagaggatcctgaaagcagcaaaagaaaataaaaaaatctcacataataaagttccaataaggttagtagcagatttcttggcagaccttacatgccaggagcgagtgggatgatatattatatttaaaatgctggaggaaaaaaacctgtcaagcccaaatactacaccctgcaaagctatccttcagaaatgaaggagagataaagacattccaagacaaacaaaagctgagggagttcaccatcacctacctatttcacaatcggggtaccgagctc

SEQ ID NO: 186862 - DNA, 590 bp, Homo sapiens
ctgcatacacaaatttgaactacattttgtagttttattatttgtattaatattgaaaattttcttaatactgttataaggttttcagtaaagcaaatgagttagtatgtataatctgttaggtatcaagattactaaaaagagcacagctcagcaaaattggcatacaagggacacaccttaatgaattaaaagccacctatgacaaacccacagccaacttaatactggatggggaaaagctgaaagcattcttcctgagaacgggagcaaaacaaggatgcccactctcaccacccttcttcatcatagtactggaagtcttggccagagcaatcagacaagagaaagaaataaagggcatccaaatcagtgaagaggaagtcaaactgtccctgactgctgacgatatgattgtttaccttgaaaatcctaaggacgcctctagaaagctcctagaacagataagagaattcagcaaagtttgcagatacaagattaatatattcaaatcagtagctcttttatacaccaacagtgaccaagcagataatcaaatcaagaactcaacccttttacaatagctgcaa

SEQ ID NO: 186863 - DNA, 704 bp, Homo sapiens
gaggacgggcaccaaatctgcattgtccattgctatttcccaggttgagttgctgaagcggcttcattgtctggggacatacccaaggttcgtcatcgcgtgacgagaagattaaggacacagacgcaaacacggagcgggtcaagtagcggaaagtttaataggcaggaaagaagagaacagctcaccggtagagagccgtcaatggtgtgccagataagaagctatgcactgaaaagatggagaggagcggcgagattctgcatcttagcttgcctaggtggggagcaggaaaaaggaggaagactgaagcacaaagcttctctcgtctgtgtcaccctctgcaaggagtttgcagttggactggaaaacccacatttcccactgagtgctttaccactctcagtggaacttaggttctgatactgagaacaaaggagagaatggacaatgaagggatcactagcagttttcattacaaatagtatcttgaaaaaaccttaacaataaggtgaggtgtggtggctcatgcctgtaatatcagcactttgggagaccgaggtgggcagattgcttgagcccaggagttccagaccagcctgggcaacatggcgaaaccctgtctctacaaaaatatacaaaaaattagccagcatggtgggacgtgcttgtagtcccagccactcaggacactgaggtgagag

SEQ ID NO: 186864 - DNA, 476 bp, Homo sapiens
ttccatcttcagtgtcatcttatgaatgctatatggccattattacttccatattccaagcaggaaaaaggaggaagactgaagcacaaagcttctctcgtctgtgtcaccctctgcaaggagtttgcagttggactggaaaacccacatttcccactgagtgctttaccactctcagtggaacttaggttctgatactgagaacaaaggagagaatggacaatgaagggatcactagcagttttcattacaaatagtatcttgaaaaaaccttaacaataaggtgaggtgtggtggctcatgcctgtaatatcagcactttgggagaccgaggtgggcagattgcttgagcccaggagttccagaccagcctgggcaacatggcgaaaccctgtctctacaaaaatatacaaaaaattagccagcatggtgggacgtgcttgtagtcccagccactcaggacactgaggtgagag

SEQ ID NO: 186865 - DNA, 692 bp, Homo sapiens
  misc_feature (453)..(453): n is a, c, g, or t
gaccaggtagactacccagtagactatccaggtagacctaactagaagtgtgaaaacgtaggcttggattaaggcgacagcgatttctaggatagtcagtagaattagaaccaggtagacctaactacagcccaacctactagccctacctactaaccctacctgggttaggtctacctggccaggtagacctaacccaggagacctacccaggtagacaccttgacctaacgtctttacgtgggtacttgcgcttactttgtagccttcatcagggtttgctgaagatggcggtatataggctgagcaagaggtggtgaggttgatcggggtttatcgattacagaacaggctcctctagagggatatgaagcaccgccaggtcctttgagttttaagctgtggctcgtagtgttctggcgagcagttttgttgatttaactgttgaggttnagggctaagcatagtggggtatctaatcccagttggggtcttagctattgtgtgtccagatgttaggtctacctggggtagacctaacaataacaaagcacgaggctacagagatctgttttgaagcattctggaaataacaaatttagatgtatttataaaatccaaggttaggtctacctccaggtagacctaccccaggtagacctaactagaagtgtgaaacgtaggctggatta

SEQ ID NO: 186866 - DNA, 631 bp, Homo sapiens
  misc_feature (392)..(392): n is a, c, g, or t
atcatagcaggatcccctcgacgtgattcaggaccctgtacaactaagcactctactctcagtatactagataaatccaccttcgacccttaagtttcataagggctatcagtagttttctgggtgtataaaatgtagcccatttcttgccacctcataccttgacctaacgtctttacgtgggtacttgcgcttactttgtagccttcatcagggtttgctgaagatggcggtatataggctgagcaagaggtggtgaggttgatcggggtttatcgattacagaacaggctcctctagagggatatgaagcaccgccaggtcctttgagttttaagctgtggctcgtagtgttctggcgagcagttttgttgatttaactgttgaggttnagggctaagcatagtggggtatctaatcccagttggggtcttagctattgtgtgtccagatgttaggtctacctggggtagacctaacaataacaaagcacgaggctacagagatctgttttgaagcattctggaaataacaaatttagatgtatttataaaatccaaggttaggtctacctccaggtagacctaccccaggtagacctaactagaagtgtgaaacgtaggctggatta

SEQ ID NO: 186867 - DNA, 507 bp, Homo sapiens
tccaccctggggcacgtctgggctacggcacctagggggagtactgtggcacccatcagagccatcagcgtgacatctgcctgtggtcttgacaatgtgatgcgatggcggttgtcagcttcccattggctggccccagtgaccctttctagagggttcagaaactcctaagggtcttccagagttgggtcattgcgcattgacaagtgcagcgccatcacatacccttctctctagtgcccactcagtcaccttaaccgaaacttccctgagccgagcatggtgctgggtgctgggctgatgcagggaagttctacccggtcctgccctgaagaaagtgaccctgtgtgcatgcatgagagtgagcagtcagttcaatactaggcctcctatctccagagtacacaagaggactggattagccgggcatggtggtgcacgactgtagtcctggctacttgggggactgaggctggaggattgcttgaggtcaacccaggaggttga

SEQ ID NO: 186868 - DNA, 552 bp, Homo sapiens
cttgtgttttcttcccagcccaagattcagaatccactggccttgagttcgccctgtcctggggacagtgggacctgtcacctgctggccaaggtagggctccaactttgtgaaaagtacatgcggcaggtctgacccttaaacaactcttctgacgtgtggaatgcagggctgggtgggagcagccggcacacctgtcattcactgtttagccactgaagggcagtgttgctccacaggaaggggccaggcagatgtgcgccatcactgtggctcccaggtcggaatgaggatattttagctagtcccaagtggctgggactgcaggaatgcatccctgcgcccagctaatttttaaattattttgtagagacggagtattactgtgttgcctaggctgatctgaaactcctaggctcaagagatcttcctacctcagcctcccaaggtatcgtgattgcaggcgtgagccaccgtgcctggccacaatgtgttgtttcattgctactgggctctactgatgttaataataaattgcttcagagctttaca

SEQ ID NO: 186869 - DNA, 344 bp, Homo sapiens
tcacatttttagatgatttggtcccattgttcctttgtatttgttctgcctaattctgctcctactgtgagtctgcccaagcatctcacccttatatgaatattcaatgttgttgcttcaggctttctatttaggtggatacctaccaaatttaggcctccagtcttgagtttttatttttatttccattccttattggcagaatccacttatgactaaaatatctgattaaagcagcctgcattaaatctgttgtattactgctgacttcacctgggtgctctcatattcatgcatctggatactccttttaaatcacacttttgatttagtttcagctttta

SEQ ID NO: 186870 - DNA, 198 bp, Homo sapiens
cctcatttgcacactaacatctacagtgtccagatctacatttatagagaatacacacctagtgcagcctattaaatgtttcacctagaaatgatgtccagggcaccccactcagactgaccaccaaaggccctcagcaaaatggccaagtaggtatagtttgcctttggtgcctactcatagcccccatctttgcct

SEQ ID NO: 186871 - DNA, 171 bp, Homo sapiens
ttagccttgtaaacctttaaggccaagaagaaaaatcagctggagagctcagtagctcaatgaagctgttttcatcaaatgtcgtaatgttcacacacatatttagccacaaacagtaacccaactgtattgccagaagtacccccctactttttataggtgcttaaataa

SEQ ID NO: 186872 - DNA, 323 bp, Homo sapiens
gcagtggtttgtccattctcaccgtttgtgatcaacattttactggaggttctagccagagaaattaggcaagaaaatgaaatacaaggcatccaaatgggaaaagaagaaatagaactctctgttcacagatgatatgatcttgtggataaggagtgcactaattgattattaaagctagtaaaccagttcagcaaggatatgggatataagaataatatacagaaaccaattatatttatatacactagcaatgaacaatccaaaaacgaaattcaaaacattttatcatagtttcaaaaagaatagaatacttagtaata

SEQ ID NO: 186873 - DNA, 800 bp, Homo sapiens
cacctgcctcggcctcccagagtgctgggattagaggcatgagccatcgcgcctggcctagattatggaatttttgtattaccatgtatgttgccgtgtaattttgttttgaaccttttttatttttcttttaattcctttgagacaggatcttgttctgttacccaggctcactgcaacaaggtgattttcccgcctcagcctccagagtagctggactacaggccggtgccaccacacccagataatattttgtattttttgtagaaatggggttttgttttgttgcccaggctggtcttgagctcctgggctcaagcgatccaccctcctcagcctcccaaaatactgggattacaggcataagccactgcacccggccttgagcattgttttttgaaggaaattttatatgattaccacataaaaaaggaatactaaaaatctaacattatttgatatctcactgtctttgaaaacttaaggaacatggacccatacaaggcagccaaatattggccggtaactcctttacaactgggctgcagcatattttattaccttctcctgacaatttcttatctggctgcttatcatttccagaacataccatccttttgcatgcctttacgccagtggcaaacatggttgtttgcctcctcataaccattctctctatcctgcttgctaatgagaccccagtactgttgatcttttccacacagctgtgagtttaggggtgggtaagccctccctacccgtggaggctgatcttcaccagactaccagacaaagagatg

SEQ ID NO: 186874 - DNA, 540 bp, Homo sapiens
tcgtggcgtggagatccgaaatgcctagcagtgacttgagcacgcttcaaaagcagaaggcgccgggcagtcccagtcactgtgctggctggaggaagccacataaaagtgtgacatcctggcatcgtacaagcatcacaaggcttttgatgtttgcttctcttccccatggaaaatcatgtacaaattcttgcttggagacatatgattaaatatcctgctatccttaataccatgagacttaagaatattggtcataccacacacctccagctgctggcatcagtatcagtcctacattctccaggcttcaaccatgtgcagctgccaagcagggctcggcgcatggcaggcaggtgtgggtcaggcattttcgcagcacgtggaaaaaacagacaggacgcttaatattaatttttaaattgtcgcatgacagcattgtacaacttcaaatagaaagctctctccagatacactaaaactcaaaacaccgatataggtcattgctttgtgaactatagcatgtatatataaactatg

SEQ ID NO: 186875 - DNA, 208 bp, Homo sapiens
tctagctgtgggaagaaaactcaaaggttttttctttttattgaggttgtattatatttacaaattagtatagggagaactgacatcattgtgatgttgtatcttcttatacaagaacatggtatgtctttttacttgtttaaatctcttgtggttttttgggagtgtttttatgactctcctcatagagttccttattgagtttatg

SEQ ID NO: 186876 - DNA, 284 bp, Homo sapiens
ccctggtctgagtccctcatttaagtggtgagaaacttaagaagctttaggttcaggattcttgaatttggtattcttactatacaatagaaagtttattggtagcaaataggcttaaaattggaatgatttcatttaggtcacaggtgaacctacttttaaaaaagtaagagtgatttgtggaaatattccatctgagtcactgtgccctaaacattattttgtaataaaaatacttaaaagaaactttatttgggaattggcaaattacagggggctgcaga

SEQ ID NO: 186877 - DNA, 506 bp, Homo sapiens
ccccatcccatctgcatagcatgcctgagtgagactccctgatgactctcaagggttggggaggaagggacagccctggctacgtggcctgagattcgtgggctgccaggggacatggactggttggattgacaagggccctggttcccccaccacagtggatggcaactccctacaggcggcacgtgtggtatgtggtttgtggtatgcagtgtgtggtgtgcggtgtctggtgcgtgcctgtggaagctgctgtcaccatgatgagcaggttttcccatccctcgggtgtctttcctgaaagtagtctgtgttctgagaaccagcacaaggaaagaaagtgcttgaatctcttcctggcagtagaggcccgtgggttagtgtcagaggaactcaggctcaccaggccctagggagtgtcattgctgtgggggtcaaagtgcttgtggggatcccccaggactttgaggcgcacattccctttctgttgcggatgatggagttag

SEQ ID NO: 186878 - DNA, 528 bp, Homo sapiens
ccatttgtctaattttgctttggttctctgtgcttttgaggtcttacacaaaaactctttgctgagaccaatatcctggagcattggcctaatgttttcttctagtagtttcatagtttcagtattagagttaagcctttaatccattttgatatgatttgatttttgtgtatggtgagagatagcagactagtttcaatcttctgcatatgtttacccaattttcccagaaccactcattgaagactgtcttttccccattgtatgttcttggcacctttgttgaagatgaattggctcaaaatgtgtgaatctatatctgggtccactactttgttccattggtctatgtatctgtttttatgccagtatcatgctgatttggttactatagctttgtagcaaattttaaagtcaggtattgtgatgcctttggttttgttctttcggctaaggattactttagctatttgaggtctttcgtggttctaaataaatttaggattttatctaattctgtgatgaatg

SEQ ID NO: 186879 - DNA, 514 bp, Homo sapiens
tgcaaccaactcccagatcaggaatcagaatccctccctccctcttgttcttcaggagtggtgagacttggcttctggtctcccagccacagttattgctcacctgaacttactttctcagcggtcacacttcatgtggaagagagtaggccacaggattgtgccttgtggtctgactccaagtgactctaaccatgaggtttccaccacttcctttgagagcattcctagtccaagtaggcctgagcattaggaaatattgacactgcagcattttcttgttgcttttagttatatcatcattgatcaccttaatggtatttttgtttgtgtgtatagtatccctgcttttcataatactgagaagaggatattttgatttgtgttcccaaagtaaagcatgaatggggagggatggccacagagaaaatgagcatttgaaattttgggcattaatacttggaattacggatatgtaggtacaaaatttatgtgctccttctcaagtgtaagt

SEQ ID NO: 186880 - DNA, 152 bp, Homo sapiens
gtaaaaccaccataggaatatacttgtcaatagactgccaggagaaaataccatcaaaaatacgtttgaatgtgaagttagcacaagcttggtgaatcatttgacctgccaggaccgagtcagatgtggaactgaatgaattcacaatggta

SEQ ID NO: 186881 - DNA, 434 bp, Homo sapiens
accattcagtagagtatagcgtgagacacatttgtatagtttcaaattcaatagagtatagcgtgagacacatttgtagagtttcaaattttctagtagccatagtacaaagaaacacatgaaatgtgttttaatatattttatttaacccaatttatcccgaatatgttcatttaaacacttaacataaattaccaggggccgggcgtggtggttcatgcctgtaatcccagcactttgggaggccgaggtgggtggatcatgaggtcaggagatggagaccatcctggccaacacgatgcccccgtctgtactaaaaatacaaaaaaattagccaggcgtggtggcgggtgcctgtagtcccaactactcgggaggctgaggcaggagaatggtgtaaacccaagaggcggagcttgcagtgagcagagacc

SEQ ID NO: 186882 - DNA, 653 bp, Homo sapiens
ccctcccttccttccttccttcctcccttcctccttccttccctccctccattctttcctttcttcctttcttcttttctttttctttgtctctcatgcctctcttttcctttctttatgggctacgggtgtaaatagaccacactgcactgaaatctacattacttaccaaaacctctggagctgcttctgtcttgtaggcagggagctcgtcctgtagcccttaggtcctcccagcctcctcctcctctgatttgtgggtgccactggggcagctgctgagtctcagtggttcctagtcatcaccaagttctgcccacctagatggtttgcacctgtccttaccagaaccctgcactgtctagatgactgaggctgcttctgcctaactgatctgctatctgtgttccgggggcaccccagggttagaggtaaatggcacaggcattgaaatctccaactgctctgactccaggttggtgcacttcaatgccaagtactaaccacacaataacaggatgccaccaaaaccttggtatggggctgctgcatcctaattaaaaaaaagtaatagatgttattttttagaacagttctaggtttacagaaaaatggagtggatagtacagagagttctcctaggctcccctgtc

SEQ ID NO: 186883 - DNA, 599 bp, Homo sapiens
gggtacctcacgtcgtgacgggtctttttctttgtctctcatgcctctctttttctttcctttttgttctactttttaaaaaagaccacactgcactgaaatctacattacttaccaaaacctctggagctgcttctgtcttgtaggcagggagctcgtcctgtagcccttaggtcctcccagcctcctcctcctctgatttgtgggtgccactggggcagctgctgagtctcagtggttcctagtcatcaccaagttctgcccacctagatggtttgcacctgtccttaccagaaccctgcactgtctagatgactgaggctgcttctgcctaactgatctgctatctgtgttccgggggcaccccagggttagaggtaaatggcacaggcattgaaatctccaactgctctgactccaggttggtgcacttcaatgccaagtactaaccacacaataacaggatgccaccaaaaccttggtatggggctgctgcatcctaattaaaaaaaagtaatagatgttattttttagaacagttctaggtttacagaaaaatggagtggatagtacagagagttctcctaggctcccctgtc

SEQ ID NO: 186884 - DNA, 636 bp, Homo sapiens
ccctcccttccttccttccttcctcccttcctccttccttccctccctccattctttcctttcttcctttcttcttttctttttctttgtctctcatgcctctcttttcctttctttatgggctacgggtgtaaatagaccacactgcactgaaatctacattacttaccaaaacctctggagctgcttctgtcttgtaggcagggagctcgtcctgtagcccttaggtcctcccagcctcctcctcctctgatttgtgggtgccactggggcagctgctgagtctcagtggttcctagtcatcaccaagttctgcccacctagatggtttgcacctgtccttaccagaaccctgcactgtctagatgactgaggctgcttctgcctaactgatctgctatctgtgttccgggggcaccccagggttagaggtaaatggcacaggcattgaaatctccaactgctctgactccaggttggtgcacttcaatgccaagtactaaccacacaataacaggatgccaccaaaaccttggtatggggctgctgcatcctaattaaaaaaaagtaatagatgttattttttagaacagttctaggtttaccactgtctaaaagtcacaaaacaatatctaa

SEQ ID NO: 186885 - DNA, 1363 bp, Homo sapiens
cccggcgccgcggaccgagagtctagccgccgccccagcccagcccgcgcggctgccgccaccggcacggccaggccagcatggtggaccacttacttccagtggacgagaacttctcgtcgccaaaatgcccagttgggtatctgggtgataggctggttggccggcgggcatatcacatgctgccctcacccgtctctgaagatgacagcgatgcctccagcccctgctcctgttccagtcccgactctcaagccctctgctcctgctatggtggaggcctgggcaccgagagccaggacagcatcttggacttcctattgtcccaggccacgctgggcagtggcgggggcagcggcagtagcattggggccagcagtggccccgtggcctgggggccctggcgaagggcagcggcccctgtgaagggggagcatttctgcttgcccgagtttcctttgggtgatcctgatgacgtcccacggcccttccagcctaccctggaggagattgaagagtttctggaggagaacatggagcctggagtcaaggaggtccctgagggcaacagcaaggacttggatgcctgcagccagctctcagctgggccacacaagagccacctccatcctgggtccagcgggagagagcgctgttcccctccaccaggtggtgccagtgcaggaggtgcccagggcccaggtgggggccccacgcctgatggccccatcccagtgttgctgcagatccagcccgtgcctgtgaagcaggaatcgggcacagggcctgcctcccctgggcaagccccagagaatgtcaaggttgcccagctcctggtcaacatccaggggcagaccttcgcactcgtgccccaggtggtaccctcctccaacttgaacctgccctccaagtttgtgcgcattgcccctgtgcccattgccgccaagcctgttggatcgggacccctggggcctggccctgccggtctcctcatgggccagaagttccccaagaacccagccgcagaactcatcaaaatgcacaaatgtactttccctggctgcagcaagatgtacaccaaaagcagccacctcaaggcccacctgcgccggcacacgggtgagaagcccttcgcctgcacctggccaggctgcggctggaggttctcgcgctctgacgagctgtcgcggcacaggcgctcgcactcaggtgtgaagccgtaccagtgtcctgtgtgcgagaagaagttcgcgcggagcgaccacctctccaagcacatcaaggtgcaccgcttcccgcggagcagccgctccgtgcgttccgtgaactgaaagcgccctgaaccccagcctgtccgtcaccc

SEQ ID NO: 186886 - DNA, 380 bp, Homo sapiens
accaaaatgtatacaacaaaaagatgactgattatttctcaagcaaaagatatttcactgtttaccaaactccaaaagatctgtacagagccttacagcacactctgaaaaccactgatctatggacaggcccctctacttaattaagtcagaaaagtggaagcattctagagtcatctacacttggattcagaccccggctccaccagttgttgagctgtaaaactggactgtttccagcctcaactggcttttgtctagattgagatgggtaatttatgtgtatcatggatggtacatattccagaatatttaagttttcagctgagacctgatttaattgccaagtcatcaattagtcacagactcagaatttgtag

SEQ ID NO: 186887 - DNA, 179 bp, Homo sapiens
taccatccccattttgcagatgaaaccagtgaggcagctgtgttgtagtagaacccaggaaagtgcttttaccactatacaacagctgcctgtcggttaagagagtaatactgccctttattataacacttggggtaagatagaaattgtagaattaatgtaagttaagttgtcttatg

SEQ ID NO: 186888 - DNA, 423 bp, Homo sapiens
aaatagtgattttgaaatgctcttaaagtctggttgctgaggctaagtcatattatgaggtaaaaacagaaagcaacatgagggaatagatttgcagtttcaccagcgtgcaaataattcattaacactcgctacagttgtgaccttatgactttattttcacagaattcagttctcaaaaggttctaataaccttacagaagaccattcctacaattcaaatatgctaccaccaagtgacactgccactgctaccaggtgacacttgattgattgattaaagacagagatcagttgataaaggcaaggcttctctgcagttcaaactgcactctgtgcaagtactgtaacacgttatcactcccatcaaatgtgtaactcccatcaaatgtgtattcccatatggataaatatcacaagtag

SEQ ID NO: 186889 - DNA, 399 bp, Homo sapiens
cagccactcaacaataacaaaaaataaacaacacttaaaaatggacagagggtgtgaatcacatttctcaaaaaaatatagtactcaaggccctcaccagaagcaaatgccagcaccacatttcttgcacagcctgcagaactgtgagccaaaatatatctgttttcttcataaattactcagtctcagatattcctctatagcaagccaagaatgaactaacacaatattttaaaaaggtagccaaaggttttatcagccacctcaccagaaaagaaaaacagatggcaaacaggctcatgaaaacatactaaagatcatttgtccttaggtaattataaatcaggagaataagcattcttaggtagcattacatacctgagaacataactagaaaac

SEQ ID NO: 186890 - DNA, 354 bp, Homo sapiens
aataaatggaaattaaataacctgctcctgaatgatcattgggtcaacaatgaaatcaagatggaaatttagaaattcttcaaactgaacaataatagtgacacaacctaacaaaacctctgggatacagcaaaagcggtgctaagaggaaacttcatagcattaaatgcctacatcaaaaagtctgaaagagcacaaatagacaatctaaggtcacatctcaaggaactagagaaacaagaacaaaccaaacccaagcccagcagaagaaaagaaataaccaagatcagagcacactaaatgaatttgaaacaaaaaaaaaccacacaaaagacaaatgaaacaaaaagctga

SEQ ID NO: 186891 - DNA, 331 bp, Homo sapiens
gcagatgtcgagaacaggcacagccatagagaaagaaagatgagtggccacctagggttatggggcagtggggattaaggttgatgactaagggtgcaggtttctttttggggtaataaaaatgttctaaaattgattatagtgacggctgcataattctgaggatatacagaaagccactgaattacacattttaaatgggtgaattgtatagtacatgaatatatcttaataaagttgttgccaaaaaaaatgcttactgccgcactggcatgaagtaactgctagtgttatgatgatggtgactcatccgatatagcactggccttct

SEQ ID NO: 186892 - DNA, 618 bp, Homo sapiens
gggctggccaagaactggaaggaatgcggtctgagccaagcaagctcccaacatgtcctggctcctgtgaggaagcaaagctccgtgtactgcagttcattagggaaacggaagagattgtttcagcttccaacagttctcggttccctctgggggagagtttcctggtggccaagggaatccggctgaggaatgaggacctcggccttcctccgctcttcccgccccgggaggctttcgcggagcagtttctgcgtgggagtgattacgccattcgcctggcggctcagtctaccttaagcttctatcagagacgccgcttttccccggacgactcggctggagcatccgcccttctgcggtcgggcccctacgtgccacagtgtgatgcgtttggaagttgggagcctgtgcagtgccacgctgggactgggcactgctggtgtgtagatgagaaaggagggttcatccctggctcactgactgcccgctctctgcagattccacagtgcccgacaacctgcgagaaatctcgaaccagtgggctgctttccagttggaaacaggctagatcccaagaaaacccatctccaaaagacctgttcgtcccagcctgcc

SEQ ID NO: 186893 - DNA, 418 bp, Homo sapiens
ttggagggaaaccaggaatcccagaaagctgtttgctcttgtgtgggaatcaagtcccagaagaagtgggtagatgcctgccttgaaatctcacttaaggagagttggtcttttatgggaggattttaaatcataaagtgcattattaaggatttgccatctgggtttttcaggtataaaggctggcatttccctaaatggcttttccctgttgaaattgtgtttctaaaagtcggtggatgggacctctcacatcttcctggagcatagccttttaagcttagctgatttctgaggctgcctcagtgggctccccagccttcatgtagactggccttgtgtgggtgggtagtggccattgctagggattccagaaactactggtgtttgcttgtgttgtgtttaaacattcatagta

SEQ ID NO: 186894 - DNA, 1120 bp, Homo sapiens
acgtaaaaacctcacactaagtgacataagccagacacagaaggacaaataccgtatgattccacttagctcaggtacttcaataggcaaactcatagagacagcaagtagaacagcagtgaccaggggctgggacgaggagagaatgggtacagagtttgtgctggggatgatgaaaaagttctgggtgtagacagtggtgactgtgaatgtatttaatgccactgaattgtacacttacaaatggataaaatgataagtattgtgttatgcatattttaccacaataaaaaaatttttttaaaacctcagaacttcagctgccaaaacgaatgaatgaatgaatgaatgaatgaatgaatgagaccttcactcttccctgatcaagattttcctggttgcatcatcaaatagacaaagtgagaaaacagcatgctgtaccggggtagggacagcgactggggcagtctctctacctgggcctcagtttcgccaactgtgaaatcaaggcatctgccccatcggaccagatgtggagcctgtgaccagatgtcatctttcctctcttcagtctcacagctaattctaggaaggtgctggcactaggaagagctctggcttagccagccacctctcactgtgcccacgccacttcccctgggagactccttttctcacctgtgaaatgcggagactaatgacaaagctactgtctctacccctgcttcccttacacactggctgcggctccctcagaagatcacaaaggtgaggtggatggagccctagcttcttccctgagctggctgcctggaaaaagccaccccggccaggtaactcaagggactaggaaaatcctggctgcactcaagcttggcaaggaggctgaggggcaggagaaatgaaggagaactctccaaggcctgccttgttgtccaaccaacacctacttcatttttccttaggtggaaccatacaagagtgggcacattgggtacagagttagtgctggcgatgatgaaaaagttctgggtgtagacagtggtgactgtccatgtatttaatgccactgaattgtacacttacaaatggatcaaatgataagtattgtggcatgcat

SEQ ID NO: 186895 - DNA, 593 bp, Homo sapiens
tcgatctctagaggagtcccctggagctggtttcctctcttcagtctcacagctaattctaggaaggtgctggcactaggaagagctctggcttagccagccacctctcactgtgcccacgccacttcccctgggagactccttttctcacctgtgaaatgcggagactaatgacaaagctactgtctctacccctgcttcccttacacactggctgcggctccctcagaagatcacaaaggtgaggtggatggagccctagcttcttccctgagctggctgcctggaaaaagccaccccggccaggtaactcaagggactaggaaaatcctggctgcactcaagcttggcaaggaggctgaggggcaggagaaatgaaggagaactctccaaggcctgccttgttgtccaaccaacacctacttcatttttccttaggtggaaccatacaagagtgggcacattgggtacagagttagtgctggcgatgatgaaaaagttctgggtgtagacagtggtgactgtccatgtatttaatgccactgaattgtacacttacaaatggatcaaatgataagtattgtggcatgcat

SEQ ID NO: 186896 - DNA, 217 bp, Homo sapiens
ggagctctttgtactattctaagtctgaaattatttcaatataaaaagtctcaaaattgccaatgcccaagtttcatcccagatcaactgatttggctttctcttgcgtggcggtgggggggcggtgaggcacagggaccaggtgattctgatatgcagttggagtgaaaatccccacactggccacaccacctcctaatgcacacccactggtggc

SEQ ID NO: 186897 - DNA, 220 bp, Homo sapiens
actaagggaaaatgtgacatccaagtaaaattatgcctatccatccttttaccagaacagatgcctggaatgatatacaccaaatgctaacccaagttaattctaggtggccagtttgaggtcatatcttactttgttaactgtattgctgaatattggccaggaatcatttttctaaaaatagtgattttactcttgatagttactattcttttttttt

SEQ ID NO: 186898 - DNA, 207 bp, Homo sapiens
ttacgaaggaaccacaagtgctatagaaatgtgtacttaatttgtctggtactaaagagctactaaaaatttcagagcagaagagagtttgattaaatcaacaatgatttcttttcccatcatcactctttagctggtaattaaaacagtatgccagaagttccccatgtaagaaaaaagaaaggcaaaactgaggcccctgcctta

SEQ ID NO: 186899 - DNA, 472 bp, Homo sapiens
atttgtgttcctcaatatgttaccaatgtatgacctacattagaatttctgggaatggagcctagaatctttttaagcacattccccagctgactcttaatgcccatttatatattcatatttcagattcgctggtataaacaatatgcagaatgagtttagtagaagggagaggtcaaatggactcatttctctctttcaaatatacctaagctattttccagtattttccttacgttgcttttacatacaatcaaataatttagatttaaatggtacacaaaaaagtggctttaactagaaatactactactagtttcaaacaactcctcattgtgaaataatttataaagtcatgatagaccaattttatgttttaatagcaattatggcaggttactaagctaatactttactgattataaaaatcaatttatgggcaatgtacaaggtcaaattcatgaactgatta

SEQ ID NO: 186900 - DNA, 324 bp, Homo sapiens
ggaatgcttggaagaggcaggcagttcccttagaatcgggtcggcgcaggcttcgctgtgcccgtgtttcctccgtatggacatggccatccttgctgccttaacttctggcattgctgttgtgccctccaggccatctgctgctgtctttggtcctccatttcttccttcctttaccatggcatagtggtgagaagctttgaagtcagactacgtgactttgatccccggctcttgtccttagtcagctgcgcctcagtgagcatattattgagcctcaatatgtcccagtttcttctctgtaaaatgggactattaatggta

SEQ ID NO: 186901 - DNA, 399 bp, Homo sapiens
taaggaagaaatagcaatacaataataataagggatttcagtactgcactttcaaaaatggatcaatcatccagacagaaaatcagtaaggaaacagcagacttgaataacaatatggaccaaatggacctaacaagatatagacagaccattccatccaacagctgtagaatgcacattcttctcaagtcataaggagcattctccagattagatcatttattggaccacaaaacaagtcttaacaaatttaagaggattgaaataatatcaagaatcttgatatcacacaatggtgtgatactagaaataaaaggaagaaagttcacaaatacgtgaacaagacacccctaaactaccagtgggtcaaagaggaaattaaagggaaataaaaagaaa

SEQ ID NO: 186902 - DNA, 376 bp, Homo sapiens
gctggcctttcctttttattctcttaaaggtgtctcttcactaacagaattttttttatttttgtttttaattattatggatacataatagccatacatatttatagggtagatgtggtattttgatgcaagcatagaatgcatggttatcaaattagggtagagtaccccatcacctgaatcatttatcatttcttcatgttaggaatattccaattctagtcttttagtcattttgaaatataaaataaatcattgttaactgtagttgccctattgtggtactgaacactagacttactcattctttttaactgtatttttgtgcccagtcaccaatccctctttatttcccacttcccttcctgtcctttac

SEQ ID NO: 186903 - DNA, 258 bp, Homo sapiens
cctgagctcccacttaatcatctctagatacttataatacctaatacaatgtaatgctatgtaaataatgtcatactgtactgtttaggggataataagaaaaaagtatgtacatgtttagtgcaggcacagctatcatcttttttttcaattattttcaatctacagatgcagaaccccagatatagagggccaactatatctgcctattttataaatacaaagcaggcaacacccacaaagacatattttctcata

SEQ ID NO: 186904 - DNA, 403 bp, Homo sapiens
tgaggaaaaacgacggtctgctatatctacatgattcacatagctgtttccagtaaagtaacagactatttaaaaactaacgagaacacagtatctccaaacctatggaaatgtggtcaaaagtcaccatcagaggaaaatggcaaacaagctttcactgcaaatacacatacaaatccaatccagcagggtattaaaagcataatgcatcataactggaaagttttattgccagcaacagaaaaagaaacaagcagaacgaacaaaggctaaatcctaaaaccaaagtggggagatctagaacgaaggggatttgtactacacaagtctactgttgaagctttaggaagctttttttttttttttgagatggagtctcactctgttgcccaagctggattgc

SEQ ID NO: 186905 - DNA, 144 bp, Homo sapiens
tcttttggtgtgttattgggttgtttttaaggacactatttaaggaaacttcttttcccctggaaaatcttgaacaaaaattgcattgaaaaactggtgtcagttttctgtgctaaatttggtgaagtttccattgttctttta

SEQ ID NO: 186906 - DNA, 512 bp, Homo sapiens
tagggtatccatgacacggcttctgccagggttttggttttagagcatttaatgtgtcatgctcttagggaacattttcaaactctggcctctgtgtcaacttttccccccttggaaatacagagggttggctcatttgctgctccattttctgccaggacctttgaccaatacttggtttttctttcctgaaattttcaagaagggaatggaatatctttgtatagcttccccctcttctggtggcagatcaagcatatggccctttgaagtttcataaggagctataactaacatgaatgaatgtcaaccatgtgccaggccttagctaggtctctttgtttatcttatttaacccttagcactattctgagtggaagatggcattatctctattctgcatttgaggaacctgaggcttaggaaatttactttgcccaagatcatagtactaatacttaggtactagtattaatacaagtactagtacttgggttcaaacccaagtcttc

SEQ ID NO: 186907 - DNA, 104 bp, Homo sapiens
gaaccgatgtcaccctcttctatctcctctcccctactcaagacctgctggagaagtaaacacatatgctttctctcccctggaactaactataaacatatcac

SEQ ID NO: 186908 - DNA, 219 bp, Homo sapiens
gctcccagaggaactgcgtgttcttcagaaagtaccgctggagccttgtgagtacagtggtgctttgtggtttgagatctcagcacaccggcagcttcagggggcttaggtagtcttcaggggtctttagcagaaaggctgggaacctcccttctggtcagagcctcatatcccagtaagaaaagttgaagcccagagaaggcgatgtctgtgtcccag

SEQ ID NO: 186909 - DNA, 136 bp, Homo sapiens
cactgtggcctacagaaaggaagtccatacacaccccaatgttcacacgaaatgtaataaggaagtaagttccgaaacgcagagcacccctaaacgcctattttccacactcccacctccagaacaggcctttcgc

SEQ ID NO: 186910 - DNA, 276 bp, Homo sapiens
ggtctgcctgcaatcactccttctatctcatatatacaaatccttccaactgctggggctcatctcctgcctcaccctcttcctgaaatgctagtttatccagctggaaggaatttctttcatcttaactattattttacaactgtttgtatctctcaggaaaccaaagatactctacatggaagtatagtttttctgaagacatctgatgaaaagtcacaggtattgatttggaatgttggcaaggcccctaaggttgcccgccggatccccttt

SEQ ID NO: 186911 - DNA, 669 bp, Homo sapiens
cacttagttgcaatggttggtgaggatttcgggcatgtgagatgtttcacatggtgaccagcacaaggagtcctaaaaatctaagtcctaccccaccttctcttccttgcccctttctcttctacttgaaaaaggctttcccacctggtgagaaggtctgggccaaagctggtgggggatgccttctatttccccaacagtaccttctagcatcaggaatctcagacaccagcctccttggtgatcttctggtttaccaagggaaggtgtcagcttgggcatggggtaggtactgggcgagacttgctaaataacactggcaaacttcggcaactgagaaatatgggttcaacgtgctacttctcctcttgtaaagaggctacagtgccatatgcaatcacgactttcccagctgaaatgactttctcataagagggagcatcacatgttccactgtgaattcacatcaaatgttcactgacattttcaaacagtaatataaatctttacacagtaaatcaatcacaacggcagcagcaatgctgttggaagcctaaaagtgcatttaccttccaaagcaagatggtatatgtaaatgttcaaatgtctagataaaactcaacctgaagacagaaataataaaattgctcagtatgctgccaagaaggg

SEQ ID NO: 186912 - DNA, 548 bp, Homo sapiens
aagatgatatttaggccaggtgcagtggcacatgcctgtaattccagcactttgggaggctaaggcaggaggattgcttgagtccaggggattgagcctgcagtgagccaagatcatgccactgcacttcagtctgggtaacagagtgagaccctgtttcaaaaataaaaaataaaagataaaagatggtattgacaccacttagaaagccatttagaaaaaaataagccagatccccacttcattacttatattgagataaataaaagatggaataaagatttaaatgtaatgaagacataaagtttccagaagaaaatataggtgaattacttttgtaatcttagagtggaaaaaagcttttgttttaacctgaagccctaaagccctaaaggaaaaaaaaaaaatcagatgatataaaaatgtaaaatttccatatggctaaaaaaatcttgtcataaactaaataaaaagacaacaaaaggaaaacatatttgcaaaatacatgacaaaagattaattttccttatttccaaaaagttcttacc

SEQ ID NO: 186913 - DNA, 558 bp, Homo sapiens
tccccctgatatgtctggcattgctatatgttttctgcatatttacatatcacatccttttgttcctctgttcctcttttactaccttcttttatgctaaacacatttttttgtgatcactttcattcatgtttattttttaatctttttgtgttattctcttggttgctgccctagggattataacatgaatcttcaattgatcacatttgtacctcaagttaatactgagctaattctggcaaaatacagcaactttgcttctatatagctccatttcccatccctcctttctgctaatgttatttatattacatcttcatgtttaataaatccagcaatacagtgttagagttattgctttaaacgttaggtttttgaaataaattaggagaaagggaaaaatgcacacactgttttatattttcccacttatgtaccatttcttcttatgcaatagatttaccagtctgtgttatttctttcagcttaaaggaatttagtatttctggtagaacaggtctactggcaagatattctccaaatgtgagttaccag

SEQ ID NO: 186914 - DNA, 152 bp, Homo sapiens
cctggagttttacatggctcagcagcaactggcttttgggtgggaagtggcagaatggttatgcacaaggagaaatagatattgacatactgaggaatacttagattcgtcgatttctcagtgtccttcgttcttgttgtttcatttgtctt

SEQ ID NO: 186915 - DNA, 337 bp, Homo sapiens
tgaaaacccaatcatcatgcttgtgaactacagaaggatctctaatgttaccttccagccattttagaagtctacctcccaagcacatatatttaggtttttaatcattcttgaatttcttgttacatagtatgtgaactaaggaatctttattttccatccagctagctaattgtgccaacaccatgccacccctgtcagattcccattccccaaatatgtgtggtccatttctagtttcttctgctctattgtttttttgtttttgtttttgttttttttttttgtctaaccctgtggaaatatcacatcatttagattactatagcctcttaag

SEQ ID NO: 186916 - DNA, 598 bp, Homo sapiens
cgggtgaggcaagaggaagcggctcgctacagggaaaagcaatggactagaagtcaggaaacctggctcttgtcagagctaacaaggttgtgtggccttgaactggacacaattgctctgggttttcattttgtcacctgtagaatataagaggatttaactatataatctctacaccaagtctagctttatagatgggaagaccaaggaccacacagaccaacattttaatactttcaaattcactgttctggcattgcttggacctcagggacagaaagcaggacacaggaaacagaactgcagtcttccatttgcctcaagccatgcttactgcagcaatgtggccacatttattttggttgagtaaggcccaaaggagtttgctatggaagcaacagcagcatatgctgatattctataattattttctttcaaatataactttttctgcacttccaagattgtcaaaaatgtctacagctgattcaaaagcatgatttttgtttaaataagataatagttaccaccaaaaataaagaatatcacttgtaattcgtagatatttgaagtgccaatagtcaaaaagcattagtcc

SEQ ID NO: 186917 - DNA, 1388 bp, Homo sapiens
aggaccatttggaaagtgattaagtcatgagggcatggtctttacaaatgaattaatgccctgtaaaagggctggagggaattagcttaaattcttttttgcccttccaccttccaccatgtgaagacactgtctgtcccctccagaggatgcaacaataagacatcattttggaagcagagagacacaaaacctgcaggtgccttgatcttggattttccagccttcagaattttgagaaatatgtttctgttatttacaaattgcccagtgtgtggtattttggtatagtagcacaaatgtcctaagacatgataaaggtatccagaaaatgccaaaaggtcaaaacaagggaacattggaattaagggaagagagagaatgaggaaagagagaaaaagtttgtgaagggaagtcttcaaatcagaggttacaaggtattagtagttagaaagcataggctttggattcaaaaaggcccagatctgttctgcttactaggcatgtgacctgggcaagtaactggtttttgcttgtttgtttgttgtagtttaattttctcatcgtacaatagatacaacatctaccttaatcagtttgtttagaggttgggtgatgagagagaacatgtctcagccgtttaagtggttacttctctggagagagtttctgggcttagggaaagaaagataaatttatttttaaattttatagccctttatctgtatatttaaagggagggaagtactatgctttataagtatgttaattgttttctatgttagcaacatatcgtatacatatacctcaaggttataagaagtcttaaaaaaattgtgcttattatttatgttgaaatgttttgcttctaaaatcctttatgttttttagcctcattgtaatttgtccccagaattgctgtttcctttttctacaacaggtttctcaaaacactcttttaaaagactagctggacatggtggctctctcctgcaatcccagcgctttaggaggccaaggcaggaggtttgcttgaagtttgagaccaacttgtgcaacaaaatgaggcctgatcccttaaaaaaaagactcattcaatgtgtttagaagttcaggccgggcacgatggctcatgcctgtaatcccagcactttgggaggcagaggcgggtgggtcacttgaggtcaggaatttgagaccagcctggccaacatggtgaaactctgtttctactaaaaatacaaacattagccggacattgatggtgcgcacctgtagccccagctacttgagtggctcaagcaggagactctcgagcttgggaggcagaggttgcagtgagccgagatcacaccactgcactccagcctgggtgacagagcaagact

SEQ ID NO: 186918 - DNA, 422 bp, Homo sapiens
ggcttacccttcatgctgtcatattcacctgctaaaagtccagtcttcctttccgaaacaagctcagaaaaccttttgggacaactaagtcggttttctcaacacaatgtgatctgttcctctttaaacaatcataatcattctcgtctcccttcacctcttttatggaagtctgattgtattttagctgtcaccatacctgtcttatcacctacagctaactgtatataacttgagtacagaaatcttgatatactcattttcataccctttataagttcttccacagttcctgcctgaaacccagcaggtgctaaattaatatttatcggacaacaagaaactttagagaccagtatatcaggaattaactccacaaagttatcctctgctttttctatttctatttctttcaagtttga

SEQ ID NO: 186919 - DNA, 447 bp, Homo sapiens
agacaaagagaaacctagggggacagcaggtggacaaaaccttcccctgaactgcactcggtgtctaggactgttggggaaggaagtgaagagccagcatgtagtctcctctggactcttacaggatctgtccacctctgggctctttatgtaggggaaggtgtgagctcctgggagtactcctgatagaggactgtttccctgaaaacctcagcagtgtttgaggccctagcagggggaacccagaccccgcctgccaaagcccctaatccctcagggctattatcagcagcctaagcgccttagggtggccagagtccagcccagcaagcagcaaagtcagcagcctcctcgccctatcctctccatgccccggggcactccagtcccagctggctgatcacatacacttccacaaagccacacaaccacagcacaaccagacac

SEQ ID NO: 186920 - DNA, 892 bp, Homo sapiens
attccagacccaaggctgacgatcttcttcaaaggagtcagtggtggaaacacagactcagagccactcccaaaaggggtgtcagtctccactgtgactgaccacaaaaccctgcaggaaagaggctgtgggttttcctgcgtggtccccagaccctaatatgcccttgtggctgcctaatacacatctctatttaaaatgttcagaatctgtgtacttggaggactaagcaggaaagaaatagattgaacgggccaaccaggtattttaggattgggctgtcaactttatagtctaacagcaatggaaatgtctaagatggaaacaatcaaaacagtcaagttgtcaacaattgccaatgaattcagcagcctaaatgaaacaagcaaggaatgagacttaagaatttaaaaaagggatgaaggacccagttcttccagcctaaaggattttgaaatctccgtttgcttaaccaaggacatgaatgccacaactcctgaatgcagaacttaatccagcagcgtgcctccagtagaaaataagctgaagttcaatgtattctctatgaagaagagggatgtacaggaaaatctgcaggcctgggtgtcagccctgagtcaggactctgactctgttgcttcttagctgtgggaccatgggcaaagaagcctggatgataacactgaacttcagccaggaagtgatctatatcctttggtctacaaatgtttcgctccatagttgccgaattttagggaatatgttccctacccatttcagttcgatctcaaatttatttagttaatgtcttgcccagaaattatttccccggtggcaatattcttccgcgtttaaccaaaaaataggtccttttaaacccctaattgaattc

SEQ ID NO: 186921 - DNA, 374 bp, Homo sapiens
tgcaaattccttatctcttcaagatgggaaaagagtttgcaggtgccagtctaggccacactttgagtagcactgtgctacaacaatcatttgtctaacgtgttccttgtcaaacagaaggcatattagaataaacccaacaaaattcatcacttctgaaagtttacttctgcaatttcaaacacagttttaaaataatctctaggggaatacaaaaattagctgggcgtggtggcaggtacctgtagtctcagctactcgggaggctgaggttgcagtgagtcgagatcgtgctactactgactgggtggcaagggtgagactccatctcaaacaagaaacacaaaaacccaaaaagtcaactttactgtcag

SEQ ID NO: 186922 - DNA, 326 bp, Homo sapiens
acgaggcgtcacataaaacagtcgctcacccgaacccattatcttcccaactgcagagtattgtatcttgggggaccaaaggaggccataaaaatcaagtcccctcaaattctatcctcacacattcattcaccaatgaagagaaggctacagaattattattattattattttagacagggtctccttctgttgccccaagctggaatgcagtcgtgcaatcacagctcactgcagtctccaactcctgggcccaagtgattttcccacctcagcctcccaagtagctagagctactggtgtatgccaccatgcccagctgagag

SEQ ID NO: 186923 - DNA, 5489 bp, Homo sapiens
ggcagagctgcagaggcaccggacgagagagggctccgcgggcccagctggcagccaggccggagacaagttgcagtcccgggctctggtgacgccgtggccgcagggtctccattttgggacattctaatccctgagcccctattattttcatcatgggcttctgcctggctctagcatggacacttctggttggggcatggacccctctgggagctcagaaccccatttcgtgggaggtgcagcgatttgatgggtggtacaacaacctcatggagcacagatggggcagcaaaggctcccggctgcagcgcctggtcccagccagctatgcagatggcgtgtaccagcccttgggagaaccccacctgcccaacccccgagaccttagcaacaccatctcaaggggccctgcagggctggcctccctgagaaaccgcacagtgttgggggtcttctttggctatcacgtgctttcagacctggtgagcgtggaaactcccggctgccccgccgagttcctcaacattcgcatcccgcccggagaccccatgttcgaccccgaccagcgcggggacgtggtgctgcccttccagagaagccgctgggaccccgagaccggacggagtcccagcaatccccgggacccggccaaccaggtgacgggctggctggacggcagcgccatctatggttcctcgcattcctggagcgacgcgctgcggagcttctccaggggacagctggcgtcggggcccgaccccgcttttccccgagactcgcagaaccccctgctcatgtgggcggcgcccgaccccgccaccgggcagaacgggccccgggggctgtacgccttcggggcagagagagggaaccgggaacccttcctgcaggcgctgggcctgctctggttccgctaccacaacctgtgggcgcagaggctggcccgccagcacccagactgggaggacgaggagctgttccagcacgcacgcaagagggtcatcgccacctaccagaacatcgctgtgtatgagtggctgcccagcttcctgcagaaaacactcccggagtatacaggataccggccatttctggaccccagcatctcctcagagttcgtggcggcctctgagcagttcctgtccaccatggtgccccctggcgtctacatgagaaatgccagctgccacttccagggggtcatcaatcggaactcaagtgtctccagagctctccgggtctgcaacagctactggagccgtgagcacccaagcctacaaagtgctgaagatgtggatgcactgctgctgggcatggcctcccagatcgcagagcgagaggaccatgtgttggttgaagatgtgcgggatttctggcctgggccactgaagttttcccgcacagaccacctggccagctgcctgcagcggggccgggatctgggcctgccctcttacaccaaggccagggcagcactgggcttgtctcccattacccgctggcaggacatcaaccctgcactctcccggagcaatgacactgtactggaggccacagctgccctgtacaaccaggacttatcctggctagagctgctccctgggggactcctggagagccaccgggaccctggacctctgttcagcaccatcgtccttgaacaatttgtgcggctacgggatggtgaccgctactggtttgagaacaccaggaatgggctgttctccaagaaggagattgaagaaatccgaaataccaccctgcaggacgtgctggtcgctgttatcaacattgaccccagtgctctgcagcccaatgtctttgtctggcataaaggagacccctgtccgcagccgagacagctcagcactgaaggcctgccagcgtgtgctccctctgttgttcgtgactattttgagggcagtggatttggcttcggggtcaccatcgggaccctctgttgcttccctttggtgagcctgctcagtgcctggattgttgcccggctccggatgagaaatttcaagaggctccagggccaggaccgccagagcatcgtgtctgagaagctcgtgggaggcatggaagctttggaatggcaaggccacaaggagccctgccggcccgtgcttgtgtacctgcagcccgggcagatccgtgtggtagatggcaggctcaccgtgctccgcaccatccagctgcagcctccacagaaggtcaacttcgtcctgtccagcaaccgtggacgccgcactctgctgctcaagatccccaaggagtatgacctggtgctgctgtttaacttggaggaagagcggcaggcgctggtggaaaatctccggggagctctgaaggagagcgggttgagcatccaggagtgggagctgcgggagcaggagctgatgagagcagctgtgacacgggagcagcggaggcacctcctggagacctttttcaggcaccttttctcccaggtgctggacatcaaccaggccgacgcagggaccctgcccctggactcctcccagaaggtgcgggaggccctgacctgtgagctgagcagggccgagtttgccgagtccctgggcctcaagccccaggacatgtttgtggagtccatgttctctctggctgacaaggatggcaatggctacctgtccttccgagagttcctggacatcctggtggtcttcatgaaaggctctcctgaggaaaagtctcgccttatgttccgcatgtacgactttgatgggaatggcctcatttccaaggatgagttcatcaggatgctgagatccttcatcgagatctccaacaactgcctgtccaaggcccagctggctgaggtggtggagtccatgttccgggagtcgggattccaggacaaggaggaactgacatgggaagattttcacttcatgctgcgggaccacaatagcgagctccgcttcacgcagctctgtgtcaaaggggtggaggtgcctgaagtcatcaaggacctctgccggcgagcctcctacatcagccaggatatgatctgtccctctcccagagtgagtgcccgctgttcccgcagcgacattgagactgagttgacacctcagagactgcagtgccccatggacacagaccctccccaggagattcggcggaggtttggcaagaaggtaacgtcattccagcccttgctgttcactgaggcgcaccgagagaagttccaacgcagctgtctccaccagacggtgcaacagttcaagcgcttcattgagaactaccggcgccacatcggctgcgtggccgtgttctacgccatcgctggggggcttttcctggagagggcctactactacgcctttgccgcacatcacacgggcatcacggacaccacccgcgtgggaatcatcctgtcgcggggcacagcagccagcatctctttcatgttctcctacatcttgctcaccatgtgccgcaacctcatcaccttcctgcgagaaaccttcctcaaccgctacgtgcccttcgacgccgccgtggacttccatcgcctcattgcctccaccgccatcgtcctcacagtcttacacagtgtgggccatgtggtgaatgtgtacctgttctccatcagccccctcagcgtcctctcttgcctctttcctggcctcttccatgatgatgggtctgagttcccccagaagtattactggtggttcttccagaccgtaccaggcctcacgggggttgtgctgctcctgatcctggccatcatgtatgtctttgcctcccaccacttccgccgccgcagtttccggggcttctggctgacccaccacctctacatcctgctctatgtcctgctcatcatccatggtagctttgccctgatccagctgccccgtttccacatcttcttcctggtcccagcaatcatctatgggggcgacaagctggtgagcctgagccggaagaaggtggagatcagcgtggtgaaggcggagctgctgccctcaggagtgacccacctgcggttccagcggccccagggctttgagtacaagtcagggcagtgggtgcggatcgcttgcctggctctggggaccaccgagtaccaccccttcacactgacctctgcgccccatgaggacacgcttagcctgcacatccgggcagcagggccctggaccactcgcctcagggagatctactcagccccgacgggtgacagatgtgccagatacccaaagctgtaccttgatggaccatttggagagggccaccaggagtggcataagtttgaggtgtcagtgttagtgggagggggcattggggtcaccccttttgcctccatcctcaaagacctggtcttcaagtcatccgtcagctgccaagtgttctgtaagaagatctacttcatctgggtgacgcggacccagcgtcagtttgagtggctggctgacatcatccgagaggtggaggagaatgaccaccaggacctggtgtctgtgcacatctacatcacccagctggctgagaagttcgacctcaggaccactatgctgtacatctgtgagcggcacttccagaaggttctgaaccggagtctattcacaggcctgcgctccatcacccactttggccgtcccccctttgagcccttcttcaactccctgcaggaggtccacccccaggtccggaagatcggggtgtttagctgtggcccccctggcatgaccaagaatgtggaaaaggcctgtcagctcatcaacaggcaggaccggactcacttctcccaccattatgagaacttctaggcccctgcccgggggttctgcccactgtccagttgagcagaggtttgagcccacacctcacctctgttcttcctatttctggctgcctcagccttctctgatttcccacctcccaaccttgttccaggtggccatagtcagtcaccatgtgtgggctcagggacccccaggaccaggatgtgtctcagcctggagaaatggtgggggggcagtgtctagggactagagtgagaagtaggggagctactgatttggggcaaagtgaaacctctgcttccagacttcagaaacaaatctcagaagacaagctgacctgacaagtactatgtgtgtgcatgtctgtatgtgtgttggggcggtgagtgtaaggatgcagtgggagcatggatgctggcatcttagaaccctccctactcccatacctcctcctcttctgggctccccactgtcagacgggctggcaaatgccttgcaggaggtagaggctggacccatggcaagccatttacagaaacccactcggcaccccagtctaacaccacaactaatttcacccaaggttttaagcacgttctttcatcagaccctggcccaatacctatgtatgcaatgctcctcagccctcttctccctgctccagtagtctcccttccaaataaatcacttttctgccgcctt

SEQ ID NO: 186924 - DNA, 5681 bp, Homo sapiens
  misc_feature (171)..(171): n is a, c, g, or t
ggcagagctgcagaggcaccggacgagagagggctccgcgggcccagctggcagccaggccggagacaagttgcagtcccgggctctggtgacgccgtggccgcagctggaagaggaaaacaaggatcagattggagaagtgatttatctaagatcccacagtggactggnagcagcactgagacctcagcctagtctcctgatccccaagcagggccctgcctaaggaacacactctgcagagtgctgggccaaagcagggttttccaactaatcttagaaggtaaagtccatgaagggtctccattttgggacattctaatccctgagcccctattattttcatcatgggcttctgcctggctctagcatggacacttctggttggggcatggacccctctgggagctcagaaccccatttcgtgggaggtgcagcgatttgatgggtggtacaacaacctcatggagcacagatggggcagcaaaggctcccggctgcagcgcctggtcccagccagctatgcagatggcgtgtaccagcccttgggagaaccccacctgcccaacccccgagaccttagcaacaccatctcaaggggccctgcagggctggcctccctgagaaaccgcacagtgttgggggtcttctttggctatcacgtgctttcagacctggtgagcgtggaaactcccggctgccccgccgagttcctcaacattcgcatcccgcccggagaccccatgttcgaccccgaccagcgcggggacgtggtgctgcccttccagagaagccgctgggaccccgagaccggacggagtcccagcaatccccgggacccggccaaccaggtgacgggctggctggacggcagcgccatctatggttcctcgcattcctggagcgacgcgctgcggagcttctccaggggacagctggcgtcggggcccgaccccgcttttccccgagactcgcagaaccccctgctcatgtgggcggcgcccgaccccgccaccgggcagaacgggccccgggggctgtacgccttcggggcagagagagggaaccgggaacccttcctgcaggcgctgggcctgctctggttccgctaccacaacctgtgggcgcagaggctggcccgccagcacccagactgggaggacgaggagctgttccagcacgcacgcaagagggtcatcgccacctaccagaacatcgctgtgtatgagtggctgcccagcttcctgcagaaaacactcccggagtatacaggataccggccatttctggaccccagcatctcctcagagttcgtggcggcctctgagcagttcctgtccaccatggtgccccctggcgtctacatgagaaatgccagctgccacttccagggggtcatcaatcggaactcaagtgtctccagagctctccgggtctgcaacagctactggagccgtgagcacccaagcctacaaagtgctgaagatgtggatgcactgctgctgggcatggcctcccagatcgcagagcgagaggaccatgtgttggttgaagatgtgcgggatttctggcctgggccactgaagttttcccgcacagaccacctggccagctgcctgcagcggggccgggatctgggcctgccctcttacaccaaggccagggcagcactgggcttgtctcccattacccgctggcaggacatcaaccctgcactctcccggagcaatgacactgtactggaggccacagctgccctgtacaaccaggacttatcctggctagagctgctccctgggggactcctggagagccaccgggaccctggacctctgttcagcaccatcgtccttgaacaatttgtgcggctacgggatggtgaccgctactggtttgagaacaccaggaatgggctgttctccaagaaggagattgaagaaatccgaaataccaccctgcaggacgtgctggtcgctgttatcaacattgaccccagtgctctgcagcccaatgtctttgtctggcataaaggagacccctgtccgcagccgagacagctcagcactgaaggcctgccagcgtgtgctccctctgttgttcgtgactattttgagggcagtggatttggcttcggggtcaccatcgggaccctctgttgcttccctttggtgagcctgctcagtgcctggattgttgcccggctccggatgagaaatttcaagaggctccagggccaggaccgccagagcatcgtgtctgagaagctcgtgggaggcatggaagctttggaatggcaaggccacaaggagccctgccggcccgtgcttgtgtacctgcagcccgggcagatccgtgtggtagatggcaggctcaccgtgctccgcaccatccagctgcagcctccacagaaggtcaacttcgtcctgtccagcaaccgtggacgccgcactctgctgctcaagatccccaaggagtatgacctggtgctgctgtttaacttggaggaagagcggcaggcgctggtggaaaatctccggggagctctgaaggagagcgggttgagcatccaggagtgggagctgcgggagcaggagctgatgagagcagctgtgacacgggagcagcggaggcacctcctggagacctttttcaggcaccttttctcccaggtgctggacatcaaccaggccgacgcagggaccctgcccctggactcctcccagaaggtgcgggaggccctgacctgtgagctgagcagggccgagtttgccgagtccctgggcctcaagccccaggacatgtttgtggagtccatgttctctctggctgacaaggatggcaatggctacctgtccttccgagagttcctggacatcctggtggtcttcatgaaaggctctcctgaggaaaagtctcgccttatgttccgcatgtacgactttgatgggaatggcctcatttccaaggatgagttcatcaggatgctgagatccttcatcgagatctccaacaactgcctgtccaaggcccagctggctgaggtggtggagtccatgttccgggagtcgggattccaggacaaggaggaactgacatgggaagattttcacttcatgctgcgggaccacaatagcgagctccgcttcacgcagctctgtgtcaaaggggtggaggtgcctgaagtcatcaaggacctctgccggcgagcctcctacatcagccaggatatgatctgtccctctcccagagtgagtgcccgctgttcccgcagcgacattgagactgagttgacacctcagagactgcagtgccccatggacacagaccctccccaggagattcggcggaggtttggcaagaaggtaacgtcattccagcccttgctgttcactgaggcgcaccgagagaagttccaacgcagctgtctccaccagacggtgcaacagttcaagcgcttcattgagaactaccggcgccacatcggctgcgtggccgtgttctacgccatcgctggggggcttttcctggagagggcctactactacgcctttgccgcacatcacacgggcatcacggacaccacccgcgtgggaatcatcctgtcgcggggcacagcagccagcatctctttcatgttctcctacatcttgctcaccatgtgccgcaacctcatcaccttcctgcgagaaaccttcctcaaccgctacgtgcccttcgacgccgccgtggacttccatcgcctcattgcctccaccgccatcgtcctcacagtcttacacagtgtgggccatgtggtgaatgtgtacctgttctccatcagccccctcagcgtcctctcttgcctctttcctggcctcttccatgatgatgggtctgagttcccccagaagtattactggtggttcttccagaccgtaccaggcctcacgggggttgtgctgctcctgatcctggccatcatgtatgtctttgcctcccaccacttccgccgccgcagtttccggggcttctggctgacccaccacctctacatcctgctctatgtcctgctcatcatccatggtagctttgccctgatccagctgccccgtttccacatcttcttcctggtcccagcaatcatctatgggggcgacaagctggtgagcctgagccggaagaaggtggagatcagcgtggtgaaggcggagctgctgccctcaggagtgacccacctgcggttccagcggccccagggctttgagtacaagtcagggcagtgggtgcggatcgcttgcctggctctggggaccaccgagtaccaccccttcacactgacctctgcgccccatgaggacacgcttagcctgcacatccgggcagcagggccctggaccactcgcctcagggagatctactcagccccgacgggtgacagatgtgccagatacccaaagctgtaccttgatggaccatttggagagggccaccaggagtggcataagtttgaggtgtcagtgttagtgggagggggcattggggtcaccccttttgcctccatcctcaaagacctggtcttcaagtcatccgtcagctgccaagtgttctgtaagaagatctacttcatctgggtgacgcggacccagcgtcagtttgagtggctggctgacatcatccgagaggtggaggagaatgaccaccaggacctggtgtctgtgcacatctacatcacccagctggctgagaagttcgacctcaggaccactatgctgtacatctgtgagcggcacttccagaaggttctgaaccggagtctattcacaggcctgcgctccatcacccactttggccgtcccccctttgagcccttcttcaactccctgcaggaggtccacccccaggtccggaagatcggggtgtttagctgtggcccccctggcatgaccaagaatgtggaaaaggcctgtcagctcatcaacaggcaggaccggactcacttctcccaccattatgagaacttctaggcccctgcccgggggttctgcccactgtccagttgagcagaggtttgagcccacacctcacctctgttcttcctatttctggctgcctcagccttctctgatttcccacctcccaaccttgttccaggtggccatagtcagtcaccatgtgtgggctcagggacccccaggaccaggatgtgtctcagcctggagaaatggtgggggggcagtgtctagggactagagtgagaagtaggggagctactgatttggggcaaagtgaaacctctgcttccagacttcagaaacaaatctcagaagacaagctgacctgacaagtactatgtgtgtgcatgtctgtatgtgtgttggggcggtgagtgtaaggatgcagtgggagcatggatgctggcatcttagaaccctccctactcccatacctcctcctcttctgggctccccactgtcagacgggctggcaaatgccttgcaggaggtagaggctggacccatggcaagccatttacagaaacccactcggcaccccagtctaacaccacaactaatttcacccaaggttttaagcacgttctttcatcagaccctggcccaatacctatgtatgcaatgctcctcagccctcttctccctgctccagtagtctcccttccaaataaatcacttttctgccgcctt

SEQ ID NO: 186925 - DNA, 792 bp, Homo sapiens
ccctcctgagtgggtatagaaggtccttgacttaggaacaatctgtgctttcttgcaccgatgtttaagccacctttcaggagtcagctgttacaccctgagctaccacctggactggtggcccaggccaaggtagaaaatgctggtgatatgtttttgaaaactgtctccaaaaggcaatatataatcaggcatttgattaaaaaaaattttagttctaaagaatagaaaccttttataacacatcattctgccattcaacttttgcacattctgattttgtcccttcaactttcataccttttcaagaacaagttatgaatgcggattggctggctgttttattactttataaaataggcagctgaatgtgtgagagggttcccataaatggagttcacttatgtaaaacactcagagaagtgcctggggcataataagcactgtataggagtgagttactgttactgtcatttattattatcatccctggggctaatccctgggagccacctctttgccttagggtgggtgccgtgtcctttctcttacttctgccccttcttggttccaggtactggaggccacagctgccctgtacaaccaggacttatcctggctagagctgctccctgggggactcctggagagccaccgggaccctggacctctgttcagcaccatcgtccttgaacaatttgtgcggctacgggatggtgctgaacaggggtcctgttcagctgctagccaagagaccagattgggataccttaccatcttgacacagcagtg

SEQ ID NO: 186926 - DNA, 4138 bp, Homo sapiens
  misc_feature (2157)..(2157): n is a, c, g, or t
tcacctcacgctcgtccatttagcgagcagagcatcgtgtcatgagcacagctcgtgggcaggcatggacagctttggaatggcaaggccacaaggagccctgccggcccgtgcttgtgtacctgcagcccgggcagatccgtgtggtagatggcaggctcaccgtgctccgcaccatccagctgcagcctccacagaaggtcaacttcgtcctgtccagcaaccgtggacgccgcactctgctgctcaagatccccaaggagtatgacctggtgctgctgtttaacttggaggaagagcggcaggcgctggtggaaaatctccggggagctctgaaggagagcgggttgagcatccaggagtgggagctgcgggagcaggagctgatgagagcagctgtgacacgggagcagcggaggcacctcctggagacctttttcaggcaccttttctcccaggtgctggacatcaaccaggccgacgcagggaccctgcccctggactcctcccagaaggtgcgggaggccctgacctgtgagctgagcagggccgagtttgccgagtccctgggcctcaagccccaggacatgtttgtggagtccatgttctctctggctgacaaggatggcaatggctacctgtccttccgagagttcctggacatcctggtggtcttcatgaaaggctctcctgaggaaaagtctcgccttatgttccgcatgtacgactttgatgggaatggcctcatttccaaggatgagttcatcaggatgctgagatccttcatcgagatctccaacaactgcctgtccaaggcccagctggctgaggtggtggagtccatgttccgggagtcgggattccaggacaaggaggaactgacatgggaagattttcacttcatgctgcgggaccacaatagcgagctccgcttcacgcagctctgtgtcaaaggggtggaggtgcctgaagtcatcaaggacctctgccggcgagcctcctacatcagccaggatatgatctgtccctctcccagagtgagtgcccgctgttcccgcagcgacattgagactgagttgacacctcagagactgcagtgccccatggacacagaccctccccaggagattcggcggaggtttggcaagaaggtaacgtcattccagcccttgctgttcactgaggcgcaccgagagaagttccaacgcagctgtctccaccagacggtgcaacagttcaagcgcttcattgagaactaccggcgccacatcggctgcgtggccgtgttctacgccatcgctggggggcttttcctggagagggcctactactacgcctttgccgcacatcacacgggcatcacggacaccacccgcgtgggaatcatcctgtcgcggggcacagcagccagcatctctttcatgttctcctacatcttgctcaccatgtgccgcaacctcatcaccttcctgcgagaaaccttcctcaaccgctacgtgcccttcgacgccgccgtggacttccatcgcctcattgcctccaccgccatcgtcctcacaggcagggcctgggtgtccctgggaggctctccagggcctcccgcccccgctgacttcccctcgtatgagagcccccctctctgctggcacttacctttaatgtccttctccatcaggatggagttggcctgggccagggtgtgaagtaagcccgggagcctgtcgctggtcacttccaagtgcctcttcccgcactttccagggcgcctcaccagcctcagctgacaagttactaacaccccagaatgagtgtgcataatgtgtcaattctcccaatttttatgttttaaagcatgactctgagagaaagcaaaggagtgaacttctaatgctgtaatttcagactcacatggttgcgcacatggatggtgtgtctgtggggtgttgggtagggccaggtgattgtttagaggtcagaagtccaggccggcgcggcggcttatgcccctaatcccagcactttgggaagctgaggcgggcggatcacttgaggtcaggagttcgagaccagcctggccaacatggtgaaaccccgtctctactaaaaatacaaaaatcagctgggtgtggtggcacatgccggtaatcccagctactnaggaggctgaggcaggagaattgcttgaacctgggaggcagaggttgcagtgagccgagatcgcaccactgccctccagcctgggtgacagagtgagactctgcctcaaaaaaaaaaaaaagagagagagatctcctctcaaggtgtctctttgctgtcccttccacacaggtctgagttcccccagaagtattactggtggttcttccagaccgtaccaggcctcacgggggttgtgctgctcctgatcctggccatcatgtatgtctttgcctcccaccacttccgccgccgcagtttccggggcttctggctgacccaccacctctacatcctgctctatgtcctgctcatcatccatggtagctttgccctgatccagctgccccgtttccacatcttcttcctggtcccagcaatcatctatgggggcgacaagctggtgagcctgagccggaagaaggtggagatcagcgtggtgaaggcggagctgctgccctcaggagtgacccacctgcggttccagcggccccagggctttgagtacaagtcagggcagtgggtgcggatcgcttgcctggctctggggaccaccgagtaccaccccttcacactgacctctgcgccccatgaggacacgcttagcctgcacatccgggcagcagggccctggaccactcgcctcagggagatctactcagccccgacgggtgacagatgtgccagatacccaaagctgtaccttgatggaccatttggagagggccaccaggagtggcataagtttgaggtgtcagtgttagtgggagggggcattggggtcaccccttttgcctccatcctcaaagacctggtcttcaagtcatccgtcagctgccaagtgttctgtaagaagatctacttcatctgggtgacgcggacccagcgtcagtttgagtggctggctgacatcatccgagaggtggaggagaatgaccaccaggacctggtgtctgtgcacatctacatcacccagctggctgagaagttcgacctcaggaccactatgctgtacatctgtgagcggcacttccagaaggttctgaaccggagtctattcacaggcctgcgctccatcacccactttggccgtcccccctttgagcccttcttcaactccctgcaggaggtccacccccaggtccggaagatcggggtgtttagctgtggcccccctggcatgaccaagaatgtggaaaaggcctgtcagctcatcaacaggcaggaccggactcacttctcccaccattatgagaacttctaggcccctgcccgggggttctgcccactgtccagttgagcagaggtttgagcccacacctcacctctgttcttcctatttctggctgcctcagccttctctgatttcccacctcccaaccttgttccaggtggccatagtcagtcaccatgtgtgggctcagggacccccaggaccaggatgtgtctcagcctggagaaatggtgggggggcagtgtctagggactagagtgagaagtaggggagctactgatttggggcaaagtgaaacctctgcttccagacttcagaaacaaatctcagaagacaagctgacctgacaagtactatgtgtgtgcatgtctgtatgtgtgttggggcggtgagtgtaaggatgcagtgggagcatggatgctggcatcttagaaccctccctactcccatacctcctcctcttctgggctccccactgtcagacgggctggcaaatgccttgcaggaggtagaggctggacccatggcaagccatttacagaaacccactcggcaccccagtctaacaccacaactaatttcacccaaggttttaagcacgttctttcatcagaccctggcccaatacctatgtatgcaatgctcctcagccctcttctccctgctccagtagtctcccttccaaataaatcacttttctgccgcctt

SEQ ID NO: 186927 - DNA, 4361 bp, Homo sapiens
  misc_feature (3206)..(3206): n is a, c, g, or t
ccctcctgagtgggtatagaaggtccttgacttaggaacaatctgtgctttcttgcaccgatgtttaagccacctttcaggagtcagctgttacaccctgagctaccacctggactggtggcccaggccaaggtagaaaatgctggtgatatgtttttgaaaactgtctccaaaaggcaatatataatcaggcatttgattaaaaaaaattttagttctaaagaatagaaaccttttataacacatcattctgccattcaacttttgcacattctgattttgtcccttcaactttcataccttttcaagaacaagttatgaatgcggattggctggctgttttattactttataaaataggcagctgaatgtgtgagagggttcccataaatggagttcacttatgtaaaacactcagagaagtgcctggggcataataagcactgtataggagtgagttactgttactgtcatttattattatcatccctggggctaatccctgggagccacctctttgccttagggtgggtgccgtgtcctttctcttacttctgccccttcttggttccaggtactggaggccacagctgccctgtacaaccaggacttatcctggctagagctgctccctgggggactcctggagagccaccgggaccctggacctctgttcagcaccatcgtccttgaacaatttgtgcggctacgggatggtgaccgctactggtttgagaacaccaggaatgggctgttctccaagaaggagattgaagaaatccgaaataccaccctgcaggacgtgctggtcgctgttatcaacattgaccccagtgctctgcagcccaatgtctttgtctggcataaaggagacccctgtccgcagccgagacagctcagcactgaaggcctgccagcgtgtgctccctctgttgttcgtgactattttgagggcagtggatttggcttcggggtcaccatcgggaccctctgttgcttccctttggtgagcctgctcagtgcctggattgttgcccggctccggatgagaaatttcaagaggctccagggccaggaccgccagagcatcgtgtctgagaagctcgtgggaggcatggaagctttggaatggcaaggccacaaggagccctgccggcccgtgcttgtgtacctgcagcccgggcagatccgtgtggtagatggcaggctcaccgtgctccgcaccatccagctgcagcctccacagaaggtcaacttcgtcctgtccagcaaccgtggacgccgcactctgctgctcaagatccccaaggagtatgacctggtgctgctgtttaacttggaggaagagcggcaggcgctggtggaaaatctccggggagctctgaaggagagcgggttgagcatccaggagtgggagctgcgggagcaggagctgatgagagcagctgtgacacgggagcagcggaggcacctcctggagacctttttcaggcaccttttctcccaggtgctggacatcaaccaggccgacgcagggaccctgcccctggactcctcccagaaggtgcgggaggccctgacctgtgagctgagcagggccgagtttgccgagtccctgggcctcaagccccaggacatgtttgtggagtccatgttctctctggctgacaaggatggcaatggctacctgtccttccgagagttcctggacatcctggtggtcttcatgaaaggctctcctgaggaaaagtctcgccttatgttccgcatgtacgactttgatgggaatggcctcatttccaaggatgagttcatcaggatgctgagatccttcatcgagatctccaacaactgcctgtccaaggcccagctggctgaggtggtggagtccatgttccgggagtcgggattccaggacaaggaggaactgacatgggaagattttcacttcatgctgcgggaccacaatagcgagctccgcttcacgcagctctgtgtcaaaggggtggaggtgcctgaagtcatcaaggacctctgccggcgagcctcctacatcagccaggatatgatctgtccctctcccagagtgagtgcccgctgttcccgcagcgacattgagactgagttgacacctcagagactgcagtgccccatggacacagaccctccccaggagattcggcggaggtttggcaagaaggtaacgtcattccagcccttgctgttcactgaggcgcaccgagagaagttccaacgcagctgtctccaccagacggtgcaacagttcaagcgcttcattgagaactaccggcgccacatcggctgcgtggccgtgttctacgccatcgctggggggcttttcctggagagggcctactactacgcctttgccgcacatcacacgggcatcacggacaccacccgcgtgggaatcatcctgtcgcggggcacagcagccagcatctctttcatgttctcctacatcttgctcaccatgtgccgcaacctcatcaccttcctgcgagaaaccttcctcaaccgctacgtgcccttcgacgccgccgtggacttccatcgcctcattgcctccaccgccatcgtcctcacaggcagggcctgggtgtccctgggaggctctccagggcctcccgcccccgctgacttcccctcgtatgagagcccccctctctgctggcacttacctttaatgtccttctccatcaggatggagttggcctgggccagggtgtgaagtaagcccgggagcctgtcgctggtcacttccaagtgcctcttcccgcactttccagggcgcctcaccagcctcagctgacaagttactaacaccccagaatgagtgtgcataatgtgtcaattctcccaatttttatgttttaaagcatgactctgagagaaagcaaaggagtgaacttctaatgctgtaatttcagactcacatggttgcgcacatggatggtgtgtctgtggggtgttgggtagggccaggtgattgtttagaggtcagaagtccaggccggcgcggcggcttatgcccctaatcccagcactttgggaagctgaggcgggcggatcacttgaggtcaggagttcgagaccagcctggccaacatggtgaaaccccgtctctactaaaaatacaaaaatcagctgggtgtggtggcacatgccggtaatcccagctactnaggaggctgaggcaggagaattgcttgaacctgggaggcagaggttgcagtgagccgagatcgcaccactgccctccagcctgggtgacagagtgagactctgcctcaaaaaaaaaaaaaagagagagagatctcctctcaaggtgtctctttgctgtcccttccacacaggtctgagttcccccagaagtattactggtggttcttccagaccgtaccaggcctcacgggggttgtgctgctcctgatcctggccatcatgtatgtctttgcctcccaccacttccgccgccgcagtttccggggcttctggctgacccaccacctctacatcctgctctatgtcctgctcatcatccatggtagctttgccctgatccagctgccccgtttccacatcttcttcctggtcccagcaatcatctatgggggcgacaagctggtgagcctgagccggaagaaggtggagatcagcgtggtgaaggcggagctgctgccctcaggagtgacccacctgcggttccagcggccccagggctttgagtacaagtcagggcagtgggtgcggatcgcttgcctggctctggggaccaccgagtaccaccccttcacactgacctctgcgccccatgaggacacgcttagcctgcacatccgggcagcagggccctggaccactcgcctcagggagatctactcagccccgacgggtgacagatgtgccagatacccaaagctgtaccttgatggaccatttggagagggccaccaggagtggcataagtttgaggtgtcagtgttagtgggagggggcattggggtcaccccttttgcctccatcctcaaagacctggtcttcaagtcatccgtcagctgccaagtgttctgtaagaaggtgagtactgcccccacttcccaccaacccatggccccttcttccttgtcatggtacccatctgtgcctttctcctctgcctttgttcttggcttccctgaactgggcaggggcaagttggtttgaaacctggggttgggtggtgagtggggtggtatcaggatatccctagaccctttaggacagaactggttgcggatgcctccagaatctgcctggtttacaaagactctttccctcagttaggggtgctccacata

SEQ ID NO: 186928 - DNA, 3033 bp, Homo sapiens
  misc_feature (1052)..(1052): n is a, c, g, or t
gggtcccatggtgggtgccaaaggctaaggcttcctgtctcccagggtaacgtcattccagcccttgctgttcactgaggcgcaccgagagaagttccaacgcagctgtctccaccagacggtgcaacagttcaagcgcttcattgagaactaccggcgccacatcggctgcgtggccgtgttctacgccatcgctggggggcttttcctggagagggcctactactacgcctttgccgcacatcacacgggcatcacggacaccacccgcgtgggaatcatcctgtcgcggggcacagcagccagcatctctttcatgttctcctacatcttgctcaccatgtgccgcaacctcatcaccttcctgcgagaaaccttcctcaaccgctacgtgcccttcgacgccgccgtggacttccatcgcctcattgcctccaccgccatcgtcctcacaggcagggcctgggtgtccctgggaggctctccagggcctcccgcccccgctgacttcccctcgtatgagagcccccctctctgctggcacttacctttaatgtccttctccatcaggatggagttggcctgggccagggtgtgaagtaagcccgggagcctgtcgctggtcacttccaagtgcctcttcccgcactttccagggcgcctcaccagcctcagctgacaagttactaacaccccagaatgagtgtgcataatgtgtcaattctcccaatttttatgttttaaagcatgactctgagagaaagcaaaggagtgaacttctaatgctgtaatttcagactcacatggttgcgcacatggatggtgtgtctgtggggtgttgggtagggccaggtgattgtttagaggtcagaagtccaggccggcgcggcggcttatgcccctaatcccagcactttgggaagctgaggcgggcggatcacttgaggtcaggagttcgagaccagcctggccaacatggtgaaaccccgtctctactaaaaatacaaaaatcagctgggtgtggtggcacatgccggtaatcccagctactnaggaggctgaggcaggagaattgcttgaacctgggaggcagaggttgcagtgagccgagatcgcaccactgccctccagcctgggtgacagagtgagactctgcctcaaaaaaaaaaaaaagagagagagatctcctctcaaggtgtctctttgctgtcccttccacacaggtctgagttcccccagaagtattactggtggttcttccagaccgtaccaggcctcacgggggttgtgctgctcctgatcctggccatcatgtatgtctttgcctcccaccacttccgccgccgcagtttccggggcttctggctgacccaccacctctacatcctgctctatgtcctgctcatcatccatggtagctttgccctgatccagctgccccgtttccacatcttcttcctggtcccagcaatcatctatgggggcgacaagctggtgagcctgagccggaagaaggtggagatcagcgtggtgaaggcggagctgctgccctcaggagtgacccacctgcggttccagcggccccagggctttgagtacaagtcagggcagtgggtgcggatcgcttgcctggctctggggaccaccgagtaccaccccttcacactgacctctgcgccccatgaggacacgcttagcctgcacatccgggcagcagggccctggaccactcgcctcagggagatctactcagccccgacgggtgacagatgtgccagatacccaaagctgtaccttgatggaccatttggagagggccaccaggagtggcataagtttgaggtgtcagtgttagtgggagggggcattggggtcaccccttttgcctccatcctcaaagacctggtcttcaagtcatccgtcagctgccaagtgttctgtaagaagatctacttcatctgggtgacgcggacccagcgtcagtttgagtggctggctgacatcatccgagaggtggaggagaatgaccaccaggacctggtgtctgtgcacatctacatcacccagctggctgagaagttcgacctcaggaccactatgctgtacatctgtgagcggcacttccagaaggttctgaaccggagtctattcacaggcctgcgctccatcacccactttggccgtcccccctttgagcccttcttcaactccctgcaggaggtccacccccaggtccggaagatcggggtgtttagctgtggcccccctggcatgaccaagaatgtggaaaaggcctgtcagctcatcaacaggcaggaccggactcacttctcccaccattatgagaacttctaggcccctgcccgggggttctgcccactgtccagttgagcagaggtttgagcccacacctcacctctgttcttcctatttctggctgcctcagccttctctgatttcccacctcccaaccttgttccaggtggccatagtcagtcaccatgtgtgggctcagggacccccaggaccaggatgtgtctcagcctggagaaatggtgggggggcagtgtctagggactagagtgagaagtaggggagctactgatttggggcaaagtgaaacctctgcttccagacttcagaaacaaatctcagaagacaagctgacctgacaagtactatgtgtgtgcatgtctgtatgtgtgttggggcggtgagtgtaaggatgcagtgggagcatggatgctggcatcttagaaccctccctactcccatacctcctcctcttctgggctccccactgtcagacgggctggcaaatgccttgcaggaggtagaggctggacccatggcaagccatttacagaaacccactcggcaccccagtctaacaccacaactaatttcacccaaggttttaagcacgttctttcatcagaccctggcccaatacctatgtatgcaatgctcctcagccctcttctccctgctccagtagtctcccttccaaataaatcacttttctgccgcctt

SEQ ID NO: 186929 - DNA, 1791 bp, Homo sapiens
gggaatggtgaggttttgcaacctagaaggagcatggtacgtggtgaggtgggggctggatataccagcggggaagtatggagggtctaaggcctgagctggccctgtattctgctatgggcatcgctaggtctgagcagagctctttcctccatctagctcatcatccatggtagctttgccctgatccagctgccccgtttccacatcttcttcctggtcccagcaatcatctatgggggcgacaagctggtgagcctgagccggaagaaggtggagatcagcgtggtgaaggcggagctgctgccctcaggagtgacccacctgcggttccagcggccccagggctttgagtacaagtcagggcagtgggtgcggatcgcttgcctggctctggggaccaccgagtaccaccccttcacactgacctctgcgccccatgaggacacgcttagcctgcacatccgggcagcagggccctggaccactcgcctcagggagatctactcagccccgacgggtgacagatgtgccagatacccaaagctgtaccttgatggaccatttggagagggccaccaggagtggcataagtttgaggtgtcagtgttagtgggagggggcattggggtcaccccttttgcctccatcctcaaagacctggtcttcaagtcatccgtcagctgccaagtgttctgtaagaagatctacttcatctgggtgacgcggacccagcgtcagtttgagtggctggctgacatcatccgagaggtggaggagaatgaccaccaggacctggtgtctgtgcacatctacatcacccagctggctgagaagttcgacctcaggaccactatgctgtacatctgtgagcggcacttccagaaggttctgaaccggagtctattcacaggcctgcgctccatcacccactttggccgtcccccctttgagcccttcttcaactccctgcaggaggtccacccccaggtccggaagatcggggtgtttagctgtggcccccctggcatgaccaagaatgtggaaaaggcctgtcagctcatcaacaggcaggaccggactcacttctcccaccattatgagaacttctaggcccctgcccgggggttctgcccactgtccagttgagcagaggtttgagcccacacctcacctctgttcttcctatttctggctgcctcagccttctctgatttcccacctcccaaccttgttccaggtggccatagtcagtcaccatgtgtgggctcagggacccccaggaccaggatgtgtctcagcctggagaaatggtgggggggcagtgtctagggactagagtgagaagtaggggagctactgatttggggcaaagtgaaacctctgcttccagacttcagaaacaaatctcagaagacaagctgacctgacaagtactatgtgtgtgcatgtctgtatgtgtgttggggcggtgagtgtaaggatgcagtgggagcatggatgctggcatcttagaaccctccctactcccatacctcctcctcttctgggctccccactgtcagacgggctggcaaatgccttgcaggaggtagaggctggacccatggcaagccatttacagaaacccactcggcaccccagtctaacaccacaactaatttcacccaaggttttaagcacgttctttcatcagaccctggcccaatacctatgtatgcaatgctcctcagccctcttctccctgctccagtagtctcccttccaaataaatcacttttctgccgcctt

SEQ ID NO: 186930 - DNA, 1060 bp, Homo sapiens
tgtgcatatacaattgagctcggtacctgaatcattcatccttcatcgagatctccaacaactgcctgtccaaggcccagctggctgaggtggtggagtccatgttccgggagtcgggattccaggacaaggaggaactgacatgggaagattttcacttcatgctgcgggaccacaatagcgagctccgcttcacgcagctctgtgtcaaaggggtggaggtgcctgaagtcatcaaggacctctgccggcgagcctcctacatcagccaggatatgatctgtccctctcccagagtgagtgcccgctgttcccgcagcgacattgagactgagttgacacctcagagactgcagtgccccatggacacagaccctccccaggagattcggcggaggtttggcaagaaggtaacgtcattccagcccttgctgttcactgaggcgcaccgagagaagttccaacgcagctgtctccaccagacggtgcaacagttcaagcgcttcattgagaactaccggcgccacatcggctgcgtggccgtgttctacgccatcgctggggggcttttcctggagagggcctactactacgcctttgccgcacatcacacgggcatcacggacaccacccgcgtgggaatcatcctgtcgcggggcacagcagccagcatctctttcatgttctcctacatcttgctcaccatgtgccgcaacctcatcaccttcctgcgagaaaccttcctcaaccgctacgtgcccttcgacgccgccgtggacttccatcgcctcattgcctccaccgccatcgtcctcacagtcttacacagtgtgggccatgtggtgaatgtgtacctgttctccatcagccccctcagcgtcctctcttgcctctttcctggcctcttccatgatgatgggtctgagttcccccagaagtattactggtggttcttccagaccgtaccagttccagctactcaggaggccgaggcagaagaatcatttgaacctgggaggcagaggttgcagtgagccgagattgcaccaatgcactccag

SEQ ID NO: 186931 - DNA, 460 bp, Homo sapiens
taatttaaagaaagggtattgctctgttgcccaggctgtaatgcagtgatgcaataccagtttactgtaacctccaactcctgggcacaagcaatcctcctgcctcagcctcccaagtagctgggactacaggagtgcaccactatgcctggctaattaaaaataaaaaaattagagtcagggatgttgctatgttgcccaggctggtcttgaactagggagctaccccttcctctgaacactgcgttatccctgcctctgagcaaagagttagcctccacttattcctcctgcaacaggtccggaagatcggggtgtttagctgtggcccccctggcatgaccaagaatgtggaaaaggcctgtcagctcatcaacaggcaggaccggactcacttctcccaccattatgagaacttctaggcccctgcccgggggttctgcccactgtccagttgagc

SEQ ID NO: 186932 - DNA, 577 bp, Homo sapiens
ataagtgccagccctgggtagggtaagtggagcctgtctgagtgaagactgtgcgggggaggcctgttgtgagtggcagccggccagggcctaccgcccctaaccagctctctgtcctctgcactgaccctcgcttgcctgcctgggccccctccacagactacgcctttgccgcacatcacacgggcatcacggacaccacccgcgtgggaatcatcctgtcgcggggcacagcagccagcatctctttcatgttctcctacatcttgctcaccatgtgccgcaacctcatcaccttcctgcgagaaaccttcctcaaccgctacgtgcccttcgacgccgccgtggacttccatcgcctcattgcctccaccgccatcgtcctcacaggcagggcctgggtgtccctgggaggctctccagggcctcccgcccccgctgacttcccctcgtatgagagcccccctctctgctggcacttacctttaatgtccttctccatcaggatggagttggcctgggccagggtgtgaagtaagcccgggagcctgtcgctggtcacttccaagtgcctctt

SEQ ID NO: 186933 - DNA, 5187 bp, Homo sapiens
  misc_feature (3206)..(3206): n is a, c, g, or t
ccctcctgagtgggtatagaaggtccttgacttaggaacaatctgtgctttcttgcaccgatgtttaagccacctttcaggagtcagctgttacaccctgagctaccacctggactggtggcccaggccaaggtagaaaatgctggtgatatgtttttgaaaactgtctccaaaaggcaatatataatcaggcatttgattaaaaaaaattttagttctaaagaatagaaaccttttataacacatcattctgccattcaacttttgcacattctgattttgtcccttcaactttcataccttttcaagaacaagttatgaatgcggattggctggctgttttattactttataaaataggcagctgaatgtgtgagagggttcccataaatggagttcacttatgtaaaacactcagagaagtgcctggggcataataagcactgtataggagtgagttactgttactgtcatttattattatcatccctggggctaatccctgggagccacctctttgccttagggtgggtgccgtgtcctttctcttacttctgccccttcttggttccaggtactggaggccacagctgccctgtacaaccaggacttatcctggctagagctgctccctgggggactcctggagagccaccgggaccctggacctctgttcagcaccatcgtccttgaacaatttgtgcggctacgggatggtgaccgctactggtttgagaacaccaggaatgggctgttctccaagaaggagattgaagaaatccgaaataccaccctgcaggacgtgctggtcgctgttatcaacattgaccccagtgctctgcagcccaatgtctttgtctggcataaaggagacccctgtccgcagccgagacagctcagcactgaaggcctgccagcgtgtgctccctctgttgttcgtgactattttgagggcagtggatttggcttcggggtcaccatcgggaccctctgttgcttccctttggtgagcctgctcagtgcctggattgttgcccggctccggatgagaaatttcaagaggctccagggccaggaccgccagagcatcgtgtctgagaagctcgtgggaggcatggaagctttggaatggcaaggccacaaggagccctgccggcccgtgcttgtgtacctgcagcccgggcagatccgtgtggtagatggcaggctcaccgtgctccgcaccatccagctgcagcctccacagaaggtcaacttcgtcctgtccagcaaccgtggacgccgcactctgctgctcaagatccccaaggagtatgacctggtgctgctgtttaacttggaggaagagcggcaggcgctggtggaaaatctccggggagctctgaaggagagcgggttgagcatccaggagtgggagctgcgggagcaggagctgatgagagcagctgtgacacgggagcagcggaggcacctcctggagacctttttcaggcaccttttctcccaggtgctggacatcaaccaggccgacgcagggaccctgcccctggactcctcccagaaggtgcgggaggccctgacctgtgagctgagcagggccgagtttgccgagtccctgggcctcaagccccaggacatgtttgtggagtccatgttctctctggctgacaaggatggcaatggctacctgtccttccgagagttcctggacatcctggtggtcttcatgaaaggctctcctgaggaaaagtctcgccttatgttccgcatgtacgactttgatgggaatggcctcatttccaaggatgagttcatcaggatgctgagatccttcatcgagatctccaacaactgcctgtccaaggcccagctggctgaggtggtggagtccatgttccgggagtcgggattccaggacaaggaggaactgacatgggaagattttcacttcatgctgcgggaccacaatagcgagctccgcttcacgcagctctgtgtcaaaggggtggaggtgcctgaagtcatcaaggacctctgccggcgagcctcctacatcagccaggatatgatctgtccctctcccagagtgagtgcccgctgttcccgcagcgacattgagactgagttgacacctcagagactgcagtgccccatggacacagaccctccccaggagattcggcggaggtttggcaagaaggtaacgtcattccagcccttgctgttcactgaggcgcaccgagagaagttccaacgcagctgtctccaccagacggtgcaacagttcaagcgcttcattgagaactaccggcgccacatcggctgcgtggccgtgttctacgccatcgctggggggcttttcctggagagggcctactactacgcctttgccgcacatcacacgggcatcacggacaccacccgcgtgggaatcatcctgtcgcggggcacagcagccagcatctctttcatgttctcctacatcttgctcaccatgtgccgcaacctcatcaccttcctgcgagaaaccttcctcaaccgctacgtgcccttcgacgccgccgtggacttccatcgcctcattgcctccaccgccatcgtcctcacaggcagggcctgggtgtccctgggaggctctccagggcctcccgcccccgctgacttcccctcgtatgagagcccccctctctgctggcacttacctttaatgtccttctccatcaggatggagttggcctgggccagggtgtgaagtaagcccgggagcctgtcgctggtcacttccaagtgcctcttcccgcactttccagggcgcctcaccagcctcagctgacaagttactaacaccccagaatgagtgtgcataatgtgtcaattctcccaatttttatgttttaaagcatgactctgagagaaagcaaaggagtgaacttctaatgctgtaatttcagactcacatggttgcgcacatggatggtgtgtctgtggggtgttgggtagggccaggtgattgtttagaggtcagaagtccaggccggcgcggcggcttatgcccctaatcccagcactttgggaagctgaggcgggcggatcacttgaggtcaggagttcgagaccagcctggccaacatggtgaaaccccgtctctactaaaaatacaaaaatcagctgggtgtggtggcacatgccggtaatcccagctactnaggaggctgaggcaggagaattgcttgaacctgggaggcagaggttgcagtgagccgagatcgcaccactgccctccagcctgggtgacagagtgagactctgcctcaaaaaaaaaaaaaagagagagagatctcctctcaaggtgtctctttgctgtcccttccacacaggtctgagttcccccagaagtattactggtggttcttccagaccgtaccaggcctcacgggggttgtgctgctcctgatcctggccatcatgtatgtctttgcctcccaccacttccgccgccgcagtttccggggcttctggctgacccaccacctctacatcctgctctatgtcctgctcatcatccatggtagctttgccctgatccagctgccccgtttccacatcttcttcctggtcccagcaatcatctatgggggcgacaagctggtgagcctgagccggaagaaggtggagatcagcgtggtgaaggcggagctgctgccctcaggagtgacccacctgcggttccagcggccccagggctttgagtacaagtcagggcagtgggtgcggatcgcttgcctggctctggggaccaccgagtaccaccccttcacactgacctctgcgccccatgaggacacgcttagcctgcacatccgggcagcagggccctggaccactcgcctcagggagatctactcagccccgacgggtgacagatgtgccagatacccaaagctgtaccttgatggaccatttggagagggccaccaggagtggcataagtttgaggtgtcagtgttagtgggagggggcattggggtcaccccttttgcctccatcctcaaagacctggtcttcaagtcatccgtcagctgccaagtgttctgtaagaagatctacttcatctgggtgacgcggacccagcgtcagtttgagtggctggctgacatcatccgagaggtggaggagaatgaccaccaggacctggtgtctgtgcacatctacatcacccagctggctgagaagttcgacctcaggaccactatgctgtacatctgtgagcggcacttccagaaggttctgaaccggagtctattcacaggcctgcgctccatcacccactttggccgtcccccctttgagcccttcttcaactccctgcaggaggtccacccccaggtccggaagatcggggtgtttagctgtggcccccctggcatgaccaagaatgtggaaaaggcctgtcagctcatcaacaggcaggaccggactcacttctcccaccattatgagaacttctaggcccctgcccgggggttctgcccactgtccagttgagcagaggtttgagcccacacctcacctctgttcttcctatttctggctgcctcagccttctctgatttcccacctcccaaccttgttccaggtggccatagtcagtcaccatgtgtgggctcagggacccccaggaccaggatgtgtctcagcctggagaaatggtgggggggcagtgtctagggactagagtgagaagtaggggagctactgatttggggcaaagtgaaacctctgcttccagacttcagaaacaaatctcagaagacaagctgacctgacaagtactatgtgtgtgcatgtctgtatgtgtgttggggcggtgagtgtaaggatgcagtgggagcatggatgctggcatcttagaaccctccctactcccatacctcctcctcttctgggctccccactgtcagacgggctggcaaatgccttgcaggaggtagaggctggacccatggcaagccatttacagaaacccactcggcaccccagtctaacaccacaactaatttcacccaaggttttaagcacgttctttcatcagaccctggcccaatacctatgtatgcaatgctcctcagccctcttctccctgctccagtagtctcccttccaaataaatcacttttctgccgcctt

SEQ ID NO: 186934 - DNA, 5279 bp, Homo sapiens
  misc_feature (3206)..(3206): n is a, c, g, or t
ccctcctgagtgggtatagaaggtccttgacttaggaacaatctgtgctttcttgcaccgatgtttaagccacctttcaggagtcagctgttacaccctgagctaccacctggactggtggcccaggccaaggtagaaaatgctggtgatatgtttttgaaaactgtctccaaaaggcaatatataatcaggcatttgattaaaaaaaattttagttctaaagaatagaaaccttttataacacatcattctgccattcaacttttgcacattctgattttgtcccttcaactttcataccttttcaagaacaagttatgaatgcggattggctggctgttttattactttataaaataggcagctgaatgtgtgagagggttcccataaatggagttcacttatgtaaaacactcagagaagtgcctggggcataataagcactgtataggagtgagttactgttactgtcatttattattatcatccctggggctaatccctgggagccacctctttgccttagggtgggtgccgtgtcctttctcttacttctgccccttcttggttccaggtactggaggccacagctgccctgtacaaccaggacttatcctggctagagctgctccctgggggactcctggagagccaccgggaccctggacctctgttcagcaccatcgtccttgaacaatttgtgcggctacgggatggtgaccgctactggtttgagaacaccaggaatgggctgttctccaagaaggagattgaagaaatccgaaataccaccctgcaggacgtgctggtcgctgttatcaacattgaccccagtgctctgcagcccaatgtctttgtctggcataaaggagacccctgtccgcagccgagacagctcagcactgaaggcctgccagcgtgtgctccctctgttgttcgtgactattttgagggcagtggatttggcttcggggtcaccatcgggaccctctgttgcttccctttggtgagcctgctcagtgcctggattgttgcccggctccggatgagaaatttcaagaggctccagggccaggaccgccagagcatcgtgtctgagaagctcgtgggaggcatggaagctttggaatggcaaggccacaaggagccctgccggcccgtgcttgtgtacctgcagcccgggcagatccgtgtggtagatggcaggctcaccgtgctccgcaccatccagctgcagcctccacagaaggtcaacttcgtcctgtccagcaaccgtggacgccgcactctgctgctcaagatccccaaggagtatgacctggtgctgctgtttaacttggaggaagagcggcaggcgctggtggaaaatctccggggagctctgaaggagagcgggttgagcatccaggagtgggagctgcgggagcaggagctgatgagagcagctgtgacacgggagcagcggaggcacctcctggagacctttttcaggcaccttttctcccaggtgctggacatcaaccaggccgacgcagggaccctgcccctggactcctcccagaaggtgcgggaggccctgacctgtgagctgagcagggccgagtttgccgagtccctgggcctcaagccccaggacatgtttgtggagtccatgttctctctggctgacaaggatggcaatggctacctgtccttccgagagttcctggacatcctggtggtcttcatgaaaggctctcctgaggaaaagtctcgccttatgttccgcatgtacgactttgatgggaatggcctcatttccaaggatgagttcatcaggatgctgagatccttcatcgagatctccaacaactgcctgtccaaggcccagctggctgaggtggtggagtccatgttccgggagtcgggattccaggacaaggaggaactgacatgggaagattttcacttcatgctgcgggaccacaatagcgagctccgcttcacgcagctctgtgtcaaaggggtggaggtgcctgaagtcatcaaggacctctgccggcgagcctcctacatcagccaggatatgatctgtccctctcccagagtgagtgcccgctgttcccgcagcgacattgagactgagttgacacctcagagactgcagtgccccatggacacagaccctccccaggagattcggcggaggtttggcaagaaggtaacgtcattccagcccttgctgttcactgaggcgcaccgagagaagttccaacgcagctgtctccaccagacggtgcaacagttcaagcgcttcattgagaactaccggcgccacatcggctgcgtggccgtgttctacgccatcgctggggggcttttcctggagagggcctactactacgcctttgccgcacatcacacgggcatcacggacaccacccgcgtgggaatcatcctgtcgcggggcacagcagccagcatctctttcatgttctcctacatcttgctcaccatgtgccgcaacctcatcaccttcctgcgagaaaccttcctcaaccgctacgtgcccttcgacgccgccgtggacttccatcgcctcattgcctccaccgccatcgtcctcacaggcagggcctgggtgtccctgggaggctctccagggcctcccgcccccgctgacttcccctcgtatgagagcccccctctctgctggcacttacctttaatgtccttctccatcaggatggagttggcctgggccagggtgtgaagtaagcccgggagcctgtcgctggtcacttccaagtgcctcttcccgcactttccagggcgcctcaccagcctcagctgacaagttactaacaccccagaatgagtgtgcataatgtgtcaattctcccaatttttatgttttaaagcatgactctgagagaaagcaaaggagtgaacttctaatgctgtaatttcagactcacatggttgcgcacatggatggtgtgtctgtggggtgttgggtagggccaggtgattgtttagaggtcagaagtccaggccggcgcggcggcttatgcccctaatcccagcactttgggaagctgaggcgggcggatcacttgaggtcaggagttcgagaccagcctggccaacatggtgaaaccccgtctctactaaaaatacaaaaatcagctgggtgtggtggcacatgccggtaatcccagctactnaggaggctgaggcaggagaattgcttgaacctgggaggcagaggttgcagtgagccgagatcgcaccactgccctccagcctgggtgacagagtgagactctgcctcaaaaaaaaaaaaaagagagagagatctcctctcaaggtgtctctttgctgtcccttccacacaggtctgagttcccccagaagtattactggtggttcttccagaccgtaccaggcctcacgggggttgtgctgctcctgatcctggccatcatgtatgtctttgcctcccaccacttccgccgccgcagtttccggggcttctggctgacccaccacctctacatcctgctctatgtcctgctcatcatccatggtagctttgccctgatccagctgccccgtttccacatcttcttcctggtcccagcaatcatctatgggggcgacaagctggtgagcctgagccggaagaaggtggagatcagcgtggtgaaggcggagctgctgccctcaggagtgacccacctgcggttccagcggccccagggctttgagtacaagtcagggcagtgggtgcggatcgcttgcctggctctggggaccaccgagtaccaccccttcacactgacctctgcgccccatgaggacacgcttagcctgcacatccgggcagcagggccctggaccactcgcctcagggagatctactcagccccgacgggtgacagatgtgccagatacccaaagctgtaccttgatggaccatttggagagggccaccaggagtggcataagtttgaggtgtcagtgttagtgggagggggcattggggtcaccccttttgcctccatcctcaaagacctggtcttcaagtcatccgtcagctgccaagtgttctgtaagaagatctacttcatctgggtgacgcggacccagcgtcagtttgagtggctggctgacatcatccgagaggtggaggagaatgaccaccaggacctggtgtctgtgcacatctacatcacccagctggctgagaagttcgacctcaggaccactatgctgtacatctgtgagcggcacttccagaaggttctgaaccggagtctattcacaggcctgcgctccatcacccactttggccgtcccccctttgagcccttcttcaactccctgcaggaggtccacccccaggtccggaagatcggggtgtttagctgtggcccccctggcatgaccaagaatgtggaaaaggcctgtcagctcatcaacaggcaggaccggactcacttctcccaccattatgagaacttctaggcccctgcccgggggttctgcccactgtccagttgagcagaggtttgagcccacacctcacctctgttcttcctatttctggctgcctcagccttctctgatttcccacctcccaaccttgttccaggtggccatagtcagtcaccatgtgtgggctcagggacccccaggaccaggatgtgtctcagcctggagaaatggtgggggggcagtgtctagggactagagtgagaagtaggggagctactgatttggggcaaagtgaaacctctgcttccagacttcagaaacaaatctcagaagacaagctgacctgacaagtactatgtgtgtgcatgtctgtatgtgtgttggggcggtgagtgtaaggatgcagtgggagcatggatgctggcatcttagaaccctccctactcccatacctcctcctcttctgggctccccactgtcagacgggctggcaaatgccttgcaggaggtagaggctggacccatggcaagccatttacagaaacccactcggcaccccagtctaacaccacaactaatttcacccaaggttttaagcacgttctttcatcagaccctggcccaatacctatgtatgcaatgctcctcagccctcttctccctgctccagtagtctcccttccaaataaatcacttttctgccgccttcagggtttctttattctgccctaggaccggaaggggcatggggagaggaagccactaacccagccagctcaccaggctggcccagacatctc

SEQ ID NO: 186935 - DNA, 2729 bp, Homo sapiens
tgtgcatatacaattgagctcggtacctgaatcattcatccttcatcgagatctccaacaactgcctgtccaaggcccagctggctgaggtggtggagtccatgttccgggagtcgggattccaggacaaggaggaactgacatgggaagattttcacttcatgctgcgggaccacaatagcgagctccgcttcacgcagctctgtgtcaaaggggtggaggtgcctgaagtcatcaaggacctctgccggcgagcctcctacatcagccaggatatgatctgtccctctcccagagtgagtgcccgctgttcccgcagcgacattgagactgagttgacacctcagagactgcagtgccccatggacacagaccctccccaggagattcggcggaggtttggcaagaaggtaacgtcattccagcccttgctgttcactgaggcgcaccgagagaagttccaacgcagctgtctccaccagacggtgcaacagttcaagcgcttcattgagaactaccggcgccacatcggctgcgtggccgtgttctacgccatcgctggggggcttttcctggagagggcctactactacgcctttgccgcacatcacacgggcatcacggacaccacccgcgtgggaatcatcctgtcgcggggcacagcagccagcatctctttcatgttctcctacatcttgctcaccatgtgccgcaacctcatcaccttcctgcgagaaaccttcctcaaccgctacgtgcccttcgacgccgccgtggacttccatcgcctcattgcctccaccgccatcgtcctcacagtcttacacagtgtgggccatgtggtgaatgtgtacctgttctccatcagccccctcagcgtcctctcttgcctctttcctggcctcttccatgatgatgggtctgagttcccccagaagtattactggtggttcttccagaccgtaccaggcctcacgggggttgtgctgctcctgatcctggccatcatgtatgtctttgcctcccaccacttccgccgccgcagtttccggggcttctggctgacccaccacctctacatcctgctctatgtcctgctcatcatccatggtagctttgccctgatccagctgccccgtttccacatcttcttcctggtcccagcaatcatctatgggggcgacaagctggtgagcctgagccggaagaaggtggagatcagcgtggtgaaggcggagctgctgccctcaggagtgacccacctgcggttccagcggccccagggctttgagtacaagtcagggcagtgggtgcggatcgcttgcctggctctggggaccaccgagtaccaccccttcacactgacctctgcgccccatgaggacacgcttagcctgcacatccgggcagcagggccctggaccactcgcctcagggagatctactcagccccgacgggtgacagatgtgccagatacccaaagctgtaccttgatggaccatttggagagggccaccaggagtggcataagtttgaggtgtcagtgttagtgggagggggcattggggtcaccccttttgcctccatcctcaaagacctggtcttcaagtcatccgtcagctgccaagtgttctgtaagaagatctacttcatctgggtgacgcggacccagcgtcagtttgagtggctggctgacatcatccgagaggtggaggagaatgaccaccaggacctggtgtctgtgcacatctacatcacccagctggctgagaagttcgacctcaggaccactatgctgtacatctgtgagcggcacttccagaaggttctgaaccggagtctattcacaggcctgcgctccatcacccactttggccgtcccccctttgagcccttcttcaactccctgcaggaggtccacccccaggtccggaagatcggggtgtttagctgtggcccccctggcatgaccaagaatgtggaaaaggcctgtcagctcatcaacaggcaggaccggactcacttctcccaccattatgagaacttctaggcccctgcccgggggttctgcccactgtccagttgagcagaggtttgagcccacacctcacctctgttcttcctatttctggctgcctcagccttctctgatttcccacctcccaaccttgttccaggtggccatagtcagtcaccatgtgtgggctcagggacccccaggaccaggatgtgtctcagcctggagaaatggtgggggggcagtgtctagggactagagtgagaagtaggggagctactgatttggggcaaagtgaaacctctgcttccagacttcagaaacaaatctcagaagacaagctgacctgacaagtactatgtgtgtgcatgtctgtatgtgtgttggggcggtgagtgtaaggatgcagtgggagcatggatgctggcatcttagaaccctccctactcccatacctcctcctcttctgggctccccactgtcagacgggctggcaaatgccttgcaggaggtagaggctggacccatggcaagccatttacagaaacccactcggcaccccagtctaacaccacaactaatttcacccaaggttttaagcacgttctttcatcagaccctggcccaatacctatgtatgcaatgctcctcagccctcttctccctgctccagtagtctcccttccaaataaatcacttttctgccgcctt

SEQ ID NO: 186936 - DNA, 1120 bp, Homo sapiens
tgtgcatatacaattgagctcggtacctgaatcattcatccttcatcgagatctccaacaactgcctgtccaaggcccagctggctgaggtggtggagtccatgttccgggagtcgggattccaggacaaggaggaactgacatgggaagattttcacttcatgctgcgggaccacaatagcgagctccgcttcacgcagctctgtgtcaaaggggtggaggtgcctgaagtcatcaaggacctctgccggcgagcctcctacatcagccaggatatgatctgtccctctcccagagtgagtgcccgctgttcccgcagcgacattgagactgagttgacacctcagagactgcagtgccccatggacacagaccctccccaggagattcggcggaggtttggcaagaaggtaacgtcattccagcccttgctgttcactgaggcgcaccgagagaagttccaacgcagctgtctccaccagacggtgcaacagttcaagcgcttcattgagaactaccggcgccacatcggctgcgtggccgtgttctacgccatcgctggggggcttttcctggagagggcctactactacgcctttgccgcacatcacacgggcatcacggacaccacccgcgtgggaatcatcctgtcgcggggcacagcagccagcatctctttcatgttctcctacatcttgctcaccatgtgccgcaacctcatcaccttcctgcgagaaaccttcctcaaccgctacgtgcccttcgacgccgccgtggacttccatcgcctcattgcctccaccgccatcgtcctcacagtcttacacagtgtgggccatgtggtgaatgtgtacctgttctccatcagccccctcagcgtcctctcttgcctctttcctggcctcttccatgatgatgggtctgagttcccccagaagtattactggtggttcttccagaccgtaccaggcctcacgggggttgtgctgctcctgatcctggccatcatgtatgtctttgcctcccaccacttccgccgccgcagtttccggggcttctggctgacccaccacctctacatcctgctctatgtcctggtgagggcttttggctgtgagcc

SEQ ID NO: 186937 - DNA, 2114 bp, Homo sapiens
ccctcctgagtgggtatagaaggtccttgacttaggaacaatctgtgctttcttgcaccgatgtttaagccacctttcaggagtcagctgttacaccctgagctaccacctggactggtggcccaggccaaggtagaaaatgctggtgatatgtttttgaaaactgtctccaaaaggcaatatataatcaggcatttgattaaaaaaaattttagttctaaagaatagaaaccttttataacacatcattctgccattcaacttttgcacattctgattttgtcccttcaactttcataccttttcaagaacaagttatgaatgcggattggctggctgttttattactttataaaataggcagctgaatgtgtgagagggttcccataaatggagttcacttatgtaaaacactcagagaagtgcctggggcataataagcactgtataggagtgagttactgttactgtcatttattattatcatccctggggctaatccctgggagccacctctttgccttagggtgggtgccgtgtcctttctcttacttctgccccttcttggttccaggtactggaggccacagctgccctgtacaaccaggacttatcctggctagagctgctccctgggggactcctggagagccaccgggaccctggacctctgttcagcaccatcgtccttgaacaatttgtgcggctacgggatggtgaccgctactggtttgagaacaccaggaatgggctgttctccaagaaggagattgaagaaatccgaaataccaccctgcaggacgtgctggtcgctgttatcaacattgaccccagtgctctgcagcccaatgtctttgtctggcataaaggagacccctgtccgcagccgagacagctcagcactgaaggcctgccagcgtgtgctccctctgttgttcgtgactattttgagggcagtggatttggcttcggggtcaccatcgggaccctctgttgcttccctttggtgagcctgctcagtgcctggattgttgcccggctccggatgagaaatttcaagaggctccagggccaggaccgccagagcatcgtgtctgagaagctcgtgggaggcatggaagctttggaatggcaaggccacaaggagccctgccggcccgtgcttgtgtacctgcagcccgggcagatccgtgtggtagatggcaggctcaccgtgctccgcaccatccagctgcagcctccacagaaggtcaacttcgtcctgtccagcaaccgtggacgccgcactctgctgctcaagatccccaaggagtatgacctggtgctgctgtttaacttggaggaagagcggcaggcgctggtggaaaatctccggggagctctgaaggagagcgggttgagcatccaggagtgggagctgcgggagcaggagctgatgagagcagctgtgacacgggagcagcggaggcacctcctggagacctttttcaggcaccttttctcccaggtgctggacatcaaccaggccgacgcagggaccctgcccctggactcctcccagaaggtgcgggaggccctgacctgtgagctgagcagggccgagtttgccgagtccctgggcctcaagccccaggacatgtttgtggagtccatgttctctctggctgacaaggatggcaatggctacctgtccttccgagagttcctggacatcctggtggtcttcatgaaaggctctcctgaggaaaagtctcgccttatgttccgcatgtacgactttgatgggaatggcctcatttccaaggatgagttcatcaggatgctgagatccttcatcgagatctccaacaactgcctgtccaaggcccagctggctgaggtggtggagtccatgttccgggagtcgggattccaggacaaggaggaactgacatgggaagattttcacttcatgctgcgggaccacaatagcgagctccgcttcacgcagctctgtgtcaaaggtggggcagcctggtaggcagcactgactcattggttaggcatagtaggcacaatgcccacatacttttaggagtccacagaaatgttttaatttccattaaaatcagaag

SEQ ID NO: 186938 - DNA, 474 bp, Homo sapiens
ccaccaagaatttcctgaggggcagccagtccagatatcagctctgagggagccctgacttcccctctgagacatcagcttcaaaggagggaaccatcctcccaggccctgagggttccccttgggctttgtggttcttgagatgagcagaccctctttgtatctgttcgcattttttttgcatgttccagtctctggggtgatagtttgatgagatagttccatgagttgttgacagctcaggggagcgtgttaaagccatgacgtttgctgtcatatataactttggctagtggcactgggacctctgtatctaccttttttttttctctgtagttaaaaatgtcctgtaatgggaacaagttgtcttctaggaagtccaggaattcaagagaagccaaggtttcttcagcaatggttatctgctgcccagtgtagccatatatccatccatctattcatctgtccatccat

SEQ ID NO: 186939 - DNA, 552 bp, Homo sapiens
tgcattgtttccgcgtagctgtatactacaggcacccaccaccactgcatctggcctaatgtttgtatttttagtagagacggtgtttcctcacattggccaggctggtctggaactcctggccttaagtgatccacctgcctcggcctcccaaagtgctgggattacaggcatgaaccactcctggctgttccctacattttttttgctcctttttccctttagccttattttggagtggggtggggagacaaggtctcactgtgtggcctaagctggagtgcagtggtgccagcatagctcactacagcctcaaacttccgggctcaaacagtgctcctgccttatccttccaagttgctaggactacaggtgtataccgtcacacccagcccccctcttagcttttttactcctctttagaaccacctgtgtacttcctggttcttgcattgtgatagagaaaggtagagataatgttaatagaaacagacatccgtggagttccaaggaaatacagtacaaacagttcaggctttctcacagagcatg

SEQ ID NO: 186940 - DNA, 324 bp, Homo sapiens
ggctggggtctctgcctggggtattacaagggtgaaatcaagacgtcagccagaagagcatctctctggaggctctagggaaaaattcacttccaaatccatcatattcatagtcccaggcattattcaaagcacatacaacagggaagtgggaaagctcaggggtccatcttagaattctatctaccacagtacttttgttagagttataaatgacttttataaaccataattgtattatctaaggactgattatatgtgggtgctactgctggttctcaaaatcagcaatctaaaaaggaggtatgataaaaatgttatgac

SEQ ID NO: 186941 - DNA, 186 bp, Homo sapiens
tctgttacccaggacggctggtcttctagaaggaggccaagcttccaagtaggggaccagagtcttgggctaggctttgccctccttccctgaaaatgtacacaatgtacctggttcacctccatttttgtgttcattcattcattccttcattcagcaatgttactaagcatctagtaagttcta

SEQ ID NO: 186942 - DNA, 323 bp, Homo sapiens
aaagtacaacttggaagagggctaagccggtgacttgagagaccaagtgcacaacttgacctcttgacttggggttttatactttggcaaactactaggatcttgcattacttctgcccactcttcaaatcttattgggaagctgctgatcaatttcaggagacataaacctaactgctgttaggcgggtgttggatgatgattctttctggctacttcctgttgaaaagaggcatcgtgtggtggggacaacagttgggcctcctcttgaagttgataaagcattctgggaagaattgcgtgtacatgcatggtttgcagtg

SEQ ID NO: 186943 - DNA, 260 bp, Homo sapiens
aggtgctcaaaagccacaggtgctactgcagatccagatagtgctagtctagtcactgcctcactagtttcaagagaatctgtggattatttcagggtaatgtaacaacagtggagctttggatggttgccttccagtttacacaggatgttttaggacacttttgtcattgaattctgacagctggccttggaaagtaggctgtcttttcctcattttggtttctgaggaagacagcaccaggacatcaaactaaatct

SEQ ID NO: 186944 - DNA, 249 bp, Homo sapiens
cataaactgtacagaagtcccccttatccatagttttactgttcagtttcagcaacccatggttgtatttcaaaaatagtaaataaacatttccagaaatagacaattcctaagttttaaattttgagttctttccaagtagcgtgataaaatctcacaccatcttgggaggtccagcaactccacactgtagacacttcctgccctggagtcacggaatagccatctcggtgatcgaattgactgtgg

SEQ ID NO: 186945 - DNA, 381 bp, Homo sapiens
actttttgtgtgacattagtatttttatttctgaaatagtatgaccacatagttgtgatgagttgaggaagagaaagaagattgatagtgaagatttttaattctgcaagagagatgaaattggtggcagtgtttgctgttcttataggaaagctgtcatgatatggacaatgaagcagaagaaactgatatagataagctactatgtaaagctttgatgtccagttttgctttatactgtcaatttgtttagaaggaatgagaggggtgttgatttttagtattacagtttctaattcaaaacctggttctaatttgaggtccttggaacttaccaggaattctctatggatttgaagagtcaatgaattattaaagtta

SEQ ID NO: 186946 - DNA, 319 bp, Homo sapiens
atttgtggcagtgtattctataaacaagctaagtaattatcttcatctgcagagatatataaactaaccacattataggctgaggaaaatttcacttaaaggtatatgctaattatagaagagcacaaccttcagggtgctttctcctaaagcaagaacaaatatcttaaaaatattagtgaataggctgataaaatcggaaggtttattatccaaagatttttctcagatgaaaaaaacagaaacaaaaccagcttcttagaacgccagaacacccaacacttggattctgtcctgtttggtagcctctgtttattat

SEQ ID NO: 186947 - DNA, 375 bp, Homo sapiens
tatcttatgaataattgggctattctttcatatgcccaagggccattttatagctctatatttcttttgtgttctgtttggggcttgaagtctctacttctgtatcgggattgcaatgcctgctgtcttactgtttccatttgtctggtaaattttcgttcattcctttatttttagctatttcaattgctgcattttcggtgtgtatcttgtgtgcagcacacagttgagtttttgctatacgagccaatccgaaaataatcttttttaataggcaaattaagccgatctagttttgatataactaccatgtttgatgtcaattctgtcatattttagattgtaattgctgaatgtattatatttactgtgtct

SEQ ID NO: 186948 - DNA, 373 bp, Homo sapiens
aggataggactggagttgatagacaaagctataaagggagacggttactggggggagagctctgtctcgcttagcatcacttgctgttagtggtgggcccagacagtgactgaaatattttcattccagaccagggtccagtgtatttatacttgatgcattaagttctgatctttaaaaagctgccagttttttagaaggagagtttttattttcattttatatggtgtgggctgaaggaatcttttgctaaatataacaatgtgagtttgctagtctttctgaggcattgaaggcatttaaaatttgaaaccagagctacctgatgggaacatccttgatctcttctccaagtcaaaccaacctaggccac

SEQ ID NO: 186949 - DNA, 303 bp, Homo sapiens
taccacagtggacacctggacttcctctggctttctcttggggactctgccaggcagaggccctcagccgtgcactgggacagttctgtgggcagtggcaggaagccttcagtcggtgaacagcgtgaagacagcctgatgcatgcaaggcgtggggatgtgattgtgtgagcagatcaatacctatatctcaaaaatgagaactttcactttagtacttgatcacttaccctattgaattatgtaagtacttcagtctcttcaacattggctttctttcattctttgtttttttaatctccc

SEQ ID NO: 186950 - DNA, 159 bp, Homo sapiens
cctagcatatcccatacaccctatacaccataccgtcctgataccaccctataccactgagcttaccactatcataacaaaaacataaacactctgcatttttcataggaatcttactttttattcaataacattcttgctcttgaaagagtaagaaaa

SEQ ID NO: 186951 - DNA, 247 bp, Homo sapiens
cttttgattatttgtctttcatatttaaatgtttgatttataaagaaaacacaaacacctcctcttaggctctccattgatttcagtctcacctaccttctcttcctctcaccatccgtgaccccatttatccaattcaattccttcatcttctcttcacctcctcaacccactgcagtttcaccacatcactccaactgtggttgccagaatgagtaaagaccttctagttgataagccctcaaga

SEQ ID NO: 186952 - DNA, 620 bp, Homo sapiens
cccgctggcgcttctccattgtagaatgtgaaattcttaaaatgcatcctatataaggaatactatagctgtgcactggtgttgttctcttctttaaactcgggaccgtatatatctggtcaaattggccaagtattacttatgctgcactccatcaagtgtcaggccacattctatcagcacagcgtgactgcctatcagtgacaatataagtgagctctatttggatccctcttaccctaccctttatatttatgacagcattatcataaaactccaatattcttcaataacttacatgtttgttgtaggataaaattattaccctcaatgaactacataaaaaatacaaaaattagccgggcgtggtggcacgcgcctgtagtcccagctactcaggaggctgaggcaggagaatcacgtgaacccgggaggcagaggttgcagtgagtcaagatcacgccactgcatcccagcctgggaaacagcgagactctgtctcaaaaaaaaaaaagaaggggttgactgccaagtttaaatattggcaggagatgaggagatttcagtttttatggagctttgttaatgagccgtgactgtttattacaagacttttactt

SEQ ID NO: 186953 - DNA, 780 bp, Homo sapiens
gtccaaaagcaccccatttacaaatctctttgttcctcaaacacaatttcagcttcctgtctacaaatgtttgctcatgctctttcctccacctgaaatgcctagtgttcctaataacttatcatttaaggtccagttatcttcccttatcaaaagcagtatctctcttatctgatttttaacatcatttgatctgtacttatctcacattgtctggcaatacagctatctgcatacgtcatctaccctactagactgaggacagattagtgtttcacaataatctcaacacaacctgaatagtgacactgttaattaaatttggcctaaagctgcttccataagcagggaactgcacctcagtatgttaaaactgcaacctaactcgagtatattcttgtaacgaggctaagcgttctgccaatcacaagcggcaagctgctcagacatgtccaaataaggcaaacgtggacacaaacgtggacctgtaaccaatcagactatgtctggatgtcacttctttttctgtctataaatcctgactatccacattgctgggtggaactctctgaacctttactccttcagggtgctgctcaattcatgaattgtttctttgctcaaattaactgccaaatttaatttgtctaaagttttattttaacaagactcaatatgtaatgctaatgagcatattaatttccttaagacgaataaagtcttttttttgagacagggtctcactgtcaccaaggctggagtacagtggcatgatctcgg

SEQ ID NO: 186954 - DNA, 264 bp, Homo sapiens
cctactcaaataaataaatgataccaataataaacaagtaacactaatctctatttgggctcaatatttggagtatgttttaatttctatattgtttatagataggttgctcaggaaacttgaataaatgcccaactcttgaggtcatatgactttttgttagtagcattttgttttccagattccacaatattatctagcaagcagagaattttgaatgcttgtgcaagtgtggttgccgctgaggtgtgcagctcaggactt

SEQ ID NO: 186955 - DNA, 289 bp, Homo sapiens
tggctggctttgacttgctttggctgacagaatgcggcaaaagggatgtcatgccacccagtagaggcctcaagaaggctgggatacttgcctctctcagaaccctgcttctaccacgaaagcaagcctggggtggcctgctggagcatgagagactacgtttaaagaacagagttgtcctgaggccatcctagaccaaccggtaaccacagacacatgaatgagcacagtccaggtgagccacgaccagaactgcccagctgaacccagcctattgcggactcacaga

SEQ ID NO: 186956 - DNA, 602 bp, Homo sapiens
aatacagagtctacagtgaagttgtggagactgaacaaggaatatattttttaaaatcaagccatgggtgggcctgggtgcttatgcctgtaattccgacactttgggtggctgaggtgggtggattgcttgagctcaagaattttggcaatatagaaagaccgcgtatctataaaaaatcaaaataaattttaaaaaagaaaaaagccaggcgcggtgctcaggcctgtaatcccaacactttggggggccaaagcgggcagatcacgaggtcaggagttcgagaccagcctggccaacatggtgaaaccccgtctctactaaagatacaaaaaattagcggagcgtggtggtgcgcacctgtaatcccaggtactcgggagactgaggcagaattgcttgtacccgataggcagaggttgcagtgagccaagactacaccattgcactccagcctgggccacagggcgagactccgtctcaaaaaggaagaaagaaagaacgaatgtaaagaaagactgaaagagaaagaaagaaaggagagagggagggaagaaagaaaagaaaggaaggaaggaaggatggaaggaaggaaggaaaga

SEQ ID NO: 186957 - DNA, 527 bp, Homo sapiens
ctcctctatctaaataaaagttgaaataaaaaatggatatagaggtagcatacctcaaaataataaatgctatatgtgacaaagccacaactaacatcatagtgaacagggaaaaattgaaagcctttcctctaaggactggaacaagacaagcatggcccacttacactgcttttatttaacactgaaagtcctggacagggtaattaattaggcaagaaaataaaaagggcatccaaattgaaaaggaagaagtcaaattagccttgtttacagatgacataatctcatacctagaaaaacataaaggctccaccaaaaaactcttagaactgaacaaattagaacaaattgagtaaagttgcagaatacaaaattagtaacatttatatttgccaacagcaaacaatctgaaaaagaaatcaagaaagcaatctcatttataatagctacaaaaaatagaaaatacctaagaatcaatctgacaaaagtagtcaaagatctatacaaactataaaactcagatg

SEQ ID NO: 186958 - DNA, 335 bp, Homo sapiens
tatagcttcaggtcttagatttgagtccttaatccatcttaagttcatttttgtataaggtgagagttgagtattcagtttcattctcatacatgtggctagctaattatcccagcaccatttgttgaaaacggtgtcctttcccctactttatgtttgtgtttgcttgttgaatatcaattggatgtaagtatctgggtttatttctgggttctctatgctgttccattggcctattgcctatttttataccagtaccatgttgttttggtgacaatgactttatagtatagtttgaaatcaggtagtacgatgcctccagatttgttattttt

SEQ ID NO: 186959 - DNA, 675 bp, Homo sapiens
tcagcccacttgcatccgagtgaataaacagccttgctgcttacacaaagcctgtttaggtggtcttctatatggacacgcatgacaatatttacaacaaataccaaggaagagctaagagcacatagcatttcccaggcttattagactgtgggatcaacctctttaagaaagcattttgcagaattgttcacaggtcattctgcagtgtgaagttttttttgcaataagatccttactctagagttaacttcactaggaagtacactctgggtgtttacctttagagcttcagtttctacaagaatttggcaccggttgggtcttgtagaaatatttactgcatggagttgaaagaagagtctggactgggagaaggatgtatggataaagaacaagggttcttttcagaaaaccaagcagctactggatactgaccttattctaaaggccaacagaagtgggaataaggtgcaattgcggaatctcactcaatattgaaggatgacggtgaccttgtgggaaaataggattcaggaatgtctttttaaattctggttatttgtacatacgcactcttacagatttttttcaaaaatcccaattccactggaaaacttttacctcgatttttccttttctaaaattctactccagactttatttcatttgcca

SEQ ID NO: 186960 - DNA, 679 bp, Homo sapiens
ggcgctgtctccatatttcacaccactaaccaccctgctgtgctcaggatgccctgtgatgcactatgataaaaatgaaagtggaagccaagcacagtggctcaagactggtaatctcagcaatttgggaggaccaggtgggagggtcacttgggcccagaagttcgagaccagcctaggccacatagtgagatcccatctctacaaaaatttaaaaataaaaaaaatgagcttggcatggggcctgtgcctgtggtcccagctacttggaaggccagggtgggaggatcatttgactctgggaggtggaggctacagtgagccgtgatcgcgccactgcactccaacttgggtgacagagtgagaccctgtctcaaaaaaagaaaataaaaagtggggataaaaagataataatcgccaacttactggtaagtccagttgaactttaaatattgccaagatttctaatttttatttttgagcctattgcttccacatttttacctgtgacttcatcttgtcttctctctctcagattttggattcataaacacctttggggaagccacgcccatcgctctgtcttgggcttgatcatgatcagaacagcctgaaataatcccatacatccacaatgacaaacggtggagcatcttagtattagggggttagtcactta

SEQ ID NO: 186961 - DNA, 427 bp, Homo sapiens
aagatgttactagctcatccaatagaagtttatttcatgctcatgttgcatgttcattgtgagtaattgattatagtactatatcctcttccctccacaactcatgttggcagggcaccctcctgggtatgacttggtgggcccatggtagagagcacagagcagtggcagagcacatggtcgctcattaatgcttttgctcggaaatggtatatcccatttctgctcacatttcattggccaagacattcagcaccaaccttaaaatctaatgcataacaaggtatcatctttcagtaggaagatacccaaggtacatggccaagcttgatatcagtgggacaggaagggatagcatttatttatatagtatacacattgggatagtatacctttgggaaaagaatatgtctgccatacctattaa

SEQ ID NO: 186962 - DNA, 734 bp, Homo sapiens
agttacacctgtgtgttgtggctttttgtgtgtttctggtgtctgtatgaagtcaggctgccctaggatggctgctctcaaccacaaggcagcgaccatcagtggcaagatgggccacaagtagtctgtcactcacgagaagggtgcaggtgactgacttccttgtatgttaggactctgtcagttgcaaataactgacaggaaacagttctcagtgccttaagcacatgtgcacaaacacatacacacatacacatgcgtgcacagcgggggggcagtgtattgtccggctgaccaaaaagatccagcgtggccaggagaatctcgtgccaggctgaggcagaagaatctcttgaacctgggaggaggaggttgctgagctgagatggtgccactgcactccctcctgggcgacagaggccactgcactcctgcctgggcgacagagtgagagacaaaggacaacaccctagtctcccttcctggctctgcatcccgccgtgccagcttcactcgcaggacccacagcatagcccgggaggcagcgctgcacttacagccccccaagtctgagtctccctttccagctgtccctggagattctagacctgtccatcatcgtatcaatggccatatctctcaacccatctctgtggctggggaatgggttttgcttatcagcttgggcctgggtcacatgcccacctctgcagctggggctagagtcagaccca

SEQ ID NO: 186963 - DNA, 251 bp, Homo sapiens
gagaaacagcgcgcactcagatttttagagaagaaatctggagaggacgtaagagagagaaacagcgcacactcagatttttagaagaagaaatctagagaggacgtgagagagagaaacagcacgcactcagatttttagaagaagaaatctggagaggacgtgagagagagaaacagcgcgcattcagatttttagaagaagaaatctggagaggacgtaagagagggaaacagcgcgcactcagattt

SEQ ID NO: 186964 - DNA, 147 bp, Homo sapiens
tgtggattagaaagaagaaaagaagtcagctaagacagaggacgagcaatcagaggagtgactggaaacccaggaatgacagtgttgccacaacaagagggaagcaagattcctgaaagagtgtggaatcaacactaaatgctgcag

SEQ ID NO: 186965 - DNA, 406 bp, Homo sapiens
taaatatacaaataagtgattgaagaaataaataaatgaggagagtagacaagccttccttccaaataacaattccaatttcttccaaataagaattccaaataacaaatgtggaaggaatgaaggaaatgggaaaatcaccttcagacctgcatagtaatgatgtcatgggccagaaaccctgaagaataataaattcatggcaaagctttaaggaggagctgggtacttacatagccccaagcaactcctccaaatacttaaacagtactgggatggtttccacagggccccacactcctggtacgccttccatcagagagtggagctcagtctccccatactgagacctgagtgtgagctgaactgggtgactctgtggacagcgacttcccagaatgaagaa

SEQ ID NO: 186966 - DNA, 444 bp, Homo sapiens
ttctcaataacaataaataacctagataccaattacatatctccttataagatactaccaaatcgccctcactcattcccctaccatgagcatcccaaacaaacaatctaaaaacaatacttacaatagcactattccttcttaccctactagcagcacgcctagcctgtgatactgggctgcccccacacatgagtgctgccctcctcacgttgcttgggacggcactgtgtcctgggccaccatgacttttctcataactagcgtggatgcttaccttgttccacaccagtgaatggcttcaggaagagaagaggaagagaaaaatatttacatttaaagaaaggtagtttaaagaaatatgttaggtaaagaattgagcaggtaatatacggagctggcaaaaattgtgaccaaagtaggtgaatgattgagatttatgca

SEQ ID NO: 186967 - DNA, 458 bp, Homo sapiens
cagcaaaacaccttccaaatctaccagggaatcttacatatactagaaactctataaatatatttgaatgaataaatgtatttttttctgataatagcctgatatggagatgagatagcagaaaattggcatgatctagaagatttcttttccccttaaacctgagtgttttttgttagtgaattcactccaatgtattgctaaaggtggtcgtataaaccattctgtttgcaatctcctttttgtccttctgttcaaagtgagtaaagaacaacctgtttgaatcagacatcagatcatgatagttatgtggggagagggcaggcagggactcagtaaaaggacctggtagagaaagcagaatctacaggtttgaacataacattatggctcagggtcagtcattctaggaattggtctcatggcagatgtacccaaagctgcatttcaagtcgtga

SEQ ID NO: 186968 - DNA, 897 bp, Homo sapiens
agacgggtttgatccaaagtggtcaagattccttttctttaaatttgttttttttttgagatggagtcttgctctgtcacccaggctggagtgcagtggcgtgatctcagctcactgcaacctcctggattcaagcgattctcctgcctcagcctcctgagtaactgggattacaggtgaacaccaccacgcctggctactttttttgtatttttagtagagatggggtttcgtcatgttggccagaatggtcttgaactcctgacctcaagtgatccacccacctcgacctcccaaagtgctgggattacaggcgtgcgccactacgcactggcaaatttttgtattttcagtagagacagggtttcgccatgttggccaggctggtcttgaactccggacctcaggtgatccacccacctcagccacccaaagtgctacaattacaggcgtgagccaccgcacctgggctattttcacttctttcgaagttatacctaggagtggaatcgctgggtcagttggtaattctatatttaattaatggaatcaagatttctttttcttttctttttttggttttactttaaaaaattctatcttattacataaaaaaaccacaggttcagaaaagccacaccaaacaaatgaatagcctaatggttcactctaacgtcaacactcatataatccctaactctggttgagaaatagtactttgccagaacaccccctccaaaagccatgccacggaccacatcctagtcacagccctcttcccccagagtagtcactgtcctgtcttttgtagacatcacttccttctttctgtatagttttatcacccaagtgtgaatctgtagacaaatatttagctttgcccataaaaaaaaaaaa

SEQ ID NO: 186969 - DNA, 701 bp, Homo sapiens
ttatttattaaagagatggagtcttgctatgtttcccaggctactcacaaattcctgtcctcaagtgaccctctcgcttcagcctccccgattagctaagactacaggtgcgcaccaccatccctgactaatttatttttaaaatttttctttttgtagagatggggattttgctatgttgcccaggctggtcttgaactccggacctcaggtgatccacccacctcagccacccaaagtgctacaattacaggcgtgagccaccgcacctgggctattttcacttctttcgaagttatacctaggagtggaatcgctgggtcagttggtaattctatatttaattaatggaatcaagatttctttttcttttctttttttggttttactttaaaaaattctatcttattacataaaaaaaccacaggttcagaaaagccacaccaaacaaatgaatagcctaatggttcactctaacgtcaacactcatataatccctaactctggttgagaaatagtactttgccagaacaccccctccaaaagccatgccacggaccacatcctagtcacagccctcttcccccagagtagtcactgtcctgtcttttgtagacatcacttccttctttctgtatagttttatcacccaagtgtgaatctgtagacaaatatttagctttgcccataaaaaaaaaaaa

SEQ ID NO: 186970 - DNA, 207 bp, Homo sapiens
agggacagtaggagaacgatagtgctattaacagcaacagggaaactggaaaggtagatgggtatagaccacaacagagttaacactaattttgaaggtgagcatcttcagtccacggttttggggaaaatcagagacaactaaagagttaaaatttgccctggaatgtggtccttatacttcagggtgataagaatctcctgaggt

SEQ ID NO: 186971 - DNA, 286 bp, Homo sapiens
atcatgcatgtttgctgttgaaaaggttaaaaaggttgaacaggatacaaaaagtaaaagaaaaaaaattataagtcattttatttccacttttcttctgtgcacaccgtctactttaattatttgttcttactgcccagaaacttttcctttgttattacttcctagagatttcattcttcatcatgccatcttaagtagactttgtactttagctcaagctaaaacacttgaagttaaggaaaatgagcttagaaacaacttttcttctatctaagaagctctt

SEQ ID NO: 186972 - DNA, 426 bp, Homo sapiens
agagaggaagcaagagagagagcgaggaggtctcagactctctttaataatcagatctcctgataactcatttccatggggagggcaccattcatgagggatccgctcccatgacccaaacagctcccaccgggccccactgtcaacactgaggatcacatttcaacatgaaatgtggaggggacagacatccaaactatatcacctccatactgttttccacagcattcccaccaacagtgcacaggggtttcagtgtctccacatcctcatcacacttgttatcttctgtttttgtttgtttgtttgtttgttttttatagtagccattctcatgagtgtgaggtattaacagtgtcttttgaagatcagaaatttctaatttgatgaagtccagtttatcattttttttcttttctggatcat

SEQ ID NO: 186973 - DNA, 217 bp, Homo sapiens
tatacagtacacttttaccatgtactgcagagtaagagccaaactaccaaagcaagagctcgaagcaaaacactctggacagcttgaagaaaaacactcccacatctgtgccaagaggttgtgaaattacagacactttaaaattagagaaaaggccgggtacagtggctcatgcttgtaatcccaacactttgggaggccaaggtgggtggatcac

SEQ ID NO: 186974 - DNA, 281 bp, Homo sapiens
tgcttcaggaaggtgatgaacaataaaaaaaaaagatatacttaaattgacagattctgttttttaaaaactactcagtaaatacatagttcagtaactgttgtgagacaggctatactacgacttgatgtttttgtaaacacagaaaatttttacataaagtttacaaacttataggcaaatttctgaatttatttttttatttttatttttattttttttgagacggagtctcgctctgtagcccaggctggagtgcagtaacgtgatctcggctcact

SEQ ID NO: 186975 - DNA, 160 bp, Homo sapiens
tcaattagaacactgaaaaatatgttttataaaaaaggtatttaattttgtttgtaggattaactcatgcaaataataaaaaagataccctgttggttcaatagtacactgtctcctttaaggaaggaagcatgatgaatgaatgatgtgtagacttgag

SEQ ID NO: 186976 - DNA, 371 bp, Homo sapiens
ccttctccatttctctagaaaagtgagttgtctacaccacaggcattccttcagcctctgggtgtagatggagcatacagatcttgtcctcatgggcagtgtagatgtttacagacactgagcccacttgatctgctgtttcatgatccaactcagacatttgctctttggttaactcattcacccacagccgctcggtggccggcctttttctcttctgttttgcccattcccctgagaacatacactttttatattgctttggttaagcctcaagcataatcatttggtttctttatacagcttctttctctgaagctaggactaccctagtttagataccctaatgtccaccagcaacatggcatcat

SEQ ID NO: 186977 - DNA, 286 bp, Homo sapiens
ttcagaggccccgtccgcaattcttcccttatatgaggatacctgcatttccttgatctatccagttttgcatatatattctgaaaattatttataactttgtgtaattctcagcaaccatggcctggatcgtgtcttttgtgatttctctattaggtgtcttcaaatctcctcactttcttcaacttacacacagagcaacaatgggaaggctgtctgttcattcaccctaaacctcttccctccaatttctttgcaaaatcctctcctcttccaggaagaaaga

SEQ ID NO: 186978 - DNA, 236 bp, Homo sapiens
caatgtaaatatgttcaataggtgcgctgtttcatggagaaaatatcttaaacatgagatccatgggaaaaaaaaaacaaataaaaggaactcttgataaactaaagttgtgtaattataaagtatgaacagatgagaacacgaggcccaaggatccattggccagcccagggtcacacatggagttagtgctgtgattacagactcagatgcccataggtgtcacgtaggtaata

SEQ ID NO: 186979 - DNA, 942 bp, Homo sapiens
agaatctcttgaatggtaagatgcagctgacatagactacgtattgtaggatttcctgtagcttttgaatgtgacttaatctaaactttatttcatttggtattttatctataattttcttgttttaggggcctcttgaactaaaaagaacaaactgggaaaaacataagctaaggttccatttcctttcccatttttgttgtgtgtgtgtgtgatggttgtaaatgcttgaatgtgattttgagattaccatacacaacttctgtaacgctggacttagctttattacagtaagatacatcttttgatagtttattactatatgtatttttgtaaaaatcttcatgtcagtataagccacattgtttcaccctagtctggttatatttgtgaggtgaaacagatggacaagaaggaagcccttttacttttacaatcattttaaattgattgtttctaaagccttgatttaacttattttggacactttcttgccatttaaccttggacaaatgactttatcatctctctcctgctcatttgtttgtgaccaaagattcacaacagtattctaagaattggtgagggtgtttataaatctaaataatattttaggaaaaagtaggaagaatgagtctccttgtttatcacgggtgctatatcatgtgcagatccttctgtcacttcttaacttttgtttggtgtctgttggccacttgtttgctagttatttcaccagacatagaactggtttttaaagaaaggtataaacaaagtgacttcattttggtgaaaaatgcattacagcagaggttacatcttaacgaatttcactttggtactccatttctacagattattgagagagagctgttgtgatgtttaagagaaaagcaccttgcttgtataaagctaaggtgcagtcatttagcagatactcct

SEQ ID NO: 186980 - DNA, 772 bp, Homo sapiens
tgtgcctcctcaggttaaactgatgctaccgattcctatcatagcatctagaaaatttcatgggactcatttttaatgcttcagtctctctaggtaaatgtaggcacaaaataaatggttttcaatgaatcaatggatggataaatgaatatctctattctagaaagcacaaaagagtattttattttatttttgcttacgtgtctgatttagtctgtgagcttctcaacaacccagaatacttctgatacattttgtatctccaatgcctgacacagaacctgtatccactcaatgaataaatggctggagttgttgctactcaaaagaaaacaacaacaaaaaacccacataggccgggcacggtggctcacgcctgtaatcccaacactttggaaggccacaaggcaggcagatcacctgaggtcagtagttcgaggctaacatggagaaaccctgcctctactaaaaatacaaaaaaaaaaaaattagctgggtatcgtggcgcatgcctgtaatcccagctaccaggaggctgaggcaggagaatcgcttgaacccgggaggcagaggttgcggtgagccaagatcgcaccattgcactccagcctgggcaacaagagcaaaactctgtctcaaaaaaaacaaaaacaaaacaaaacaaaaaaaaccacccacatagaatcatcaaaatgagttttggaagcaaacttgaaatcactattcaagacttgggcaaaaccaaagagcatctgagattaaactgggacat

SEQ ID NO: 186981 - DNA, 295 bp, Homo sapiens
attaatatgtacacttttcctttagtgctataaattccactttcagcactgttttcgctgcgtcccacacattttgataagttgtattttttcttcattcagtttaatgtaatttttatttcctttgagattcccactttgatcactgaattatttagaagtatgtttaatttccgagtgtttggacatttttctattttttttattatttatttctagtttgactcattgtagtcagagaacatactctgtatgattttaattctttcaaatttgttgaggtttgttctgtggc

SEQ ID NO: 186982 - DNA, 299 bp, Homo sapiens
tcattgaatgcatccaacattatttcctaacactttccagtccctctttcgctccaactagaacgggctttaaatcttgagctcagaagaattgctctcacttggtggccaccctctcatggcaatgccctcctgtcttccctctgtctgcacaattccaaacagccccacagagaccctgtactccatgaagtattacttccaactcaccattttttttttctccttcaactctcagagaagtaaggctgtacatttctacggggtgcaaaacaatatctgccgtaatgttagagata

SEQ ID NO: 186983 - DNA, 182 bp, Homo sapiens
tctttactacgtccagtaaattgtatctaataaagcagccagcatgccatgagagctgctccaaaggacagctgcacagtagcaggggcccccaccactcccaggggatacctagcactcagagcccctcctacttccaggtaaacagatgaaagggtattctgaccagtcaaaggcaaagg

SEQ ID NO: 186984 - DNA, 330 bp, Homo sapiens
gatcacgccactgcactccagcctaggtgacagagtgagactccacctcggaaaaaaaaaaaaaaagccagtgccaacttagaccatgactgagagctcttggtttatcttatccttgccgagctgggtgttacaacattgaagccttctgcagtgtcctccctccctttttctctctttctctctctctcctccctttcttccttttacttctcttatgataggctcgtctgtacttttttgatagaggtaaccatttgccacaccattttctgaagggcctgctctcttccccattcatttgtgatggcacatttatcctaccctaag

SEQ ID NO: 186985 - DNA, 153 bp, Homo sapiens
ggaaactgaggcaaagagagtttctccaaggacatagaggaagtaagtggcagcacagggatttgaaccgacaggctgggtcttgggtctgggctattaaccactattacactctgtccacaactacaaaaacaagaggtgacattttcttaa

SEQ ID NO: 186986 - DNA, 177 bp, Homo sapiens
gcgggaacagagaagccagatgggtctggaggtccaggcaggagaccagcctgttccaagaccccatcgtggagtccttcaccaatggcaaaacactgatgtgtggatggtggtgtacactcatggcattcaaaatgttcccaatccgaatcgaaaacataatcctgctcgggtgtg

SEQ ID NO: 186987 - DNA, 630 bp, Homo sapiens
tctcctgaaagcaagtttcagcaagaggctggaaaggcctctcagagagaaggctgagctggcagtgatcagggagcccccgggcatttggcagccgtccacagtaagaccggcagatggagccttcatctggcaagaaactggggaagctggcggtgtcgtcaggtgcaagcttcagtgagaagtgccagcactctgagaagatgcacagaaatacagaagcagctcccgtaggagaaggaatggaggccgcacgcggtagctcacgcctgtaatcccagcactttgagaggctgaggtgggtggattacttaaggtcaggagtttgagaccagcctgaccaacatggtgaaaacccgtctctactaaaaatacaaaatattatccaggcgtggtggtatgtgactgtagtccgagctactcgagaggctgaggcaagaggaatcacttgaactcaggaggtggaggttgcagtgagccaagatggtgccattgcacctcctgcctgggcaatagagcaagactctgtctcaaaaaaaaaggaatggagaaaacatagccatagctctgggagtaggaacagaagcaagcaagctgactgccagtcgggttctttcttctggaaaaggc

SEQ ID NO: 186988 - DNA, 314 bp, Homo sapiens
caaagtgctgggattacaggcgtcagccaccgcgtccggcccaggaaatggcttcttaggaaacctgttctagtagtcatagaggggaaaagactcaagaacagattaatagttttatgtgctgcctcacagggtaaactttcatatgtctgatatgacatatgaaataataaaggatattatctgaacctttttttccaccaacttttccctgtctttcatgctatagaaccatcaaattttatttctgaaagagacctgagagattgtttatagtaccttcctttggtgaataaagaactcactcaagagag

SEQ ID NO: 186989 - DNA, 239 bp, Homo sapiens
cctggatgggaaaaatcaacaactaagcattcctattttttcctaatttccttatttgtattgcttcctaaatattgtattttgcagagctgaaaccagggctttaatttaacaaggttttcttctgggctagagtcaagaggaggaaaagaagaagagagaactgaacttccagtgtttcattccattaggtttttatgtgtggtgcttactggtgtagaagtggcaataaaaaggta

SEQ ID NO: 186990 - DNA, 784 bp, Homo sapiens
cctggtcttgaactcctgacctcaggtgatccacacccaccttggcctcccaaagtgctgggattacaggcatgagccaccgcgcctggttgcattcccatataaatttaaaaacaatctactgaaagatgtatacgacctccaccaagaaaattgtaagacatttggagaagtttaaaaagacatgaataaacggaaatggtttttttaaataaacaaatgatttttaaagttgatcattaggttaataaatagtcatataatgacaatccgatgagattatgttgcccagggtggtctctaactcctagcctcaagcagttttactctctcattacaggtgtaggccaccgtgcctggcctgacacttggaaatcttaatcacaattattctttgtttttataatgtttactgttcaaatcaatttctggttggatagtatgtatatataaagccatgctcaatggcctagatatatttactgccaaatcttttatgcttttagtgttttttttctggacaagatctatgcttattgcaataaattaaatgcaaagaatattctagtagaaagtcagtctgcacttcctaaaccccaccccaccccaccaattccttcataactgttattaacagttagctgtgttttctaatggattatctccaaagtatatgtaactcagatttttgtgaggtaggaaaagaataacattaattccacttcacatattgaaagtctaacatacaaagagattaaatatctcctttcttttgccaaatgtt

SEQ ID NO: 186991 - DNA, 291 bp, Homo sapiens
tcactatgaggttgacttgcttgtaaataaatatgactattattcaattatctatatttgatgtcagcaaccttcttccttgattttatttttctacttcaataagcccactacttatacttgtgtgtatgttttctttttcctcttactctatatttaaataccacatgcttgagaaagaagataaataggtaatatttttgcatttgtagaagttcttcagaagcatacagactcctcgatgacgtacgtcttttttttttttttttttgagacagagtttcgctgttg

SEQ ID NO: 186992 - DNA, 416 bp, Homo sapiens
cagcatccattaaagtagttctgtggcagttgcaagtctttttggattaagaattcatcaatatttgtaatgtgtgctgctgttttccagagaagagaaaagctcatttcctgtgatttattagtaatatcattagatactttataaagtatctgcatttattttcccagatcactctgggcccattatcaaacaatcaaaacatcatgaatgaatgagaagcaaccctttgaaatgctgtgatggagtaagacagcagatggtgacaagtgggcgatactgccctactccttgtatggagacactggagagtgccggccacttccgcttctgccgattccagttccagttctgtctcacagtggacatagctgatgtagcagttttgaaaacttctctgcctgttttgttaaggg

SEQ ID NO: 186993 - DNA, 295 bp, Homo sapiens
agacagtttgtgtccacctaagaacaagtattttaagcaaccactcaaatttcaccataactgcaaccagaaattggttcaggcaagaattatcaatgtatgttaggtattagagggaaagtttaaagaggagtatgatcttcaaatgtttccctacagattgcttattagttgcaaggggaaataacatctacacagtaaataaatcagattaacacttgaccagatgatcaaaattagtatcaccaatgaacagcacctgcagttgtgataccctgagaaggaccctatatca

SEQ ID NO: 186994 - DNA, 165 bp, Homo sapiens
aaaaacatacaatatatgttttgaaatacaatatatgaaattaataaatttcacatttattatatgctgaaacttgtaataatttatgtagaggctgaaggtgatatcttccaccagagatgattcccctttttagttgttaggccaatttaattagagttttat

SEQ ID NO: 186995 - DNA, 729 bp, Homo sapiens
ttttttcttgaacgttggctcccccatgagaagcaagctccacgaggctgtgtccgttttgatcgctgctgtatcactaggaggtagctcatccctattgagcaccaggaccaagggctcaataaatgttgctgaatgaatgaataaatgaatgaatgaatgggtggatctttgagacggaaaaggtcttagattcttctagtccaaccttgccattgtacagattggaaatctgaggcccagggaggataagagacttactcagggtcacagagagtgactggcaaggttggggcttggagcacggcctcaccagcatctagcctcgtcgcttgggaagcattttcagaatttttcctcagtagccaggtctgagctctaagctgcgggggccctgaggacgcaaagcctggcccctgcaccccctggattggaacagcaggtgacctctgttacctacgtggaggccactcagggggtcaccagagacaggccaggctggtgtgtgcctacgcggggaacagaaggcccatgttggggcctggggctggaagtagaacctgaagcgtgggttggggcaagggcagcagaagcaaatgcctacaggggagtccacgtggccttcctgagcctcagagcggggtgcaggagctgggtaaggctggccgacctgaattccttcctcccctcacatgctcctgggggacccagccgcacgcaaactcgaat

SEQ ID NO: 186996 - DNA, 437 bp, Homo sapiens
aggagggggtgcagaagtgaggcggagttgatggaggctgagttcagtggggagcggaggcggatgatcctgagcctgggttctctggagctcagagagcctggagctgagcctttctgccctatctgaagggtagaaaattgagtttacgttatttcatccttgcaatagaaaacttactccgtgagatcctttgcaaaaaaagctgaattactttcactggactatgaaacgaaggatagcatttttgcttgcctatgcttctatgtgacaatttatcacattttggcttttaagtgatagttatattgtcccaaaataaatgcagggagaagacagaacatggattaaatgaattctgaattcccagagcacttaatggaagccagtagatggcacctcatatgcctactctctggccattactctttgtaccc

SEQ ID NO: 186997 - DNA, 734 bp, Homo sapiens
  misc_feature (731)..(731): n is a, c, g, or t
tgaaaaataaatatactaacttgatttgtgtggtaactaacacagtaacatgccaaagaggtgcttgtttcattcatgcattcatttatcctttcatgcatttattaacattttggaacacgaagtccaggtgtcattgggtactgggagaatcaaaggtgaactttgattacattacaagagcagaaggtagacaagacatggtgtaataaactgcaccaccaagagggaaatgtcgtgccaagcaaagtacaaagtgctgtgggcttatttgatgataagactgttctgttctcagtaaaccaagtacaggttggacaaaactgctaatggaaatgccagtgcattttaatccttactcaacatgttgaactcttgcaacactgacgtgtcctgaaagagagagcaactcttttgctgacttctaagttcatattggaacaaatattgtgttatctgatgctaaaaatgggattgcaaatattatagaatgtttagtgtcccatctgggaaagaaagagagtgaatacacatgcttggcattataatcaagttaccatatcctgtctcttgaaacacacaaaaagttatgcaaaataattatctgggtgaatttatgatctgagaaatttcttataagtctgtatatttgtatttctttaaaaatagacatactaagatttaataattgttagcacgacatatacctaggggggatactctagagcggncct

SEQ ID NO: 186998 - DNA, 371 bp, Homo sapiens
gttatctgatgctaaaaatgggattgcaaatattatagaatgtttagtgtcccatctgggaaagaaagagagtgaatacacatgcttggcattataatcaagttaccatatcctgtctcttgaaacacacaaaaagttatgcaaaataattatctgggtgaatttatgatctgagaaatttcttataagtctgtatatttgtatttctttaaaaatagacatactaagatttaataattgttagcactataaaatatctatagacaaatactgtcaaatattatttctgaaatggccaaattaaccagtacccataggacatcaggaaatttcttcataattctagaaatagttgttgaattattgcttga

SEQ ID NO: 186999 - DNA, 513 bp, Homo sapiens
actcagaacaggaaagcacagaacttctcgattccatagctcccactgtgctcctgacagtaatatgtatatgtatatgaccttcttccccagtggaactacccagagacagcatctgtgttcagtggcctgcccatctgtccagtcatcttgacagtcacgtgtcctccttttgtccacgtaaggttgtactgtccaccaggcagaacataggcataacagtgaactcatttgatttttatcttgcagctaactaatctgaggatgtatgcttaatatctagaacctagatttgattctagatcagttttacccctggattgaaaaatcagttatgttcattgacaccaattactgcctattattactgaagtttgttcttttattgaatttctactaggtcttctatgacatattaaattagagtggaattttaatcactttaactgatagttttctagtcttgccttcacgattttttgattcaatacagtatgtattaaatgcttttgt

SEQ ID NO: 187000 - DNA, 294 bp, Homo sapiens
gttaccctccaccaccactaccactttaaaaagaaattgaggctcacacaatttagtaacttgaccaaggtcacatgctggtgagaggtgaggcaaaggctgggactcaaatccagtgcaaaagcccatcctctaatacagaagcctgtgccctaacacagaaatgcgtgtgcatggcgagacgtatgtctgcacagaaagacctctctgctgacaactgcagtggctgcatctacataacggggtttgggtcacaactttctcatattttgtaaggttctttttttttttttt

SEQ ID NO: 187001 - DNA, 248 bp, Homo sapiens
  misc_feature (35)..(35): n is a, c, g, or t
tgaaaggagataatccagcaaaggaagcgagtctngactcccagccccatcctcttattccccctccccccaggcacagctgctgtttggctcactctatatatagcggcattttcagggtaattacaataaaactgttgaaaggagataatccagcaaaggaagcgagtcttgactcccagccccctcctgtccctggcttggtgcagccctgcaccccctttccccgaggcctcctgttcccaccc

SEQ ID NO: 187002 - DNA, 419 bp, Homo sapiens
tatgccatccccatctaccccgcgaaattcttaacaccacaactcgctccctccctgccgttatatctacaagcctgtagcagcgcagccacatcaatgcaggcctgaacctgaccctgggtggactccctgctctctgccagcccctttctcacccctgggtccccacggcccctggctctctcccctctgctagaatctcgctgagggattggtggggagggggtggtcacgcactgggtggagatctggtgccccctggaggccggacaggaagggccagggcggacaaggtctttgagaactcggtggcatcccgctcctgatggcctgggtcccaccgcccctcccccagccttcctgacagcagaggagattatgtgctgcgctgctacgggtaccagtcagcgtcttcagta

SEQ ID NO: 187003 - DNA, 374 bp, Homo sapiens
  misc_feature (18)..(18): n is a, c, g, or t
  misc_feature (31)..(31): n is a, c, g, or t
  misc_feature (43)..(43): n is a, c, g, or t
tacatgataccatcgttntcggtacccgttngcagcgcaccanctacatcaatgcaggcctgaacctgaccctgggtggactccctgctctctgccagcccctttctcacccctgggtccccacggcccctggctctctcccctctgctagaatctcgctgagggattggtggggagggggtggtcacgcactgggtggagatctggtgccccctggaggccggacaggaagggccagggcggacaaggtctttgagaactcggtggcatcccgctcctgatggcctgggtcccaccgcccctcccccagccttcctgacagcagaggagattatgtgctgcgctgctacgggtaccagtcagcgtcttcagta

SEQ ID NO: 187004 - DNA, 345 bp, Homo sapiens
tcgcaccctggccacaacatcaatgcaggcctgaacctgaccctgggtggactccctgctctctgccagcccctttctcacccctgggtccccacggcccctggctctctcccctctgctagaatctcgctgagggattggtggggagggggtggtcacgcactgggtggagatctggtgccccctggaggccggacaggaagggccagggcggacaaggtctttgagaactcggtggcatcccgctcctgatggcctgggtcccaccgcccctcccccagccttcctgacagcagaggagattatgtgctgcgctgctacgggtaccagtcagcgtcttcagta

SEQ ID NO: 187005 - DNA, 406 bp, Homo sapiens
ttttaatggggattctgaccgtagcctggtgaggacacatttaacgtataaggaaatgagagatggaggttccgcatcagggtggtggcagcttgagtcctgctgagttgccttggactctgttttttccaaggtggctggggagaggatggctgagctgggattcagccagtgatggatgccctcagccaactgcaggggcgaggagagacttaagccccctccctgtgatgggatcatgcagaccctttggtgcgcttctggagaggtggctccccgacttacagcttttcttggaaggccaaggctgccctcttctggtcgtctgtagtgggtggccatgcttaacagcgttgtgccttagtggacactgaccaagggcctggcgtaagctagggctggatgt

SEQ ID NO: 187006 - DNA, 191 bp, Homo sapiens
ctacagcattcttcacttgaccttcttttcatcccaacattcttcctaaaatctctaccaagctggtacacacctcaaggttctctccttgatctttctcacccatccaatcaccctaagcaatctcatccacatccttgcttctactgtgtggtctgcagcagcctgggagcttctgggaaatccagaat

SEQ ID NO: 187007 - DNA, 197 bp, Homo sapiens
ctaatccaccacacattttggattctgctctgtttgcctgaggtgttagatctctagccaggactgtgaagggaaggaacttgaatccttcctattgagctattaatgcagagtcagtgagatgaagggttccactcggggtcaaaatcatgtcagttaccaagcaaaggagcaagtaaggggaaacatctcctcat

SEQ ID NO: 187008 - DNA, 175 bp, Homo sapiens
taagagggatcaatcactgatttgaaggtgttctagatgtgaatctacaatagagttcattgggacaatgtcccaatgtcccgagagcctgaaggataccttggtctttctacttcaactgtagaaatcataaaggcatactacaggttaggtcagacaggagacaactgaaaga

SEQ ID NO: 187009 - DNA, 570 bp, Homo sapiens
tggtttgtggatcatttatctaataggtattcaatatctaaagacaatccattcataaaactggtggaatctgtaggtaattaagtgggtgttgtagttgtgattttattttatgtcagaaacaagttaggtataatttataaataggtaaattttctgtttttttagtaggtgctgcccccttaagtagaactaaggaaattgtattaggaagagtactgaataaatataacactacagtttctcatttactagtcaccagggagactgatatgaccattgcctttaaatgatcatagggaatttgacttacattcaccctatcacttcttgggagaatatgagtggggttgaaagagaatccctcaggtgcacagaattttagttaatcatactgcctggtttatgatattctatcatcattggtgtctcagtcattctatttatgttactaaatgcaaaggaaattcagcttacttagaactggaattaatacagtgtgaggatttttgtttactttgttttgtttttgtcttgagctgcagtcagggtgtatagttcctaaaggat

SEQ ID NO: 187010 - DNA, 390 bp, Homo sapiens
gcttgaagttttccagaacccgtgcgcagtgcagaggtacaaggaggacagtgttgagagccggtttgtgctgacagcaatgctgactgaagctctgtgcttcacttggtcctcctggcccttccagggtcgggacagttaccccctccttttcacagcttcccaactggtcactgcagaccaggattcaaacccaggcagtcttctcagccaccctccatctgatttttttttccggccatctccaagtggattctggcctgacaccaaagacagctcagccgggtgccgtgggggattcccatggggttgttttatcacatgtgacttccaggccaaagtaagcttctggagataggaaggtggtttctcagcgttaggtctacctgg

SEQ ID NO: 187011 - DNA, 358 bp, Homo sapiens
agccgagatcgcgccactgcactccagcctgggcgactgagcgagaccctgtctcaaacaaaacaaaacaaaaacaacagcaacaaactaaactgagtcctcttaaaaattaaagagttttgcttctcagaataggagtttgaaaaaaatgaatgagaaatgtttcctgaatgagaaacacccagtcatggcttgcagtttgataacggaaagagcaaaactctgcaaaataacttgaactatgttctacgccgaatatgagagaacgtgaccaagggaaacaaccgcatgtagcctcgagtaagtggtccccaggaggttcgatggcagtttggttttattcatttcagcgagacag

SEQ ID NO: 187012 - DNA, 235 bp, Homo sapiens
atgaggcttggaccaagggccttggtcaacacgaagaaaaaggcagacctgggtctctttcagtgccctggcttacagctgcttttcacagatgcttttgccagggagaactttcatctagccacaaaccccctgaagccacacactttctaagatcttggcttttccctttgagaatttgctgagatgatcgactctcttctccagaaacacaagtctgccaccagcccctctt

SEQ ID NO: 187013 - DNA, 550 bp, Homo sapiens
cgatagtatagtctgtagagttctatttctcgatagtacactgagcacatgtgtatatatgtgggtacacactgagggctcgtactttatatacactctatataagtgctctctgtgggggcacaccactttttgttgttgtctcgctgcgtgtctctttcccccccctctcacacaacacatacttttggtatatatctctctgtgtgtgtgtgtgtgtgtgtgtgtgtgtgtgtgtgtgtgtgtgtgtgtgtatatatgtaatccctcccagctctaaaatttgcaactccaaggttgcatgttggaaattggacaactgagtcattaaaaataggtattttcccttcacatcccaccctattgatttctgtcctggtgcctgttcaagcttcatgctagggtctaccggttcaaagaggagcatgacacatgaagtcagtcttgtcactgctaattggtgtcttacatagataaattatctagttatcaggtgtctcttcatttcgtgacaacatagcatcaagaaagttcgttaagaatgcggaga

SEQ ID NO: 187014 - DNA, 189 bp, Homo sapiens
gaaatgtcttatcatagattctacaaaaaaaagtatttccatcttggtgagtcaaaaataaggtttaactctgtgagatgaatccacacatcagaaagcatattcaaagatagctcgtttctagttttttattgcaagatattccattttttactataggcctcaatgggctcagatacatcccatcgt

SEQ ID NO: 187015 - DNA, 368 bp, Homo sapiens
cacaggtgttattcccaagtggtgacgggcaaactgggtaaaactataatagtacgaatacctggcagcaagacacgcacatccagattgtacggagagtagggggcagggacagagggagtcctgagcacacctgggccgatcaggtaccttttcaggaacctggaactacaactgataaaataattttctctctccttgtgagccttgactccaggcccacgtatgagaatgggcatcttccaagaggcctggagacactaagcatgcaggtctgcagatgaagggaagacggcaggcaccgaagagctagcccgggaggaaaacagacagggtgtctgaccacacaggcctggctcacgtaacct

SEQ ID NO: 187016 - DNA, 308 bp, Homo sapiens
agttcccaacaaatggactgtgacattggcgcagaagtggaaaagtgaactgcctaaaaaaggaccagctgaatgaggaacagggaggaggcaatatagaggtaaaaaaaaaaaaaaaaaaaccaaaaccaacaaatttttttgcagtggcagttttgcccccaatgaggtttttctgaggggggtctaactgcaaccatgatggcattgagactgatcccatttagactagcctacttcataaatagcccccaccaaaaaaagaaaactcgcaaccccgaatataacccattctaggtctaaatgca

SEQ ID NO: 187017 - DNA, 115 bp, Homo sapiens
atgtgaaaatccagatcagtcaaccaaaggaaggtattttttttttcttaaaatgaaggcttcctggtttgtttagaaatgtaggttagccttcaagaactcggtttccatgcag

SEQ ID NO: 187018 - DNA, 1631 bp, Homo sapiens
ggtggcagatgctgggttcctatgtaccttgtctcacctaatcctcacgcaagtctggaaggaaagtctaccattattccttttaatgaggacactgaggcctggcgatgttaaagacaacccctcaccacctccacgtcacccagcctcctgaaggtacagcagaggtataaacgcaggcagtctgaccccagagcccatgctcctgacctactgcagtgtattcttgccagtcagaatctcttgggtggggtataggcacagggattctagtctagtcaatgctccagagtgacagttgagactttttcttctattttcttcagagacagggtctcactctgtcactcaggctggagtgcagtggtgcaatcatagctcaccgcagcctcaaactcctgggctcaagtgatcctcccacctcacctgcctgattaggaggactacaggcacatgccaccacatccaagtaatttattttttgtagagacagggtctcactgtgttgcccaggctgatctcaaactcctgggctcaagtgatcctcctgcctcggcctcccaaaggactgggattagaggcacaagccaccacaaccggcatgaaccttcttgccacactgatcaccaggccagggactgctgtggcagcctgagcatccaggtgggtcactaaccacaatgacgaaggccctccggaacctgatgctcaaacctccattgccagtttcatctttggctcacagccctgcacccaacaactggtcactgttcctgcacattcctgtctctgggcctttttgcataggtcatcaacacctcagaggatccatttcctgagggctaatgctataccaaggtccttatgtgcagttaaccctagctatcttcattggagagatggggaaactgaagctcagagggctgttgaaagttatcaaccaatgcagagccagactgggatctaggccattccagaaccttaggccccactgctggctgcgtcccttcatctgaaatcctcctcaaggcccggctcaaaggtcacttcctcccttcctttgtgttcctgcatgactctgttgtgtagcacagaattcctcatctgccttcctggctgaaatttactaactgggcactgtgctaggtaggaaaaaaagctccagggagaaaggcagacccctatgtagagaacaacacacctgcccctacttagctctgccaagtgctacttaggtctcatgagggctctgccaggctcggggtaggaggtgggggaggcggcagcctctggaggactgatgcaggagctaagacttaaaggatgaggtgacaccagccaggtgagaagaaagggtggtgtggcccaggcagaggggatggcacaggcaaggccgtaggagagtacacccacactgctgcaggctgttggagatgatcccctgtggaaaggcaccagggaagggtcagaatcttgtagggagaccacagagggccaagtgagaggcaaagatgtctgaatccttgaagatgcagagatgggggtgggagggggtggaattcacggaacattcacagaacatttggtaggaagatccttagcacttgatgtctgagaaggaatgaggcatg

SEQ ID NO: 187019 - DNA, 233 bp, Homo sapiens
ggcatggtggcaggtgcctgtgatcccagctgcttggaagtctgaagcatgagaattgcttgaacctgggaagcggaggttgcagtgagctgagatcacgccactgcactccagctggggcaacagagcgagactccatctcaagaaagaaaagtggggtgtttagtcttcaaactccgtgtttaagtgactggagtgaaaatgtaaatcataggccggtgttggtttaaaaa

SEQ ID NO: 187020 - DNA, 374 bp, Homo sapiens
tatgttcctttcctccattcaccccatgagataccacgtttcacagggatgtcttccagactttgatacatatgtgcataatttttcacaagtcaatcaaatgataccatattccccaaactatacatattcaaaatgcccaaccatttactgtattgtggtcatctcttcatgccaataaaggaaggccaccttaaatctttttaacaactgcacagtatgccattccaagtctgccttaatttaaccaatctattgatggacatttagattcatccaggggtgtccaatcttttggcttccctgggccacattggagaattctgtcttgggccacacataaaatacactaactagtaatagctgatgagctt

SEQ ID NO: 187021 - DNA, 310 bp, Homo sapiens
ccagaggctgctcttgtgtgtgctccacattacagcccttgacttagagggcttgaaattttccccaaaagtagtcaaggaaaaatactaaaagtaaagctttttgacgcccggggccccgaggcagacccgggggtgtgggtgcaaatggctcccggagtccccccaggctgtgtccaatcagccatcaacaccccttactaccccctccagctaggaacagggctcagggaaccccttttctctccatttgtgtttgaaaattttcatggtaaagttttagaaatagtggcctggctgggcgcggtgg

SEQ ID NO: 187022 - DNA, 449 bp, Homo sapiens
gaatgctgattgaaacttagactatgatggggtagatgggtgtactgagatgcaaactatgcttcccgagtgaacagccacagcctgtcctccttaggaaagaatgaccttattaagagcagccaccaatgatgacaacaggtataggtggagttttagcttcagtttgagggggtggggtggagaacttattctccaggcatctctggctttgcagctaggattcctaactcagattcctaactccttattcaccattatgggaagtcgcacttttgttgcagcttgcttcgttcattgttttctttcatgctttaaaattttttcccgcttgaaataagccttcttttggtttcctaatagtcgtttgcattttctcttcctctgaaatatagcagaacagagaagtcaggcaaaatggccagcagactgattagagacaactggca

SEQ ID NO: 187023 - DNA, 184 bp, Homo sapiens
tgcattcttggcacacccagcaagacatgtaagcacacaacagatccatggaggactctcaacacaaagatcgcaataaaaattgtttcaggcaaaaattattgatgggctgggtacagtggctcaagcctgtaaccccagcaatttgggaggctgaggcaggaggactgcttgagcccaggag

SEQ ID NO: 187024 - DNA, 114 bp, Homo sapiens
agatgagacattttgaagcacattgaggcctggagtttaaaaccaaatatcctgcgataaaaactagaaacaagctatctgtgaaaatgctttgtgatctgtgaaataatgtca

SEQ ID NO: 187025 - DNA, 257 bp, Homo sapiens
aatcttactacatttctttagcatacttattcatcctttcttagaaaattattttacaccacctctctcttctgaagcctccaacaactcctccccattcttactctcagatgatcattttttttacgccgatcaaaattgaactcagaaaagagcctccgttcacacacttccatccccatgagtacccagtacctggacctatgcccttgtatgctctgcctccttgactcttctctttatcccacaatctactt

SEQ ID NO: 187026 - DNA, 166 bp, Homo sapiens
gcaccgggtgccagacctacgcagccacagagccttcctgaagccctccatgagagtcacggctctcagaaacgtcctcagtacaccgaactcagggtctaacctcaggcagtgctacccaagctcacttcgcggcacccactcagcaggcaccgcagcaccgttc

SEQ ID NO: 187027 - DNA, 476 bp, Homo sapiens
gcattgaggagggaacatctaggttgcaaacttgttgtagagattttactcctatatttgataatctgatttcattttgtctcaccggaaatcccaggtggcagccgccttctccctactctgcctgtccctgcatttcatttcagcgtgccagttagtaagctaacagagactgagctcttttaatgaaatgtaggttttctactgtagctacctagacatacaaaattactctcacctcttctgatttctttgtgctaaatgatctctctctttctaccctgtcctgcttcaaggtttatttcatttccttaatttgatatttttccattattggtctggaagactgtgtattacatgtataaacaagatattcttatttttgaagaaaaagaccctttgggatctgaacagaaaagcaacacattcctgttccctccagtaatgtttctttcccccttcacttcccttcacta

SEQ ID NO: 187028 - DNA, 408 bp, Homo sapiens
ggagattgactgccaaagaggaagtaggagaggtgtgagaggttggagtccagtgaagagaaggggtcaaggaatgtaggcagccttcagaagctagaatatgtgagggaccagattctccactaaagctgccagaaggaacccacacaacaactttatagctctgaaactgattctcactgctggcctctagaactataagagaataaattcctgttgtttcaaaccaccaaattggtggtagtttgttacagtggtaataggaaactaatacatgtgctagcatcccctgtatagcttcattctgcaggaacttggcaagtccctgttatgtgcaaggcacaagacctactgttcccccttaaacctaggagaggggggaagtggaataaaggggctttttttgca

SEQ ID NO: 187029 - DNA, 451 bp, Homo sapiens
acttgaacaaacctggcttgagattgggtcaaaacacacatttcaatgtccaccagtgggacaaacgcccccttctccagtgaggaccctatcactttccacagcttttcttcccactcttggacaacagacagcccacactgactttaagttctgagcgcttggttagtatttccggtcttcaggatgggtccctttcagagacctgcgcaggcagcctgcagtctgagcttgctggctctcctactctccaccttgtgtgtcccctaccaccctctcccccgacctggcacctgctcattgttcctctcggctcattgttcctctcagggccagagccaggaatgaggaagaggaggggagagaatgggcttcgactgatctcctctcttccccagcctgacccttctctcctggaggtccctgttggcttcactccaggcagggtctc

SEQ ID NO: 187030 - DNA, 633 bp, Homo sapiens
gcacccaatggggctggactccagccatctgctacccagactcactgaagagttccgcatctgatgaaacctctggggagaatgaatgagaactgatgagggaacactagcactgcatctgagtaaggggaacttgggagaaaacaattttcctgcctgtccagagggatgggaactcagaattggaattaagctgagttaaagaaagtaaatatgacatttccagtgcatctgctttgtagtagttatactttttatgttgaatcactcagaaaaaaatgtaaagataaaaacagactaattttagtaatgccttacataaccttatattttatgacttacaaagtgtttacatacatttgaaaacagtggtacatatagcactttatttacttgttttgtctataggcatggggattttctgctggaaggtagtaactccacagccccactgggatcagaggctcacagctctgacagcttgaagagattgctgtaattataagaatggaaatagtactgattatcaagagctcgttagtgcatagtacggagatgatatcatcttttgaaaagtcttaagaggctgcaatctggctttcatttgcaaatttctgttcccacccttagttt

SEQ ID NO: 187031 - DNA, 265 bp, Homo sapiens
ttgtgatccacccgcctcggcctcccagagtgctgagattacaggcgtgagccaccgcgcccggcctaattttttcattttttatagagacagggtcgcaccatgttgcccagcctggtcttgaactcctgggctcgagggatcctctcaccttgacctgagattacaggtgtgagccattgggcccagcctgcattttcttgaagttgaagatttcctctgtgatcacatcaacccaagattctctttctctaagccctattag

SEQ ID NO: 187032 - DNA, 220 bp, Homo sapiens
cctgacatagccaggcccagcctctggaacagtcctgcccaaacttgggcttagcaactgttatcaagaactggatgaactgaggcctccttcccaccacagggcaaatctgcccatcgccaggtttgaagttcttaatgaagaccaggctgagaagaagctcacagttttaggtttctctctctctccctctttctctctctctctctctctctctctc

SEQ ID NO: 187033 - DNA, 198 bp, Homo sapiens
gtaatattggtaatatttggtaatatttgagcaacttgcttttaactgtaggcttttgaaaaaaaccatttttttgtggattcttaaatattgtagtaaatggaaatgccctttttatgggagcctgtgctggggcttcacagtcacacagagttgcctttgagaacaagaatcagttataaactatgtaaagttggg

SEQ ID NO: 187034 - DNA, 549 bp, Homo sapiens
cctccttctgccaacatatgactcagacaagggggatggagcccagcagccatcatggactgtgaggtgacctagatcctgaaagccatgtgtaagcaggtagaatatgacagcctgggcgctctaagagccctaaactactacctctaactaatttctatgtgagagagaaataaaactttacatcacttaagcctccgttaactgactataaatctgatttgttgctgttgttatacacagctaaagttaatcctaagtaacataagcccaaagcaaaaataaaataccaacatgaccctgcccccacttcttaatcccaaccaactccataaaagacaaaacatctgtccagataaaaatccaacattcctacaaattaatctgttttacatttgaatgtccagaatttcttatactatctctatcactggctccagagaacatacaatcaagatactaagcctttttctaattaagataaaaatttccccctgtcttaccggaggcactcatcaggggcctttgtgagtccagtggtgggagggt

SEQ ID NO: 187035 - DNA, 516 bp, Homo sapiens
tctagtttagaactcaaacatttacctactgatgtgatttttatttttgtaggcatttgtcttggttataagagggcagggaccacatcttactctccagaagccctgacattgtccagctgaatgggtccccagcagtggtgcatgtactgatgcaggagagtgcagtgagggataggaggaagccaggaggcgaagatgggaggatgtaaggaggaaggtgctgtgtactcagcaaaggcaccctgggggaggccaggcttacctctctttgcaggaatagtttatgtttgaaacacctggctgggtgcggtggctcacacctgtaatcccagcactttgggagcccgaggtgggcgaatcacctgaggtcaggagtttgagaccagcctggccaacatggtgaaaccccatctctactaaaaatacaaaaattggccgggcgcggtggctcacgcctgtaatcccagcactttgggaggccgaggcgggtggatcatgaggtcagtatagata

SEQ ID NO: 187036 - DNA, 359 bp, Homo sapiens
aaggaactcttgaagaaaaaaatgcatgttaacataagatcttcatactcagttgatcattgatactgttttcattcttgctaatctttctaaaaaccaccaaatatatttctatattcatgtgtattatacatagctatatatagtttaggtatcttcaattcagctgaaaaatgttaagcctaaacatttccaaatttagagcatttagtcacatcaactctgcttttccctggggctaagtttttggaaaggtagggagtcagctgtcatttctgctgtttttaaaaaggtgaagtgtgcttcctaacaaataaaaaggatgctgacagaaggttactttctgcgttggacttact

SEQ ID NO: 187037 - DNA, 254 bp, Homo sapiens
ctgctgcttccaacacccacctctcagtagacccgaatcctaggcctgggtgaacactgccatctagttcagcctcacatttttggtgggaggctggaataggttagagggcaaagttccttttctgacaattcagtggaaatgtttaaattaagcagaagtatttatatttctacactctttgatcttaaaattttcttggatgtgggagaggtaaatgttacagcatgatagatagctgttgtgcctgttat

SEQ ID NO: 187038 - DNA, 650 bp, Homo sapiens
  misc_feature (3)..(4): n is a, c, g, or t
  misc_feature (616)..(616): n is a, c, g, or t
  misc_feature (650)..(650): n is a, c, g, or t
ggnnagcaatcagcgagactccgtgggcgtaggaccctccgagccaggaaagggaactctctgaccccttgcgcttcccgagtgaggcaatgcctcaccctgcttcggctcgcacacggtgcgcgcacccactgacctgcgcccactgtctggcactccctagtgagatgaacccagtacctcagatggaaatgcagaaatcacctgtcttctgcgtggctcacgctgggagctgtagacctgagctgttcctattcggccatcttggctcctccccaccctagtctgaaacagaggtcaacccacaccttgatttcaacttggcaaaaccttaagcagaggactcagcgaacatgtgcttggacttctgaactacagaactgtgagataataaattggtgtaattataagttgctaaatttgtagtcatatattatctgaaatagaaaacaagtgcaatcatttagcacattaataagtatttacttttattcaggaattatgtaactttatttagtatttgcttagtaataattattgtgagtttttgagcatgggaactatgtcttattatcttttttatgctcaatccctatcagaagttgtgtattaaatnaatatttgtcaaacaaataaacaaatggtgcctn

SEQ ID NO: 187039 - DNA, 236 bp, Homo sapiens
tgttctggtttggtttttgggtcctcatgttatttattgccgaaaccaggcaggcaaccccaagggcaccaaccagggcctccccaaagcctgggcctttgtggctgccactgaccaaagggaccttgctcgtgccgctggctgcccgcatgtggctgccactgaccactcagttgttatctgtgtccgtttttctacttgcagacctaaggtggagtaacaaggagtattaccac

SEQ ID NO: 187040 - DNA, 1289 bp, Homo sapiens
catggtggcgggcgcttgtagtcccaggaactcaagaggctgaggcaggagaatggcgagaacccaggaggcagagcttgcagtgagcggagatcgcaccattgcactccagcctgggcaacagcgtgagactccgtctcaaaaaaataaaataaaaagccaataactagatggacatatggcaagaaggaaaggtcttaaaaacaatgttgactgaaaaaatcaagtaacagaaagagctcaagaccatattaccattatgtaaattacaaacacattacacacaaaataatatatattttacaaagataaatacatatatgcaggaaaatatatccaagataaaagtagacatttatatgaaaacaggaaatgggagtaggaattaaggatgaaagaaaaaaaataagagggtaagaagaactttgaagagattaaaaattatactgtattaggacctgagttgtattgtaaacagaagtctctgctcctaagttatacatatgtacacatgataaagaacctaagaatgaggttcaatctttcagtctaaagaatcattggtatataattttaaaaattaaaaccaatctaaattattgttagagtttattacattatgggaagtgatgggagtagggtggcatagatagatgcatattaaaatttcttattaaaaaagaagacatgtatttggttgattctaggtgtgatagacaaaagtgagttttaaaatgtgaattaaaagttttagggtaatagccaggtgcagtggtcccagctacttgggaggctgaggcaggaggatcacttgagccccagagttcaaccatacagtttgagcacgatcgtgtaaccgcacttcagcctggggtgatagggtgagactctgtctctaaaaagaaaaaaaaaaaagttttagggtaaccattagagatacagacatgagatttcttgctttaaacaattagtgaaaagattggaattgaaagaaaacttagtgctcacaagaagaaaaaaaagaaaaagcataggtaaatagaaaacacactaatggtagaaataaggtgaaatgtatcaataatcaccttgtgagttaaattcttctatgaaaaaagactcattaagaatcatataagcaaaaatatgcagtactatattgtttttaagatatcctaaaataaatattcatatcaaacaaaatagaggcccaagtcaaaaccaaattatttatctacctgggatattttacaacgattaaaatacacacctacctaagataaaagtca

SEQ ID NO: 187041 - DNA, 730 bp, Homo sapiens
agaatctgtcattgtgatcaaagtttatgaaatgaatgaggcagaaccaacttgagactattggtgactcaggtagtgattccagaagcctgtacatgagctccagcatccaggttcctctgcagctgcccccatggccttggatgctgttttaaataagatgaaaaaaccaggtttgggacagcagacctattgtcacctagcagtgcctagaagaaatgatcctcaggctcaaaacttacacgaggtctctacacccccacatagaatttagctggtttcccttcctcacctcccaccacaactaaaaccccagtgagctagtgtaagcctcgcctgaatttgtgaacttttgccctagtcacagatagaagagaaggccagtgagaaaagaatggaggcctaccctcttcaggcaagccttgcccaggtggacgtgatacccgggggttggaagtgagccagcccactgtgcttaggcacatagcagtccacggaagaaaacagctagcctggttcttgcttttaagatgtagtacctccccctccccccaccttgccactagtagtaaaacaatgactatcaggctctggccaatctgattaatcgtttctatgagccagaacaatgctactcaaagtatggtccacagaccacttgcccatctgaaaactgcttgttcctgatccaccgtgagataggtacagtacatgagaatattttgaaaac

SEQ ID NO: 187042 - DNA, 534 bp, Homo sapiens
gtgaagattgaatgagttaacatcgtagacaagtacaacaggaatgttattagctactgttagctggacttaaattacaatgtaaagtttgagcctaactccaatttcatgacaaagtagaagagtagtgttatgttaataagtacttctaaaccagtgtcttgatattgagctacaataaatattaagtccaataaaggtgtttttgttaatccaaaatgcaatttcccctcagtcctgattcaagcaggcctgcaataacttagttatccaactgattaacattctaaaactatactgagggaaaaaacattctaccagaaatttacattttgtactggaaaatgaagatccagtaaaatgtcacatttctgtaggaatgtaacaatcagggcttttgttgtttaaatggaaggatgcaggctccattctgtgtaacaccaaagaaatatgacatgtttgagaaattttgtatttttttgcatggtggccttactttcttgttgttactcatttttggggtggggggaggtc

SEQ ID NO: 187043 - DNA, 219 bp, Homo sapiens
aataaggggttcttatccttggaggcagagctgggaaagaatgtcctgtaattaagagtcctgatatatatttggtatttcaaaatgtgcaccaaaagttagataagacagaacatccacataaagaagtgaatgtaaacaagcacttgtgtaaccaactgtaaataaccatgagtagaacatcaccagcagcaatttccataaatgccatattggttg

SEQ ID NO: 187044 - DNA, 410 bp, Homo sapiens
gtcaaggctgcattgagcagtgtttgtcccactgcactccagcctgggtgacaaagtgagaccctgtctcaaaaaaaaagttcaaacttttacaggcagctgaaactcattttaccatttatttaaaaattgagataaaaatcgtatgctctaaaattcaaatttaaattatacaatttaggaagttttaatatattcacaagattgtgcaagcatcaccactatctaatcccagaatattttcatattctgaaattattttcatatttcatattcatcagcagtcacttcccattttatccttcccacagctcctggcaaccacgaatctattctctgactctatgtatttacctattgtggacacttcatacaaacacaatcatacaatatgtggtcttttatgtctg

SEQ ID NO: 187045 - DNA, 524 bp, Homo sapiens
atccatgcgtctttcttctgattaccagcatctctgtggtgacatactcttttttcttcggtttatttccagatctaacagaatgatgacattgtgccaattctcagtgtcttgggaggtggggataggttggaacatgcctgctattccttgtcagagcagacctggggaggatgtccatcaagaaaggacctccagttcctcaataagtcaaagaattaccatgtgacccacaattccactcctaggtacatacccaagagaactgaaagcagtacccaaataaaagcttatacatgaatgttcatgcagcactattcacagtagccaagaggtggaaacaacacaaatgtccatccattaatggatgaatggataaataaaatgtggtagatccatacaatggaccattactcagccataaaaagaactaaaagtgctgattcacgctacagcatggatgaaccttgtaaacattatgtctaatgaaaatagccaagcacaaaaggtcatatataaatcca

SEQ ID NO: 187046 - DNA, 698 bp, Homo sapiens
gcgtcagaacaatccctctgagctccagttctctgggggactagaagaattagcaaacagtgcaatttcacctttaagaacagggcgagcctgtgaattagacaacaccaagatcacatcgtgcctttcctcagagcggaacaggctgatgaaattgcaaatcaagctccatctggccttggccgacccagccctctgctgccagggcccaagttcgtgactcatccctctgccagggactttgggtgcagggcttcatcaagccccagggccgcgtgccggatggtcaaggagggtgtgcaggtgaagtgggcacgtcttggcacagggcaccggggtttgagtgtatctgctctgtcgcgatgaacaactggtgactgctccccttctgggggcagaacagcaaccatgacttaggtttcactactcgggtagctgatttcagcgcttcgggtcacttcctggtgttgtggagggtaactgtgttttccctttgggggctgtgagaactgtggcctcctcctgtgtgtctcctctggcttcctaagtagggagagtcaggagggagacgggggtgccttctgccaacctctctattcactcctcatccttccctctcgcagggtcacctgctggagacagctcctcacccttctttcgtattctctctctctctctctctctcaactattaattat

SEQ ID NO: 187047 - DNA, 377 bp, Homo sapiens
ataattatgaacaaatttctgactactgatattctccttaagttaggatttactctgttaacttcatgtcattattttagcctctttgtcttcatttacttttgtccttaaggctgtagaaacacgtagtaataattagtcagattatggaactgatgagctgtggttatagcctccatcaccagaaagccttccattaatttgtaacacagtgctatttacataggaaaaggtctattttaacagagctgtattctcttgaaagaacccttttgccctaggtatccataaaagtggcacagtagtgttctttgttttactttggatgcaaatggagaaataaatgtgaatcaaaagtaatctatgagaagtatagc

SEQ ID NO: 187048 - DNA, 178 bp, Homo sapiens
caagcagtttatttccaaatttccaaagtaaaaatcttttaagtaattactgcatgcctgaaacacatacaccaacaaggttagagttttacatcataatttcaatgcacattatcgactttttgtgaaactatcaggactgccaacttttaattttttttttttttttttttttttt

SEQ ID NO: 187049 - DNA, 645 bp, Homo sapiens
cttgttacgggcgggcacacaggcagcgtggctcagagaagcaggagcaggaaagaggcaatttattctaaaggcttaaggataaccagcgccagtcctaagaggccactgaagacaaaagacacaccgtaggttaccaatgagctttcagtacagctttgctgcctcctcagtctgcctaaagaaatcaaggtcagaacctgcctgtacctgcctgggaagcctccaaaggaaatttcagcgctcagattctctcctggacagcactctgcctcctgagtcaggctgagcccaacccaagagtgcgggactctgaagggtcctctgcaattcttcctccagcccagatgacccactagagcccaggtaccctggaaccaggtcacacagccctcctgtgctcttgacaacagcttcttcacaaccaaagagatacaaagggtgtgctcttcacttagacccctcactaaaccatctacaaacacacactcacctttcagccgcactatctagcacagcagcgtggcattcctaagagcacccagcctgaagtgaaacacttggcatgtactatttagttctcacaaccccatgtaaccaatttttcaattttttttatttttcaaataagtacactgagaatca

SEQ ID NO: 187050 - DNA, 271 bp, Homo sapiens
gtatatgagagaatatttgagttgtgaaaggcagaaagagaacaagaacaaatgagtaggagagggggctgggggttaagggacagggaaagggaaggagagaggagagagatgccagagtgctctcctctagcctcttgccctctctttccctgtgactgggaaataatgacacctagagcagctgtcttaaactcccaagctaacccaagtgttgaggttggttttgatggccatacacttagccctggactattattggaaacaagct

SEQ ID NO: 187051 - DNA, 204 bp, Homo sapiens
cccttgggaaacccatgtggaggaggccccattgctgcacccgaggggcttgcagtctggtgttgaagacaccagttgatgacagctgttgatgacagctggagcaatgaccatgataagagcttcatgcagcatcctttccgcttccccttctcagtatctctgcctagggacagaaagtccctggaaacctaggggcaagcg

SEQ ID NO: 187052 - DNA, 462 bp, Homo sapiens
  misc_feature (39)..(39): n is a, c, g, or t
tgaaaatgtgggtgttacagtcatggacggtccgttctnttctatgatgccgtttcccacacgtggtacggtgtcgctatagcgacaccgtacacagacacacaaagacacacagtaacaaaccacagacacaaacacacagcaacacacagacacacacaatcacatacacagacactcaaatccatggaaatacacacactgctgagtagctaaggaacagagcttaattccaaggacctgggagtgccagcccctggaatccagcagaccccagcactccaggccagcccaccttggtgacgaagtctttctgggaacacagcttgtcaatgtagctcaggaggcccgggtctgggggcgtccagtcctcttcctgtggctgcttcactttgccctcttcccgttgtttctcgggctcccccgtggtacggtgtcgctatggggatcgtctagagtccc

SEQ ID NO: 187053 - DNA, 347 bp, Homo sapiens
ataaaaaaaaccccacatttaatgttaactctgttttaaatgcttcagctgcagttaaggtctgttacactcttttaatgcatttcttgtatctatataagtgttcaaaatgaaaattatttgatgtttgagttatgcttctgcccggtttgtgttctcaaccccatccacagacctataagatttgtttcagcaacctcattcttacaaacaaaactaacttacatacgtgcactcggtgcaaagtagatgccattgaaggtcaagaatatgtgttagatttctgtttgaggacatttcaacattttaaacagactaggaatacttggatttactcctacatctag

SEQ ID NO: 187054 - DNA, 269 bp, Homo sapiens
tctagtgattctgctgcctcagcctcccaattagctgggattacgggcacatgccaccacgcctggctaacttttgtatttttggtagagatggggtttcaccatgttggccaggctggtctcgaactcctgacctctgcctgccttggccttccaaagtgctgggattacaggtgtgagccactgtgcctggcaataatttttaaggatgggaaaaggactctaaattccactatcctcatgtaattttatttcattctcacttttca

SEQ ID NO: 187055 - DNA, 416 bp, Homo sapiens
ctgtggagtccctaactgctgccatgggtgagaaagcatatgtcagtgagcatgctctctggttccagtaatggaatcgctaactaaaaatgcctttaaacaacagaggtttctgttttctctttgaagtgatatggaagtatgttacccaccttgaatctaaggatgaataatcaaagacccacttccaacatttctactgcatcattttgaacatgttggcttttgtctccaggctgttgcctcatggtctcaagatggctgccacagctgttgcctcacggtctcaagatgaccaccacagctattgcctcatcatctcaagatcactgctgcagctccaggcatcacagtctctcacagttgtgttcagcgacaggaaggaagaggacaggcaagagagtttctctcttttg

SEQ ID NO: 187056 - DNA, 486 bp, Homo sapiens
ccccaatacggataggaaaacaggcccagagaggttggttcatccgcttcccacaatttgatgaaaaaattccctttggttatttatatacttgggctggaatttccctgccaacacctattgctcccttctcctccaacaatattttgggaattctcattctattatccccccaaactgctcatatatgttgactgaaaggtagatcaaagccataagcatccaaaccacaacagtcgttcatcgggatgacgcagacgcttattaaagattgtgctgagggttttttctccaaatttcctcagaccctcgccatcctaacaggctcttacttgtaaagctttcagtggtggcccttgacattttctcagttgctcggtctgcctacagtctttagaaagatgtattcattgcctcacaccataagctaaatgaacatttattcagtgcttggtgtaggtgccaagcattgtctagacactggta

SEQ ID NO: 187057 - DNA, 296 bp, Homo sapiens
ctgcccattagactatgacttatcaccattttaagacatctcaatttcaaagatgttaagatgtgggaaaaaaaggtctcagaatctataaaatacaagataaaccagacactgtttactgacataaaaacacttaccatcttcacacgccaccaatattccttcttagctaaatgtgtatttacatggtttactgaataattctatccagtctggttcaaatattatattaacacattgccaggcacagtggctgatgcctgtaatcccagcactttgggaggccaaggcgggct

SEQ ID NO: 187058 - DNA, 717 bp, Homo sapiens
ttgcaatgtggcaataacaatgaagtcttttataatttgcaagagtgataatccaaagactttctacctcttgaaaagtaccttatttagctgcttcatttgcaagtgtggcgggagcggcaattgaggtggccttttggtctgttcagtattgagtcttaagctgaggggcatattaaatatgtcgctgacacgggtatccctatgctatgtgctcttcctgttctgattcttaatttgtcttcactgtctcagtagtggtataaatggaattagccaagttctgcctgttgagtgtaggtatccagtgatcccaataaaatctcctgccatcaatttttgttacgtatgtatttagaggaatgtctagctggttaagccagagttctaatggctttgaattgcaggaaattgaggccctgtagaataatacacctacttgcctatcaatgataaagtggaactttatataagatgaagttacaagtgggttagagtgggaaaagggaactaaattcagtacaatattttacaaggagtaaagaaactgagaaaatgctatacagtttgtatgccaaacaaagacctgtactttacaagatcgaaatagggaaaattaaggccatcttagtgttaagattcttctaggaaaagtagcttctgatttcttaaatattagctttggctagtggtcatatttgtattcctcttgagctt

SEQ ID NO: 187059 - DNA, 561 bp, Homo sapiens
cctagaggacaagccttctttctcttggtatttttttcctagaatctggcatagccctttccacatcatgggggcgctgaacaaattttagttcatggaagaacaaatgacagagtgaagactactccctctaggcagtgagggagctgattggtgcttagtaccacagtaggttcgacttaaatataaaaactaaggctgggcacagaggttcacacctgtaatcccagcactctgggaggccaaggtggacaggtcaactgaggtcaggaattcaagatcagcccggccaacatggtgaaaccccatctctactaaaaatacaaaaattatctgggcatgggggcacacgcctgtactctcagctactcgggaggctgaggcaggagaatcacttgaacctgggaagcgaagattgcagtgagcagtgatcacgccactgcactccagcctggcgacagagcgagtctccatctcaaaaaaaataaaaattaaaataggccgggcacagtggctcacacgtataatactagcactttgggaggccgaggtgggcaaatc

SEQ ID NO: 187060 - DNA, 278 bp, Homo sapiens
agtcaaagaggaggcaggttgattgacttcattcctttcggttcccctggctctcttagactcaacatgttacaatatttgcagtaaataccgtctaatactggctgtgcattctggttctgaaagatgtgttagccatctgctgctctccctgccttgtgatgtctgtctttttgtctcttgctcatcccatttctcacacatggtggatgtatatggcatgcggtcgggacccggtaagctggatttgggagacagaggctggagtcaggtgggtg

SEQ ID NO: 187061 - DNA, 236 bp, Homo sapiens
ccaggtagacctaacacgagatggacactcaggccacaagtgaacatctgtccccaggtggacatccatcccaaggtggacatcaggccagaggtagtcattagtctccagctggacaatagtccctaggtggatacctaggccccaggtggacactagaccccagattaacacaaaaaccaagtaaaaaatcaaaccccaagtggaaaaccagtccctaggttaggtctacctgg

SEQ ID NO: 187062 - DNA, 595 bp, Homo sapiens
tcctggcaaaacagagagctgggctgagtcagccatggaaattctgtgcctgtaagcattttggtcaataaggggtcaaggaggaaggagaacagatttggttactgcatttgctcctggttctgggttgaacttttgagaaaacagtttctcctgaaataaaagaagatatttgttaaaaatcaaaacaactacataaaagaatattttaacaggtagctgtaaatgataaaagaaagaaaaaaaccaccgaagtaaaaccgtgtatccactacccagcttaaaaacagagcaatgtcaagactcttgaagtctcttatgtgctcctttctgattctatttctttctctcatcctcacctcctaggttggcaaccatttacatttttatattttaacattactttgactttatttgtagttttagcctatatgtatgggcaaaatatttcattttgcttgcctgtgaactttaaacatactgtatgcattccttttgcttattttccttctcaatattgtgagatttacccatattgactggctagctgcaggttattaatttgtattaattaatgctatatagtgttccatag

SEQ ID NO: 187063 - DNA, 380 bp, Homo sapiens
ggaaaaaaggcattcattacatactttgaaaggtgaagtgcaaagtactgtggaaacacactgggagcccctgagggaatgacgccaaagccagaatcttgagtgaaccaagttaaccaagtaaacaaggcagggaagtgtgctccagaaggaggaagccccatgtgacccagaggtaagaagagcatgagacttagaaaactgcaagtcaggcaggcctgggttaaattctacttttgcttaacttctctgggcctacttcctcatctggatgaaggagatgggttttaccaccttacagagtggcttgcagatgaaatgtgataacatatatgaatctactactggttcatggcacacagtaagtgtgcatccctttc

SEQ ID NO: 187064 - DNA, 393 bp, Homo sapiens
ttaaaaacaaaaatgaagtcattagttggaaaggataacaacccttttgttccttcctccttctccttgatattattagatactggataactaaaaccacttaaaaatgagctaattaagatcttaccttctttttttagaatgccttttgccttaagtgtaattaagaagcttacaccacaccttggccccactcccacctctaacccttcatcgggaagagacaatactaagtagttggtgtttccttgacatcaaaggacacggtataaacctcaagtattgatagaaacaaaagccagaggaccatgtgacgatgactggccctctttctctcctagacgggggtagccgtgtgtacacacgtgtgtgtgagtgtgccgggacgctacc

SEQ ID NO: 187065 - DNA, 631 bp, Homo sapiens
atcagtgctgctttagaagcagcaaggctgggccaggtgtggtgctcatgcctctctaatcccagcactttgggaggcctaggcaggaggatcacttgagctcaggaatttgagaccagcctgggcaacatgatgagatcctgtctctatgaaaaattataaaaattatctgggtatggtggtgcgtgcccgtgatcccagctacttaggaggctgaggtgggaggatcacttgggcccaggaggttgaggctgcagtgagccaggattgtgccactgtactccagcctggtgacagaacaagaccctgagtctcaaaagaaaagaaaaaaaaatgctggagtgtttgattttgagttgttatattctggtatctaaccccaaaagagatgggagacattgtgacttccttggtaattaaaatttaactggcccaaaaaatataactgttaaggtaaaggatttttgtttgggggaaaggctataatttaattattcaacttagctttcaagaacagaaaagtatttatataactaaatatagaataataatggctgtcaacatctaatccaactgaaataaactttagttttcttatgcctccaaagtaccatagaaaaagagaaaagac

SEQ ID NO: 187066 - DNA, 597 bp, Homo sapiens
acaggtcctgcactgagcctgggcgtgtgtcatctgcaaccggctttctcagaggcatctgtgtgtctcctctaggactgactacaccagctccttcattcaccctgtctctctgctgaggggcactggggctatgtgaccagttcaaggcaaacagaaatacctggtaaccctacctctctgctcaggacactcatcctccctgatcccctgccaggcctcgcagcttttttagtccttcttaagaagataaaaagtgcaattcagtctaataaatataaaactccagagcagaccagtgtaacatcaaaactccctgtttctcgattggtggcttctactgacagaaggcagtggaagagagagaccagtggacgcacttatgtgctgtgtccaggcacaagggctgggcagatcctgagattccaaatcccggaagctttgccagtccatatgagtcagggccccatcaggacagaacctgagatctggactgggactcaaagcccgcaaggtctgggatcccactgcatccttagggaaaacccagcgacccccagccttatctgcatcccctacctgggacggggatcctct

SEQ ID NO: 187067 - DNA, 415 bp, Homo sapiens
tcccacaatctataatatacagcaacaggcaccactgtgcagcttcttatccaatcacccgcaaatcccgtttcatatgatgttgcttctatggcagtctcaaaagtagaagatagtataattctaatgtctacatgctgtcttgcttgctcctcaaaatagcattatagatatcaggaaagcaagtgttacttttattattacatttactaggaagaaacagaaagttacctaaaggtgggggaaaaaaagtggtaagcatcagaaccaggatgtgagcccatgtggttttaggattatttaaaactgagaaaattataatgtgttgatatatttagataacatttcattccttgccaaatttgaaggcaaaagtatcaaatattaagaaagtgaataatggctaaaaataaag

SEQ ID NO: 187068 - DNA, 534 bp, Homo sapiens
tggttctctcctttacagtgtgggactaggacatcaacacaattttgaattttggtctcatttcaggcctgtgtgagggggtgctgactctgggtgacatcaggagatcaggcactggctagtcatcacaaacagaatcccaagagttcacttagtgcccatttttgcttatatgtgtatcttattggagccacctgtgattttcagaactgctgaattgggggaaagcagacgcaactgtttggggccacgtgcgcacacacttgaaatgctcagttgcactgtgtaatgtaggatttttccgtggttttggattcttcccatttttgttggccttttccctgtgttacgcactgagacacttctgtacacagctgtttcttcgaaatcaatcaaatttgaaacagcctgatttgcaaaactgaaagttgttgtatggaggaagatccttggtaagaattacatggctcacgtatcatgttcttcttacattgttttttgtttcccagccattgtcagggaacaatagctgga

SEQ ID NO: 187069 - DNA, 366 bp, Homo sapiens
acccgtggcaccttcacacatgctgagacacagcctcggaccccagatgtcacccacagcgaggaggggcctgggaaatggagcaggcttcagtccctagcaccgccacaaacctgcttggcagctcagatgcaactgtcagacccctcagcattcagtggaaatgccagggacccagaacagtcaaataatgtccaaaaagaacaaaactgggggattcacagatcctgatttgaaagcttgctacaaagctacagttatcaagatggtgcagtcccggcgcagggcagacgtctggaccaatgggataaaacggcaagtcaaaaaacaaggtatgatgtcaaaagcaattcaatggggaaagaa

SEQ ID NO: 187070 - DNA, 788 bp, Homo sapiens
agccaaattatagtctaacacattgctgtcaattgcacagattcacctgggaataaggcatcaaacatctccataccaggccctgtcctaggccctgggtcacagatgtaaacaaagtcaacatgtgccctggatggagctgctcagttcagggaaccgcaggttgctgagcatggctggagcacagagcaggaggtggaacgtgatgagagaccagtcggagagacaggcagggcccgctcacgaggtgccttgatgcctcgcagagggacctcgagttttccctggggtggtgggggctgaggaaggagtcaagcaggacagacattggcagatgctcgaggcataggcgcagcactggggacaagaagatcaagctcccttgggaagattcctagctgtgctccgctccttccctcctctgtaaaatggggacaggagaagtacttatgtctccgggtggtcatgcagtcccatctgtaacaaacacagccctaaaatctccatgagggcaaggactctgctcaccctacatcccagtgcccagaacagagcccggcatacagtaggtgctcagtactgctcaatacacggccactaccgtcgtctgcaattatagagttttttgatgggcagcatgagaatggcctggctgcctgtggggcgggcaagaagagcagcaaacccaaccggaagtcccctggaatatccgctcccttggggacctcacccaggccctactgggccgggatgttctggctcaagacacactcgcacagttcacagac

SEQ ID NO: 187071 - DNA, 788 bp, Homo sapiens
tctctcctggcctttgaaagatgctgactagagcacactctcctgccctttgctgggtgcttagaagaaaggccttgaggtaaccctgttccagcctccccacaggcccctgcagccacgtggactgaccagaggctccacacacgggcaggtgtggcctgacctcgctcgcgtaggatcatgggctagtgggtcccccaatggggggctgcttcgagtgtcaggaggcagcgaggggtgcacagtgccctggcctctgccatccccgttggttatttggctggtctgtgtttggtgagcgagtagagggatccagagtgcagggtggtcttggcctggggcttttgactgccctctggagatgcactgagggccacccagctggggagcagccgggagggataggaacctgttcccaccgtggcgtctttgcccttccaatctgcttcaccgtcgcccttgatctctgtgccagttggaaaattgaggcagaaccaatacccctgggtgatctggaaatcatcagtgggaagggttgcctttgcccaaggctaaagatgacatgtccctgcacactttcagccccaggttttccccacagacccctgcagccacgtggactgaccagaggctccacacacgggcaggtgtggcctgacctcgctcgcgtaggatcatgggctagtgggtcccccaatggggggctgcttcgagtgtcaggaggcagcgaggggtgcacagtgcctgcctctgccatccccgttgttatttgctgtccgtgctgatcg

SEQ ID NO: 187072 - DNA, 1069 bp, Homo sapiens
tctctcctggcctttgaaagatgctgactagagcacactctcctgccctttgctgggtgcttagaagaaaggccttgaggtaaccctgttccagcctccccacaggcccctgcagccacgtggactgaccagaggctccacacacgggcaggtgtggcctgacctcgctcgcgtaggatcatgggctagtgggtcccccaatggggggctgcttcgagtgtcaggaggcagcgaggggtgcacagtgccctggcctctgccatccccgttggttatttggctggtctgtgtttggtgagcgagtagagggatccagagtgcagggtggtcttggcctggggcttttgactgccctctggagatgcactgagggccacccagctggggagcagccgggagggataggaacctgttcccaccgtggcgtctttgcccttccaatctgcttcaccgtcgcccttgatctctgtgccagttggaaaattgaggcagaaccaatacccctgggtgatctggaaatcatcagtgggaagggttgcctttgcccaaggctaaagatgacatgtccctgcacactttcagccccaggttttcctaccttgtggggaggtgagagcgtcagggtgagtgctgggtttgaggctcagctgtgctgtgtgaagattgagaggagcccacctgatcacatggacagaacgcacaggctcctgggtggccctgcggctccagtgacatagcacatggtcgggcatacaacagtgcccaggaaaggttagctggtggtgtttccagggtatcgtgctgagcttctgagatgagaatgtcctgtgaaagcctctgtctggaggtttcattggaagtaaagtttacatacaattaagggcctaaaattgtattttcatttaccttaacccagattcccagcaagctagagagctgccctcaccccaaagagttcctcatgccccgtcctggataggcctgtcagggccaggcagtgggcgcttgtccctcgccccatcctggacagtcctcacctgtcgctcacagcctgttctgctctggtttt

SEQ ID NO: 187073 - DNA, 224 bp, Homo sapiens
acacactgatttaagcggcctcctataattttgtccagtggatgaacaaggtcttgacttactcagtgagagtggtgttggaggggatgggctcacggggaaattggggtgttcagcattacaaaatcgataggctgaaaagaaacagtatttgcgtccagatcaatgtaccatgtgatgcaaggccaggaaaggaagggcaagggtggagggcagaagtaatg

SEQ ID NO: 187074 - DNA, 574 bp, Homo sapiens
ctttccctttggtttaagtctcactactcagactaacgtaacagcctattaacataacagcccaggatctcttatcactggtcctggttttctctactacatcctccacacaaacatctaaattttgtttctaaaagcccagaaaagagctcattttgctgcttaaaaccagccataatgatggattaaaaaaaaaaaatcatttaggtccttttgcgatacaagttacagtctacctttctgtcctagtatttaaattacactatgctagtattcccaggtcctcaaacatggcatttgctttcttattgaggaaaatctgtaatgcttttctcttcactcttaacagtagctggacccaatttgaacaactcctcttttgaaaaaaccttctgcaaatttttgtccccctcctcacattattcccctaatacatggaacagaacaccagcactaggtgagaaaacagaggtttcatgggcacctattaatgattattctgcttgaaaaaacaatgggtatttcttgggaatttaagaatgtaccatcacgtgagaaactgaggtataagaaa

SEQ ID NO: 187075 - DNA, 313 bp, Homo sapiens
ctctaaaaaaatttttttaaattagccagatgtggtggcatacacctgtagtccccactactgtggaggctgagatgggaggattacttgagcctggcagttcaaggctgcagtgagctatgattgtgccaagtcacttcagcctgtatgacggagcaagaccatgtctctaaaaaataaatagataaatgaatacataaacaaataagttctctgattggcctggcttcagtcacatgactgaagggggatgaagtgctgctagggtcttgggtcacatgtccaccctggtgccagcccctctagaatccta

SEQ ID NO: 187076 - DNA, 143 bp, Homo sapiens
gtggaagatataccacagagctcatgaaagacttttaactgattttaatagcagtcattacattagaaaatgagacttccgcttgtaacagagatgaactgggaagaaacaaaggaggagaggtaactagtgcagcgccccag

SEQ ID NO: 187077 - DNA, 431 bp, Homo sapiens
gcaggcagcagaattggatcgggaatttctcaaactgccaaagatgaaattagaatgagtgatttttggctggcagcttgaagtacatatatatcagtttgtgtatgatacgtgtgagtatgtagtggtttttccctcttcaactgtctttaaatatgtgtgcgtgcgtgagtgtgtgtacaaacacacgtagctttaatatcaaaaaggttatttttgtaggtctgttaggagacatgaatatgctcaaaagggaaaaaaatacatggatagggtgagaggagtttgctttatttaaggacatgataaaaggcatagcccttctgcctttctggaatgctgtaacagaatatagaaataattgtatcatctcctgtacttctcagagctggtgtttgcgtgaggctggccctgtgccaggttggcagggt

SEQ ID NO: 187078 - DNA, 338 bp, Homo sapiens
cctcatccgttcttgtcaagatttaaaaaggtaatacaatgatgtccttagaatactgccaaacacaataattagttagttattattataccttggctgattctcatggtctcctaactcattaaattttttctaattcattttttatatctcataatacattcttccccttttttccctttgcttaccaagctctgcaacctcataatacatttgataggtagtcattaaacaaaataatttttttgcagattgactaacgttgggtttagggctgttctcttttcttttcttttctttttctttttcttttttttttatttgagatggggtctcac

SEQ ID NO: 187079 - DNA, 389 bp, Homo sapiens
cagtagagagttctgggctagagagataaatgtgtgagctgtcggcctatggatggtatttaaagtcatggcactgaagagataactgggggaatgaatatagagaagaggaccaaggccagagcccatgggacattcagcatgaagaggttggggagaagagaaggaatcaggaaagggacagtgaaaaagtgaacaatcagatgtgatggggagccgggcgcggtggctcatgcctgtaatcccagcagtttgtgaggccgaggtggatggatcacctgaggtcaggagttcaagaccagcccaagcgacagaacgagatcccatctctacaaaaaattttttaactaggcaagtgaggtggcgtttgcctgtagtcccagcgactt

SEQ ID NO: 187080 - DNA, 218 bp, Homo sapiens
ttttccacaccccccctcctcccattcaagttgtcttcagtgggatgttaggactgccatgtgttaagggactctcctcatattctattcctttcaaccaccctgtgaattggaaaccaaaactctatgataaactttgcttttttaaggtcagccaggtgcagtggctcacacctgtaatcgtagcactttgggatgccgagatgggaggattgctt

SEQ ID NO: 187081 - DNA, 205 bp, Homo sapiens
tggccacatctgacagttttatggcatcattttctgacccccatctaggttgggaaaatgtccaggcttttgcagcctctggtgggcactattttatgccctccaagtaccagttgttctctgtagttcgcacaaatcgccccttgttcacacaaggcacgggccattgttggaatcaggctttccaagctggaggggcccttag

SEQ ID NO: 187082 - DNA, 579 bp, Homo sapiens
aaaggaaatctctggggttgtgctgtgttcagtcacatcaacgcttatgtggcagggattctggttctaactgccaggctcctggaagccactgagacaccaaaccctatgggaggtgtaaggcaggttccctgtgaaggaaaggggtatctggttgggtaatttgcacaccatcagtgacgagaaactgaggatagagaaatcttgctcaagacataattcagacaaagggacattatggtaatttagacaaaagactcaccctagagtgtttttatgcttggcctctgccaccatcatttttctttcaatgtctgtcattgtatataaatgtttattatactagagttctgtcataatggatatgagttgagacaaaggatagagaaagtaatatgatgctggctacttttactccaaaaaggaaattctaaacaagcagagtgaagccagctgctctatatgtcacattgatataagtcactgaaatgctgagttcccaaaattgtgttccttccttttcacaatctctccttgctcacatcggaagtggaagtgagcatggtcactggtggacat

SEQ ID NO: 187083 - DNA, 331 bp, Homo sapiens
taactcactccttgaaacacgtcattgacttccagggcactactcttggttttcctacctttcatctccttagacgattccttttaatctcctgaccttcaaatgttggaagtggcctagagcagagagcacctaatttccaaccacactacagtccttacaaaggacatctggtagcgcggcttaaactagccacccttacattgtatgcgtccaaatttctatctcctgttttaatttctatgaactcctgacttgtacatcaaactgcttcggtaaccttttcatctggatatttaatagacctcaaacatacctacactcaaaatta

SEQ ID NO: 187084 - DNA, 382 bp, Homo sapiens
cacaacggcgatatgttcgtagagatgtgtcgttaggtgatttcgtcatgggaccatcacagagtgcactcacatgagcctggatggtacagcctactacagataggccatgtggagtagcctactgctccaaggctactgagtgtcccaaatcctgcaggcaactgtaacacaatggcattggtgtatctaagcatgtctgaacaagaaagggacggtaaaaatgccatatgacaatcttatgggactcctgtagcatacgtaatccactgttgacagaaacatccatatgtatgcaggactatgtcttcataaagacacaggctggaaaaaacaggaccaaatgagagcaatttgcttattagaaggaaagatgactttc

SEQ ID NO: 187085 - DNA, 277 bp, Homo sapiens
caactcatggcttcttccatgggagggaatgaaaagaatggaatttacatctaatgttccagctttttggggaaactacccaagggactggtttctgttttgtgtgactctgaatgctgacagagaactagcatactttggatacatgagggcccttgagacagctcagcagcttgttgcagcaccagaaaacctgcagtactgaaaacagacaatggaagcagcaagaaattatgagctcctgataaaaaccagcaaacttttctaattgggaaat

SEQ ID NO: 187086 - DNA, 290 bp, Homo sapiens
cagcagtggtttcttccctgtctatggatccgtggacaacctctgaagatctcttctttaccatccttttggtcttctccagagccaccctactggggctagaccctattctcaaagtaccattcctctagtatccatttgtacttcatgacatttccaaaaaaagtcctatgtttgcaatgaaataagaaagtggctgggtgagggtcggagggatgagctggtatgtgtcattgcttggagaattgacctaccaaaggacttccgtgttgctttggccagtcccagag

SEQ ID NO: 187087 - DNA, 265 bp, Homo sapiens
atcagattcttcagattaaaaaattagggtaagaaacaatcagatgatctctgtttcagcttacatacataattcttcattacatccatctcatctgatcctattaccctctttcatgtctttttatcattgttagaagagcctatgacatcttatacttttccttcttagaatttagcacaaataaaattaagtcattatttgagctttatgagaattaagaccaactactattgcttagcacagtgctcgacatgaacaggta

SEQ ID NO: 187088 - DNA, 311 bp, Homo sapiens
accagtacatttctgatcattgaatcctgtcctataacaccaatacactatccattattgtcagagtttaaatggatatttttataattacctcatacagttcagttataaataaatctcctctgtgccgatgtcgccgcgccctcggaggggctcgcgggggccactccagggcagggcagggcagggcagggcaagaaagaaagaaaagcatgagaggacccaggaataagagatagcatggtaaaaactaaagtaagtttgagaaggcctaaagcacagaatggaggggagacacgggtaccgagctc

SEQ ID NO: 187089 - DNA, 228 bp, Homo sapiens
agctaaggacttaggcgctccccaatactatgtaagtgacagtatacaaaatgaaatttcccaggaaattattgttttccagaattgaagggataggccagctgagctttttgcccttgatttttcactcaacccagaatgtgctacctggggtaccatggccagtttgtgcaattctctaagaaagaaggaccaggaagatggatagagtctggttgcttcaagtca

SEQ ID NO: 187090 - DNA, 462 bp, Homo sapiens
cacacaacacacacacacacacacacacacacacacacacacacggtccttctctctccacaaatggtaacatactaaagatactcttctgtactttcacagtgcaagtaccatatcccacacctaggatttggctaaggccacagccaagtgaaggcagggtaggcacttggcctctaagctctgcatccagtgctccacgtccaagctctgcttgctccccacagcactccccaactcatccacagcagccaactcagccgcaggctgcctctaacaaccacacacaaaaacaatgagaaatggcccatgctgctttctgggcaggacactccatcctgcagaagggacctaaaggtccctcactcctccacctgggaagctgggctgccaagggatggggcaggcggtaggactcacactgtccatgttcttctgctgcatggagacagcaaagagtcc

SEQ ID NO: 187091 - DNA, 578 bp, Homo sapiens
gcaaacatggagtaggcagagaaaggagttcaaatcagtcacctactaagaaccagcaactcttttgaacttaaaagtcatttttccattcaaactcatgaacctgaaggagatattgcgtagacggcggggacggtggaaagaggctcagaaaggttaagcaactctcctaaggtcacacagctataaaaatggaaaaacaagtttagaaccagtggttatcttaagatgatagcattactgctaatacttattttcctttttatgtttatttgcatttctaacttttcctaggttaaacacattttgctgggaaaattttccagactcaaaaaaaaagattaattattggaatgaatttgtttaggtatttctaaataatggtgtgataacaaaaaattaactggtcccaccttaatcttcacctatgcaggaagtatcctgaatttttcctccctctgcctctctgaagcccatgtgggccacaacagaaacacgactgaagcccagcctcttgggtatcagtacatgctcaacagacaccatgttgtggcttccttggaacttcaatggcacca

SEQ ID NO: 187092 - DNA, 476 bp, Homo sapiens
gcccaggctgatcctgaactcctggcctcaagtgatcctcccaccttggctcccaaagtgctgggattacaagtgtgatctaccacacccagccagtgagggcatttttataatttcatctctaaacagtggatgcacacattgatatgtgaaatgctctgggctggtgttttttcactctgtgagtggtgaattggtaggtagtaaagtcagtaaaattagtcatgactagcgtcttgaagaaaagaaaatagaatacaaacaaaaaatatcagagtgaatcactcaaagtaaggataagaaatttttataagaccttttttacgttttatgagtgtgtgtgtcctgatatgaaatatatttcttcctacggatctcgaaaaagtttgaaaacctctagcatccgctcatgccccagtttaatctctcgccatcttttaccccaggcttcaggcatgttgattgactggacattc

SEQ ID NO: 187093 - DNA, 957 bp, Homo sapiens
cgcttctccacctctctgctcatgtaaagaaactgatgagaaaagagactaatatgtctagactgagttagaaacttcatatgagtgggttttgtagaattgatgggaaagacagtgggaacctagaagaacagaaagagacccacagaatgtctttctttcgtctctttgcgtcactcttgagggaggggcgtatccgcgggcggctgtttaccccgtagctggggggtcaggtgggggccatcataaagaccgtcgtgtgtagaccctcctgtgctcccgaggtgttcccgcgcaggattcctccgtgggcctagcaggcctccacgattgagcgtgagagtgttctcggggtgccgcgcacacccaaatccccgcgcttacattctggggggtgatttcctaggtaagaagacagggtgtttccccaactgtttgcgccagggctgggtccttcagagtctccttgccctcaggggggttccaccccgcttggtgttccccccaaatggtgctggggataatatcacggcggtagccgccactgtgccttggcccagaaatggttcttcttcaaagatcaggagttgtaagcctctctcaaataaggtaaaggcctgtgatcccatgtcatgagataccaaaagcctccgtggggagcttccgaggcgactgcctaggaaagttagtcgaacgtgttccccaagatagttctcttgagccatatagcccccccagtgtttaggaacttcacccggtgtgggacaagacaccacctattgtctgccgggggtcaccaaaattggcgcgctcattaactgctgctggttgtaaccgcggcccctatattcgcagaaagcccccctcgtgtgtgtgttgttcacccaaccctccgtgggcccgacttaggggcaataacacgacgaggcgggccgtacttttatgtcggtgtgacca

SEQ ID NO: 187094 - DNA, 399 bp, Homo sapiens
gagtattaacaaactgctacatagctgattcttccaagtatccccacccccatttaaaaaaagggaaaggttgctttacaacaacttatgtttttgtgaatttaggaatttcaaagaactgctcaataatcacatataatactgtcctggcagcatgagagtcagcgaaagaattaatccctgatcgctccactgtatgtaatgaattcgctattttcttatgcatttagaatgatggtgctagatatatgccattcttagaactaagagagtaggcactcttttcctgtagggattgtcttatggaccccaggtgagaaagactgcaccaaaaatgtcacaaaggtacagaaccgctgctttagaaaattatgtataacgcctctgaacaagtaaaca

SEQ ID NO: 187095 - DNA, 210 bp, Homo sapiens
ggaggtgggccctttgatgagtgattaggtcatgggggcagaagcttcatgaatgggattagttcccttccaaaagaaacttcagagagttccctcaccccttccaccaccaagaacacagtgagaagacagctatctttgagcctggaagagttcctcaccagataccaaatctgccaacaccttgatcttggacttcccagcctctag

SEQ ID NO: 187096 - DNA, 308 bp, Homo sapiens
gagggaggaacagtggcttgtactgggagggtgtcaggaaggaacgggaggaagatggcgacatcaggggcagggcaaatgagccttgttcggccacagccttggctttcaatctgtgcaagtttagtgagatcacgctgcagaagcagtgtcaggctgaggacacagtggccctcgaggaaatgataatggacatcagctccacccagttacacacccaaaaactgcaactgccatacacaaggagctcccgttatggtggttctctgccaacaccctaccacactgacagctctccctatagtcct

SEQ ID NO: 187097 - DNA, 400 bp, Homo sapiens
ttgacaaccttcagggtctgtttcagcttggtatgctttctctttttgtgtatctagcaaaaggaagattattttgggattattattaaaggaggttttggtcctacaaccatgctaattgtacgtgaaaatgttttggacccaatacagatgtgaaaacagaacatacagtttataatgactggaattgtttagcaactaccacgttaacattgaaaccttgcaagtcccatagccaaattttcttagtgaaaaaaaaagaaatttttgattaaagtgcagacatttctagaaagctgcgggtcaaaccagttaattatttttatcatgaaatggggaagaaaaatatgctatcatttggcacatctggctgatttctttccttactttgaaataatac

SEQ ID NO: 187098 - DNA, 201 bp, Homo sapiens
aggtgcatacctgttgtgttgttgtgttcaaggaacagcaaggagaccagtgacagtggagtgagcaaagaggaaagtgggaggagataaggacagagaggtgaggccaaatcttgtagagccttatggccattttaagaaccctggtggccaggcacggttgctcacgcctgtaatcccagcactttgggaagccaaggc

SEQ ID NO: 187099 - DNA, 324 bp, Homo sapiens
aggcagaaggagacaccaaagcaagttttagagcaggagtgaaagtttattagaaagctttagagctggaatgaaaggaagtaaagtacacttggaggagggccaagtgggtgacttgagagatcgagtgcatggtttgaccttttgacttggggtttcatatattggcatacttccagggtcttgcctcccttctcccctgagtcttcccatggagtgggctgttcacgtgctgggtggcctgcatgcacagtgtgtttactgcagtggtatgcatacccacttgaggcatgcttcccttacctatcaagcgtccctataagg

SEQ ID NO: 187100 - DNA, 596 bp, Homo sapiens
caaacaaagagcaacagtaacaaatttcagtgaaattaaaaaaaaaaatcagaatccagagctgctacaatgcataatcaaaaatgtccagttttcaataaaaattataagacatacaaagaaacaggaaagtgtgatccatactcagggcaaaaaaaaaaagcagccaaataaaatggccactgagtgttctcaagtgtctgatttaggagaagtagattttaaagcacctattacaaatatttccaaagaatttttaaaaacatatttgaagaatgaaaggaaagtatgacaacaatgaatcattaaatagagaatctcagtaaagatattatacattgttttttaatggaaattattgagttgaaaagtataataactgagaaaatctcaaaagtatatttgagatggcaaaagaaaacaacaatgaaataaaagaaaaattaatagatattacacagtatgaataacagagagagagagagagacagagagagagagagaagaagaagaagaagaagaagaagaagaagaagaagaagaagaagaagaagaagaagaagaagaaggaggaggagaagaaaagaaaagaaaag

SEQ ID NO: 187101 - DNA, 528 bp, Homo sapiens
atctgattcaagatgtcgctattatcccagtttagaaacatttctgtcactgcatcaggatcagagaatgcagttctaaatggcaaatctagacttggtttgacaagacatggaatgaaactttgaaattaaaactccttccttttccatccttagcagaatctcctgagatgttcaagtagctctggaaagaaactgatcagattctaatctgtcaatttaaaaagtttttttttaaacaatttttaaatttgttttagagatagggtcttgctgtgtcattcaagctgcagtgcagtggtgcaatcatagctcactgcaatcttgaactcctaggctcaagggagcctcctgcctcagcctccgtagtagctgcaactacaggcgcccaccactacaccctgctaattttcttatttttaaatttttttgttttgttttagagatgaggtctcactgtgttgtccaggctggtactcctgacctcaagtgatcctcctgctttggcttcccaaagctctgggatta

SEQ ID NO: 187102 - DNA, 256 bp, Homo sapiens
ataatgatgataatatccaacgtttatcgatggcttctgtatcactcactgtgctaagtgttcaatacactttgtctcatttaatcctcactacaatcccttgcggaaactgtgttgttatctttgttttacagatgaggagggtgactgcagagggagatacatggtttgcccaaggttacatagctagacataaatgacaagcaagagtgtggcaccctcacttttaattccagggacgcgttcctcttctagt

SEQ ID NO: 187103 - DNA, 274 bp, Homo sapiens
tctggccttgctcccccactccctgccctcctggaatgctttcagaatttttgcacctctggaagtgggaagatcaatattttaaaaacctcatccgaagctcagagaccccctccacagcatagtaggggatttatgcgctggtgttttgacagttttccctgtgactgatgcagaactcagtgaccttcactggctccgtgaaccagcggtggcagtgtcgctatgtgctgagaagcaacagttcaattccattccagagatagttttactt

SEQ ID NO: 187104 - DNA, 287 bp, Homo sapiens
agcctcctggactcaaacaattctcccacctcagccttctgagtagctgggaccataggtgcatgctaccatgcccagcttttttctttctttctttctcttttttgtatttttggtagagacagggtttcaccatgttgctcaggctggtctccaactcctgtgctcaaggaatctgtccacaggcctccccattttatagatgaaaaaatgcccagagaggtagaataacttgtccaagatcacacagctggaagtgtgtccagtgatcacagagctggaagtcc

SEQ ID NO: 187105 - DNA, 294 bp, Homo sapiens
gtagtctccaaaaaagcaacaacaacaacaatcaagaccatgtgtccaggaacatctcatataacatgacatcctctcccttgacatccagcattctaccagaatatgcctgaaagttataaataacctttgggcagccaagatctcaagtccacattaattggttgtaataccagatgagacatatccagtcaaccttatttacagctcctgcaaaggcagaaaaacaaatatactacacagaaataaagctgtaatatctatacagaactccagaattcaattaatccagac

SEQ ID NO: 187106 - DNA, 540 bp, Homo sapiens
gcctataataccagccctgtgggaggccaaggtgggaggattgcttgaggccaggagtttaagactagcttgggcaacaaaatgagaccccatctctaaaaaataaaaataaaaaagttagacgggcatggtggcatatgcctgtagtcctagctactcagagggctaagacaggaggagggttactaaagcctaggagtttcaatgttgcagtaagctatgatcatgccactgcactcccgcttggacaacagagcaagaccctgtctctaaataaagacaattttaaaaataattaattaaaactagctgttcatgaggattgtttgtaaacactaaaaccaggtagaatgatagaaatggcaaataaaagcaataacccttaatgacaaacggattaatgccaatgggtattaactattgtaattgtaataacaaaacagaatgcagaagatttttgaaatcttttaaaaatactgaatctgacacaattttggttgttgtaaataaggacaaaaaatgtacgaaaggagtgggtag

SEQ ID NO: 187107 - DNA, 440 bp, Homo sapiens
acctcctccactaccatctagtttttattttttatttatttatatatatattttgagacagagtctcattctattgcacaggctgggcgagactcagtctcaaataaataaataaataaataaataaataaataaaaattcaggctgggcatgggggctcattcctgtaatctcagcacttcaagatgtcgaggtaggaggatcacttgaggataggagttcaaaactggcctgggcaacatggtgagaccctgactctacaaaaattcaaaaaattagtgtggtgtgacagtacatgcctgtagtcccagctactcaggaggctgaggcaggaggatccctttagtccacgagttcaatccatcagtgacctatcattatgccactacactccagcctcggtgacaaagcgagaccttgtctcaaaaaataaaaataag

SEQ ID NO: 187108 - DNA, 198 bp, Homo sapiens
agtcacccctttcgttcattctttcttcattcttccagagtttctaagtacaaactagtataactacatatctgattacttaattttctctctctcttaagcaaaggtagtaccttgtacacaccatcttgtgtgtaaaacaagattttttttaaaaaaacaagcttgtttacttttatttattcctttgacaatgta

SEQ ID NO: 187109 - DNA, 330 bp, Homo sapiens
aaatcattatcttaccatttctctcaccacctctctatcctttggctatttggattgaacccaagaactcaactcttaacacagctcagaaaatcataactatatagccaggtgtggtggctcatgcctgtaatcccaacaatttgagaggccaaggagggaggatcgattgagcctaggagttcaagaccatgcctggctaatttttatattttttctttttgtaaggatggggtttcaccatgtttctcaggctggtctcaaactcctgagctcaagccatccgccctccttggcctcccaaagtattgggattacaggcgtgagtca

SEQ ID NO: 187110 - DNA, 370 bp, Homo sapiens
aaaggacactgaaaattaaaatatgagatttgggggcaaatcatcaaacctgtgtgataaatggattagattcagagatcaacaatttcagattgaagctggtattgggtatacactgtccttttggatctgtgatttagtagccaaacgaaatccaatatcctaattggtgaggcaggacagtgaaatcacctgtactatttggaaactctcactttacctctctgcctccctttcatacttttctctttttcttggctacttggtttcatttccttgtttgaatcgtgtggagtacacatatttgaatctatcaggtggtatttacttggacttggctccattgcattgtgtttgaaactctggcaga

SEQ ID NO: 187111 - DNA, 102 bp, Homo sapiens
gctggggtgtggagtgggcacactggaggaagggatgggaaggtctgaggcctgggtaaagcagacacggcccaccccgccttccagctcccagcctcacct

SEQ ID NO: 187112 - DNA, 286 bp, Homo sapiens
agtgatacttcagattcaacatgtctcaaatataatgctttatctttctcatgcatacttattttctctctgagtggatatataactatcctctgagttgcccaagctacaaactttataaacattcctgatttctgccttctcaatcttggagttcaactaataatcaagttcgaatggtttaaatttttaactttttttcaatttagattccatctctcattcatttcattttaacaaatttactaaggacttaatctacgtcaggtgttgtgctaagaacagc

SEQ ID NO: 187113 - DNA, 285 bp, Homo sapiens
gaattgtaattaagctagaggacttttattaccagatatcatgacccattataaaattacaataattaagacactgtggtatcagtccaatgataaacatacaaagaaatggaaaagaaggagtacagaaatggaaccacacataaggctacctgatttgtacaaatgctcaactgcagttaagtgggaaaaggatggtcttttcaataattggttctagaaattttatatagcaagagtacttgactcaactaataataattatgtaatattcccttgacaaca

SEQ ID NO: 187114 - DNA, 511 bp, Homo sapiens
ggatgaagccggaaaccatcattctcagcaaactaacacaggaacagaaaaccaaacaccgcatgttctcactcataagtgggagctgaacaatgagaaaacatggacacagggagggaaacatcacacaccggggcctattcaggggtgcagggctaggggagagatagcattaggagaaatacctaatgtagatgatgggttgatgggtgcagcaaatcaccatggcacatatatatacctatgtaacaaaactgcacgttctccaagtgtatcccagaactaaagtataatttaaaaaattaatacagatgagatctggagcatatgtgtataattacataagtcatgtatgttttacatgagcatagaaaatgtaaaaagatatgcacaaaattgacttttttatatactcttctgttacttggctttgaaaaaataatgttcccatttttgaattttaaaagaaaactccaataagatgtgtatatgttaaaaaaatttttttaat

SEQ ID NO: 187115 - DNA, 185 bp, Homo sapiens
atgttgagatggctgcagtggatggactcatcaccataataatattttctctttaatacttttttagaacattaagtgacaaccagagtgtctaaaactgggttacacagcagtaataaaatcagagtgacactttgcagcagcaggactggaattcttgctattggggttggtggcagcaaact

SEQ ID NO: 187116 - DNA, 379 bp, Homo sapiens
ttgtgccactgcactccagcttggatgacagggagagagcttgtcacaaaaaacaaaaacaaaacaaaaaaccaactaaactaaagataaagagagctgaacataaatgctgtcatctagttagaagtatgtgttagcaattctgaaactatattatgtgtatactggtatacatgaataagtaaactatattgtagataatgagaaccaggtttcttactgttggagaaagaagttacagataaggaaaggggattaaatgaatgctgtggtattagatcagaaacagaagtatctgtataaactcatgtttttaaatatacacagatggaaagatacagaaatatagatatgtgtatatatatgtggattatgttat

SEQ ID NO: 187117 - DNA, 265 bp, Homo sapiens
gcctactagtgttgggactataggcacacaccactgtgcctggcctggacatgttttaaaatcatcctatattctgattcagtatgtgtggatagagtccaggaaattatgtttttaacaagtatcccaggtaatttttaccttcagggaagtttaagaagcactggtagtggaagggatggacttgtggagtcaaagcagtgagcttgaagtggaatgagtcgagtctaagataggagattgaagcaaaggattatggaagctg

SEQ ID NO: 187118 - DNA, 1189 bp, Homo sapiens
cccaggggagtggttcgcacaaaaggggacaacagacaaaagtaggaaatacagtccttggtctgaacaggtttaaattcttgatttgggggtaggggcagacagataagatttttagttctgaaagagtagagtcaagtgctaacatatatttcagacttgaaaacatttagaaaaatgagtgataggcttgtattggaaatctctatttagtggtaagggaggggattaacatttcctgcctcaaacttctagaaatcttctggagggtcacatacatgtcagagcattccagcataacaacagttgatggaccgaatgccctaaatgatcagactgagcagggacattcacagcatagcaaacttagagtttctcccccttgaagagttctttattcattggggatcacaggagatacagcttacccttgagctttctcaaaattgtctttctgtggtttgggaagtgagaagtgggtgaaaacacacttgctgtaacctcttggatttctcatattgctggaagagtaccctttctccttatgaaggaagaggaaactttttgttgggcaaattccaggccaaaaaaaaagctcttggattttatttttttttctatctgcctgtggaggagtggggatgatatttggttcttccattgagaagctacctctgccctcaaaggaaggtaaagttactatagttggctccacttttaataacactagtgacctagaagaaacctaatgctttcattttattattgagagaaattgggacccagagaagttaagtaacttgttagtattaaacagctaattattgtccgtgagtccctcaaatttagtatcctgatcactattccagttttttcctctactgttttgagatgcttatcttactaggaaaggaagtttgcaaacatttaaagagacttttctacctctggaatgctagctaatatgattctttccgctaccttatttcctttctaggtgctgaactgcccccttttagaagagttgttttgctctgcggaatgagcagaaacagagacacctcttttaccctttctctttgcctttcttttccttcacagagttctcatcagccatggaaaagtatgctgttaccataacaagggcagcagaggggaactaactgtgatggtctgaaattttgtctgg

SEQ ID NO: 187119 - DNA, 295 bp, Homo sapiens
ttttaacatccctattcctaccaacagcatgttcgtggcagtttaggttgttctagaagatgacgtgttttctctgccctgctcctcacctcctctgagtcctcaccgagggccttagcatctgaattctgccaacagagtgctcaagacaggctagggtttttcttttggagcgggtgggtgagttgtggacagagtcttgctctgtcgcccaggctggagtacagtggcatgatcctggctcactgcaacctcagcctctggggttcaagcgattctcctgtgtcagcctccc

SEQ ID NO: 187120 - DNA, 148 bp, Homo sapiens
gtgtctgatttctcaacattataatataataactcaattataatattataataacattcaacatagtgttcagagattcctccatgattttgcaagtaatagtggttctgaatacaagtccagatacaggtactgaatatatcttctc

SEQ ID NO: 187121 - DNA, 393 bp, Homo sapiens
aaaacaaaaacaaaaaatcaatcactctatgttgtcttgtttttgctattcagagtacaaacactcagaatcactgcatgttgaaagaggcagtcaagaaatatttttgatatgaacaaatcaagaactttatatttcaaataattaagtattcattaggcatcttatacaggactacaaaaggaagaaagacacctctgctcacaagaagctaattttgtctcaatattctgataagtcttcataatgtgctacattttataatgtgttttcacttgttcctcacaacagtccagttattatcctttcttatttacaagcaatgacatggaagctcagaataggcttcatacctactgtgttagttttagattcctaggcctgctgtaacaa

SEQ ID NO: 187122 - DNA, 160 bp, Homo sapiens
ctattttaatatatttaaaagcactttttaagcctacttcaaatttcttgtaggattaggagggataaaatacgaactacaaagaataaagaagctcggtcatttattcaacaaacactggctatctaccatactgtaagtaacattctaggcacctggg

SEQ ID NO: 187123 - DNA, 310 bp, Homo sapiens
tggtattaaatgacagctgtggaactgtaatcttctgtgataacttcccttgctgcacgttctcaaagaggttaagtcccttcctgtgactgactaatgctggtgcatcttttactagttttaacttcttttttgtttcttttactaagtgtatgaacaggaagatttcagaatctggggtaactctgccatctaacataaagcctccagagtatctgtagatgtggagatgagaagggtcagaagtctcatgcgatgtggtgtgtccctaaagtagcaaagcggagtcatttactcaatgcggggaggg

SEQ ID NO: 187124 - DNA, 353 bp, Homo sapiens
gcagtaattaaaaatggtctagaaaagttagtaataggtagatataccacatttatcttactaaaattctcttatttctttaaaggcttgtcccattttttttcattctgaacctgagaaatcatgctaattaagggcatagtctacccaaaccacactgtaggataaatctttttttgtttttttgagacagagtctcgctctgtcactcaggctgtagtgcaatggtgtgatctcagctcactgcaacctccgcctcctgggttcaagcaattctcctgcctcagtctcctgagcagctggggttacaggcacctgccaccacacctggctaatttttgtatttttagtag

SEQ ID NO: 187125 - DNA, 217 bp, Homo sapiens
gtgcacattaaagaaccacttgaaaaatcctgagtctggtgcagccttgtaaacaggcaacttaaatacatcctgatgccatatgaatagtggtacttgcatatagggtataggcggggaaatttcaccagggagctgacattttgatgaggccttgagacgtatctattaaaacctgatgggggatcatcattcttggcaggaagggcaggcactg

SEQ ID NO: 187126 - DNA, 127 bp, Homo sapiens
caccaccgcgtaccatgacaggctcacaggaggcatttattaagtgattgctggctgatgtcctcacgcttccacctatgaccacctgtggcttattcccattttctaggggagcccctgaggctca

SEQ ID NO: 187127 - DNA, 306 bp, Homo sapiens
cagcaccattggttataagatatagtcaatttcagagattaaactgtgaaaaaagtacatcttaaaatcagtgagatacagtgttttcatttgtataaggatatatttgggggttttgattgctttaaaaacatttacctttattctgtatcctttactcctagccccaggtgcatgtcagtaattacccacagactgcctttttcaagatctacttaagagttttagcgcatagcagaaagaaagattaattgccaaagccattaattacagatggctttgcctagttagtgctcctaattagtt

SEQ ID NO: 187128 - DNA, 401 bp, Homo sapiens
ttggtgccactctgctgtgcccagcatccagcacttcctaaagaccaatgcttcccaaagtgtggtcttcggaacagcagcatctgcctcactggggaatttgttaaaaatgcagattctggggctccactcagacttactgagttggaaactctaggagtggggcccagaagtgtgtgttttttgtttgttttggtttttctgagaggaggtcttgctggaatgcagaggcacaatcatggctcacggcagacttgaactcctgggctcaagcaatcctccggcctcagcctcctgagtagctgggactacaggcacacactaccacatccagctaatttaaaaaacatttttatagagatgagagtctcagtatgtttcccaggctggtctcgaactcc

SEQ ID NO: 187129 - DNA, 263 bp, Homo sapiens
attgcctgaggggaaaaaaaacaaaaggatcacctggaatgagtttgtagagattcctggctccaactcacacctactgaatcagaatatccaagtgagaggtctggtctcgtctgatggtcactaagcaagccaggtgactcctattattaaggaaacttgggcaaacactgtgctaagaaaaaaatttaaaaatctatgcacagttcaacagagcagagagaaacaaaggcctaaaatctgacagggggagtgagggattt

SEQ ID NO: 187130 - DNA, 444 bp, Homo sapiens
agggcacggcagtgggagctgcacctgggtggtgcttgttgcccggtggctgcagctccgcacagggctcattgctgtccctggagaggctgagtctggtaaaccaatttttccctttgagtcttgttgcaaatggatgcatttgaactgtaatataaagtattgtgtttatttaaccctgcaaacggatctcctttgtctttgtgaactggctgggcagctaaagacccacattccttccacagttaataaaacttcttatttttctctgtgcttataactttaattacactcagactcatttagtctacttcagtttttcaaaccacctaaattaaaaaagaaacagcctctctcaatgtgcaacataatcatcatctttagattaaaagacacaaattgaaaacgcatcttgtcagttttgtcttcaaggcgtcatcttaa

SEQ ID NO: 187131 - DNA, 166 bp, Homo sapiens
tacatgatggttacatgagtgtttatgacacattgctatgttttccatttttgttttggttcatttctaagtgtgcagtctagctatatgataaaaattattaattaggagaaatggtccatgaaaattattattactctgctcattatatactgaagggaaaaat

SEQ ID NO: 187132 - DNA, 654 bp, Homo sapiens
cctgaaatcaactccatgtttgagagaaagatgtagaagtgttattcatgaccgtcccatcccaaagtggcttctgtgaagtagtctcatgtgggctctgctagcttgtccagggccatttctatttgtgctaaaatgtttgaaaagaactctgggtttacattttggcctggaagatttgtctccttctgaatagtggttacttataaaagtagttcttcccaacttagagaaatgtaaccttttttacctatgtaattaatgccacctctaactcacttctgtaatcaatattgttattttatgtctctgacagcatccacacactgattttgacactacttgagttatctttgtctccgtatctctagcctcaatatacttatgttacagaatgaatgaactggcctagaattaagtaactagataatctcaatctctaaaatgcttccaaactccctaatttaatcatagattcaaacccaattgtttaattcagtcaaatcaattgctttgggagtggtgtagtcaaaacaaccagttggttgactaaaagatcctggtttctgctggtatgtgtacatgtacccacaattgcctctttttggcattggctgctactgggtcattaacaccagttagctaaataaaaga

SEQ ID NO: 187133 - DNA, 469 bp, Homo sapiens
ccacatagccagttaaacaatacatcctggacaatttgatacaaattgtctatgcttctcattttcccctctacttcaggaatttcagagactgcttgatatagtggttaagaggacagaacctagggccacactgcctagatctgaatcctagttctactacttaccagctgtgtgatttgggtaaggtgcttaatgctctgtctcattatacgcagctatgaaatggggacgctcacaggctgttatgaggattaaaggaattattatgtgcaaagttcttagaacagtgcctggtacataagtactatatgagtatttatcaaacaaacaagcaaccccactctcctcccctggctgggttatctttaccctgctcctaactcacagggcacatcgccatcactgcattcatcttgcactgtggtcatctatttaatggtctttgagctacttgaggcagggattg

SEQ ID NO: 187134 - DNA, 340 bp, Homo sapiens
ggaaaatatctaatagaaagtcttcccaagatgacctaactaaaaatatgtgataagtaatgaaatgaagcctggactagacactacgccttccagctcccaagtcttgtgtctgttcccttttaccatactacttacttgccctggcttaatttaagtaggcaaagcatcattatggggttcaggaaaagatacctgaaattcagagatctggagttaaaatctccctctcaacatggaactacttgggaaatttctgatcaaaatttctaaccaaaacttttttttttgagacagattcttgctctgttgcccaggaaggagtgcagtgatatgatct

SEQ ID NO: 187135 - DNA, 444 bp, Homo sapiens
agcatccctccctccttgtgaaaagaccttgaccacttctctcttgctggtctccccgtagcagacaacggctcgcctcccagtgccacaggaagaacgtggctgcctcaacatgagcccagccctgccactccaggtgtgagacctgggcaagcagcatcagtcttgcagccacagctttcttgtccatccagtggacctagggctattgtgactataaatgaaaaaagaacctaagacagccctggccttaagtagttgcttaaaacgtgatggccggcatgatggttttttaaacatttgggtcccctgctctcttcccccatgtttcctagtgtctgggttggaggcagccttagccaccttcttcttaccttgccttccctccttcctacctgtgtccaggacaaaatgcctgaggaatgtctctgcttcattaagcag

SEQ ID NO: 187136 - DNA, 241 bp, Homo sapiens
aaaaagtctcctatctttggcttttataatagagacaactggaaaagctcagaaaagatcctacctctgaaaaattatttttctttaaaaaaatcaagagacaaagcaattgagtttagctcccaatgcataaaaataactcatgatgtcacctccaagttaggcaaaattccttgtcacaaatgttcaatatgtgtagccaggatacgagataaaagtaaaaaccagaatgctaggcagc

SEQ ID NO: 187137 - DNA, 125 bp, Homo sapiens
ggagttgtggtttccagctcttaaaaatttgtcacattgataagcatgtaaagaaaactaatatttctttagcaacctcagatggcttaataaaagcagctgattttgcagggagggtagcaggg

SEQ ID NO: 187138 - DNA, 683 bp, Homo sapiens
attaatagagcagacttttgagaaagtaggagtgtagtagcactggaaacagaatgcaaatttctgttccataattaggtttattgtagctatagcgctcccagataacccatgtgtgctagtaatatctattgtgtgctcttactatggtataaaaacctcgctggaagctacttattttgtacttaaatattttaccaatttttaaaaagtcttaatccaatgcttataccagtgactgtttttataatacttgaagtaactttaagaactgaaacaaccctggaaaactctacatagctagatagtaacaatacttgtataagaaaccaagtttccttattcccagcctggtgtctgtatcgtgacacactactctgtgtatgcttggttttagactaggaggagagtcctgggaagggcaatattacagaagttttcttccacatgaggagaatgcttagtttcaaatttaaatacatgtgtcagatggaaccctgcctaactcacttctacaaataacttccccaaaatcttagaaggttttttagaacatgatataagctttgtgacaaaaacaaatgccattgtgtcccttatttagtcataaaaccttaggattcagctgaatatatattcacacatgtatattacacatatatcactatacagttaacacatgc

SEQ ID NO: 187139 - DNA, 273 bp, Homo sapiens
ggactgatgcaatgaatgacaggagggcagagcagagctcctgcagggaaggtgggttgggacagaagacccccctccccaaaaccaaacaagccagtcaaccttgaactgccgtagaaaggagagggagatgggcgtggtgactcacgcctgtaatttgggaggctgatgtgggtggatggcttgagcccaggagtgtgaaaccagcctggccaacatagcgagactctctctacaaaaaatacaaaaattatctgggcatggtggtgcatg

SEQ ID NO: 187140 - DNA, 570 bp, Homo sapiens
gcatacaatgcataataatcacatcagggtaaatgagtatccatctcctcaagcacttttcatttctttgtgttatagataatccaattatactttcttagttgtttttgtcatttatttatttttaaatttatttttccataagttattggggtccaggtggtatttggttacatgagtaagttctttagcagtgatttgtgagattttggtgcacccatcatccaagcagtatacactgcaccatatttgtagtcttttatccctcgcccacctcccactcttgccctcaagtccccaaagtctattgtatcattcttatgtctttgcatcctcacagcttacctcccacatatcattgatgttataaataaatatttggtgccgccaaagaaacagcactcgaacataaatttaattttctcagcaaggtaattttacttctatagaagggtgtgacttgcggatggagcaatggcaggagcacacctgaacaagggaggggaaggggttcttattcctggtgcaggtagcccctactgctgtgttattcccctattggctagggtt

SEQ ID NO: 187141 - DNA, 216 bp, Homo sapiens
tggtctcctgtttcaggctggaaattgagattaataagattcttgctcttcgagtactgataggaatccttttctttgtggttgttgctgtttactagaatgaatctaggagtgagtgggagaagagttcactgtacattctcacacacgtttggtggaattgtttgcagagctcagtggtttgaataatacagtgttttgttcatccagaatttg

SEQ ID NO: 187142 - DNA, 565 bp, Homo sapiens
gtcacttgtcatccctatgttttgaaatcaatctccctaaactccatgtcccccaaatgtgaacagagtgtgttcactttgtctcagagagttgccacaagtgttccatgaaataaaacatttattactatgcttgactataaatatttattgaatttgaatgaatgatatctatttttaatcatgtctacaagactctaaagtctagattcaaaatattagcttcataatatttaattatagagtgctatatttttcattttgatagatgtaatttatctaagaaggttatattaaataatatttgggggataaagggttaaaatgaacttaaaagaaatttcctcttgttaaatctttcaaatatgttcttttttttccaaaaacaaaaaccaagctggaaattgtgatttcgatccaatttctaatataaattgttatcacagaagcaaaacttacgaaattaaagattacttgttcttctattacataggcataaaacactgaagttgttttgttaattactatataataactagtacaaatccagtatactaaaacctaa

SEQ ID NO: 187143 - DNA, 183 bp, Homo sapiens
aagacataagagggtcagagtccgacataaaggtgttgagtctttctgattacaatgccattgccaagtatataagcagttctgttcagagataattttcacactcaacaaatatattctggtaggtcttcactaaattaagattatttaacacaatatctaatctatttgttaagaaatgag

SEQ ID NO: 187144 - DNA, 196 bp, Homo sapiens
tgagttgtgagcacatgtaggggcggtaatgagtctgaaaaaggatatgagagaggaaagattaccttagggattttgatcaggaggcaataggaggtaaagtgtagtgtttggagacgtttgaaccaaatgaatttggaccaaaaaaaccttttagcaggagaagtaacacaagaaacatttctggaaaattaac

SEQ ID NO: 187145 - DNA, 507 bp, Homo sapiens
taagccatgcaaaccgtggtactttgttatggtagcccaagccagctaatacagaaaggccagcctgtttaccaatttatgaagaccagcctgacagatctattattacatggaaaactctcattaggatgctaattcatatgaaattggcaagaaaggaaatttttgttatgtaaaaatatatgactttatgtacccatgtattcctcagtaaagtacctacacttgataatatttataatatgaaggtttaatttacatctgactccaaacattatctaagtctcagttgtggaacaagaaatagatgacagaagggatccaggagtctcacatttaaaacaggtgagtggaagtcagtggcaatgtaaattgtaaacatctaagatatgatatttatgtcctttccatgaattattatgctcatggatatcagtagactattcattttttctttaaaatcaatagttgtttcctaaactccaaactctgaaaagataaataagg

SEQ ID NO: 187146 - DNA, 504 bp, Homo sapiens
tctgtgagactttttagggatttattaacatgatacacaattagcaaaccatgtgtttatttcactcattttaacaaatatccatgcctattatgtgccaggaacttagctaggtatcagatgtgggattgagttttctactgctctggcagttcatagttaagggcccagggtgaggatgactttgatggcaaatgaatggatacaggattcataaattttatgaacctaaactaaatgagcacttgatcggagagcttaattttcagaaatgcaacttctttatttgttttgatttgttttcttgagtcaaagtctcactctgtcacccaggctggaatgatctcggctcattgcaacctccgacgcccaggttcaagtgattcttgtgcctcagcctcccgagtagctgggatcacagatgtgcaccaccacgtctaatttttttatttttagtagagacggggtttcaccatgttgaccaggctggtcttgtactcctga

SEQ ID NO: 187147 - DNA, 270 bp, Homo sapiens
taatgttcacggtacagaagtagctgcaacgaaagcacttgaccaaggaagctgcaagaatagaatgttttgatcaaaggatgtttctgaattttttaaaaattatgtttaaaggtgaaacacaatcatttcataaaatccagggaaggctgggtgcaggtagttacgtgtggtgaaagcagaaagacatgactacattttttgatggcatctatttcctcagtgcaacagaagcaagttcatcaaatcagatacatacggagagtgagg

SEQ ID NO: 187148 - DNA, 184 bp, Homo sapiens
ggcaaaccagagaatacagtacagtgggatcaatgttataaacgtatgtacattgtactgtgagaacacaggggtgaggaagtgagaggagtcaaatatggccaaactatagagagtaaaggggaaagtggcataaaagtaggctggagagtttgggagaggtcagatcatatgggacagtttg

SEQ ID NO: 187149 - DNA, 439 bp, Homo sapiens
gagattacaggcatgcaccaccatgcctggttgatttttgtatttttagtagagatggggtttcgccatgttggccagggtggtctcaaactcctgaccttaggtgatccacccaccttggcctctcaaagggctgggcttacaggcgtgagccactgcaccaggccatcataggtaccatcatttgaaatactacagagctgtaaacatggttgacagaatggtctgaagtaataactcatgtcttgctggaggccagcaaattttttttttcatatatatatagttttttaaattatactttaagttctagggtacatgtgcacaatgtgcaggtttgttacatacatatacatgtgccatgttggtgtgctgcacccattaactcgtcatttacattaagtatatctcctaatgctatccccacctccccccaccc

SEQ ID NO: 187150 - DNA, 635 bp, Homo sapiens
cacaaagtgccaaatacgtacatcataggattatactcattcagaacaggtaaacttgtcatctaatctaatgctgaagagtgaaatgctattattttaaatcaaaatatttctaggcttgtgatttttttttactgttccaacgaaaacaaacaactctcatcattttgggtggtttcataaagaatggaacttctcaattctatctgcagaattctacatctgtatgataaaatgtaaaatgcccagccttagtagcccttaacttctttctggctccagttacccaatcagaagtgaggcaggtaggactttcctgtataaattcagaggcagttgtgagaaataaatgaaatcctggatgtgagaactggaaaatgtaagggcccggagtgatgagggtggatacgaatgtgctctcaaaatcaatcttaaaaagagattcctggaacctctatggcccctatgcacgcaaacaaacctcttacctccactttgtctattagatatgatgaatattataattccttgcattatttcctttgtctaagtacttgagtccaattttgggagcaaagtgggagaggaaatcattacagaggctgtttagatgctagattctgatgaacgtgaca

SEQ ID NO: 187151 - DNA, 444 bp, Homo sapiens
gatttgaaccaagatccttccattacacaacactgaatgaactcaggagcgtgtgtgtgtgacagagagagagagagagaaggaaaaaagacggagaagaagagacaaggagacgaggacagaagacatcttggagatgggtttaggaagaagtcaaaaagggacatagagatgggagaaacactgttagggactggtatgttgggagacagtaaaagatttcaagaagaaatgataaccatttcaaattctttggaaagatcaatcaattaaagaactgaaaaaagtcttttgagttccaacaagatcttttggtcaccttggaaacagcagtaattagcaaagtagtggggagaagctagtgtacaacaggttgaggaatgactaggaggcagggatgtggcaatgatgaacagactactctttcgagaatcagctgtaaag

SEQ ID NO: 187152 - DNA, 731 bp, Homo sapiens
gaaagatgaaggagacattaactcttcttctgaagcacaaatcagaacagatatttttcacgtgttgagcatgtatgtgccccacctgggtactgggcagcatttctgattgaacactgccacagtgcttgatgcaggtttacgtgagccccaatttcacgagggggtcccctctcctccctccctcggatgtctcatgtctccatctgcactcttagtggcctggtctttctctgagacaattccaggctggttcccctgctttgctaccccccacaacctctcccacaccattgcccagctcccaagagctcactgtggctgaggaaagggggtgccttgacacggagttcccttcccatgagggtccccagacacttctcctggaagagctccaccaggacccctgccacatgcgcctgttggtgcagggaggagaggggagcaggttgtgtctgatgtgggtgtgtctgtgtgcaatggctgcttgtatccttgtgtgttgtgtacctgctcagcaaactgagtcctgtggccaagaatgatcctgggcaaaactgaacacatttaacccaagtttgatttcaactcaacactttcccattgtgcctccttctcatcccaaatgtgccaaatacttctaatcttagtattcgttctttgctttgtctgtcaggtcctgttctctacgagtgaatatcctaaggaccataataaagccagttcccttt

SEQ ID NO: 187153 - DNA, 398 bp, Homo sapiens
aatggcgtgaacctgggtggcggagcttgcggtgagctgagattgcaccactgcaatcttgacaatccactgcaatccagcctgggcgacagagcgagactccgtctccaaaaaaaaaagaaaaaattagccaggcgtggtggtggtggtagatacctataatcccagctactcaggaagctgaggcagtagaatcatttgaacccgggaggcagaagttgcagtgggccaagattgcaccattgcactccagcgcgaaactctgtctcacacgcacacacacgcacacacacacacacacacactccaggaggaaagaaaataaaggacaaaaagtgggagaaacagatgaaacagaatcaacaagctactgacaagtgtggaagcttgatgaggca

SEQ ID NO: 187154 - DNA, 362 bp, Homo sapiens
ttctacgtcttccgtatatttggttcctcttgttttccccaccaaatcaaaatatctctgttgcttcacaacactggagcacttctgtggacagaggtagaatggatccagtccctgtaattccctgtcaggtggcaatccaaagccctcccttcaactatcttgttggggagttcatgaggccaccctactgcctgctccattaactgagacttttctgaatagcttttacagccctgcatcattagcctgattctacctattcaatgtgattttcctcttctccccaacattcatcctctgttccaaaccagctgttcttacttcttcacattccctggtctttcccttccctgtgcctg

SEQ ID NO: 187155 - DNA, 440 bp, Homo sapiens
agactgtggcatgacttttctcagtttgtagtacaccttattcatattctctaaaagcacctcagttacaaagtgtctcagttgttgctttttctcagcactggattttaagaactagtctccttaaaacaagaaacatcaaattaaatgcctttgttaaatgaacaaagtatgttcagctttgagatttatcatttgaataaaattagagtgtcagtgccagacacctacctacgaaatatttaaacatccttgaagtggacttttggcttttggatactccctccataccttggatgggtccatgtcaccgtattcatcgtggagtggattggtctgaggagtgacttgagaagacttcaaaaaatatgactacaaaatgttgtttacaggtacaatcctgtttttaggagattgagaactaggctgtgtgtattatt

SEQ ID NO: 187156 - DNA, 497 bp, Homo sapiens
ttgattacctatttaaaaatcctgtctccggccgggcacggtggctcatgcctgtaatccctgtacttagggaggctagaggtgggcggatcacttgaggtcaggagttcgagaccagcctggccaacatggtgaaatcctgtttctattgaaaatataaaaacgagctgggtatggtggcgcatgcctgtaatcccagctactcaggaggctgaggcaggagaatcacttgaacccggaaggtggaggatgcaatgaaccaagatggcaccgctgttctctagcctgggcaacatagtgagactctgtctcaaaaaaaaaaagaaagaaaagaaaaagaaaaagaacctgtctctaaatacagtcccagtctcaggtggaggtcaggaagggctttgccataggagtttgagagggatacagttcagccatgacagaatgtgatgaggaggtgcaggctgtctctccacctgtcacctgtttacaaagctgatctc

SEQ ID NO: 187157 - DNA, 204 bp, Homo sapiens
gctcccacccccggccagtggtcagtgcatgtgatgtgtaaagccacatttcaccagtaggggatgccattgaaccccctgtaaaagcaaaacacacttcactggctccctgctcttgagacacgaccacgcccagctatttttttgtatttcttgtagaggtggagtttcatcatgttgcccaggctaatctcgaactcctgg

SEQ ID NO: 187158 - DNA, 118 bp, Homo sapiens
gttggttgataattttatggtattccattgtatgaagatactggtctttacttaatcagtcctgtattggtggaacttagtggacatttgttttgtttgttttttgcattaagaaaag

SEQ ID NO: 187159 - DNA, 430 bp, Homo sapiens
atactgaattttctggtcctgggtcccttcactcttggcatacatggcaattataacctggcccttcagagtaaagagtcacttagcatgaaaataagactatggatcttggggccacaatatcaaaaccaataaaaataattaacatacaaaactgcatcttgtccctgatttggagtcaaaaggctggtattcaaatcctggttctgtcagttctgtttcaatttctacccaatgggaaaagtctgtggatgagtatagttgaaatcctggttccttccaagttctaaaattacatgaatgctctctagggaaaatgatttagaaaattaaatataaatgccagattatgcaatgattttaaaatagaaaaggatgtataggtaaatgctaattagtattatcatttaattccaaaaatcaaaatttt

SEQ ID NO: 187160 - DNA, 559 bp, Homo sapiens
aataacaaacaagaaaggatcagaactcctatgcattgtgcattacacattgcagatgctgaaaaaatgtttcattcacagggcagacactcactgagcgctctgtttgttttattatttatttatttttattttttgagacaaggtctccctctgtgcccaggctggagtgcagtggcaccatcttagcttactgcagcctggaactcctgggctcaagcaatcctcccctcctacgtagctggggctacaggcacacactaccacatctggttaattttttaaactttttgttgagacagtgtctcaccatgttgcccaggctggtctcaaactcctgggttcaagagatcctccagcctcagtctcccaaagtgctggaattacagactttgtgtcaagtcagaagaaattaaggcaaggggcacttccaaatctgttaagacccattcacctgcatgtgcagttttgggatttgctcctcaaaaactctgagcactcctagatgaatcaagttcaaaaatattctgttagagaatctggcctgagtaaatagaag

SEQ ID NO: 187161 - DNA, 305 bp, Homo sapiens
acgagaattccttgaacctgggaggcagaagttgtagtaagccaagatggcgccactgcactccagtctgggtgacagagcaagagcgagactccatccctccccccaccccccccaaaaaaaattaacctgaaagggcttgcgtaagcaccacctttctcacctgtggtgacagtagggaaatgaggtgttctgtggagctgtcacaagactttcacaaatcagtttagataaggattctggcttcaacttttggtagcacaaacaagtgtcaccttggtgtttgctgctatatacagctagtt

SEQ ID NO: 187162 - DNA, 599 bp, Homo sapiens
ttataactctagcagcattgctgcattaataatttaagaaattaaaaattaatgggatgtctacaacttgccacagtgcttggcttatagtaggtgttcagtacgtttatgttcaatgaattactccaaatgcatgttgtagaaatttacaaaatctgatgagttaggttttccccctgtagcgagaaggagcaaacaggaggtttatgagatgtgctgcctccttgtgaggtagtcagtagactaaaattgcacatttctggcctagaaaatatcatagatcattaaaaatctttggtccaccttttgagactcactgtctctcccagtacccttcaagttttgcaaagcctcattacgtgaggaatccagacagttttgacagacagtgctattgaggtgggcataactgcctcttagcaagggacagcaggatgtcccttgtagtatagattgtacatatctattgtagatcatatgtgtctgttgtagtatacatctataatacaggaccataactcgaggaatatatggggtatgtgggactttgagaagacagttctgtataacaaacacatgacatttaatagctgtgctac

SEQ ID NO: 187163 - DNA, 394 bp, Homo sapiens
tgtaccccctttcccctccaagtataagggcagagttttggatctgtacacagtgtgaaagatcaagtggtcccagagaatgacaacctggctgtttcccagccccaccaaccaggagacatcactcctagagaaaaaaactccacttcccagggctaccccaggatttcagttcccactttggcaggccccactggagacttccagaaaaatcagagaaagctctttcctttggagttgtaatggtcacaacaccctgcacacagtgcactgagagatgttgaaagctgacacaccaagaagggatggtttgcctattagcttctagctttcttcctattgccaagtgagctgaatgaataaaccagcccaatgaaagtgaccagccagctat

SEQ ID NO: 187164 - DNA, 424 bp, Homo sapiens
tgacccatggggaggataccctagagatctaatgagcctgagagccgcaaggcctggaaagctgtacaacaagggaagcagctttggaacaatttttcaggttttgttcttgtaatcttttatacttccccctttatctcagtaatatcctttatgtttcctcctgcctttatttgctgaatattttattttcactactgttttatagatccctaccaagaagaaggatgaagaacttaatagcaaaagacgagcacaattgccagagatgcgagaagaaaggacctcacacggttcttgacttttctacagagctcactgcacattttcccactaaaatgttggggttccactcccatcacccagactggagtgcaatggtgcaatcttggtgctgaacctccgcctcccaggctccagcgat

SEQ ID NO: 187165 - DNA, 380 bp, Homo sapiens
ggaagtctggcagttgccatctcaaccaagcatcaaatttggcatccctaagggtagggcaagctgccatgctgagcttcccaggtgatgtcatataaggtacacaccatcactcaggaagaattcgcaccacaagaatgtttatgctaaatctaactgagtctctagacccaaattccagttcacggggaataccaaggatagaggaacaagtcaaacaaccccttaaagaaaagttcagacaagttcagaatgtgagacatgctatatgaaaactcccaaggacttgacaaaaagtcttatcacaggggatttttttaaaaattctagattttctagattaagagactaaaaacaacataatgcagtacataaacctt

SEQ ID NO: 187166 - DNA, 313 bp, Homo sapiens
aggtagggattcgaatttaggctgctatgctcctcatcttccttcctctctctctgtgtccctcccaacatcaccctctgcatagattcatgagctgttaattttgtccgtgatgctcctattgctcctctttttttctgattttagttgaagtgtcacctcccagagaagccttcctgattggatcaaatgcccggcccgggcaccaagaattaaagttgaaactttaattctgtccgtgtgatgttgagtaatacccatttcttccactggattgtaaactccctgggggcagggatggcgtctgcttttt

SEQ ID NO: 187167 - DNA, 176 bp, Homo sapiens
ttatcccaagtagctgtcagaatgcctttaaggtaggctgccttgttggagaggccagtgtgctaccaagcaagttacaagaagatctggaatgaggcagactggatttgaatgaaccctgttctgccactttctggctttgagaccttaggcagttaggacctctctgaccctca

SEQ ID NO: 187168 - DNA, 251 bp, Homo sapiens
cttatacatatttgcttattaaattgggtaggaaaagaaaggagaaaaaatgtgccttttttactctctcgtatcattgcctttacccacaataattgtggatttgaactagtgtttgaaatcacttgttttcaccctaaagaacttcttttctttcttttatggttagtgtacttgcaatggattctcaagtttttttggtttctatttgttttttaatttgaggattttaaattttcaccctctgtttt

SEQ ID NO: 187169 - DNA, 193 bp, Homo sapiens
ttttgtagtatccaataggcacacacatttcattagtaaataactgtgattattcctcatgctcataaaagggtttatgagaaggaaatttagccaagagactgagttttccaaatgagactgtttaaactgtcacagcaagatgctggatgggcaggtttaatgtttaagttgtctgtgtcttctccttccc

SEQ ID NO: 187170 - DNA, 253 bp, Homo sapiens
tccacaggaggagagaaacctgagttttaacagataagatagcatgatgtttctcatttttaaaagaggtttacacattaaccattactcatcaattcctaaccttgatgttaacaaagaatagttttctgaccagacagagccctttttctcccccagagacttcatccaattaaactaaactaggtgtgcttctttagtacatacgtagtgtagcataactgctatttcttcgtgcatgtcttgaactaca

SEQ ID NO: 187171 - DNA, 623 bp, Homo sapiens
tgctcccttctactacacatctaaagacataaagtaaccatccgtaacagatggctggttactatggtccaaataatagatggtccaaataaattcaaaatctaggtaatgtatggtaagacctcctaaaacaatcattgtattaattttaagtaaataagagccacaataccaaatttgaattgttaaagaatcccaaataaatatagagtaatcaaatcctatatagctgacatgataaaaacactgtatgaaacaaaaagaaatgaatgtcaattgacatcctatcctaatacttgaaggttcatcaagaaaactgaaacataaattttataataatcatagatacatctatttaacctacaaatcacactcctctagtcaatgtttctcaaacttttttttttttttaggcagggtctcaaccttcgcttccccagctcaagcaattctcgtgcctcagcctcccaagtagctgggattacaggtttgcaccaccatgtctggctaattttttgtatttttactagagacagggtttcaacattttggccaggtgggtctcaaacttctagcctcaagttatctgcccactctggcttcccaaagtgctgggattaatg

SEQ ID NO: 187172 - DNA, 133 bp, Homo sapiens
gacggtgctaggagacaggaggtcgggtttgcgggagaggacggtgctaggagacaggaggtcgggtttgcgggagaggacggtgctaggagacaggaggtcgggtttgcgggagaggacggtgctaggagac

SEQ ID NO: 187173 - DNA, 478 bp, Homo sapiens
tctgccatgccaactgtcaccacagaagaaagacccttacaatgtggaaggtaaaagttcaatttctaagctctgggcctgttcttcagaggctaaagaatctcctcatctccagtgaagccatccctggaatccctcactgattcagctggagtatggaggagcttaagttctaaagacctattcacttcctttaattccacctatacttcacaactgagaataccacaaacagttgggccctagaagaaagaagagctcacagatcttgcacttctaggtctgaattgtccaagtgaagaacgctcatttactccacatcccacagataactatctctcaagtgatcccagtatgaaagtctggagtatgagtataatatactcactgtaatatctgagtacaggaagttcacttcagagtcttcattctctcaaataagacagacacttttgataaagattattttatttaattg

SEQ ID NO: 187174 - DNA, 116 bp, Homo sapiens
agacgtgatggttggtggttgtagtggtgaattatttctaaagtttctggagctatactgcctctatacagaatggtaagttattagttaggtgagttgtttttctgttgttttgt

SEQ ID NO: 187175 - DNA, 222 bp, Homo sapiens
agaagcaatatttcctatcaaagacttttcctttgttgtatgtaataatttcccctgactcagcactataaggatctgaatgtttttcttctgttacaggaagcgttggtaacccggatacagaatcaatcttataaagcatcatataacaagaaagatcagtcagacttagtcatgaaagacaggagccagattaaaaactaggtattttttgttgttgtc

SEQ ID NO: 187176 - DNA, 148 bp, Homo sapiens
aagaagcagcggccacagcataaactatcaagaatgtccccaatattcccaccaaaagccccactgacttaaaacaaacaaacaaacaaaaaaacacacacacacaaatatacacataggttacaaattaaaactgaacagaatgata

SEQ ID NO: 187177 - DNA, 241 bp, Homo sapiens
ccagtccaggcatggtcagggcttcctatggctgagtgatgacgatgggcatttaggagaaggcaccaaaatggcaggtgtgggagacaccttcattcctcccacagctattgatctggtatctaccaggtcctgggcacgtgcaaaagtcatcagccagacatgtctgcagatcttgttttctctttggaaggacgtagacattgcccgaaagctactttactctccaggcagtgaatgg

SEQ ID NO: 187178 - DNA, 465 bp, Homo sapiens
tggttgctcaacaatgtcaatgtactcaacatttcaaaacagcacacttaaagatgggtcagacagtaaatcttatgttaagtgtattttaacacagttgcagagaaaaaaaggcaattacaaactagattatcacgatggctgcatactgtatggatttactaaaaataattcaactgtacactcacagtgagtgagtttcatgatatgtaaagcatatgtacatgaaatggtttttaggaagacaattacatacttggctatccctgtcattgaaaggaccacagttatgtgtgtgtttttttctgtgtgggattcccagcatcttaagctcgaaatgactaaagtagcgaggttgagtcccataaatcatgatctgccactgcaaaagtattgcccctttggacctctgtttattcatgccaggaagcaaagtcgactgacttggtaaccacagctgcttca

SEQ ID NO: 187179 - DNA, 301 bp, Homo sapiens
taatacacttataaaaaattagccggccatggctaatttatttctcacagatctgcagactgggaaatccaagatcaaggcccatggcatgggctggctttctcacagatggtgccttcttcctgtttcctcacacagtggaaggggcaaggaagctcctttgggccttttataaaggtaataatcccactcatgagccctcatgacctaatcacctcccaaggtccccacctaccaccagcactctagagaagatgatttcaacatgaatttcaggggcacacaaacattcagaccaggg

SEQ ID NO: 187180 - DNA, 538 bp, Homo sapiens
tccggctcccatattcaagcaattctcctgcctcggctccccagtagctgggactacaagtgcgtccaccaggcccagttaatttttgtatttttagtagaaatgtggtttgtcatgttggccaggctggtctcaaactcctgacctcaagtgatccaccggcctcggcctcccaaagtactgggattacaggcgtgagccaccgcacccagcgcaaatgtgtttttgtatcagtctgtgtctgggtgaacatgaaacctgggcgcatccagctccatcttatggcgtagatggaggcttggctgtgaggtgtacgcgtcggtgtgtctgtgtctgagcaggtcaaaatgacccttcattgtgtcctggtgtgtatctatctgtccacctcaactccatgtacgctgttacgtggtgtgtgtctctgaatatacagggacatttaagtttctgtgtgtgttggcatcagcctagatgtacattgcgtcgctaggtgtttgtaatcaatgtgtacatgtgtgactgtgtgtttatgtgt

SEQ ID NO: 187181 - DNA, 579 bp, Homo sapiens
tagctggatcaccctattccatacaggggacagcattcaaagttctgtcgggagcctcagattccttgtttggtaatgtaggtgtcagtctcgcttctgaaaaccagggttactgagaggtatcactgcatttaggaccctagtccttcctgaggaccccgatcgtatgttgtggcaatgcaaatgtggacccaaaaaacctgagacaggtctcagttactatttagaaagtttattttgccaacgttgaagacacgcactcatgacccagcctcaagaggtcctgatgacacgtgcccaaggtggtcaggcacaggttggttttctacatcttagggagatgtgagacatcaatcaatatatgtaggaggtacactggttcggtctggaaaggcgggacaactggaagcgaggcaggaagactcaaagcagggaggggttttccaggtcactggtaggtgacagacaaaaggtcgcattcttttgcatttctgattggcctttcccaaggaagcaatcagatatacatttatctcagtgagcagaggggtgactttgaatagaatgggagggaggttt

SEQ ID NO: 187182 - DNA, 622 bp, Homo sapiens
taaattttctgtccttagcgcatatgtatatgtgtatgcccctccccctgtttttgcttttctgtaccagggatcagctttctcccctcttcaccctcctcttccctttgctctagtctgtgtgctcgctcttgtccagggaacttacttttttatcttcacgtatgttactgactcctcactctgacttatagcagccagttagctgtggcctcattgctcattctgatggtgttctttttggattctgccaaatctctttcgcatttgtttttcacctcagtactccacgctgtcagcagttcagcaagccctttccaagctaatttttccccatttactttttaattagttttcttctcctgcttctccacccccttgtcctgcagttttttgtggataacagttgagagccccactctttcttatgtgatttttaagaaaatgtgggtgttgacaaaaagagtcaaactctgtaaaatatttgaagagatttattccgagccaagtatgagtgaccatggcccgtgacacagccctcaggaggtcctgagaacatgtgccgaaggtggttggggtacagcttggttttatgtattttaggaacgcagtcatcaaggca

SEQ ID NO: 187183 - DNA, 299 bp, Homo sapiens
tgctgggattacaggcgtgagccaccgtgctcggccaatcgaaaggatttaagcagaggaatgacctgctaatttgtcttaatacggttactctgctgtgtggagattagactcgaggagataagaacggcagcaagaatacttttgcattcatttggacaagatgaaattgcctggtatggagagaaacaaatatcgatagaaattgtgaaggtagaacaggaaggactggctaatagattgaatgtggggttttggtttaaataagatgttaagaaagtttcttggggaaggactaa

SEQ ID NO: 187184 - DNA, 982 bp, Homo sapiens
tgctggaattacaagcatgaaccacacacccagcctgttctctggcatagtttctaggaatgcacttcagcaataaccaggaacagtctgtactcacagacagctccttatctcaactgctaatcatggattccatttcctgggtaaacagtggtatcatctcacgcactactgcttctctgcagttccttcacactttgctgtggtttttcttttcagatgcccttaaaccatatttagggcattgtggcacagacccacctatctcctccaaccttacatttaccattaagtaggtggccatgtgacaagtcagtacagttgttcagcatcactggaggagtggattggcaatatgcaaagcggcaaaaaatggaaacgaacttatccaagagcttctaacataaacagcaatgctaagttgattcaaagcagaaatcagtaaagccacatatccctatgtgaagcaaaacagattttgaggtacatatacgacaagcctgagtaggaagttcagatgacaataactgatttactaagggattttggcagaattcttacccctgaagccagaaccacagtgggagcactagtaagcagttggggatgcctgtcttagtcattctggctacgaatgcctcaaagtcaaatgagatgctgtagcaccatgattcctaaatctgctgcctaagtagatgaatcagcagaaacacttattaaaaacccagattcccagggatctcaagaagaatccgatgcagtaagtttgagatggtggcctaggtagctatcagcagatgattcttataaccaggtaagtctgagaaagtcgttaataaacttaacagattttagaaccaccgataacaccacgaattttattttatttttttgagatggagttttgctcttgttgcccaggctggagtgcaatagcaagatctcgtctcactgcaacctctgcctgccggggtcaagcgtt

SEQ ID NO: 187185 - DNA, 633 bp, Homo sapiens
ttttcctttcttgtgccaagtgcttcagagttttcaggatatgacacgtaatttctccaagaacccagtaaaacctggtatcctgccgggcgtggtggctcatgcctgtaatcccagcactttgggaggccgaggtacatatacgacaagcctgagtaggaagttcagatgacaataactgatttactaagggattttggcagaattcttacccctgaagccagaaccacagtgggagcactagtaagcagttggggatgcctgtcttagtcattctggctacgaatgcctcaaagtcaaatgagatgctgtagcaccatgattcctaaatctgctgcctaagtagatgaatcagcagaaacacttattaaaaacccagattcccagggatctcaagaagaatccgatgcagtaagtttgagatggtggcctaggtagctatcagcagatgattcttataaccaggtaagtctgagaaagtcgttaataaacttaacagattttagaaccaccgataacaccacgaattttattttatttttttgagatggagttttgctcttgttgcccaggctggagtgcaatagcaagatctcgtctcactgcaacctctgcctgccggggtcaagcgtt

SEQ ID NO: 187186 - DNA, 571 bp, Homo sapiens
tgctggaattacaagcatgaaccacacacccagcctgttctctggcatagtttctaggaatgcacttcagcaataaccaggaacagtctgtactcacagacagctccttatctcaactgctaatcatggattccatttcctgggtaaacagtggtatcatctcacgcactactgcttctctgcagttccttcacactttgctgtggtttttcttttcagatgcccttaaaccatatttagggcattgtggcacagacatctcctcctacacagtgcaagggtggcttagacatggccagagatgttgaatagtttggtgcctgagcttgcgttctctgccaaagccagcaaaccaggtacctccacgcacggcagacttgtgaggggacactgccactgtcttcacgttgtccacagttgtggggcagccaaacactcccacgtctgcggggaaggaggggcttcaggcggcgtttgccctgcttgacgcctcaatgacatgcgatgagcgctgtctcctgctccacagatgtaggccgcagcacccgcagcaccactgatcacgtctaaa

SEQ ID NO: 187187 - DNA, 1011 bp, Homo sapiens
tgagacagggtcttaccctgtcacccaggctggaggacggtggcacaatcttggctcactgcaacctctgcctcctgggttcaagtgattctcctgcctcagcctcccaagtagctaagattacaggtgcctgccaccatgcccggctaatttttgtatttttagtagggatggggtttcatcatgttggccagccaggctggtctcaaactcctgacctcaagcaatctgcctgcctcggcctcgcaaagtgctgggattacaggcgtgagccacggcacccagccttgtcttggtttcttgttcaatcttctttgtctttactcttcctcttttctggtgacataccaagatgacctctcatcagagctatgcctcctttcccacacacccttcctcttttaacacctgctgtcttgcgcacatccatatgtgtttaaacagtccccgtctctgacgcgggctctcctcttgaagaataaactggaagaactctaaagcatggagctctttgtcagatgtggtattcttagacgacctcttttagttagttacatctcccaagatcttctatgatgtgatctcaaataactgttcaatggcacctcactcgctcatattattcccagctaaagagcccttcaagctaagaacttcactgagctgaaacctcagctcacgtgatttgcttcaaaatctaccagacataattttaaaaagagggtgtgtgtgccattagggtgatgaaaacgttctgaaactggattcaggtgatggttgcacaactcggccaatttactgaaaatcattcaattgtacattcgaaatgagtgaattttatggtacataaattacgcttctgctgtgcgtggtggctcatgcctgtaatcccagcactttgggaggccaaggcaggcggattgcctgagcccaggagttggaaaccagcctggacaacacggtgagaccccgtctctactaaaaatttaaaagttagctgggcgtggtggc

SEQ ID NO: 187188 - DNA, 1064 bp, Homo sapiens
tgagacagggtcttaccctgtcacccaggctggaggacggtggcacaatcttggctcactgcaacctctgcctcctgggttcaagtgattctcctgcctcagcctcccaagtagctaagattacaggtgcctgccaccatgcccggctaatttttgtatttttagtagggatggggtttcatcatgttggccagccaggctggtctcaaactcctgacctcaagcaatctgcctgcctcggcctcgcaaagtgctgggattacaggcgtgagccacggcacccagccttgtcttggtttcttgttcaatcttctttgtctttactcttcctcttttctggtgacataccaagatgacctctcatcagagctatgcctcctttcccacacacccttcctcttttaacacctgctgtcttgcgcacatccatatgtgtttaaacagtccccgtctctgacgcgggctctcctcttgaagaataaactggaagaactctaaagcatggagctctttgtcagatgtggtattcttagacgacctcggggaataaaccacttaacacagggagctggagtcattctctttggaaacagcttttagttagttacatctcccaagatcttctatgatgtgatctcaaataactgttcaatggcacctcactcgctcatattattcccagctaaagagcccttcaagctaagaacttcactgagctgaaacctcagctcacgtgatttgcttcaaaatctaccagacataattttaaaaagagggtgtgtgtgccattagggtgatgaaaacgttctgaaactggattcaggtgatggttgcacaactcggccaatttactgaaaatcattcaattgtacattcgaaatgagtgaattttatggtacataaattacgcttctgctgtgcgtggtggctcatgcctgtaatcccagcactttgggaggccaaggcaggcggattgcctgagcccaggagttggaaaccagcctggacaacacggtgagaccccgtctctactaaaaatttaaaagttagctgggcgtggtggc

SEQ ID NO: 187189 - DNA, 681 bp, Homo sapiens
caagcctgggtgtgaacaacctgagcgttctgcgctcaggaaaactagggtgcaccttggctgtctgttccattccctgccagcttaagcatccacccccatcagtccacccctgctgcagtcttcgcttcttctgttgccttctttgccaacctcagcctctttcctcccctgtagggcccttagcaaaggcgcaaggagggtagaggcctgctgattgggcattagaatgtgctaatcccccatctatgacatcacactgggtggctatggggatgtcagtactacaaattttcagtatcctagctctctccagcgctggggttattagaggacagaaggccttagaaatgggagggcctcctgggttagtgccactgaatacagctgtgcaggtcgcacactggacaacttcagggcaacatccatgtagactaggtcacaaatagtgctccccagagttgtagttaacaacctacacagcgccatgtggcagcctaggaggcccagagttcatacagagaaggagaggatggcctgcagaccttggaatcactttgtctgccttctagtctaagcaggaccctgtagagtggaagcagattcttgtctaacattcaagcagctgtcccattgcaagttcccttcttccctcctctctggcatcagcacactcacata

SEQ ID NO: 187190 - DNA, 520 bp, Homo sapiens
attgtaggatagtgctgcttcacagttggaaacaaaaaggaaagctctgaacccaagaaggaaggagaagaagcacttgaaaatggagagccactgaatcaaggaaaagacaagaaaattctaatgctatacaaataaaccaatgaaatgggtatttctgataaacatgtttttaaaagtaaagctgaaactctatttgtaatacagaataattaatcccaaacttcaattccgtattacagctagctgaggagaaggagaaagggggaggaacatggtgacaaaaaaggatacaggctaaaagggggcttgagtaagtacacaggtgggtgtgctaatctgaggggaaatctcaaaccttgctgtttactggccacaagcctaagaacatataatttgttgtatctgccctttgaaatttcagatgacttgactagcattttagtatgattctttttgtgctgggattatttaaatagaggagaaaagaaagcaacttacttgaagacgagagaagtga

SEQ ID NO: 187191 - DNA, 1181 bp, Homo sapiens
aggatcccccagcgaatgtcttctcagtcaaccccaatcaacacacaaggtcttcagcctgcacctatgggtactcagcagggctcagcctgaatggaaatgacttcaggcacgtggtgttggcagatggagccacaattgtggcctaccctattagcaatccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagacttctctccttcagacttcggggaccgagctc

SEQ ID NO: 187192 - DNA, 361 bp, Homo sapiens
ctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgccacccctcttcctgtcaccagcttttcctcagcatccacaggtgacagcacccctcttcctgtcactgacacttcctcagcatccacaggtca

SEQ ID NO: 187193 - DNA, 1378 bp, Homo sapiens
aagatacggggaccactggagaggctcttctcagcagcccaagctacagtgtgactcagatgataaaaacggccacatccccatcttcttcacctatgctggatagacacacactcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagacttctctccttcagacttcggggaccgagctc

SEQ ID NO: 187194 - DNA, 385 bp, Homo sapiens
tgattaaaaccttcaattttgccctatctcctaactggagtcctttaatctaagcactattctcacctctttccagccattagattgaaaaccttatagggacagattaccaagagggccaactccccaactccgagttccccaaacttgtctgatcatataattcacctgaaacacttgataaggatttccagatcccaccccagatctaaagaacaagagcctcacaggcaccgcccctctccaaacacacagccctataatgtcccaggagattcttctcttaacagtctttaactccccctgcaaatagctgaggtcattctcctcaagttctttccaaggcatgctctttgaccctttctccatggcttagtttagcact

SEQ ID NO: 187195 - DNA, 384 bp, Homo sapiens
ctatgtgctgggctgcaggctgcggtggcgggcgaggcagctagtccagcgaggcagctagtccaaagggtgcccttcgtctgtggcctcagatggccctgtgtgaggcgcttggcttggttagagttgtgtctcttgtctgctctctctgtgtaatgtcttgtcagccgttttatgggatggatgtgttcttggggtgtatggattatgcttccatcagtctgtacatttagtgggggccttggctccttgcggtagatattacacagggagaagcctctagtgaaacacatactctgtgacttcccttttctaccagtgttgacttccacgtctctcactgacttattgcaagacccttaacagctgtcaattgctttttct

SEQ ID NO: 187196 - DNA, 648 bp, Homo sapiens
caacactcatgctgagacttaactcctaatgtggcaatactgaaaggtggggcctttgagatgtgattggatcgtaaggctgtgccttcattcatgggttaatggattaatgggttatcacaggaatgggactcgtggcttacagaagcagaacaaaggcagctaatcaaactgtgaccggtcttgcaatgcaagcatagctggtgaccttgcagctgcactgacaggaaatcaggaacttaaaacttgaataataagaaatggtaaggggaaaagagaaggtagtaaagggatttgttgttttttcctcttatccttgctaggggcagactgtgttgagagagtctctggaactaattcctcagggctctggcttttcagacagtgttatcaaggatctgctagggctctatctattgctggccttggagtcagtcaagtactgtgaagctcagttatgcagctgagcttcacacattaggggagataacagagaacagcacatctggagtgcaatggatgagcctcaaccttaggatgaaccactattggtgaccataggatttcccctaccaggtaagtggcagtccacatacctctgccccaccacagctccatacgcctcacctttacacgcatggtcacttg

SEQ ID NO: 187197 - DNA, 199 bp, Homo sapiens
gcaaggtgctggggatgtaactgtgaacagaagagtcccctgatctcatggagctgttaaaaatgtcatttggcagagcagggtggctcatgtctataatgacaacactttggtaggctgaggtgggagaatcacttgagcacaggagattgagaccagcctcagcaacatagcaagaccccatctcttttaaaaaaaa

SEQ ID NO: 187198 - DNA, 421 bp, Homo sapiens
agattgcaccaccacactccagcctaggtgacagagcgagactccgcctaaaaataggaaaccctctaggagcccgggaggcctctgcttctgggggagcatgagagaagtggcacaagttgagtatcccttacccaaaatgcatggtatcagaagtgttttggatttcagattttttttgggaatctggaatatttgcattgtaccagttcagcattcgtaataatgaaaatctgaaacccagaatgctccagtgagcatttcctttgagggtcatgttggcactcagaaagtttcagattttggagcattttttatttcagatttttggattaggaatactcagcctgtacttgtaaacccattgaaatgggtaaagttgtggaaagaagcacattattctgagctttcaggtttactg

SEQ ID NO: 187199 - DNA, 827 bp, Homo sapiens
ttaggaggtaaattaaaaaactaaaaatacagtgacactttgctttcctcatagtagaaaatgtcaaatcatattgtagccagtcatatagaaaagctttctcttggctgattttgtctaatgtgataaattacatactttggtatgtaatttttattttaatacataatcttagcagtgttcttcttttgatataacggcgatggtctatatataagatacagttatctctattagagaatagtaaaattgtccttaggagtttttatatccatctacaaattattgaaggaccagttcacagtttttggattattcaagttatttgcttctcagagagtactttttgttatgactctaatatttgttactctgtttttctgttgctcagcctgtagtctcctggaaggctctattctaactttacgttggctcattatttttacatgttcctactacttatactcatctctttgaagtctgacatccacagctctgattatttattcatattctagctttgtttcttctgttgtctgcatgacatcattacttgccccacaaatttagtttaatttgttattctaacccttgtcatttgtgctacttttctttttcacatcttttttccactttgatatatatttcacattctgtcagttcttgccccaacattctcagttgaaaagtaaagaacaacacagtagcagttagtttggtacagtagtccctcctttccctggggtatatgttccaagacgcccagtagatgcctgaaactgcagagagtactgaaccctacagtactttgttttttcctatacata

SEQ ID NO: 187200 - DNA, 711 bp, Homo sapiens
cttgacctagaggatcccgattgcattgtcttcctgagtagctgggactacaggcaagcgcacacgccagctaatttttttatttttagtagagatggggtttcaccatgttggccaggatggtcttgaactcctgacctcaaatgatctgcttgcctcggcctccccaagtcctgggattacaggcttgagccaccgtgcctggcctaaagtgatttatatgtcaacattacaatactacggaagtctgtatttgtctatatatttacctttaccagagagcaatatttttgtgttgctgtctagtgttttcactttaacttgaaagacttcctttagcatttcctgtagggcaggtctagtagtgatcaactcacttggtttttgtttgtctgggtaggtcttttaaagaatttttatttttatttttgagacagggtctcactctgttgcccagactagagtgcagtggcccgatcatggttcagtgcagcctcaacctcctaaggttcaggtgaacttccaagtagctgggactaccggtatgcaccaccacacccagttaatttttgtattttcagtagagatggggttcaccatgttgcccaggctggtctcaaactcctgggctcaaataatcatccatcagagctccaaagtgctgggattacaggctgagccactgtgcccagctgagtctttttttttttt

SEQ ID NO: 187201 - DNA, 349 bp, Homo sapiens
gaagctattggctgatcctcaaacatagttagctactggaagcaaccttgtatctaaaacaccatgttagcattgggatgaggtagctgaagtgaggtgagaggaagagaagctcacagaagagagttggcaaaagacgtttggtggaaggttatttaagatagaatttattctaatccagatcagagaagcagcgagagattatatagttggaaatgtggcccacatcaaccctaaaagataaggacatttttttgcttccctgttggaaagtatttggaattcatggcaatttagttttccactttgcacttggaaacttaatttcgtctttccccaaaggtctata

SEQ ID NO: 187202 - DNA, 550 bp, Homo sapiens
cttttctgtgtttcgggttcatccttcccttcttcccagtctgttacctttatcttactatggtgttatgatggggaggaaaggaagggtgctgacctcaacagggagccagcatattgcttaactaatccaagccagggcttgcatggaggatttttatttcccacaatatcatgggtaccctgtgcagggtggtgaggggtgctgggtgggaccatatcactttacttcgcgatgctggaagtgtttgggctttgggaggaaaggtcacaggcagcgttatggtttgagtatgtagagatattgggccttcactctccagctgcagtagaacgaggttggcaaacagcagtcaaacttatgcttttaaatgagatagagctgatactaatggacaagttggtgctatccccggaggaacatgaactgcctgtatttgagtatgtatatgtctgcagctctcggattatagtgttatggcttgttgtgccagagagttcttctcttttcaggctgcatagaatattttcatggccactgaccttgagaa

SEQ ID NO: 187203 - DNA, 648 bp, Homo sapiens
aatctcaatggttacctgctattaaggtctgccatattagagtttgcactatttgctaccaagtttgattcatacatctaaaacatttgtagttacttgtcaaggacttaatttgaaaatcatttgccaggccacatagttatcaatttttttttctatcagctattctgttgtatttctaaaacattttttagatgactttttaaagtatatttagcagtaaccttatgaggttcaaattggtaaatctcttgtaatttagccttcatcgaataataggtaccagtgtattaaaaatgtgtattttttgcagccccttgaaccagagtaggttcagagaaactcccaaagtttgtactttagacacatcatgcttgattggtaacttccctccttttttggggaacatgtttgtgtcctattaacttaattggatagatttttaaatatttcttatttttggcacacggaaagggtagttcgagtacagaactttgatttttggtgtagatgcagagggaatgatgggtaaatttcctaggtttatgtgaatttagggggtgtatgcattttgaaacaatctactaacagatggtgctgaaatctattacctacatgttttctagttgttcagcattatgttaatga

SEQ ID NO: 187204 - DNA, 527 bp, Homo sapiens
ctgtgctccctattctgtgaaaggggaggtgggacaggaccctgtcagctttgacaccatagagcggtggagggaaggtttctcagtggctccctctcccctcctacccgatccctgccttgctggtcagggcctggaaaatctccctgcaggcccccctcgctcctcgctcctcgctcctcgctcctcgctgagcagcctgatgcccttccccctggcagagccagtacgtcttcctgcacagctgcctactgaacaagattctggaagggcccttcaacatctctgagtcttggcccatctctgtgatgaacttcgcacaggcgtgtgccaagagggcagccaatgccaacgctggcttcttgaaggagtacgagctcttgctgcaggccatcaaggacgaggctggctcttacgcacccctgcctggctatgagcaggacagccccatctcctggtgggccctctggctgtgatcatatggtgctgactggcctcgcagggccagaggagctctgggagctggt

SEQ ID NO: 187205 - DNA, 179 bp, Homo sapiens
atctccttacctacaatgtggcttagtgatcttaggacaaaggtttggcttggagacttcaaagaggtttgtccatttcagactcttcaaaaacagttactggttacttacaaataacactttgtaattcaataactgaaaaatcaaaacaactttaaatagattttaaggctggagaa

SEQ ID NO: 187206 - DNA, 661 bp, Homo sapiens
taaagctatgatgctaagtttagagttctccctgagaaaataaggttcatatttcagcttatttttattatcttcctgccaacaacctcatccagcctacaaaatagggtgctattctgaatacaaaacgttattttataaattttgatccaatatgcagaaatgatattggacttccaactttattattctatcaaagatgctattcttaacactatctcacaattttgtcaaaaatatttaggagattgatgaaaactgcggcccagtgtcatatataagtaagcatattattctctaacaatgcagaattttattttcagatacagaatatctctaaacaccataaagtcaagttcttgaaaggatgagggacatccctccttcatattatctggatgaagtgagtatacctgagacaaaatggttcccaagtcgataggtgactacagttcactgatgacttagaaatatagtattttaataatgacaccaatatcaataaacaaagatatgtcctagaacgaaaaataatattttctagggaatttggggaaaattagtctcatactgcccagagaatcatcagacatattacaggtcctaaaatatgattctcagtaaatatttgttaaataatcaaaagtttcactctaatgtt

SEQ ID NO: 187207 - DNA, 485 bp, Homo sapiens
cactgtctgggaaaacttcagaaaagacttcaagaggggaggtggaggcagaggtcagatgtcaggatccatgtgtataaggggtacagaagaatgaccaggctgctcagggagagggttaggtataaggtgcaggcagggatgagactactgaaggatatgagcagcatccatgatctggggcgttcaggaagatgagaaaactggcccaaaccttgaacttcagaggccttgccatttctacatgtctcagaatcaagagaccagctgaggtttaacaactgtggtgccaagctgagctcagatgtgccaaatgaggaaacactggtctctaacatccacacactgaagtgtcaacgtgttgacacttcagcgagtgggtccctgcctatccagggtgacaccagtgactgcacatgtgttcttgagctgcttttcctccggcaaagactcatgtctcctgtctctttctgtcttgaaggata

SEQ ID NO: 187208 - DNA, 122 bp, Homo sapiens
agtatttttgaatggaatatgtctgggctttgcttcaaaatgatctgcgaagagggggagtaagttggagtatagattaaataagatcaaacatgatatatgaattgttgaaaatggataat

SEQ ID NO: 187209 - DNA, 467 bp, Homo sapiens
agagtaaacagttttttaagtttgggttatgaacaactcccttaatagaaagccaaatgtattgctttctactttataggaaaatctgtctcaaaagaaccaccacaaaacttttatttcttatgaaaatctatgtaactttcagacaaagataaatacaaaatattaaagattaagaaggcaaaggtcaaatgattcctacaagatcacctgacatcatctccctttaaaacaactcaacaggtaaactggaatcctagattaataatttgaccgaatgcccactgctgacagcaataaaaaggaaaaaatctgccaacaaataagatttttgtatgagataatgattcaaagctctaaatgaacatgtagagaaccaaaggtcaggttctataaaacttttcaaaagtatggtttaccttaaacaaccttaagattctcatcactatattcacacctgaaagaga

SEQ ID NO: 187210 - DNA, 328 bp, Homo sapiens
gcctatgaaacatccatgtgcagttttagtaaccagctaaatatctaggcaagtatcccaggaaagatgtctgtactgaaggaagagatttgggagtcatcagtttacagattttgaagctttgggagtggacaaacttaccaaaggtttcttggattcatttaataagtcctagagtgaggtggagaaaaagactagaactgagccttgaaggtcatcaatattttaagtgagagtagataaaaggagtgttcagaggaaaaaaagagaagctggtgcggaaggaggcacaccagaagagagttgtaccccaggaggtaagaaaata

SEQ ID NO: 187211 - DNA, 326 bp, Homo sapiens
aggagtgtttaggtgtttcttatggatatcagtttcatctgttcctaaaagagcctgcctcttctgattggccatcagacatcttcattttagagtcttgtcctagagcagttatcacttgtagactgatatggagactctcaaaatttttactttatttttgcctctctatagtccaaggcagatctaagatttattggtctttatgttggcattttgtgtattatagtttgtaaaatgcatccacagagggggaaaaaaatcaaatgtagtcactatgaaaaattgatgaagatttgggacctgtcatcctcccactacaccat

SEQ ID NO: 187212 - DNA, 415 bp, Homo sapiens
  misc_feature (37)..(37): n is a, c, g, or t
tctctcagcagaggttgcagcagggaggtgcttgctnaatatttattgaaggacccaggcaggagaatcgcttgaacccagaaggcagaggttgcagtgaactaagatcatgcctgggcgacagagcgagactctgtctcaacaacaacaaaaaaagaacacagtgttacccgtgtgtcggacattggctttgaaggtaggaaggacatagcacagggaaaaattctgccacttcccagctctcctgctagtgaggaaggcagatttaaagaaggcaacagaccgggtgcggtggcacatgcctgtaatcccagctactcgggtggctgaggcagaagaatcacttgaacccatggaggtggaggttgcagtgagctgagatggccattgcactccagcctgggcaatcaagcaa

SEQ ID NO: 187213 - DNA, 264 bp, Homo sapiens
ctgttatatatctatatttccccttgtctgtttgacagttctacctcatacaaattgaagcacagggaaaaattctgccacttcccagctctcctgctagtgaggaaggcagatttaaagaaggcaacagaccgggtgcggtggcacatgcctgtaatcccagctactcgggtggctgaggcagaagaatcacttgaacccatggaggtggaggttgcagtgagctgagatggccattgcactccagcctgggcaatcaagcaa

SEQ ID NO: 187214 - DNA, 146 bp, Homo sapiens
ggtagaagatgaggtccctagaccccctacttctccgcctcgtccctcactggccctttaagaaatccccccgcccacaacaacaaaacgtgtttgacggtcgtgactgttgtcccctctggttttctctatttctgatgctgatg

SEQ ID NO: 187215 - DNA, 253 bp, Homo sapiens
ctttcagcaaacatttattgagcctttatatggccagcactgtgctagactgttctttttaattattgtggtaaaaccacattccataaagtatataatcttaaccattttttttttttgttttttgagatggagtctcaattctgtcgcccaggctggagtgcagtgacatgatcttggctcactgcaagctccgcctcctgggttcacgccattctcttgcctcagcctcctgagcagctgggactgcagg

SEQ ID NO: 187216 - DNA, 160 bp, Homo sapiens
acaaaaggaaacaaatagataaacgggacttctctaacatttaaaacttcccttcttgttcagagaatacaagaaagtaaaaaagactgacagaaagggagaagaaaatattcaaatcatatatttgataagggacttatatctagagtgttaatgctta

SEQ ID NO: 187217 - DNA, 318 bp, Homo sapiens
tccctccttcactttatgttttcattatcttccctttctctaagataaaagtcacttctgtttcctaactgtgcaaaaatagttaaactggaatgatgtttcctagaattccttactctttatggttccaagttagggctgcccatagagaactttattcagagggtctgtctaggcctctaggtagtactgcaactcacatacgttgttgctgatcactggctcacctcctagatggggcagcagccaggcccactgctctttctttttcttttctttttttttttttttttgagtcagagtctcgctctgttgccc

SEQ ID NO: 187218 - DNA, 601 bp, Homo sapiens
tcctggcagagttgtcctctggggacaattaaggtagccaagttgggaagggcagttaacttattagttcatatcagattagggaggcccttgtgagaatgatgggcaggaaggcctgtttgtcataggacagcaccagggaaccaggcagaagccctgtattgtagtttcagctctgccaccaactaccagccatccagactgctatgggcccagctctacatcctacttgaaggcctctgaagagatggtttctaaatttctcttagcaataacttttttcattgcttttgtgtcctctttatattattttccttaatgttttcctaaatatgtgtctctgaaaacagaaaaagcacatcaagtgtttgcttagattggtaggtagagttctgatttggcctaattttagatttgattcttctatctagattatgctttgctcttgaatatgagcctcaaatgtaaaaggagagtcttttacttttcagctggcatatttcagagatggagacagcaggttattttcagcagatgtttgtgatgccatggaataaaatgaatagtgaaacaaattaatgtattctggaagtagatctga

SEQ ID NO: 187219 - DNA, 387 bp, Homo sapiens
gatctagaaggggaaggaaatcattccagaaaaaattttttaaaaacttctctacaagtatcctagtctgatgtaaatggctatatgattatagaagcttcaacagtatatgtattaatgtatactttatcattcttaattacaatgattttgctgaaagcatgtagcttattctcaatacatttgtttacagtttagaaaagttagtttttcatatattatgtgatactccatgtttatctttccccacttagtctatctggtataattttagatttctgaaaatatatttgagacatcaaaatattctattttcagtgattcagttcaatccgcaataatcccgttatctgctgtttctgaggatcagtgtagcctattaaacag

SEQ ID NO: 187220 - DNA, 344 bp, Homo sapiens
tgtcattccagtgaaaggcagtgacgtcttagtgctgcggtgagaatcctgttgacctctggacccctggaaggaaggcgctgggccctggggtctgtggagcctgctttcagaactgtaggattagatgacagatgcacggctgagcacagtgcctggcacgctcttggagtccagtacatgttacctgctgccattattatcctttcccccaactaacctgagtgacactgcctgggggagtggaggtggaagccattgggttaagaattcagtgtttgtgatttcaaatcctgctcaaggtgctaacatgtttggtcctcaggagtgagtgaagggcccag

SEQ ID NO: 187221 - DNA, 276 bp, Homo sapiens
taaaaacaatattcatgtatatggggtttaggatagagactacaaggaaacaaaggaaaatgttgaaagtaaaatgatggaaaaacatacacctggcaattttttttttaattttagtgtgtacatagtaggtgtatatatttatggggtacgtgagatgttttgatacaggtatgcaatgtgaaataagcacatcctggaaaatggggtatccatcatttcaagcatttatcctttgagttacagataatctaattacattctttaagttattta

SEQ ID NO: 187222 - DNA, 404 bp, Homo sapiens
gcacttacagagatcaataagaacaagtttaaaaacaaagagcatggacaggcagtttacagaaatgccaacagccagtatgaaaagagactggctttttaaggtaatgaaatgtaatttgagcagtgacattacactgggtgggcaaaggtgactgtcactctcgtggtttatgtccccttgagtcaatgggtaaggctggaattaaactggcaagtggagaaatgacagcagcctcacctggagtctgtttttttgggtggagcaacaactgccatgtccacagtaatgatgaatgcttctcgagccacgtcgctgccaaggtcttcacaggcatttctaaaaatgaagaatccttgactgcagacacgcaagttaaaaatcactaattatgttctcgatcc

SEQ ID NO: 187223 - DNA, 397 bp, Homo sapiens
agagtggtggctgccaggggcttgtgggagggtgaaaaggagtcattcaaaggatacagagtttcagtcacgcaagatgaagaggttctagagatctattgaacaataatgtgtactgtacacttttaaaattattaagagggtaaatctgttatgttttctatcacagacacacgtacacgaagataaaaagggttacatgtgccaacagaacaaagaaaagataaacgccaccttgctgaggtgaaatgacccaaggggacagcaaggagacaaaggcagtagaagctgggctacctctgtgtaggggaggaaaaaagcagaagaggcaaaaagagtcacacgtaccctctgatgcagcaaaggaaaagggcacaatgttaacaagctgcaattc

SEQ ID NO: 187224 - DNA, 120 bp, Homo sapiens
taatgacaattttataccactgtaaattcctgccagtgagagaaaaaccctatgacttggggggaaaagtgtcaatgacatgtatagcgatgtactcaaccaggggcagaaggcagctca

SEQ ID NO: 187225 - DNA, 805 bp, Homo sapiens
gttgctccttataaattaccttattgttgtttccttataaattacccagtcttaggtattctattacaccagcacaaaatagactaagacatgactactgtgtggtgagcactttgcatgtatcatctcatttttatccttacaccagtctacaaagaacatattatctccactttacagatggagaaactgagtcttagtgtgtcaaaatggtgtgcacagttaagtcagtaagactctcagactccagagacccttctcttcccacagtaccccactggctcaagggtcagaatggggcggtgttagaacttcaggtgagaggacatctcctcctcctgttcgtgtggatccagcctgtggccggatgctctggctgtatctgggtggttggtgtgggagagcctgaactccgcctactcactgaactccgcctactcactgaactccgcctacttactgaactccgcctactcactgaactccgcctactcactgaactccgcctactcactgaactccgcctactcagccccaccgtcgctgctgccccacactgtaggaacctctacggtacctttggactgagaaaccatagatctcttctctctagcttgtccgctgctgccagaagtgtgtaccccagacgtgggcagcgcctggggttacttctcaaaaccacagcaagcatttattgtctttaaaacacaatagcatcatgaatcaattttagtgctagagagatatatgtgactctttaaaatggtcccctaaaatttgtaaattacaggcatcagcatcaata

SEQ ID NO: 187226 - DNA, 676 bp, Homo sapiens
gtaatgaagaaacaatttctggaggaaatgtagttcccttggatgttttcccaccttctgctgcaaaagtcacatcactctctaggcaaatactcaaaactttctgtttaataaaagaatttaacctcatttcattgaatcctcacaagatctttatgaaataagcaaaagtaatataattgtctccatttcgcagaagaggaaattaaaccttaggaaaggtaaggaaatttttcagggtctcccatgattgatccaactctttcctaagaaaaaaatgggtctaattaactaagtactagcaacaattatttggaaaatgatagggtcaccggccttaaaagattatgtcaatcatttctccaaacggtatcatacagcaattcctctcacaatatcgactttatctagtctttccttgaacataccaagtgatggtgggctcactgtttaaagaagcaacccattccatcattgaaaatttataactataagaagttctttcttatcttgaactgctatccaaattcctaaatcttctcaccctctggtcataataccgctttctagatcccatttatcaattaaggggatagcctatatatgacagtttttacaaaatgtgaagggaattcataaagaccctcttgtcgtctctgagttcactctttatgca

SEQ ID NO: 187227 - DNA, 491 bp, Homo sapiens
tgtgagcactctagttaatcatacaacccaaagacggggtttgcaagaaccctaatttgaagcaagtcagtcagacgttccaagaggcctggacttgtgactggtaggaagaaggatacaatcttttgggactaagccctcaatctgtagtttctgagtctacctccaggtagagagtgtcagaattgaatttgtagacactgattcaattgcttgatgatttcaagaagtgattgcttgcttggtgtatgaagagaaacccccaaacatctggctacagaagtcttgtgttgactattgtttaataagaaaaattttaaaagcgtcctgagtttgtgttgttttctaccccacacgcaatccctatcctcaaaccagactcatttattcatgttcttcctatagcctcctcttcctacaaatctaagttttgaggaaagaaggaaataaaagcctcactaaccaactaagatgtggaactgatagcaagt

SEQ ID NO: 187228 - DNA, 573 bp, Homo sapiens
gcttgggggaagtgcaccccaggagggcagtgaataaagtgttggggttggtctgaaggaggcggaggcccaggtgggaacattgacaagggactctgaggtgcagcatccccatagccaaatcctgggggagcaggctggtctctgggggtggaaggtggggggaccctataagggccttgctgcccaagaccccaggctttctgcagaggatgcaacagaacctatacttctctgggtcctgcatggacctcttctgctcaactgctctgggccctccacgaactgcacccctgaacagacagtgggggccctgtcatctatagctcctgtggagacctctgtgggctgaaaacccacttaagtcacacaccaagaggatgacggggtcctcaagtatgtcactaaacagaaaaatagtccaaaatgataccgaactgacaagtaactacagggaaggtaaacataattgtgatttccctcatgttgcttttgttttaataaaatgttaagtaacaaattgttttagagcaccttcctttggtgtctttgagaacatgctccatgtgcctg

SEQ ID NO: 187229 - DNA, 314 bp, Homo sapiens
tgtgagccatcaagtccagccgacaatatcttaaagatggagtttaattctctggtcaacaaatacatgtaatgaaattaacaaaaccatataaacaaaagagctttgatatgtttctaaagttagaggagaggataggtaataggaaaagtaactgggaaagaccatcgaaagtttagtagagaaataagtgaaatctcacaaaaggaaaggaagaggggaagagttttataagtaagaggttaacagatttacacctcccctctcagaaaataatttgtttagaaagaaataacaggtgttctgaaacagaa

SEQ ID NO: 187230 - DNA, 644 bp, Homo sapiens
tgggtggcgttctagaggatcccgaggctgaggtcaacgtccatgtataatgtttaataaattaataatacatccatatttaaagtccttcataaaataatgcttcatcattgaaaaatagcacatgtttgctcttctcacctgcgagtcagctttccccaggccctttctgatgtgtcctcagcatcagtgtcttcaccatggctgctggtgagtcccagcgggcccaggtctaccccacctgggcgatttgagatgctcccttcatgggtccgtgtccgggggtcacgggcagctctgccccagcccacgggcccccattcacgcgcatcaggacagctgggctcagtgatgcgttcattcctcttggtggtattggttcctggtttattcaactgaatgacctcatcaccctccttccaacacacacagctgtgaggttcgaacccccaggaatcatgatgcaacacatgtcactttcctttcctttgttttaaattatgaactctgttgggcctttgtaaacatccaaaactagcactggttgaggtcagaaattcattgttgttcatagtaaagttagagagtgttccaatataggagaagctttgcaagagcttgaatataagtcagctttgtctttg

SEQ ID NO: 187231 - DNA, 236 bp, Homo sapiens
ggtaagtcttgatagggaaggttttctcctgaggtaagggaagcaagatgggttttggaagcaaagtcttgggttcacatccttgccctagttattgccatacgatcttgagcaattcacttaatttctctgtacttcaattattttgttctctgtaaaagagatactattaccctcttacagattgcttagcacagtagatagtactggtactgatagtaggctgtggttattgt

SEQ ID NO: 187232 - DNA, 637 bp, Homo sapiens
acaggccagcttaaactctgtcaattggctaaagattcttagtacaattgatgcaccagaaaaaaaaaatgattagccttgaatctagcatacattcttagtgctaataacaatgatgtgctgattatatcattgctatttactttcagggttgtacctgacaaactgcgttctctggccttgggtgtaagctatgtgattttgagaatatttgggactattcctggaccatcaatctttaaaatgtcaggagaaacttcttgtattttacgggatgttaataaatgtggacacacaggacgttgttggatatataacaagacaaaaatggctttcttattggtaggaatatgttttctttgcaaactatgcactatcatcttcactactattgcatttttcatatacaaacgtcgtctaaatgagaacactgacttcccagatgtaactgtgaagaatccaaaagttaagaaaaaagaagaaactgacttgtaactggatcatcattgtattctccaagatttgtttctgtgcccaactttcagaagaggaaaatcacacattatgtttacataagtagcaaaaatatatttatggtgatctgcattttcataataaagtgtcctattgtgaaaca

SEQ ID NO: 187233 - DNA, 346 bp, Homo sapiens
ttaataagcaggagattttagctttctcaaagacaatggttatttctgagggaagataaatgggatggaatcagaaaggaagaatagggggtttctagtatgcctgtggtatcctaattcttaacctagatgttgtcacaaaggtatccactttataacatttttattttgtcacattatcttgcagctacctaatatttaaattaaaatattatgtagatatatggtagagtttaaattttgttttaaagcaaattcttctaagtaagtaagggaaattactcaaactagaggaataaattcccaaaggaaggaaagcatggtgtgttcaggaaactgaaataat

SEQ ID NO: 187234 - DNA, 391 bp, Homo sapiens
agtataataaataacctttttcttaagccaaagaagtccaaaccaaaagaggaataagaaaagagagggagataattgtctccagatttttgtttatttcactcattttacaggaaatgcactagcaattttggctaccatatccagataatactagatgttttacatgtatgagtctgacatctctaggatatattatcattataggaggagagaggggagaaggagaagcagaagcgggggtggtagtaatagttatagtagtggcagtatagcaatagtactggtgatggtaataggtcaaattatggttgcggttattagaaatcgttcattcaaacctatttagagtaaatatccccaggcactaggtaataaaaacaagtgtgat

SEQ ID NO: 187235 - DNA, 304 bp, Homo sapiens
attttgaagtgtacagttcattggtttttagtgtattcactatgttgtgcaaacataaccactaattccagaacttttctaacatctcagtaagaagccttgtatctgttatcaatcagtatcaatcacacccaccttttcccctgtatccatctgtatggatttgcctactctggacatttcttataaatggaatcataaaatatgtggtcttttgtattttctttcacttagtattagtataatgatttccaggtgggctacgtcaggtgggctacgtcaggtgggctacgtcaggtgggtg

SEQ ID NO: 187236 - DNA, 360 bp, Homo sapiens
attcccattaaaatctacttgttggggtttggggcatgtattagcccacaatatcaactccaaacactatctacttgttcggagttgaagtgagtaatgatattggattcacttggcagataaaggaattcttgttctgtttgagttatgtaagatgaggatttaaggttgaatgcttttattcaactgagtaagtaatatcgagcattttcttctatcagatcatgaagaaatatttgaatcagcaagtcatttctctgatctctgttctcactatgatttgagtagttatatgtttcacatttacattacttaatatctacaggaaatgtattttaatacagagtagttgatataaaa

SEQ ID NO: 187237 - DNA, 274 bp, Homo sapiens
acttccctgttcttgacatctgtcctttctggttctcctcttgctctgttgcttctctgcctatttctgttttcgtttattctacttcttcttttcctgatctgtatgttaaaggtccagatttttctctgtgaactgtctggttatgtcacttgtctatttttctgtcaggccttttatctcttctaattttagaagctctttctaaaagttatgtctttgatgaaagttgcaagtattttttcttcagctttttgtctttttactttgcttt

SEQ ID NO: 187238 - DNA, 675 bp, Homo sapiens
agtaggagcagcagttggaaaaagtgatggcaaatgagtgaggcagttatccagtaatttcttgttaattttagtcattgcttacaaagaaaaatataatgtttgttaaatacatgcactcttacttcttttgtcctcattgatgatggaactgtgactggaattagaaattcagcttctgtgtttaaaactgggccaggtgtgagccactgcacccgggcaatgcagttaattataaatttcattttcttctgaagagctaaaactatttgatatatgattcccagtaaactatgaattattgaggaggctgccaggaagaactagctaagccctttgctgctactgtgaccagcaacttttccatcctggccatgcagcttcctttatcgcgtattgccatatgaatgtccactaggtggtgctagttacacgtcatactcagtgttgtaggcacatccagtttaacacagtttttatagatgcagaagcttacctaatggttacccagtgagttaaaactggagttatttcattgcttcatccacagtcagctaagcaattatttcacctcaactgtaaaccttagaaacacgttttaaaagtttggagaacctaatttctatttccctttgaccaagataattttaatctttaataacagctaagagccaa

SEQ ID NO: 187239 - DNA, 379 bp, Homo sapiens
agctcggatccgggagtgcagcgacggaatgcaattaaagagaaggagcttcaaacagcaagagcttactgtgtgccatgatttaagagagacagagagaggaacagagatagggagaaacagagacatagagagaagtagagacagaaagagagaaacagagacagagagagagagagaaacaggcagacagagagaaacaaagacagacagagagatctgggagtcaggacacctgagtctgtttctgttggagcctcaggcaactttcctgatttctccagaactcaggtgtctgatctgggccaccttcctcactcatgaccttcttcccctgtgtgagggtgaccttaagtcctgagtgcttgatactacttgg

SEQ ID NO: 187240 - DNA, 211 bp, Homo sapiens
gggctgggattacagatgtgagccaccacacccagcccaatatcaagttttagactgggcgtggctgggagactagcaggtacctagcttgaggacatacttgtaaatttccagttttttccagtttttcccagtttttaaaatgtacataaaaggaacatgaaactggaagaagagtaagaaagtaggaaaaaaagtggtctttcaatga

SEQ ID NO: 187241 - DNA, 544 bp, Homo sapiens
gcagctcagctgtgccatcaagaaccaggactttccatccttttactctaccatcctcagcacgttggctgttgcccttggttcgtcctctcataattgtaaagtaactgccataagcaccaaatagtatcctcagtcagcagtatgtgaaggaagatggaagaagatagggtcattttctacatgcacctctgttcttttaatagaaaggaaaaacttaccagagccccactccttccccgaagagattatctagaattggctcgtgtgcaactgtgatgaagctgagtaagtggatatctggtgtttctaacctttatggtgagttgtgggtgaggaaggcaaaaagttggaaatggcagtttgatgggaacctatgatgtctgtcacatattttactttctggatattatttaaatcggttactttatccccatttccactaatgcttctcaagttcaggccctcatctctattcatataatagcctccttacgagtttcagtctctagtattacttcattttaatccttcctccattctg

SEQ ID NO: 187242 - DNA, 684 bp, Homo sapiens
tctttcaaaaacacagaggcacacagatgtgccctgatccctccaatgttataacaccaattcatcgacctcattacacatgtgcagtgaaagagagagacacaaggtttagggagaatagtgtcaccagaggttctagtgtcccataaacatccagacgtctccatctctgtctcccacacactcacgcagacagctgtgtgtgtggcaggtactctctgagatggacctcagcgatccatgcctcctggaattcataccctgcatcccttcccctaaagtatgggatggacttgatttgcttctaacagataaaacacggtaaaagcaataggatgtcacttctgagattagcttacaaaaagactgtctctcatattgggtgctcttgcttttttgttctgagagaagcctgttggctttttgtgagctgcctatggagaaatgcacatggcaaggaaccgagggttgcctccagcaaactgctggtgagggagtgaggccttcagtccaacagcctttaaggaactgaatcctgccaacaaccatgtgagtgggcttggagatggatgctaccaccatcaagccttcaggagtgaatttttttgttcttgagacagcgtctcattctgttgctcaggatggagtacagtggtgccatcttcgctcactgcagccttcgtc

SEQ ID NO: 187243 - DNA, 174 bp, Homo sapiens
gaggccaggcacagtgtcttcatgcctataatcccagcactttgggaggccaaggtgggagaatcacttgaagccaggaatctgatactagcctaggcaacaaagtgaagctatgtcttgttcacaggtagggagactcagtattgtaaagatatcctttgcaatcaatatata

SEQ ID NO: 187244 - DNA, 480 bp, Homo sapiens
tgatagtgcatatgtagtgatagagtatatgcagtgatagagtatatgcagtgatagagtatatgtagtgatagagatgaaactccttttgggcttttttgagatgtgactaccctgttttccaaagtaaagcatgaaaagctcacatggattgcctgctcttccctcaatttgactcaattgggaggttttcaaagattctggcaattgtcagtcttagatttcaatgctattagtttttactttttatttttatttttttgagaccgagtcttgctcaggctagagctattgcccaggttggagtgtagtagtgcaatcacagctcactgcagtcttgaattcctggattcaagcaatgctcctgccacatcctcccaagtagctaagactacagatgggtaccaccatgctcagctaatttaaacatttttttagagatggggtctatgttgcccaggtctatggcctcaagcaatc

SEQ ID NO: 187245 - DNA, 263 bp, Homo sapiens
aggaagactgtaaaagaaaatattaagggtcttttgtctgaaaatatttcaaatttgatttaagagattcagagacctgttatttgtggaagggaagctgccaatacaaatatgaggtagatcggtcaacttacatacaactgatttgacaagcatctgttataatactgaagatttgtaaacactaaacaatgtttttacctccttaaaagttttgagaacttgccagtattggcaggaggcagagactctgaaacgtgctt

SEQ ID NO: 187246 - DNA, 300 bp, Homo sapiens
attaaccgggcatggtggcgggcacctgtaatcccagctacttgggaggctgaggcagcagagccgcttaaacccaggaggcagagactgcaatgagctgagatcgtgccattgcactccagcttgggcaacaagagtgaaacttcatctcaaaaaaacagaaacaaacaaaaaggcagctgggttgtcactgatgggcagcatttgagcctgccacactggcctggaagtttcccttccagtctggattttgtctgctccttccttccccctcaccccggtacctcttcacctcccatc

SEQ ID NO: 187247 - DNA, 272 bp, Homo sapiens
ggttttccagggccgtccagaacagagggtggtttggtatttgggccccagaggtacttagctggtgattcaagcggtggctaatggtgtaagtgctgcaggacgctgtggtccatgctgagaagcttgtttcagataatttgctctctgcttccctgccactcctccctgggctggcagcaccctcggccctatggccagcaagtgcgtgttccttttctgtgggcctcctccctgacccacaggagacctgtatcaccccggcacaccag

SEQ ID NO: 187248 - DNA, 506 bp, Homo sapiens
ctagttctctaccctaagtgttttgaggtctttgtacttagaggcgacagagaattttacttcattcagagcaagccttagctgagatactaaaatcatgtgaaagtctgtctaaatgtaagggtggttccatctttgcttctcagttcctctttacctgtcagaggagatagttatcctagacagacctcccaaaagataactttgacttccagattctgacagttctaatctccatttaactgtattttctttcctttttatagcatgagcagtaatatccagaccaacatggaatggaggatgtcccttaatctcctcacatggctatcccttgtgcagtcctcttttaacaagtaattgtttctgtggatatctgttaaggttaaggagtatagtgaacgtctttgggtttaggttgtttaacctcttcacactccatataaatcattcttccaatgtcttttaaatgcaaccaaaagactcaccaaagtgacattggcaga

SEQ ID NO: 187249 - DNA, 331 bp, Homo sapiens
catgccggggagagcattctgggagtagggtctgtgtgcagatgggttttttggaaaccttaagactgccccatttgggatggttagagcatttctcaatctttcctttagcagcaagctctggtccttggagagagcatagaaagatgaggactgaaattattccacaaatacatcaccggacaactgaatacattatgagaaatagttctcaatccatggctccactgtatcaatgtatttcattgtcatttttcctttgaaaatccctcaagcttatcaggatttagttgtacaatgaagaaatacattatccctccccgggatacag

SEQ ID NO: 187250 - DNA, 595 bp, Homo sapiens
gttttaaagagttttctaggaagacctctctgagaaggcaccatttgagccaagacttgatgacctggctactgcatgaggatggaaggtggggaagctgatgggagcagcgagagaggtgggagcagttagaggctattgcagcagtccaggtaagaaggaatggtggcttggacaaggaggtggtagcagagatagggcagagatggccagattccagatgtattctgaaggtagagctgacagatttgctgagcaattggatgcagaataggagggaaccagaggcagtcaaggatgactccagacttgtgagctgaacaatgagaagaatagattgagatggggaagtctggcagaggaaacaagaagttctgctttggccatgttaagtttgagatgcctattagatattccaagtggagatgtcaaatatgcagttggatatatgagttctgggaagagggccagccttgagctataatttggagagtcatcagcttataggtgacatttaaagcaatgggactggatgagatcaccactgagggcggagtacgtgtagatggaagtaatgcttattcagctagcaata

SEQ ID NO: 187251 - DNA, 623 bp, Homo sapiens
caaaagcacactctcaactctgggcaatcattacccagcgttctctgcttggaacacagctcaattcttccaggttgtcccatcttcctctaatgactacatacatacgcaattccaactagaaaggtactcatcatattacagtgaattacctgtacaattagctgtcctttccagactgtaagacagcaaccatatatctgtcttattcattatagaattcccaaggtcaaacactttctaggtcactccacacatgttggctcaatgaaaaagtactcagtgatgtcacagggtttgtccttagcacagcctgaattcaatcatttcatcaatttaagtatgtctgttgtcatcatttatcaaactggcctatgtataatgcatgtttatatgtacgtgtatatttatgtgtatgtgtgtgtggatatgtatatacatgcatttatttccttgctctttccactgaaaggaccaagtagcaaacagggtacctaatgcctgggtcttggtccctaatactactccacactaaaaagaatcaaggatccttggatgccaatgctgggccaggataggtataagataagcctgcatcatgatatgtcaaaaagcaagaaagg

SEQ ID NO: 187252 - DNA, 279 bp, Homo sapiens
gcatgggtgactgaaaagtggagacttagggcaaggggcaagttaggaggaaagatggcgagttccccactggacacaacgaggcttaggtgcctggaagacatccgaagggagatgtccaggtggccgatggccacaggaatctgaatctcagctgagagagacatggccacttgtgacagaagccacaggggtggctgagccatccccagggagagaagactaaggcctaggtctaaatgcatagtcaaatcgcgatcccgatataaaccattctag

SEQ ID NO: 187253 - DNA, 180 bp, Homo sapiens
ttctgcccctcacaagaccctggcttcctgctctgctgcttcctgcttctgccaaaggggtaggcttagaattcaaatgcaggggacaggtcagtagggtatgaagtttgttaaactgatccagagtggttaggttggaagttgatgttgtttgttttgtaggtgcatgtttagacaaag

SEQ ID NO: 187254 - DNA, 503 bp, Homo sapiens
aagaatgcacatgccagatcaatgtccatataccatatatctgaagctatgtgaatttaccctagcaaaagtatcacttctggcacagtagttgcaattgagatttccacttcgttgtttgagatagtccagtgtcatgctctgggatctgattcctttttgtaggggccagactgatgaattaaatgaaaatatgctggagattaccatctctgtatcttttaggtctcaagggaaaaagcaaaaggaaacaagaggttacctggtgcatttgaatgtttaaagaggagtttacatttctaacagagtttgagagtgagttaaatggaaacatggaaaagtaagcagagaaaaaaaaaaatgaaaaccaaggcaactattaacgtcagggataaaacaagagcttgtactagaaaataaatgcaattagagtactctacactgcttagctataaataatattcaaatagtcattaagtattatgactgaatattggtttaac

SEQ ID NO: 187255 - DNA, 415 bp, Homo sapiens
caagagtgatgcataaataataaaaaaaataggcattttcatggtataataaatttgccttttttacctatagagttcagagaaatttttaggcaaatattattagccattgctaatattttgaactcagtttttaagtatcatgatggagtttacccatgttaggggagttaatctattaattatcagtgggactctaattgagtcctttatttaatttttcatcacatccttgttatgttaggagatggttcagagtggaaccttaaaaaacagttggaattcttcaaaattagtcctctacaaaaggttaaaattatttgacttttggatgataaagcaaacagtttttggaacaatcagctattgatttgcttttctagagtattttgaatgagagatactgggaagaaac

SEQ ID NO: 187256 - DNA, 524 bp, Homo sapiens
ctttcaaatttcccatgtttatgattcctctgttcctaaaagaatccttaatttattcccacccagagattccaggaaatatttcctatgaatggcctgtgtagcttttcagtaccttctctccccactgaggagccatactgggggctgccccaaaagagagctgccaacccgtcacccatgtcatctgggtgcagagggtgagaagcagcccttccaggtccctgtgtgatgggaggtgggtaaagtcagggaaaatgagcatgtcctcaatctgggaaggatgttgatagagattgaggcacctccatagatttctatcctcccagtgacccctgcttctcaaggggcaagtccccagccccaggtgcctcagccacccttacagattgtaggtggttacccgacagtctacagagaaaaatatgtctcttttagcaggggtgggtgttctggctctgctttctgactgtttggagacaggactggtcctttggggatggcttagttagggtccaaaattg

SEQ ID NO: 187257 - DNA, 270 bp, Homo sapiens
gtttgatatattttactaccattccctcagatgcagctacttctatgatagataccttatttctgtccagttatttaggttcaaagcccttgtttgtctttgatgacatccttagccatcacttccacaatctcatccaagtagtaaccatagcctatcaggtcgtcctttctgagtgctttcttctttgtttattttgctctatttctgttagcacccacgtcagtcaagtgttccattatttgacctgtccatctctgccagtgtaac

SEQ ID NO: 187258 - DNA, 250 bp, Homo sapiens
tgcaactttgcacttagcactcctctttcagtacattgcactctgcttgcaaactggcaaaacatccttttgtctctaccagtgggacctgcccctacccttggagcagatcttgttttcaaattctgataccacaaaatctaaaaatgcacccagcctgatccacctattatccactgaactgaagccagcattcaaagggacactaaagagaaagcttctaaagatagagaatgtggatcctccccaa

SEQ ID NO: 187259 - DNA, 580 bp, Homo sapiens
cttgcgccggccttagaccagctagctgtctgcaggctttccctgcccacggctgcccctcctttccccttcacagccgtttccgcccacatgcgccgtgcatggttaatcgcaccgtgccatccacttctctgaggacctgagttagcacacaaagtatgttcgttccctgtgtcctcacctctccctgatgtatcttctcccttcctctgctggctgtctgttgggaatcttgggaaaggaatttgtgagtaatgttccaggcagcctagcttttagggtgaatgactggttctgacttatgtcaatacatccttgagtcatgccaagaactgtgggatgatcaaggaccacggaccagtgtcctggaagcatcgatggctccaagctgctggcaccactgtccttggaattaccgagtgtgatttttagagttacgggcacatttctcaggccccataaatgtgatggatggtgaattacaggacttttgagtatatagtgagtggactacaattgtgctgtatgtagcccactgctttgtgcgtgaggcgattttaggccattgaaggagttcagc

SEQ ID NO: 187260 - DNA, 244 bp, Homo sapiens
atgaggataactgaaaaaacattaacgatataaagcaaccaagtttaagactggaaagtgatgctatcacttatgtaaaagaaatagcaaccagttaaaagatgttcaaagtatgttaaaattagcctaacagtaggaatcatatgaaatctgcaaacatctgtaacattgccagaaatacactgttttataaacgccaatttgcagttgggcttccagaaagaaccagataatgcccagagaa

SEQ ID NO: 187261 - DNA, 515 bp, Homo sapiens
cacgtggttctaataatcattggagtataccgtatggtcattctggttgcagatgtccagcctctgctgtgattggctactgcctttgccatagtggttgttaaatattttgaatatcaccattatttacaactaaaatattccctacattacaaatgaaacaaaaaggagaataaagaattcaggttgctgacttaaaagcatccaaaaagtcattggcatggaaggattaataacattcccttgtgttcatggaggacttcagatctttcagactatttttacagcaattctttatgctgaccctcagaacaactgagatagaggagaaagaatgggaaaaaggagggttgggggagagagagagagagaaaccacaagctcctctttaacaaacatacaggcaagttacagaggttttgggtgatctgcccatggtcaaagggaaggtgagtaacggaggccaggcaggatcccagcaagtgttctgtccactcaatcaccaagctttggac

SEQ ID NO: 187262 - DNA, 386 bp, Homo sapiens
ttctctttcccttttctttttttatgcaactaataaaaagattgctaacacttattacataggaaacttgagatgtatacagagttctagaaaatgggatgagagctgtttttattcctagaccagagtaactttgtgagagcaagctgttttttattccctgtcctccaccttcctttcactctgttattattcctgttaataagtaaatgacccttctgaattgaaacagggttgggtctgctctttaaaaacataacctttttattgggattttctttaagataggctaatttattaaaattaaaaaatcttgctaggtattaactttgttgcttatctaagaccaagaaatatatttttatacatctcagctctcacctatg

SEQ ID NO: 187263 - DNA, 336 bp, Homo sapiens
agtgcctgtgcctgtgacaaggtgaaataatcaggacgacagggtgcctgtgcctgtgacaaggtgaaataatcaggacgacagggtgcctgtgcctctgtccgtgacaaggtgaaataatcaggacgacagggtgcctgtgcctctgcccgtgacaaggtgaaataatcaggacgacagggtgcctgtgcctctgcctgtgcccgtggcagggtgttcttcaggcttccatcacgtctgctgttggctgggtgtggcaaagaggtgactgtattgggacaattttcttctttctctagataactaacagtgtttatcagggatgagagttgggtt

SEQ ID NO: 187264 - DNA, 405 bp, Homo sapiens
tgcaaaaaagctagactgtcctagcctcccagcccacatctttctcctgtgctggatgcttcctgcccttggacatcggactccgagttcttcagctttggggctcagaccggcttccttgcacctcagcttgcagacagcctattgtgggaccttgtgattgtgtgagttaatactacttaataaaccccctttatatatcaatctatcctattagttctgcacctctagagaaccctgacaaatacacgcatgtcgccagtgcctatgagagcactagctctttggatcttggattttgcaatgtatccttgaatagttggattttgcttcttactcatgaagaccacagggcaatgtggggcaagccctctactttttggcgcccactgtctctcacggtct

SEQ ID NO: 187265 - DNA, 290 bp, Homo sapiens
aacaaaagtactatccccccttttgccataattgttataagtccttaaagagtgaattcttctcctacggtacaaaaattataggttaatacaggatacaagtgtggccaagcttgcagtaggatgaatcaccccaaaaattgctttaattaggtggccaagaagtgcgttatttgaagtgagaacatctgttgcaacagtcacaatttaggagggtggaccacatccagcactgacatttaagggcaatttacgagaattactgttaaattacaagaatgatatgttta

SEQ ID NO: 187266 - DNA, 244 bp, Homo sapiens
ttaggatacactaggcttggtgacctgtgagatctgttctaagcctgaagatctttcaatgtaggtaaacatatgcagcagtcaaaatcaccaaaaactgagcatctgtatatgaaaatgctacattataacatgattattcatccacatggatttttaaaatacattctacacatacctgcttcacaatgcgagatgaacaacatgttaatatgcacaccccgccctccaagacctcagtgtt

SEQ ID NO: 187267 - DNA, 397 bp, Homo sapiens
tcttgtccctgacaatttaaagccttcaagtttgaccttcccaaccctcaaccttaggtcgtgtgaggttgtagccagccttagttctcaagttgaatggggagtctatttcacattacatgttgttttcttcttcctatcaaatttcttttctctgtaagctaataaattattattgtgttgggggtaatccatatggcagcaaacaatggcacagctaattgttatatacaaatcagggataataaaagttaattggatatgtctgtaaacactgtatatttggaatggatgcatttccagttagtatcagtctgcttatgacaaccaaaacactgctgatagccagttggccagaaattatgttcacggatgcacatagacatcattgtgaaca

SEQ ID NO: 187268 - DNA, 384 bp, Homo sapiens
caggtgaactcttgagaaccttgtcttccagccacagtcctccctctggccagcaatgaagtccacagtaaaaaataatgataaaggcacacagcatatctgttattctagtaatcacagatgcatttgcagctctcatcaaattccaatatggactgagccacactatttcaaatgctgggccgtgaacgtcatagcaatgccctcgagcatctccaaaacaaccaatagcaaacacagcttaaatgtctctttgggaaacagctatgaagtttggggtacatgtaaaatgggaatgttaatcctatccacattttaggatggttaggagtctggaatgaaacgatagacatatagtgttgggcaaaatgcctagtgcagtgg

SEQ ID NO: 187269 - DNA, 300 bp, Homo sapiens
agctaaaaaataaaacaaagatatatgtctaaatttcatactctttgcagcattacagaataagggaagatagttggggtagagaggtggataacccaacaatagggaaatggttaggtaataaagagagtgtcaattttgtccgacagcattaaaatataacaaccaggcaaatattcattatgtaatattagcattcattcattatattgaggatatccattacataatattgctgtgatggggcatgaaatagaggacgggaaccaaattcatccatcacgttacaacatatatgaa

SEQ ID NO: 187270 - DNA, 402 bp, Homo sapiens
ctttgataagtctggctacagagtaaagttaacattctattatgaagcaaggaataaatccatccctgtatcaattaaaggaagagaatatcaatgtgaaagggggcattagaaaccacgcttcaaaaggattcccacagtgacagaacttctcaatgaaacaccacaccccaagtaacgggggcggggtggtgcaccatagaatctgcccctaggaggcacagccacctccacaccgagggtttccagtttcccattcacataaaagaaacaagtaagagattctgggaggcgctgggctaggaaggcatctactcactgtctccaccaacaattccctcagtaaagcagccattgcccaataatgcttctatttattttacccagaagcagatctattag

SEQ ID NO: 187271 - DNA, 702 bp, Homo sapiens
agatcaacccatggttacgattgacactagttgcctgggatggaccaattgacctcttggtggttcccatcagtgtctgggagacagtggtcatgatgcaggaagcaaggacccatgtggagctctgccattaagtcgatgtgggaacaatcaccctcgactgaaatatgggcacttctaattcatctttcctccagaacaacctgcttccataactggcagccctgccccaccagtagactatgtctaaagcttcctgtgctctcagggccaactgaagccacccaggactgcagactgaagatgggaactgtagccagcactacctggggctcaccccaccagccaccccactcccaacccagctcgctaggctttgccaagcaccaggccaggctcagcagcttgcgagccatgtaacatgccagatagatagtggagggaacatgtaactgagtaaccagcaccagagctgggccacacattttttgtttttcatgcagcctgtatttgcgggagggtggtggtattgatggctctgtgtgccccaggggtctctgtccaggcactctagtgcttctctggtggctgtccctctccactggtccatatttcaaacttcagtttggggaatgggccatcagcctagcatgccagagaggatcccttactgactcctgagacccctgggtgcagctcgta

SEQ ID NO: 187272 - DNA, 360 bp, Homo sapiens
taacagcaatataatcctatcatctctcttttgttttgtgtttttcagttggtgtgttaatgagtgttctcacttcattagctgtctcatctccagaacagccatatggacagctaagtcaaatatgaccatttccagtctatagtaagaagactgagaccaagaaagatcagatgaaccgtgtgaggtcatccagtgaataagggacttgactgggacttgaaggagggtttttaaactgtaaggccaatattctatcctctgtttacacgttcattaaagggagctccaaaaaccacatttctgggcctacttcctttgggccagttaaacatgagtttgggttagttaaacatgagt

SEQ ID NO: 187273 - DNA, 163 bp, Homo sapiens
gttgggcagagtttgaaaagattgtagttgaagaggtcaggagctatgtccctactgcagttttctgcagtatctggcatgtcatgcacatgagggaaataccaattatatgaataaataggaggtaggttttcgtttggatatttatagtgggcaataagtt

SEQ ID NO: 187274 - DNA, 621 bp, Homo sapiens
cagtttttcaagaagggtcagactccaagaacaagcacaattagaaataaaggatgacttctaagaattgtgtgccagtcagaaaacactgtcttagttgtcgacatacaatataaagtaatactaaggaatgaaaaatgcaaggaagagaaattatggctttcttactagtgacttagcctctctgcttgaatcatatctataactttttgaggttctttataactgtggggttctcagccacaagcctaatgagatgaatgggcatgcaggaggcaatagcgtgcctctcaagctcaccagagcagcagcagagactgagcctgtgtggcaacaggagtgtggcccaaggtacactttctggaaattaggtaatgagcaaaaaaagcatttggtcagtactagatgagatgtttttaacacatactgacaacagaccataatacgcaaggagataaagtttcacacttttttttcttgtggttggttatagtcgggttggcttgaaatttagagtatgcacatacggttacagaggcccttgatagatttgcatgacagtaatgtctgtgaacccaatattcttcacgcctggggtcatggcctgcacccgtagatcca

SEQ ID NO: 187275 - DNA, 661 bp, Homo sapiens
tattcagataacccaaataatcaccatcacttctcttcagtggaacactcacagtgctcaggaatccttgttttcctttattaaactcctgggaaactttctctaccagcctttctaagccttttctacttttaaagactaatttccatgccctgaatcctttatcctcagatcatctcataaaacaatctcagtgaagcaggatacaaggtaaatgtcatacatccccaacatcttaatttatacctctcaaaattttctctccacccatcttcccttaccttgtcctcagtctcaaatgagaagatggccttcctcctaaggctaaagcaatactttcggttcagcctccttacctcctctctacaacttcgctctatcaattgttctgtatttctcgtattttcaatggtttacgccaggttccttgctattgttttgttttaataaccctaaccttgctaccatcagaataataattatatttctactaactgcaaaatcttataacattggtatatatacttcacactaccattcattagctattactcttttatctaacttcctatccatcactcaactgcaagtgcttcctctaaatctttataaccaaatccagtggtcttttctcagtctttactctttttttttttttttt

SEQ ID NO: 187276 - DNA, 679 bp, Homo sapiens
aggaggaattctgaggaggtgggaggagttctgaggaggcaggaggaattctgaggagggaggaggagttctgaggaggtgggaggagttctgaggaggtgggaggagttctgaggaggtgggaggaattctaatggggggagttctgaggagggggaggaattctgaggaggtaggaggagttctgaggaggcaggaggagttctgaggatgtgggaggagttctgaggaggtgggaggaattcccaggaggtgggagaagttctgaggagggaggaggagagaggcatcctaggtcaagccagaaagaagagtggtgaaattgcttcctgattcctccttggtgactctgaggttagagaggaagctaaactctgaagcccaccttatatacggaagatgatctggggtctgtggcattccaggtcctgctctctccctaggccatcacttcagatctgcaatggactttgtatgtcagccatgataaaccaaggccataccagttttctatttggtcctcaaatgtaccaaactctttcctgccccagggactttgcgtatgttgtctcctatacctggaatatatgttttccaagcctctgtctctgagactcggatgaaatgtcatttcctcagactggcctttcctgaccactccacttgcccctcccaccct

SEQ ID NO: 187277 - DNA, 254 bp, Homo sapiens
tctccaagtcacatagctggaaattaaatgttcaagttctaccttggccccaatttgatgtttggtgctctctggattgagttgaattatgttcaagctttgcaatttcacttgtggtaaaggctctaacattttctctttctatgcaaatttctttttttcttttttttttttttttttttgcgcaacggaggttcgttcttgttgcccagtctgaagtgcaacgacgcgacctcggctcactgtaacctccg

SEQ ID NO: 187278 - DNA, 481 bp, Homo sapiens
acccagagttgaggggccaccggggtccctctcttgagcacaggcgcccggagcgcaaatgcgcggactgacccagcggccggcgcggcggcgccgggcggacttaatcgcgggcgcagcgcgaggctcgggacccagagcaccacctaccggcggcacggtcggcgcagcaggccccagaagggcggggaacgctgtcaagcccaggggcacttcggcgaggagccccacccgccctccagctgaccctcagctgtggcccacatccggggcccagagcgccgcggaaacgccgaagcccggccggcaggtacccgcacgtctccttctgccaccgcggagcttgcttcattaactccgtttcatgtgacttattttatttcttttatttttatttatttcattttattttatttcacttatttcacttcaatattttatttggtttatggttttacttcattaattttacttcattaat

SEQ ID NO: 187279 - DNA, 854 bp, Homo sapiens
tgtttatctacacgagttccagtttctttttgctcctaaaagggtcatttctgcagactacattaaacacaggaaaattctcataaatatcattaagaattcctgccatccaaaggtgctacagcctctcacccgaaactgtcagttactgaaatgtcagctcagctcggcctgggcgtgccacattccttccacaaccgaggctgcatgctgcaagcaccccaccccttccctggcatatgcagcagactgataaggccgacttcacagagaacgttccaggctgttcccagccatatgggattaacgccttttgagagcaccagaaaggaaaaatctgggaaacgtgccattaaaaaacaaactccaatcttaccagcctatctatcagttccactaactgcctaaaaaccacaacagagacgacttcctaggaatgcaatcaactgactgcttatctcaaaggagccaactgtctctgattttgccaatcaagtctgttcacatagagactgaaggaggggaaatgaagtgctaagtatattctctatatgtttgaggacaacttcccatttaaggtaacttaaaaaaaaaggtatatatttgcaaaatattattagaggagactgaagacgtaggctatttataaatgctgcaacgcagcagtcaaacgttagctgcatcattcagcaagtaatgcgaatctcagggggataaagcaggaattacaactatgtcctctattgtaataaataaaatgaataaaatgaacttgtcagcattcttacaatactaccagatctcggaagaagagtggggtctgaatatatgaatcttggctagaaatttctaat

SEQ ID NO: 187280 - DNA, 275 bp, Homo sapiens
atgcagttttgatcttgaggctatgagatgtattttcagatcagatttagcctaaggttacttagatttagcctaggattttctacagctgtatcattgaataaagtactttacaatggcctagtttcttttcacctatatagacaagcctgatctaaccacgcctttgcaacatcacatttatgtaattataggattctattttattttattttgttttttgagacggagtctcgctctgtcgcccaggctgaagtgcagtggcgcaatcttgg

SEQ ID NO: 187281 - DNA, 344 bp, Homo sapiens
aattcatgtcatttaatgaacatgggctatgtgccagaaaccaccaggtgccagaatacaacactgaactacagtaggcctgtccctgggccccagagctcccagacacactaggaagacttgttgatttaatgataaaccttgattgagctcatgattaacatcttcaccaccagacatcattgagtgctctctgtgtgttcaactcagaacatacccttcctgccctcagaggctggaatgtgagagtcattaagggagacaccattgtgggagtgagaaaatcctggacttggagggaactgactagggatcacctcccagctctgccatggacccactgt

SEQ ID NO: 187282 - DNA, 762 bp, Homo sapiens
gccacactggtcatctacaaagtaatgtttaccaattgacgacagggatttaactagattaaaaagatcaaagtgtggtttttctctgctttttaaaatttcactcggaatttgtagctgggccaattcaacacattttacttttcagtggaattgatttttctaatgtttcagaattttaacatatcaagaagaaaacaacgttctcaaagtctggcctctttagcatgatgtaaacctatagaaatgctttgaaatgtgctggtgtaagataagagttatcttgtatgatttaatcatatgcagtgttgtctcagttacgttcagggaaatgtttctgtgtcattcagagatgcttgatgaattaacacctcccaccctgagtgaggggttgacttgttgggagatgatttgggcttcactgggatctgtgacaggtgggggctgggctgggtgtcacaaagagaatagtggtagaaatcgggcgaaggaagaaagaagttactggtaaaaatcattacaccataaagcaccaaggaaataactgagttaaaataggtgaagtttcttttttcccccctgtaacaggagagttttccttatgataattattctgagacttggtcactttgtttttgaatgtggagctgctgaactcattcagaagccatttgctgcctatcaggactttctgaagaagttcttttgcctctgcctaccctctggcaccctcccatggaggcacaggggacccagagctaa

SEQ ID NO: 187283 - DNA, 2273 bp, Homo sapiens
  misc_feature (178)..(178): n is a, c, g, or t
  misc_feature (1575)..(1575): n is a, c, g, or t
atggtttctatcatcattccatttgatgcagtgggctctattcagttcattcacatctgtgtccttcgactggataccacttaagggcagtatccttgaagcttattgtgaacgtaagtgtgactcgtgaacttctactgagctaaacttcacaagagactgccaccagtgtgggagncaacacgtcgtcggatgctcgaaatcaagggtctcacgaattggacgctctctgaggttctactatatctaggcatcttatgctaacatgagagattggacattgcgcatgtccgcatatcaagactagaccaagggaactgaccaactctatagcctaggagggaatttgaaattaaattatatgacagaaggggggaatttaggaccaaccagcaacagtttgagaaaagtaccaaccccaaccaaatagatataccatggacttaataatataataaaaagcattattttgtagaaactgcttctctctttgtagaactagttgcaatgagttatgatcttaaacctagtgatatgatcacactaaacagtatcacatttaggctgtgtgtgtttgtgtatgcgtgtgtgtgtgtgtgtgtacatgtacattccacttttgcctgtgtgactatgaacaagtcagtttctcatgataggactcagttttctgaattccaaagaggacagttgagctggattttgtttagggcatcttccaatgccagttccatttataaacaattattgtttttccattcccaagaaaatgcaagattgtgttttggggaagattctcaactgtgagatgacagcgtatgctatgttcctttcattgcaattggtgttttatagcatcctgcccagcctggcccgcatttggccccgtagccatgctgtcctcaggctaggatctggttagttgttccagactcaagttggtccctccttctgctctgtggagaaaaatcacaacctcaaagggataggtttttttttttatggttgctcctgagagtggcatggtccctctagatgtcagcaaatattaaggcaattaaataaggcaaattaattatgggaaacattagcattgatttctgaagacagtcttcttcttgctgagtctagcctcaccccttcttgccttttaggaagagttccatgttcttagacaagcttgttttcggataaaatattagacttttttcttagaaaatccctttgttttaaaattggtaattttttaaaaatcccaatctctggctacatttgagtttgaggaaattctttttcacatctctaaatatgtttcaatttgatagtattagtaaataagtaaataaaaatgccttattccacaaatgtttattgagatccttctaatttccagtaccaggaatacacacatcaataggacatggttcttatacttcataaagtcatagaaagcaaaaagaactggcagttatctggttcagttatctgattctctgaaagagaagaaatataccagccagtatagtcaatattattttcaaaaatttggtgaatggccattgtaaggtgcatttncacacatataatcatactcctatcaactataaatatatgaattgcttataagcatgattgacatttgttattcttacatagattttgtgagtgactagcaaaagctgttctttgcttctagaaccatgctgtcccaatataactttttgcattgatggaaatgttctattttagcactgtccaataagttagcctttagcaaaacatagctattgagcacttgaaatatggctagctcgttatcctcagcaaactaacacagcaacagaaaaccaaacaccgcatgttctcacttataggtaggaactaaacaaagaaaacacatgggcacatgggggaacaacacacactggggcctgttgaggggaagaggggagggagagcatcaggaagaatacctaataaatgctgggcttaatacctaggtgatgggtggagcaaaccaccatggcacacatttgcctatgtagcaaacctgcacttcctgcacatgtaccccagaactttaaataaaagttggaaattaaaaaaaaaaaaagtattgggcatgaggtccaaaagagaattggtatcaactaagtaccgttaacatacaagatatgacaatgaagaattaatactgattagctgctagatacgaagatgcttacatataaacaagcacgtttttcaaaataaacatcttgaaactaaaaaaa

SEQ ID NO: 187284 - DNA, 701 bp, Homo sapiens
atggcttattcatgcattcatttattcatttgcttattcattcattcactcattcattcaataaacataagcattttttaccttgaggaatgaagctacatcatggtacatccaggtcaaattggagaaactctgatgtcagtcagggtacattttcccttttagtctcattcagcactttgtctgggattgaatttcctgttcctagaagactagaccaagggaactgaccaactctatagcctaggagggaatttgaaattaaattatatgacagaaggggggaatttaggaccaaccagcaacagtttgagaaaagtaccaaccccaaccaaatagatataccatggacttaataatataataaaaagcattattttgtagaaactgcttctctctttgtagaactagttgcaatgagttatgatcttaaacctagtgatatgatcacactaaacagtatcacatttaggctgtgtgtgtttgtgtatgcgtgtgtgtgtgtgtgtgtacatgtacattccacttttgcctgtgtgactatgaacaagtcagtttctcatgataggactcagttttctgaattccaaagaggacagttgagctggattttgtttagggcatcttccaatgccagttccatttataaacaattattgtttttccattcccaagaaaatgcaagattgtgttttggggaa

SEQ ID NO: 187285 - DNA, 647 bp, Homo sapiens
caaacacatgcacacttagtgttacctaatgcatttgtcccaagtcatcacttctctacaaagagcttttaattcactggctcaggtggctctggatgagttaggaggggtcaccaatgtggtttcctctgaggaaactctctccatttgtctttgagccaaccctgaactggccctggtacctgagtaagagccatgcagggccatcagcagaacatggccttgtggttctcacccagtagtgtacctcacaaccacaacttctattacttatagtcccttttccccttatttggttaaaggttacttgtatagtgggctctatgtaactcccatagtcagctgaactctcaattggagaccctactttctctaggcatcctagcacacaggcaactttatataagcctatatttatgctacattacacccccattcttacgacaatttgcttcgcattccattctcctactagcagccgctgctatcacctgtagacctattagcattcaatctattctatcattgacgtcactgctccccgacttccggcccccgtggccgcccgagccgcgcacctgcaatacccccaactaaatcctacatgcccaccatacacctccaaccagggcacaccatccacacct

SEQ ID NO: 187286 - DNA, 315 bp, Homo sapiens
aacctcttcattaatcctgcccatcacataaaactcaaattcttcctactggcattccagaccctcctctccctacccctaatctcaatatcattctttcagtgcttctaagtggctcacccatctccctaataccactttccccatcatagtatctgcttgtaggtactagtagaatatagtgcacacagtgagcttattcatggttgttgactgactaaaaagcacagaaaaaaaaatcacttcctatatgtctcaatccaacatgttcctgcaggttgaaaactataaactccaaaaaacacttcaagcaag

SEQ ID NO: 187287 - DNA, 502 bp, Homo sapiens
ccttgcagctttccctactcctgccccaactgcagtaggaaatggaatcccattagttacccattgtcctgtcttcacatttgtttgtcatccatgtgtgaccatgatctgttgatatctttgaatctcttccctccaaaccccaagtaagttgtccttcaactgttctcagtttttcttcccatatattatttctggactgggataccacgttccccttggactacaatgtagacctcttgcattgattatatatttgtagtgcttgacttttttgcttatcggttggatattatagcacaaaactgagaaaaggaaaatcaacaaagaaaaaaatttttgattaaagcagggaattaggaatattttctttttctccctattttactctttcttcaatctagcttctatatgtgaaactaaaatgcctattacctatcaccaatgtatgtgtttttagtgaaccaagattggcagcattcagtcattgattaaattaccc

SEQ ID NO: 187288 - DNA, 297 bp, Homo sapiens
gcccgctaattttgtatttttagtagagatgggtttttgccatgttgatcaggattgtctggaactcctgacttcaggtgatccacccacctcggcctcccaaagtgctgagattacaggcgtgacccaccatgcccagccaacgatttttgtgctttttgtattttttatttttcccaaggaaaataacattattaaatatgactaaagtattcttctataatctgtatacttttttttttttttgagacagagtatcactctgtcgcccaggctggagttcagtggctcagtctc

SEQ ID NO: 187289 - DNA, 410 bp, Homo sapiens
ccagctgctcacacgcagagctgacacacagccaactgggcccaactcgacattcctgggtttacacagaaagttccgtctcctgggaaacccctcagtcctaggccacctaggatggttggtcacactgcaacgcagggagcaatgggaacaggagcccagacgcctctctcagcagcccaaaacgcagacactcgcaaggaagagaaatatcccaaatgtccatcctttgggttcaaaaagtcaacttcccttaataaggtgagagacgcatctgttcagagcagcagtattcacaatagcaaagacatggaatcaacccatgtgtccatcagcggtagaatggataaagaaaatgtggtacatgcacaccatggaatattatgcagccataaaaaagaacaaaatca

SEQ ID NO: 187290 - DNA, 289 bp, Homo sapiens
aggtgccaggggacggttggtgccctttattctgaagggggatgtgctgcccagggcagcgggacctggaattacattttgagatttccaggaaagtttcaggtggaggcagaggctgggcgcagaggaaaatgtggcagtggcagagtgtggggtgagagccacgaagagaggaggtcactgaggtggacagtgggacagagagagggacggggagaggaacaggagtttcagaaacgtcctggacacattgggcagccgtcagcattgctttccattcatggacaaa

SEQ ID NO: 187291 - DNA, 574 bp, Homo sapiens
gaatacttgagctatttagctgtccttcaatcaattcctaacgtccttttatccaaggaatatttagaaatgtaactgaaactctctcatgaactgtttatggacaagagatgaattgacagctgcttttactctgtcccattgattgtttataaagctaggttaatagcttctgagtaaaattttgataatctgacctctggattttttcaaactctcgagtagatatcagtcagttctgatgagtgatctaaccttggttcgtcaatgcaccctgtgtatgtagtagtctttgattcactacgtctgtcttctcggctccaaagatcaaattaatttttcctggataaaccacaatgactgaaatccctctcctcttcaactttcaataggaacttcacttacttctcaatgatttataatccattattccctatctacccttttatctttgacacaccaaaaaaaaaagtctacttttatagatcatatgtccttgcatgtaaagttcttaaaatgttttttaggtcttcttaattttatctttcccctaccttgctctaggcttttttgg

SEQ ID NO: 187292 - DNA, 2078 bp, Homo sapiens
ccgcgctccacgcccgcagccgccagacggcagcgcctgcgtccgtgcccgccccagccggtgcgcgggagccgcgggggcaaaggcgcagtggccagcggaccatctctcgtgccctcgctctctgcgctccggggcagctgagccccggccacccgctctccaagatgaagaagctccagggagctcacctccgcaagcctgtcaccccagacctgctgatgacccccagtgaccagggcgatgtcgacctggatgtggactttgctgcacaccgggggaactggacaggcaagctggacttcctgctgtcctgcattggctactgtgtaggcctggggaatgtctggcgcttcccctatcgagcgtacaccaatggaggaggcgccttcctcgtgccctacttcctcatgctggccatctgtggcatccccctcttcttcctggagctctccctgggccagttctccagcctagggcccctggctgtctggaaaatcagccctctcttcaaaggcgccggcgcagccatgctgctcatcgtgggcttggtggccatctactacaacatgatcatcgcctacgtgctcttctacctcttcgcctccctcaccagcgacctaccctgggagcactgtggcaactggtggaacacagaactctgcctggagcacagagtctccaaggacggcaacggggccctgcccctcaacctcacctgcaccgtcagccccagtgaggagtactggagccgctacgtcctccacatccaaggcagccagggcatcggcagccctggggagatccgctggaacctctgcctctgcctgctgctggcctgggtcatcgtgttcctctgtatcctcaagggtgtgaagtcttcgggcaaggtggtgtatttcacggccacgttcccctacctcatcctgctcatgctgctggtccgcggagtcaccctcccaggggcctggaagggcatccagttctatctcaccccccagttccaccacttgttgtcttccaaggtgtggattgaagctgctcttcagatcttctattccctgggtgtgggcttcggggggctcctcacctttgcctcctacaacacgtttcaccagaacatctatagagacaccttcatcgtcactctgggcaacgccatcaccagcatcctggctggctttgccatcttctccgtgctgggctacatgtctcaggagctgggcgtgcctgtggaccaagtagccaaagcaggccctggcctggcctttgtcgtctacccacaggccatgaccatgctgcctctgtcacccttctggtcctttctcttcttcttcatgcttctgactctcggcctagatagccagtttgcctttctggagaccattgtgacagctgtgacagatgagttcccatactacctgcggcccaagaaggcggtgttctcagggctcatctgcgtggccatgtacctgatggggctgatcctcaccactgatgggggcatgtactggctggtccttctggatgactacagcgccagcttcgggctgatggtggtggttatcaccacatgccttgccgtgacacgggtgtatggcattcagaggttctgccgagacatccacatgatgctgggcttcaagccgggcctctacttcagggcctgctggctgttcctgtccccagccacgctcttggccctcctggtgtatagcatcgtcaagtaccagccctcggagtatggcagttaccgcttcccgccctgggctgagctgctgggcatcctgatgggcctgctgtcctgcctcatgatcccagctggcatgctggtggctgtgcttcgagaagagggctcactctgggagcggctccaacaggccagccggccggccatggactggggaccatcgctggaggagaaccggacgggcatgtatgtggccacgctggctgggagccagtcaccaaagccactgatggtgcacatgcgcaagtacgggggcatcaccagcttcgagaacacggccatcgaggtggaccgtgagattgcagaggaggaggagtcgatgatgtga

SEQ ID NO: 187293 - DNA, 262 bp, Homo sapiens
tgtggaattccaggaggaagaaacagtaagagcacaggcctggaggagggaaagtatggggacatatttgtgcatcagattgtctaattagttgttgcttaaagtatcaggaggtctctctggtaaagatgggcttacgctgaaacggtgaaatgtgcacttgatttagcagctcacgggggagccttttagagttttggagtttggtggtaacctggtcaaggcagtgttttataaagatgcatcaaggacaaagtgatat

SEQ ID NO: 187294 - DNA, 334 bp, Homo sapiens
gcaaagtcctaggggttggtggagccacaggctggaaatagcctgggtccctgaaacaccatgtggaggagattgcttggcaaccagggacacccagtgggacttgagcaaaaaattacccatcaccttttgatttaatctaccttaattatcattccaaaatttcttttcattatactattatattaatttcactctttcctggatactatgtctttcttttacttggaagtgtttattgaagtattcatcaagtaattttttaaaggaagggtactgaagtaaactttctgaatctttcatttaaaaaaatccccgttttactctcccttta

SEQ ID NO: 187295 - DNA, 479 bp, Homo sapiens
agaagatatacctagcttattcagctttatcttcattcagaaattgatattaaatatgtgtgatagagtgcaagcatactgtgtttcttcacaataggatttgaatttcaggggatttaaactatatataggaaggaaatatatcgttggcacttattgtttatagagaaagtacaggctgagtatcccttatacaaagtgcttgggaccagaagtatttttggagtttgaatttcttcagatattggaatatttgtgttactggttcagaatccctaatctaaaaatctgaaacccaaaatgctccagtgagcattttgtttgagggtcatgtcaatacacaagaagttttggattttggagcatttcgaatttcagatttttggattagggattctcaacttgtattcaggatgcagataagtcccttctctccccattcttcccttctactctctcatttctccaaaagctttagg

SEQ ID NO: 187296 - DNA, 188 bp, Homo sapiens
agattgtatcagggcaagttgcatagatcctacccttcctttgatatccattgcaaagatcacctccttctggggggctttcccaattcctgcagtggaaaatgaactctattccaacaactctccgaagtacacagaagttctttgtgttatatctgtatatctagattataagctttttgtcaaca

SEQ ID NO: 187297 - DNA, 451 bp, Homo sapiens
cctgacgcagagcatttccctaataatgagccctctcagaataacctttgtctccttagtacattaatcaacacagagtgactatggccaagacagtgtgatagtcctgaactcggggaattctggatgaggatatgagaaatctgtccgcatctctgcctaccgcctcaggaacttcttgggcttcccagcctctcagctcaaactcaggtgtgaaggtttatgatgcagtcacagctttgagcagagaccacaggcaggggaggaattagtctgcaaaggtgctgatcgctagggctggacatggctttcccagagaccagtttctgtgggtcccaaagagagatgaaacatggccccagccctgaaaacaccagcgaggacccaagaggatgtgtatctattgatgaggaactaatagcattagtcaaatttcttaccgggctgaatg

SEQ ID NO: 187298 - DNA, 242 bp, Homo sapiens
caatatgggttttgttgctattatttccctcacagggcactgtctattatataatttcagccctacctttttctgttgatatgccaaagcatattctcatattgatcttcatacacaaagcagaaatatggaattcatgataccttaatttcctattataaatcagttcattcagcacagatgggcatgagtaacatccgccatgtacaatgaatgtgagaaacgcttctagtttatttgta

SEQ ID NO: 187299 - DNA, 362 bp, Homo sapiens
agaggatccttaggagatgtggagaagagctgcagagtcagggagaagagctgttgtgcaggcaatcaacagtgtctgccataacccccctctcttaatttgcgcacagtaatattcactctttgtggtatatatggctctagggttttgacaaattcataaggagaaatggagaagaattaattatgagttcaagtccaagtcttctagcaataatactctcacataagaagatcattacattgtgtactatgcaattggaagttctaattaatagctgaaataccaagtgagggggaaaactttgaagtctaaattgtatcaggctttcctacacacacacacacaaacacacacacaca

SEQ ID NO: 187300 - DNA, 454 bp, Homo sapiens
gttagaagtagggttgccagataaaaaacaggatgcctgattaaattagaagttcaggggaaaaagtgagtttcagataaacaaattactttacagtataagcatgtcccatatattacaggttatatgcaaatgtcctaaggacataaaaagtgttgctttagtaagaaggaagccaaagaaagagtacttttagtggaagtagggtggtgtaaaccagattgcagttgaggaatgaatggaagataaagacgttgagtcagtgtttgtaaacaagtctttcagaaattgatttgaaagggaagaaacaaggtatttatttcacttcctctgagaagttcagtggttatttttcttacgtcgctattgttaagccaaatgactatgaaccgtttaattgtaaataacaccaaacatataatgggaccacaaataaaagagaaattattcttaa

SEQ ID NO: 187301 - DNA, 364 bp, Homo sapiens
aaatgagaagtttggaacagacccccagacaggagttcagttgtccaggcattttgatggtgtggcctgaagggctttaactgcttttaaaaattgctagcataaattgtgaagacttgaaggggatgatattgttgctcaggcctagctcaggggaggaaaccatgagcagagttgagtgcaagggacagagtggtgcaagcctgttgagaatccgaggggagaggaaagaggcagcttctagcgcaccacacacggagcaaagtcctggtgctcagagcacagtctgggagagaagtgcaaggagtggggagaagagactaatgcaagcccatcgctggagacagtgatgccagtgcacagg

SEQ ID NO: 187302 - DNA, 519 bp, Homo sapiens
gtgagtccccaagcatctgacgattcttgaatgaggatattgactacaggttacttagttgaccttgttaaagccttatcatatcaggattaccagggtacaaaaacattcctaaaataaatggctctgttactaaacactccccttataacaccattgttgacactgtgacttttaaaaatctctcatatctggccatacctgtctcaccttcctaaagtcacactgacagatgacacaccagggcaagatgaaaactgtagggacttgtgtagaatgaaacgataacttcctgttcttaaaagggactgttgatataatatcctttttgcaaaaacagggaaatgcttaaggttggagtttctgttttcaataatgaagatggatattcacatgaaaagaagacaaaagaaaacagaatgccccagctgtgggctaagcagttggctatttttatttgtcaggacaaaaacatcaaatgacaattctttcttcatttctctttatgaatctagtact

SEQ ID NO: 187303 - DNA, 381 bp, Homo sapiens
tatatgggattatcaacactgaagagagttgttactaaatttggagacagagtgagaaatagaagcagtaatataaggtagggaatgaccttaaagggaaactctaagtaatctcaggactgtatgatttaagtgacttctgcaggggaaaaaaatgctttctacaccaatatgacatggcattattagaattttaagacttgattttggtttttggagacaggttcttgttatgttgcccgggctggtctcaaactcctgggctcagagactacaggcatgagccaccatgcccagctaatttattttttgtagagacaaggtctcactatgttgcccaggctggtctgagactcctgggctcaagcaatccccggtcga

SEQ ID NO: 187304 - DNA, 346 bp, Homo sapiens
gttgaaggagtcacttaaagaagtccagctagagagggatgaatatgctgaacatctaaaaggagagagggcccggtggcagcagaggatgagaaaaatgtcgcaggaggtttgctcgttgaagaaggagaagaagcatgataaatatcgggtagagacgctggagaggagcttgtccaaactcaaacaccagatgggtaagatggggctggcgtgacctggcagcaggactggcatcagagggctgtgagggtggcttggagtgccccagcgaggtgggtggatgggaagggctttgaggcagagggaaagaggtctgtgccaggagacggcaagtcttgtcatc

SEQ ID NO: 187305 - DNA, 313 bp, Homo sapiens
gttgaaggagtcacttaaagaagtccagctagagagggatgaatatgctgaacatctaaaaggagagagggcccggtggcagcagaggatgagaaaaatgtcgcaggaggtttgctcgttgaagaaggagaagaagcatgataaatatcgggtagagacgctggagaggagcttgtccaaactcaaacaccagatggctgaacccttgcccccggagcccccagcagtgccctctgaggtggagctgcagcacctgaggaaggaactagagagagtggcaggagcgctccaggcccaggtggagtacaatcag

SEQ ID NO: 187306 - DNA, 361 bp, Homo sapiens
gcgtgcaggtttctgggatttggagtcctcataggattctgggacttgaggttccttgcgcgtagggtgccgcgccttcccgctggtgaagtctgtctctccagcgtgctccctggagctgtcggggtggaaaacctggatccagcttgggcatctgaaggtcctggaaatgactgggcttcctcacgttctagactttattaactgatgaagtctcccttcttctaattgcataaatcgtctgaattatacatgtcttttgggggaacaagaatttggttacctgctcagcataacctcttttatggaaataatttaataacatatgtaacaaatataataaaggaagaaactcaaccag

SEQ ID NO: 187307 - DNA, 170 bp, Homo sapiens
catactctcacatacataaccacccaccctactgacctacctactggctgtgcttacctcctcaatcctcttgcaacctctgtacagatatctattactacgcctacagtggtcttttataacttgtttatattacttttctcttccaccacactgtgagctccttaagg

SEQ ID NO: 187308 - DNA, 171 bp, Homo sapiens
gattggaatgtgatttccttttcttataatgtctttatgaggttttagtatcacggtgtttatggcacattaaaatgagtaggacagtaagtaatacctcttcagttttctgtaatgatttttttagaatccatattttattttattttatttttttgggacggaagatca

SEQ ID NO: 187309 - DNA, 296 bp, Homo sapiens
gatttcaatatggctgggtacagagaaggccagagccagtaatctgagacatgatgcccattaatagtgaagttactctgggcttggccaaagtaggaccaaataacaagaagcctctggggctaggaagggagcttagatttaacatggttgacaagagcagtcactccagatttctgaagacggctaggatatgatgaccaaagcagtgacttagagagatgtattctggcaatttttcttgttttgcagagaaaaatctgtaacttccactattagaaaaaggctgttaaggg

SEQ ID NO: 187310 - DNA, 422 bp, Homo sapiens
tcgctaataaatggctgtagagctgctttgagtaaggtgtatatagtgtatgtgatgctgtagccatgagtttaaatattaggcttattttgtatacctttttgcatacgtcagatttgatttgagatgtgtaaactttgtttggggataattttaaaagaaggaacctgggttttgagaggggagtagaagtggatagaataaaatagatgttttgtaatgtagctttgggagagagaaaaacctgaggccagtaaagctgagcttcaaagtgcattcttatttttgttgtcgaagggaggtgaggaagtcaagtcagttttggcatacagtttagaattgttttttggctaatggctagggttgctagtgggtgaagtttgaggcacatctttgtctcatatggctattaaccccacagc

SEQ ID NO: 187311 - DNA, 459 bp, Homo sapiens
tcaggcccactgtctctctgttactgcaatgacatacatagacatcataagacaactactctgtccatgcatactggcttggaagtgacactttctaagaccttgcctgcctaaatatgcagcacaatcatttctacttgcataggaatcattctgctgctctgaaagcacaagatccaaggcagactcatccacctaaacatacaccacgtagtcatttcttctctgggatccagccatcttcacaggaggcctgcaaaaatggtgtctgaccaatcagtctgtgattcgcaacgtaagccgggaatccttgctcttatacatcacagcttctcccaagtagtttttctataatagagttctttctgactttttaattcaaagccggaaacagactattacctttgatttatgctgttacgtatcctgaagtgaacagtacacaagggcataattcat

SEQ ID NO: 187312 - DNA, 299 bp, Homo sapiens
aagctgattgccaagggaaaacacaatagttgtcttcactgtttccttagtgataaaagtagggctgatgttttgaagatatatgagccagatttttatgtaatacacaattttcacaatctgggcagtccaaagattaaatgtactgcttctgtgggtagtgagtttctccattgctagatctaagtatcagatgggtaattagtctttgagatccctactaaacaaagtttataattatgattctagaactttctagagtaaaccataatatccctggtcaaaggcaatcaagctat

SEQ ID NO: 187313 - DNA, 722 bp, Homo sapiens
aaaaggatacattatgggtaagggaggatcctggctaaactgacttaagcaagattcttggtaaaattggactatgcagggacaaatacagaagtccaaaagttagggccaagttgagaagagagttcagagtagcctttgggaggctgaggcaggaggattgcttgagtccaggagtttgagactagcctgggcaacatagggagaccctatcttcacacatgtgcgcacacacacatgcacgcacacacacatgcacgcatatgtatgtatgtgtgtgtatctatctatatattcgataaatatatattgaaaaaacaaaagagagtttggtcaaggagagaatctttgtcagaacgtcttatatctgtgatcatcttaaacaacggtcagctcctgcccaatcttgtttgttgttttgtctgtattcttacttcctcccacaactgtgattattttcaagcaaatcccagacattatatcatttcatacatttcatcatgcatctgtaaaagataaaggtattgataatggtataaaaaaattactgttacttgttttaggtggggtaatggtattatggttatgttttataaaaatacagtctgttgaaatttctgagtctcttatatcttttgtttaagttctttgtaagggtcagaataagtctctgcattgtagttggttaatatgtcagtaagtttcttaatctgttggtttcc

SEQ ID NO: 187314 - DNA, 505 bp, Homo sapiens
taggttaaaatcttcattgtagaaagtttttaggaaagcaataaaatgtaaaataagattcgatgtggaaaacagcagtaaatactatgagaaggaagctctcctgatggaccctgtggacggccccatccttgcatctttgttggtggggccctgtgccctagagtacaccaagatgaagactgcagatcacttctggaccgatccctcggctgacgaacttgtccagaggcaccgcatccacagctcccacgtgcggcaggactcgcccaccaagcgtcctgccctctgtatccagaagaggcattccagtggcagcatggatgaccggccatccctctctgcccgcgactacgtggagtccctgcatcagaactcccgtgccacccttctctatggcaaaaacaacgttcttgttcagccgagggacgacatggaggctgtgccagggtacctgtccctgcaccagacggctgacgtcatgaccttgaagtggacacccaac

SEQ ID NO: 187315 - DNA, 1135 bp, Homo sapiens
gcggccgcctcgggtcctgacgtcgggcgccctccggccgtcactcagcgctcggccccgccccgccgcggctgccgcagcagcgccgcggccggaggagctaccgccgccaccgccgccaccgcctcctgggactcggaacgcagcgctcggagccatggcctcggcccccgcgggtaagaggccgctggacacgagggcggcgggagggcagcgcccggcccccgcaccctctctcggctgacccgcggctctcgtttcttgtcccacagaggcggagacccgacagaggctgctacgcaccgtcaagaaggaggtgaagcagatcatggaggaggctgtgacacgcaagtttgtccacgaagacagcagccacatcatctccttctgtgcggctgtggaggcctgcgttctgcacgggcttcggcggcgggcggctggcttcctacgcagcaataagattgcagccctctttatgaaagtgggcaagaacttcccgccggctgaggatctgagccgcaaggtgcaagacctggagcagctgatcgagagcgcgagaaaccagattcaaggcctccaggagaatgtgcggaagctgccgaagctgcccaacttgtccccacttgccatcaagcatctgtggattcgcacagccttgtttgagaaggtcctggacaaaattgtgcattaccttgtggaaaacagcagtaaatactatgagaaggaagctctcctgatggaccctgtggacggccccatccttgcatctttgttggtggggccctgtgccctagagtacaccaagatgaagactgcagatcacttctggaccgatccctcggctgacgaacttgtccagaggcaccgcatccacagctcccacgtgcggcaggactcgcccaccaagcgtcctgccctctgtatccagaagaggcattccagtggcagcatggatgaccggccatccctctctgcccgcgactacgtggagtccctgcatcagaactcccgtgccacccttctctatggcaaaaacaacgttcttgttcagccgagggacgacatggaggctgtgccagggtacctgtccctgcaccagacggctgacgtcatgaccttgaagtggacacccaac

SEQ ID NO: 187316 - DNA, 577 bp, Homo sapiens
gcggccgcctcgggtcctgacgtcgggcgccctccggccgtcactcagcgctcggccccgccccgccgcggctgccgcagcagcgccgcggccggaggagctaccgccgccaccgccgccaccgcctcctgggactcggaacgcagcgctcggagccatggcctcggcccccgcgggtaagaggccgctggacacgagggcggcgggagggcagcgcccggcccccgcaccctctctcggctgacccgcggctctcgtttcttgtcccacagaggcggagacccgacagaggctgctacgcaccgtcaagaaggaggtctctggcaacctggcttctgggagcttttgctagtgatgagcatctgtggcagcttaggcaccctggttcgatgtggtcccttctcaaggtctcactttcctgctttctaagtggacgaggttggacagctccaggattccaagaacctcaactcatctaatttggccagtgtcactctctgagagccaagtctttgttttttccactctgaatttgccaagtatttattcaagactaattaaaactaagtagctggta

SEQ ID NO: 187317 - DNA, 299 bp, Homo sapiens
cgagtgacactggggattgaactctcatctgtggattgtgcgtcctctgctggtctccatccaaacctgcatattctctcctcttgctagtaaatactatgagaaggaagctctcctgatggaccctgtggacggccccatccttgcatctttgttgggtaagttgtcctgtgtgctgagcttcatctagacccgtggtcttgagtctgaggggcaccttctccaggactctctcacccctgtccagccttgcccatggaaatgcagcactgttctagctggctggaggggagggtagt

SEQ ID NO: 187318 - DNA, 1039 bp, Homo sapiens
gcggccgcctcgggtcctgacgtcgggcgccctccggccgtcactcagcgctcggccccgccccgccgcggctgccgcagcagcgccgcggccggaggagctaccgccgccaccgccgccaccgcctcctgggactcggaacgcagcgctcggagccatggcctcggcccccgcggaggcggagacccgacagaggctgctacgcaccgtcaagaaggaggtgaagcagatcatggaggaggctgtgacacgcaagtttgtccacgaagacagcagccacatcatctccttctgtgcggctgtggaggcctgcgttctgcacgggcttcggcggcgggcggctggcttcctacgcagcaataagattgcagccctctttatgaaagtgggcaagaacttcccgccggctgaggatctgagccgcaaggtgcaagacctggagcagctgatcgagagcgcgagaaaccagattcaaggcctccaggagaatgtgcggaagctgccgaagctgcccaacttgtccccacttgccatcaagcatctgtggattcgcacagccttgtttgagaaggtcctggacaaaattgtgcattaccttgtggaaaacagcagtaaatactatgagaaggaagctctcctgatggaccctgtggacggccccatccttgcatctttgttggtggggccctgtgccctagagtacaccaagatgaagactgcagatcacttctggaccgatccctcggctgacgaacttgtccagaggcaccgcatccacagctcccacgtgcggcaggactcgcccaccaagcgtcctgccctctgtatccagaagaggcattccagtggcagcatggatgaccggccatccctctctgcccgcgactacgtggagtccctgcatcagaactcccgtgccacccttctctatggcaaaaacaacgttcttgttcagccgagggacgacatggaggctgtgccagggtacctgtccctgcaccagacggctgacgtcatgaccttgaagtggacacccaac

SEQ ID NO: 187319 - DNA, 836 bp, Homo sapiens
cagttcacgggggcgggttcacactctataatacgttgtcggtggcccgacaatagaatgtgtggataggtgcatgtgtgggatgtgtgcatggagtgtctgcacatgtgtgagtgtgtgtgcgcccacgtggatgagtgtgtggatgggtgtgtgtgggctgtgcatggggtgtgtgcacatgtgtaactagatgtatgagtgtgtacatgtgcacatgtgtgcgtgcatgtatccacatttgtgagttgtgtgcacagaggctactgcctccacaggtgtctttttcacatgcgtcagcgtgacctgccaagactcacagttccacgcgtctgggggcgggactttctgtctttatctgctggtttaatgagtttgactccttataagaaacacattttcttatttttttccaagtgtttagttgggcacctgctgtgacccccaccaggggtcacttacaccaaggtcgtcccttcccgccttcccatccgtgtttccctgtggctaaggtttcacttccactcagcagggatatgaaagctgctcctgtctcttgtgattgagtcgtaagctgggggtgaaaaggagacaatttttactggagttggatctcaggaggtgaggggagaactgggttaagcgggggctttagccatggaaaggagattcccttttcctaggggtttccatgacaacctgcccagaggtttatgggatggctgggttgatgatgctgtggacacttggatgtgcctttggaaggtttactgacacctcaggaattctctgagaagggacttcacctcactcagtaaggaggaaagaaggagaag

SEQ ID NO: 187320 - DNA, 942 bp, Homo sapiens
aacgcgctcacaggctatgactggcacccatctcgactggcggtctactccttaacaacttctgtgtgtgtgtgcccaggtggatgagtgtgtggatgggtgtgtggggggtgtgcatggggtgcgtgcacatgtgtgagcgtatgtgtgcccaggtgtatgagtgtgtggataggtgcatgtgtgggatgtgtgcatggagtgtctgcacatgtgtgagtgtgtgtgcgcccacgtggatgagtgtgtggatgggtgtgtgtgggctgtgcatggggtgtgtgcacatgtgtaactagatgtatgagtgtgtacatgtgcacatgtgtgcgtgcatgtatccacatttgtgagttgtgtgcacagaggctactgcctccacaggtgtctttttcacatgcgtcagcgtgacctgccaagactcacagttccacgcgtctgggggcgggactttctgtctttatctgctggtttaatgagtttgactccttataagaaacacattttcttatttttttccaagtgtttagttgggcacctgctgtgacccccaccaggggtcacttacaccaaggtcgtcccttcccgccttcccatccgtgtttccctgtggctaaggtttcacttccactcagcagggatatgaaagctgctcctgtctcttgtgattgagtcgtaagctgggggtgaaaaggagacaatttttactggagttggatctcaggaggtgaggggagaactgggttaagcgggggctttagccatggaaaggagattcccttttcctaggggtttccatgacaacctgcccagaggtttatgggatggctgggttgatgatgctgtggacacttggatgtgcctttggaaggtttactgacacctcaggaattctctgagaagggacttcacctcactcagtaaggaggaaagaaggagaag

SEQ ID NO: 187321 - DNA, 759 bp, Homo sapiens
gctggtaccggccccggtccttagcatcgtgccattgcactccagcttgggcaacaagagtgaaacttcatctcaaaaaaacagaaacaaacaaaaaggcagctgggttgtcactgatgggcagcatttgagcctgccacactggcctggaagtttcccttccagtctggattttgtctgctccttccttccccctcaccccgttacctcttcacctcccatctcatttcactgtgtagctcagtctctcccacgcacataattggggacagtgggggctctcttaccagcctcctcagcaacgcacgtccatcaggcctggcctcagtggccagccacattgatgtcacactggaattgttaccccagacagggcgaagagataggctatctccccacctcccaccctactccccactatattcccgttttgaccacctcagcccctcagctgccccctctcactttggccaatcccaggcaccaatcagacttcctcctccacctggagcccctagcatttccttgtcccctcttccccaaaacctctgtaaagggtacgagagggaccccctgccgagccgcccgccactcagggcagtccgatctaagaagcagaagctggttggaggctggctgggcctctgtccagtccccagatggataaactgccttttctcacatcccctcttggtgcctgatcttctctgcccccggggccagacccactgtgctgttttctgtcagtctgtggcacag

SEQ ID NO: 187322 - DNA, 495 bp, Homo sapiens
ggtcgttctacacggatcccaatgcagcggactcggtccgcacgtccatcaggcctggcctcagtggccagccacattgatgtcacactggaattgttaccccagacagggcgaagagataggctatctccccacctcccaccctactccccactatattcccgttttgaccacctcagcccctcagctgccccctctcactttggccaatcccaggcaccaatcagacttcctcctccacctggagcccctagcatttccttgtcccctcttccccaaaacctctgtaaagggtacgagagggaccccctgccgagccgcccgccactcagggcagtccgatctaagaagcagaagctggttggaggctggctgggcctctgtccagtccccagatggataaactgccttttctcacatcccctcttggtgcctgatcttctctgcccccggggccagacccactgtgctgttttctgtcagtctgtggcacag

SEQ ID NO: 187323 - DNA, 560 bp, Homo sapiens
ttcccagttcaagcgattctcctgcctcagcctctcaagtagctggcattataggcgtgtgccaccatgcccggctaatttttgtattttgtagtagagacagggttttgccgtgttggccaggctggtcttcaactcctgacctcaagtgatccgcccacctcggactcccaaagtgctgggattacaggcgtgagccacctcgcctggccctccatttcctgatctagtcttatatccacgctcaccacctcagcacgctcagacccacgctgctgtgggctcctctggctcctggaagagtgcgtccgcagatgctgcagtctttgtgtggctcagcaattgccactcacatcaggaactgcctttaccctgtcaggctctactgagacccgaccctggttattaagctataggggagacaaggatggatcttaaagaagacaagcaaaatgtagtgaagcaaatagaatggtggttcctgggggatgggggcaggggacaacgaggagtgactggctaacagatacagcgtttcagtttggaaagacaaaaaagtt

SEQ ID NO: 187324 - DNA, 417 bp, Homo sapiens
gaagacaccgctttctagtacacgtgcaaacaggaacaggggcgagtccaaggtggagccaatgcgaccacacgtggcactggcgtcccccagaacagatggggtgagtgtgtgtcaccaaggccatatggggcgatggcgagacgaacaatggtgtccaggtatgtgcctggtggaaggggggcacaggtgacctccccaacaacgtcaaggaaaagcaaagcacacctgggaaccaggagagggcctgtgcgtgaatccaagccacattttgctacacctgctggaggagcggagaggtttctgcaaagttcacttcacccccacctctccaatgcctaggtagccccgacacaacctcccatgcacccagccccagcccaatccctttggctccctgacattcatggcagccaa

SEQ ID NO: 187325 - DNA, 164 bp, Homo sapiens
attgcatatattccctcacagttgtaattactgtatatcataatattttcttaacagcaaatgcacattttcttcacctttgactttgtacacctctaggttttgaaagcaaatcgacccatgctgcaggattatcacagggttgttgccacccctgaaatatt

SEQ ID NO: 187326 - DNA, 383 bp, Homo sapiens
acatatgaaagggaagaatcctgaaaaataaaaatgctggttaccagtttcagttccctgatgcagactcacctctctaaacctgacacaacttttaaaataaaatgctataaaataacgcatgtctaaaagcatatgaggcactgttttaaacatattgttagcatgagaatatttatattcagggacgctgatgattattagccatagtaatggagtcatataaaagggtttcattttccctatcggatataaacacaatttcctacattcacaataaggaaaaagcacatgtaactgaaaaatgtataagtgattctattccctgctaccttccctggccactctgttagtatagttaataaggaaacagtatgtgcagg

SEQ ID NO: 187327 - DNA, 316 bp, Homo sapiens
gagaagcactgttctcagagaaagctgaccccattcctagctccaagagcaggccctgattgtacatccaaaccaaacatggtaattccattctccttgccagtgattagttcttgaatcagatttaggtttactcaatcagtacctggcatgtccctagaaattcttgtagttcagggatgggcaggtggtctctactggttcaatttcactgaggagaagaagggaatggatgctgggtaggcagccaacagcatccatttcaaaactggaaagacggatagggaccagttcatgaggaatcttgaatgtctag

SEQ ID NO: 187328 - DNA, 752 bp, Homo sapiens
taagaccacttatcccaaagctctgagtcatgatgagagttgtttgctttcatcagagctgttagtttgatcagtaagcacttactgagcttctaccttcacttggcatttttgtagatgctgagaatatcatggtaacaaaacaaaattcttatcctcatgaagcatatgcttcatttggagacaccaacaatgcgcgtgtgtgtgtacaagaataagagtaacaaagggactaaaataggcaaatgcgaaagaggatggtggagaatactgtatcagacttgttgcccataaaatcctttctaataaaaagaaacatggcagagatttgaatgaaatgagtattcagaagagcagccacacatgttaagttcttgataaatactgtgcatgaaagaataataaatggatatgactactgttaaaggcaagactgcaagagcagtagttacagacaggtttgatcccaattttagaagaatacacataaaaggtttgtaattttatagtgagaggcaacagttaatcaaaagtatagtttataaaacttctgggtaaggagttacacatatttttggttgcagtgaggcaaaaataatacagaattgtgggaaattttatgggttttattgaaataattgttaagaatacgttgtatttattgagtgcctactgctgtgtacttgtgctagatgccttatacaaattctcaattaatttttattgcaacatttcaagtaaagaggtagttt

SEQ ID NO: 187329 - DNA, 254 bp, Homo sapiens
ttatgccagatgtcttcattctgggaaacccaacagattatcacctgtgggccccatttttggatgaagaggggccattccctgaaggggacatacctcagttccccgaggggattcagatgttcacctcaactcacaagaaaaacttctggccgggcgcagtggttcacacctgtaatcccagcactttgggtggccaaggtgggcggatcatctgaggtcagaagtttgagaccagcctgaccaatgtggaa

SEQ ID NO: 187330 - DNA, 458 bp, Homo sapiens
ggttcttcaaacgctgcccgttcctaaagcaagtcttgcttcgggtcacctcccacctggtggcagccagggaaaggggaaaggaagaagacactggaaatgcatggccagccccctaggggcatgaggaaggagccttcaggtggcccacaaagccctagctctgggccaggggctctggggggctgaggggaccagactgggtgcagggccttgggagctgccagcctccttcccactgggcttccgcagaactgggactctcacttcaggggccaccacatccctcctctctgcttctccccccagatcaaagggtaccctcccacggttggcagggcctggctgagtgcctctagcaccctttgtgccaccacaggcggtcccaggaagggcagcaaggtcagaccattcctcattgaaaaccgtggctagggcacagggctctgatctgaagg

SEQ ID NO: 187331 - DNA, 208 bp, Homo sapiens
cttgtcctgggagaggagtggccgtgtcaatttttagtgggtatggtcaagagtgggtcagaatcatgtgggggttggcaccaaagtggggagagggaataagttctcagaacatttttactctctcttccctctcaccctaggagacccagaatagcaggacaatgtacaatgtgacagcctgtgtgcagaataaaccctcacttcc

SEQ ID NO: 187332 - DNA, 193 bp, Homo sapiens
ctctactgttttctctgatccatgactaagttcaagggggaagaaatacctcacctcacattttgtgctctaaccctgatgaagcttcaggcctgagtttctaactgttccattatcccagagccttttggttaagacctaaaaaacttgcaatggggaataaggaggagaagggaactgtggtcaggtatag

SEQ ID NO: 187333 - DNA, 509 bp, Homo sapiens
gtagattcttgcaggagaaggatatgactctgtgaggtcaaacaaattcaaacctcaggaatgaaactagggctggataaaacagtaggtgatgaacaaaaattaacatgtaagactcctatcagacttaatttccccatttatgttcactcttagctattaagaaaaaaaaataacctttagattttcttttgagaatacagtatatatgagttgggagtatggtaatttctctattggtgcttccatgtctgctagaaacttagcccttcaattcacaaagtgtccagtggcagcaagaagagacacccaggtccagagagctaacagctggagccatcctcacaccaatgcctgattttccaagggcaacgctgcacggctcagcttggtgattcccagctcactgtggcacaatgtaggcagctacatttaaaaacaagaactctactctcaactgatgaccaggtttagaaactctgatttgccttacccaagaaatattttaa

SEQ ID NO: 187334 - DNA, 210 bp, Homo sapiens
ccttccttccttccttccttccttccttccttccttccttccttccttccttccttccttccttcctctctcctttccttccttgcatgaactagatgctaccctaggcactgagcatacagatattgaccaagatctaatcctgtcctcaaagagttcacaacctcatgattgtcctcagccccctgtagcaaaggaaacttttattgg

SEQ ID NO: 187335 - DNA, 781 bp, Homo sapiens
tccccatatgtaaccaaaaaaatgctatcctggattttatttctctttcacaggaatgggaaggaaaagtgtggagtccgtgtggatttctcttattttatctgtggcttgaatgtacatttctgagagagggagtcagatggtgaaagggagagatgttcttgctgagtttgtttatgttgtgcttcagaggatgtaagacaagcagcaaatcagcagagacaagttaatgttcaccaccacaaaagtgaaattaaataaactgatgggcagtcccttggaagatggagtctcattctgtcactcaagctggagtgcagggcgtgatctcagctcattgcaagctctgtctcccgggttcaagcaattctcctgtctcagccttcctgtagctagctcgggactacagactggacactgcctcccaagcccgccgccatggccgcctacaaactggctgctgatccagcatggagagctgcatggaacctggcagatccacttcagcagctgatacgactccgacctgagcccggcaggccacccaggaaggtgaacgcgcaggcgggcaaggagctgcataagatgtcggctatgaggtctgacattctgcttcacctccagtcgcacgaagagacccgaccggaccctcctggcacagggctcagaatgccattgatccagatgtggcccacctgtctatgcggacttgggcgcctcatgaacggcacctatggcgggtctgcacgattccgccaagccaaacggtggacacctgcgg

SEQ ID NO: 187336 - DNA, 475 bp, Homo sapiens
aagcagcaatctggctcattatcaaggttttcaaatgatttgaaataaaggtggaactggggaagggagcaccatatagaaatcaacagatatcacttctctaagatagttccaccagacaagcccctcttgctccccgcccctctcctggctaaggccctgtcttcctcctgccagcctgctggactgctccaaagcctatgtccctctaagcctgctcagacagagccctgtcccccacccaggggagcagcccttagtaacaggactggagcaagaaaataaaacagtttaaaactttcgcagtttcccaggtatgttctggtaagttctggttgcaaactggcctgcactgggtggagagctaacagggctgggtgtgtgggctgcgggatggaggtgggtctggtccctgcagagctcacaccagctgggctgcgatgccccagcatggaaatcagcagcggcccgagtg

SEQ ID NO: 187337 - DNA, 626 bp, Homo sapiens
ctgcctcagcctcctgactagctggcaccataggtgtgtgccaccttgcccggctcacttttttaatttttcatagagctgaggtctccctatgttgtccaggctggtctcaaactcctggcctcaagcagtcctcccacctcagcctcccgaagtgatgagattaggcatgagccactgcacctgtccggtttttaatctcaaccttttttaaaaaaaaagtccataccttaataaacagtatatcaaatatgacttaatcttgtagaatcaagattttacaggtagccctgtagcacttagcccacttttcagagaagattaatgacttgtcattggtgtcatcttgtgacgtaatggcagatcaaggacttgaacacaattctactaactcttagtagagccgactttccaatgtacagtaatgcctcaggtttttcatttcgtgtcttattttactgtacaactgatccagaagagagagcaatgtgtgacatggaataatcagaatgacttggaagtattgagaaatggcaagtttgtcaaatgcatgagacttgtcctaatccagttaggcagttctttgaagcgtttgaagaaagtattaatttgagatacccatagga

SEQ ID NO: 187338 - DNA, 289 bp, Homo sapiens
gggttggggccaaagatcgagcacgggaaggaggtggagctccaggaagagaagacgcgaaaaatccaaaagaaacacggggagcactaatgctcatgaatatgcaggctgcgtgatttctcaagcaatttccatattttatagcgaagattctgcttcttatggtgtaaaattggtttattcattctgcaatgccatgatttgctgtttttgaattcccctgctaggccattttccacctcattctgttatctcacattacatcacatttgagctcttggttgatcat

SEQ ID NO: 187339 - DNA, 800 bp, Homo sapiens
ttcctagttcattattaacttagctcattgcaatgtcatattctaaactctgtctgtacaataaattaggactggtcatgacttcttggatgtttttgccccacttcaaggtagactttaattcagtctacacagttaattattgctctgaaatatgaagggaactactcttaattgtacaaatttgacaatatgaaatgtttcactaaaaacatgcttaaataacattgtaaattttgaatgttttaaaaaaagttacaaatgttaaccctcatggcacactttagaggactatttaacctttcaactttaggggattcaaagctttgtgaatcctttaaaaggattcttctgtaagagcccatacattgcgatttaagataccacctccctctttttttgttaatagagagtctactatgaaaacaggagtggataatatgaggtattacaaatccatctatcatttacttttttatgtgagccagtgaaatcatacatactgaaaacctgctgttcctcactcttcacgctggtgtagcaaacctccacatgtgcccattgtattagattctcctaaaatgcacatttcccttgggatacttttcttctgagcttttttgaatgggcaagaatggggccgactgacaattttgataaaaatacttgaattttaaatcatgccaacacatttccataatcagctagaggtatttgattgaaagttttaaacagtgatgacattttaaaggccttattaagggcttgaattatctcctttattgtaaagagtaatttgc

SEQ ID NO: 187340 - DNA, 496 bp, Homo sapiens
aagagaaaggtagatgtgaaagagaaaggtagattgagggctaggtctttattgtgcttaggggaaagtgtttttttcctcccaatttttattttattgtgataaaaataacacttaacatgagatctaggtgcttaacaaatttttaagtgtagaatactgtattgttgactaaggtacaatgttgtacagcagatctgtagagcttactcattttggtttactgaaactttatgcctattgattagtaactccccatttccttgttctgcaatctcctggcaaccaccatcattccactcttggcttctacaaatctgattatttaaagtgcttcatgtaagtgagctcatgcagcatttgtctttctgtgactggcttatttcacctcaaagtttatccacgttgtcatacttaatagaattgtcttctttttgaaggtataaatataccacattttctttttccaatcacctattggtgaacaattaagtgt

SEQ ID NO: 187341 - DNA, 402 bp, Homo sapiens
tagaagaggaatgtgggactggctggccatggattagataactgtggaatcaatgcccttttacttgggacatctttccaagtctggattatttccttaggattaactgggaaatcactgtacaaagaagaagcatatcaatagactgcttccttattttcaacccagaataatgcatttttccattgctagaggactgctttaaaatacacacacacacacacacgaaacaccaggatagcacagacagtggctttcagggatgaagatacttcctttcctgtctgttctagtctcttctggttgcgtggaacagaaactagtacaagctagcttaaggagatgaagctttattgcaagaatataaaatgttcttgtgggaatgacatgagtagccccatg

SEQ ID NO: 187342 - DNA, 343 bp, Homo sapiens
tcaactttcacaaaacacctcccagtttgatcttgctttcaactctgcatctatactgaatgccaaaatccaacttccaacgtttccttgacatttgaaaccgtggagcaaaattaagaacactctgcctacctggtgcattcttaaaaagaatcctgaagcaatacacaacgctacagatgaaactaggcactaatggtaaaatttcacaaaggggtgaactcagtggaacatacagattccacagttacactgacatgaggcctattcattagacataaatcacgccaacattcaaaagtatagctgcttatttgggaggccgaggcgggtggatcatgag

SEQ ID NO: 187343 - DNA, 508 bp, Homo sapiens
tggatctccttgctttctatttgtgccccttgtttgtcgttttgtatgaagggggtttttgttgttggattttcttccccatctctgtgtcctgttatgttctttggcttatgtttcaaaaattctgtttcctaccaccaacctctgtacatgccacaacacatacaatttgtactttcacagtttctgtgaagtaggatgatctgcagttaataatcaactgtttgggcattcttggtatccaaggaaggttttacttagaaggaagaacctggaaggacctgttggcaattagactacttctgcgtttattttacattttcccttattaacgtaggctgttgagagttgacttgttttataagagaaaccagattgacagagaagacccccaatcagatagagttattttaaaaataaatgtgtttattatggtaacatttggggtagaatctaaagggcatatttttaaaaaaacttttagttctaaagacaaaagagtttaacc

SEQ ID NO: 187344 - DNA, 559 bp, Homo sapiens
cagagatcccagtcggcatttacatgtaacctgtgcactactcccatatactttaaatcatctgtagattacttataataccaaatacaatgtaaatgctgtgtaaatagtatactgtattgtttagggaataatggcaagaaaaaaaggtctgttcatgttcaatacagatgcaactatctttttttttttctgagtatttttgatccatggttcgttgattctatgaatacagaatgctgactgtgagccacctcgtccagccagatagtgctttttggatgggaaccctatttcctattggttttaggtgggtcatcatttgtcagaggccacaatacttaaccacttagtttctctgtagctccttgtgttcaaataatcatttataagcacacagtcagtgtacagccatccctctgtagccatgggggattggttctaggaaccccacccccacagataccaatagccacccaagtcccgtatataaaatcgcatggtatttacatgtaacctgtgcaccttctcccatatactttaaatgccgactgggtag

SEQ ID NO: 187345 - DNA, 456 bp, Homo sapiens
tcctaaatggctgtatcccaaaaaaacaaaggaacagccggacccagtggctcacgcatgtactcccaaagtgctgggattacaggcctaagcccctgcgcccggcctgtttttttccttaaactttgagaagctagcagtttttggaaggaatcaagaggtgaccctgtcaagtctatcttatcaacatcctacaagcccattgattcttgttgtgttttattttctttaagttacacattggttttggatcataaaaatagtacatatttactataaacctgaaacataagaaatgaacaaaagcccttctaggtagatactcaagagaactggaaacaaaacgtccacataaaaacttgaatgttcatagcagcattattcataatagccatttaggtaacagccatttaggtaacagccatttaggtaacagccatttaggtaacagccatt

SEQ ID NO: 187346 - DNA, 262 bp, Homo sapiens
attataatcaataaagaccttttcagtttctctcctactcttttttagccccttcacatctttatcctttacatgctaacaacctagttagcattcacttaactttcttcatgtttcctgtaaagagccactcacactaggatctccttgactgcttttttttcttttgtttttcttttcacattggttgtagtcaagagtatcaatattgtctccagggtactctcacatcagcatactgctgaagggctaacctgaatta

SEQ ID NO: 187347 - DNA, 426 bp, Homo sapiens
tttgtaatgaaggctacccaaagtcataataccattgctttgtgtcaaaaacaaaaaaaaacaaaaaaaaaccacaaaaaccaggcatgatgccatgcacctatagtcccagctatataattttttaaagttcacagccactgcaaaacatgccaaattgtaaagaccatcgatgctaggaagaaactgcatcaactaacgagcaaaataaccagctaacatcataatgacaggatcaaattcacacataacaatattaaccttaaatgtaaatgggctaaatgctccaattaaaaaacacagactggcaaattggataaagagtcaagacccatcagtgtgctgtattcaggagacacatctcacatgcagagacacacataggctcaaaataaagggatggaggaagatctaccaagcaaatgg

SEQ ID NO: 187348 - DNA, 394 bp, Homo sapiens
gttaggaatcgatgcagatatttgattcaagtaattgatgctaaaatatggttaagggttaacctcaccatgagacattatatcttaaaagaggaggtcatgaatcaatacagaatctctaattagtttaattatgtggaaaaagtatttttaaagctgggcaaacctcttagaaactttttcttctatttgtccattttagacaatggtgttccttccccacccactctgctagagcttacaatatgcaggatcactgggggtagcaaatgcctttccttttatgtgcaagaactactttacctcattgggctcctcagtttttggacatagcaaattgctaatactagaaaccatctgacaagttgttctaagtaagtttctattttcttca

SEQ ID NO: 187349 - DNA, 545 bp, Homo sapiens
gtacagagtgaatgtcaataggtgattcctatccacatttccccagacagctcctctgttttcccttttcactttgccagtatggaacctaccctgtgcaaggtattgtggtagatgttgggaactcaaaggtgtaaagaaagctagccacatttgtgcagtgataaaacaagtaattccccagaccggctggtgacttctgcactgactcttgacgagcagggcttcacatgccacatgtaggtgaggatcgcttttagatgttctcaaaatatggaccccaatccaaacctgtctaacagtaaggagagtctggacatacagatgttaaaacacagtggagatgatcctggactcctacatgaagactacacagaacattatattggactggggattgtttcttccttaaataccaggttcttttagggaacattggcagggctttcattccttgtattgaatattctcaagtcgtgatattcccagtggttttgtttgctgttatggctgagacacacacacacacacacacacacacaaca

SEQ ID NO: 187350 - DNA, 259 bp, Homo sapiens
gctactcagggggctgaggtaagaaaactgcttgaacccgggaggtggaggttgcagtgaactgagatcacaccacttcactccaccctgggcaaaagaatgaaactcagtctcaaaacaaaaaaacaaaaaacaaaacaagaaaaagaaatcaatgtttaaatgatcaacagaaggacttgagctatggctttttcatcacagacaaccatttaccatcacagaaaaaaaatccatctaaattatagcatattatatg

SEQ ID NO: 187351 - DNA, 246 bp, Homo sapiens
ctaggcaagagaatcttaaccaccatcaaatgttttccacacagaataggcagacctagtttattctggaaaattgagggtttggatatgtactatataatcagaggaaacaagcagtaaaggacctgagctaatttggggtaaccaaagacttggctaacagatgcttccttactctggatccctcatatgaatcagatctggccagtgatatgctggacagaagatatctgaggttgagatacc

SEQ ID NO: 187352 - DNA, 145 bp, Homo sapiens
ggagaggatgttgaattcattggggagcatggagatctggagaaactagggagagacccaagaggagagttaatgaaagcaatcggaaattcttgcttggagtcgtgtgcggagattaggactggaggtttagagttagggtact

SEQ ID NO: 187353 - DNA, 686 bp, Homo sapiens
tgtgcagctggcagcaagaacccctaggtgcttacacttatattttaatttaattgcccatattttttccatactttcttcctgtcttgtgttgtttccacaagctccttgtaaatctagtgggaccccagatttccctgtctagtttcctaatggatgcatctcacatttttccatgaataagacgtccttcttgcatccttgaagcatggatctcaaggattaccattttccatgaaactgactgagacactatttcatgggggagatgcttccattcctccaggaaatagagttatcttctacttttgtgaagaaataaaagcaagcccaaagaaacttcagagagggaagagacatgaaaatgagaagagcaagcccctgccctaccccacaaaaatgagagcatcttagaaaagaaaggtgagcagtctgttatgtatgcagcaaaaggtgataaactgatacaatgatctatcaagataaggaagagaaatagagggtgactaaattaaaaatacaacacagtagtaaaagaacacgaggagtaaaaataattacttgaaactagaattatttcattactaccattaccatcaaaaccaatttgttactcatttctatgtggcattgtttgtcttctaatccaagtgcctgctcatttttttacatattatgttctatgg

SEQ ID NO: 187354 - DNA, 275 bp, Homo sapiens
tttgccggagctaactttcgaactaccatccaacatttcaaggttaatgtggtatgtctctattacaataaatattttttagatgagtggtgtatggtcaaaattacatcaactgcaaagtctacaattattatgcataggacaaagggcacacaatttctgctactaccattgaaacttacttacagcatataaaaaggcaatcatttactttttttttttttttttggagagggggtttttttccatcattaagccggaaatgacgaaacccc

SEQ ID NO: 187355 - DNA, 487 bp, Homo sapiens
gcggccgccgctgctgggtgcataggacgaagggccctcgacccaatcccagtccaagcttccggatgacgcacctgggctggggacctctcccacgtgaggggggccaaccaagcatccccagccccggggccacccagcctgctccggagggagggggcagggaaaaagggcatctcggggccaaaacctcatgccggatcctccggctttccccccatttccaggatatcgtttcgcatcagggacactcgtctccacacctcctacctcaaagtcctacgcacctacccttcacgtctctccaaagcaactgaattaaagcgcctactggccttggcggcgcaggtgagtgccaagaggtggaggaggaaggggcccgctctccgccaccccctttcctcgcctccccacgatcgccaagcttcatcggggatgtgtgccttggggtgcgcgggttaagagggagcttaaaaatgccccaagc

SEQ ID NO: 187356 - DNA, 1087 bp, Homo sapiens
gcggccgccgctgctgggtgcataggacgaagggccctcgacccaatcccagtccaagcttccggatgacgcacctgggctggggacctctcccacgtgaggggggccaaccaagcatccccagccccggggccacccagcctgctccggagggagggggcagggaaaaagggcatctcggggccaaaacctcatgccggatcctccggctttccccccatttccaggatatcgtttcgcatcagggacactcgtctccacacctcctacctcaaagtcctacgcacctacccttcacgtctctccaaagcaactgaattaaagcgcctactggccttggcggcgcaggtcccaagattttgactgattggttgtacgactagagttgctggagttcaagtattttcattttaactattcaactgaaagcagtgcgttacaacagaacacgggttccaaagaatttactgagaagaagcaaagtaatacttgggagaactataatacacaggcatctcatgaaaatcatccaacatatagaagaatatatagaataaagcaaaaatcatcagaaactccaccgtcttggatgaccatagttgatattctgaatggcttctgttccgattgaaccttgactgatgtagcacctatcaccaaattgctgttcaggaaatatgtcctaaagaaactcccaacagcagcaatacatcagagtggcacctctttacactggttcttgaacagaaaaaacaaaagtgtccaagtgactcatcttacagcgccactggacagcatggcagaagcttcattagaactaacattttaacaagtggctaaagccagagagcaccagggacactactgacttcttcctgctgatcactctgccaagcccttggtctcccactttaggacggcttctgagggcacacactggatcacaggcaccgaactgactgactgaaccctgaccctgggtctaccctacgctaagagcaaaaaacacgggtcttgaacgcagcgtctgacaaagaattcccacaccgggccagcggccccgtctcacgcccccacacctcccatc

SEQ ID NO: 187357 - DNA, 242 bp, Homo sapiens
cccatctgtaaaaccaacccgctcaatcatttactgacgatcttctgtgagaatgcctggcatgtgtgcctgaagcccctctgcccaggcattcggggaagggaaggagcaccttggggagcccccactcacccatgggattgctcaagtatcaggcctgatgggaagtgattcttccccttggcaagctgcccatgtgctgctgtgtgacctagatcgagtcactgtccctctctgggctt

SEQ ID NO: 187358 - DNA, 237 bp, Homo sapiens
tctgttcctcctcctaaatcctcgctgctgtaaatggcaccatgagccccagaatctgtccaagccacaaatctgctgccatgccactatgtttcctcttccctggcccccttgattttctgcatgggtggattcagacactttccagaaaaacacaacacaacaaaatactcacagatcttgaaaagagcaagcctgtcccaaagaatatcagattactaaaatactcaatgtctg

SEQ ID NO: 187359 - DNA, 250 bp, Homo sapiens
tctttctcttactccctggcctccttgttgttctttaagcatacaaagcatgctcccatgtaagggaatctgcatttgctcaaggatttccctggaacatttttcccccaaagcaacagtttatctggtttgctcacttccttcatgcctctgcttaaaaatgactttatggccgggcacggtggctcatgccagtaatccaagcactttgggaggccgaagctggtggatcacaaggtcaggaaatcaa

SEQ ID NO: 187360 - DNA, 498 bp, Homo sapiens
aaagttcattattttttattgcttttattttcatcagaggatagggtgagggactggcatcttcagatgtttaaaacacttatttaggtagcattattttttataaaggacacgatttcctaaaaccgccagaaaggctattggaaaactcagttactagcctgggaaagagagacgcatttaaactctaatagacgattatacctccagcaccccccacccccaccccaatgggattggaaaagggttgagtttacagaagagagagagcagagaagggtgggtggaaggtggggaaggcgaaggagaggcagggaataggaagttctcggcaatccccgggattaaggtaaacgccggagctcggcggacgcaggaagctcccttacctttctctctaagccccgtttgcacctgatctgcaaccataaatacttcgtggtgcttagtgtgcagccaaacgatggccaaatgttaaacaattcttcacgctccctc

SEQ ID NO: 187361 - DNA, 189 bp, Homo sapiens
aaaaggcagcccctaaatccctgttttcttggagtgcacacaccactggggccaacagtgactatgaaatgaaatttcaggtgaggaatatggccacaaaaagaacatattttgagggggtgccttgctgaagagggaggttcctccagagacttggaggaagtaaggacagactgtatggtcacctgg

SEQ ID NO: 187362 - DNA, 142 bp, Homo sapiens
tcactctagcctgggtgacagagtgagaccctgtctcttaaaacaaaacaaaacaaaaaacaaagaaaaagaaaagaaagaagaaaaaaatagagaagaaaagagaccgagggcctatcataagtcaggagcaaggctccat

SEQ ID NO: 187363 - DNA, 718 bp, Homo sapiens
actgtgcaggaatctagttatttctggccaggcacaatggctcacgcctataatcccagcattttgggaagctgaggcaagaggattccttgagctcaggagttcaaggccagcctgaacaacatggcaaaaccgcgtcactacaaaaaatacaaaaattagccaggcatgatgtgtgcacctgtagtcccagctacttgggaggctgaggtgggagggtcactggagccggggaggttgaggctgcagtgagctgtgttcatgtcactgcactacagtctgggtgacagagagagactctgtctcaaaaaataaaataaattgatttctactaattcccaagcaagtggtagaggctggattcaaatccatgtttcttcaacccacagttttccctataataccatagagattcccaagacatgaattactcagtggaaccatgtcttcctgcttcttattccccattccctctgccacttttaggtccttatcctaaaggaaaagttcagtgaaaacaaggcaactttcctgatacccagctataatgccaacatccaaggctttggagtcaggcagacctgaattcaaaaccttctctctcaccagctgtgtggacctggacagatgccctcatgactctaagcctctatcttaatattccagatgagatagcccacataaagtgatgatcgcagggcctggcccacagcaagtc

SEQ ID NO: 187364 - DNA, 339 bp, Homo sapiens
aaaaccaaattgtcataaaccagggttatagagccaacccctaataattggcagtgaaaagaacctagtcattttatagcagtttcaacatttaaagttttctgttgcctgtcttcatttttcctttgtagttttcacctggaattacgtacctactttgaaatcacctagagcataattctaaaatcattacattactcttaaatcaggcaataaaaatctcttttaggttgatattagctttagtatggtctttctaatgctaattttttttgcacacttcctttttttcctttagctccatcaaactttaaaagagaatttatgtgggaaattcat

SEQ ID NO: 187365 - DNA, 263 bp, Homo sapiens
taaccttttaggtaactgtactacctgtaacagctgtaatatttcttatgcacgccttatctccttattgtccacagtcatggttccaagggggataatcccagaggcatacttctcatctctctaggaatggggatggattttcattagggtcttgttctgtttcctggagttttccccaattgattggcttacttccctcatgcctctgagtagcatattgctacaatgatccctgttatcactggagtcccagtttgggt

SEQ ID NO: 187366 - DNA, 479 bp, Homo sapiens
ccaaattcttgtgaacagattgaaatctttggaggaatgacagtgggttgtgcctgaggatcactgccacccctccctctgtgctccagagtagcttgtatgggattcacatttgaaaaggtgcagttaccaagaggacattttcccggagggcctgtgattgggtagtaaacagtgtccctgccggccatggtgagggctggtggaaagtgacatcagatactgataatccagctctcgacactgtgtggtgatttgaatgttccaaaaatatctgggtaaatatttgacagtgataattggggtgctgtcagtctagccaaggacctgtacttagcaacaagttctcaagggcgtgcggttcaggcagactttcaacgtgctgtgagcacaggacctgctgtggatcgcatgggctcagcagtcaggctttgtagccgtatttacacgttagtttatgcgtgttagggagccaagtt

SEQ ID NO: 187367 - DNA, 303 bp, Homo sapiens
ctacccccaaaatctctcccctaaggtacccattattaacagttcagtgagcatcctttccagattttttcctatgcattgacaatcatgtgtaagttacatgtttatacatatgtattcatatacacattcagatccagaaatgtttttttccaaaagggtatcatactagtcgtaatgttctgcaacttgctttttcacttaacaagcagagtgggcatccctccatcccagtgcagatggatctggatgctccaaaatgtatgcatgccgttccctgatggtgggcatttgggctgattt

SEQ ID NO: 187368 - DNA, 290 bp, Homo sapiens
gtcaggtgtggcggcgggagcctgtaatcccagctacttggaggaggctgaggcaggagaatcgcttgaacccggtaggtggagggtacagtgagctgcgattgcaccactgcacttcagcctgggcaacagagcgatactccatctcaaaaaataaaaaataaaaaataatgtgctcttcaaacaaatttattatgaagaaagcttaaaatgagaaattccatgctcaaagagagacaagaatgaactttggcatctattaatatttctatccataaaaatttgagtgt

SEQ ID NO: 187369 - DNA, 651 bp, Homo sapiens
gactccgaggttccgtagacttgtcagtcagaacgagcttccgggcccagggctgaacgggccaagttccaggaaccgtagagatggcttctgccggaaaaggaggacaggatgctctggtccttttcaagctactcagctatgggatggtattattcactctcttcaggcccaagtggaaataaaaagaaggaggcatcatttacagacatacaaagactgtttcactggttctgatgctgtcgatgtggtcttaagtcatcttatgcaaaacacgtgcctaagtagcaatgacatctcttgtcttaaaggggttcatctttgccaagttctaatgaatcacaaagtatttgaaccagtaggaatgaagaagcttttcaaaaaagaaaaggaattagaatttgaagattccaacattagtctctacaggtttctaggcaataaatcatcttacgattgttgcaaaagacaaaaggatgctgagaatgagttcaatgaaaccttgagaccaggatatgaaatgatttcaaatcctctagcacaggagattggtgaggaaagaattgaggaacttattcatacaataaatgggaatccagctttatgtccaaatatcacagttcagaaaccttttctccggctttcaaaaga

SEQ ID NO: 187370 - DNA, 719 bp, Homo sapiens
gggcctgtcttctttaccactttgctcacttcatgaatgtgggggtgtatgaagagtatgatgaaattagaggctatgttctggagtcagactgatcagtactgggattctggccataccccctccttagctgggtgactttaggcaactgactgtaccatcctgaaagtcatctgtaagccgtgctgaccccccaaccacaggacacttgtgcccgctgcaggtgctctgtcagcagtgacttctcactacctggcatcctctgaattcacaagcagtttgaagaatgagcaaatactgagcaaagctcataggattaaatacacacagacctgtgtaagttaacaccaagctaagggttaaatactttacaaaaattctcagtgcggttggtgggtgagaagggctgtcgtcccctctggctgccttgccaagctggtagaggggccatctcccactacctactgacaaagattctttgcttgacccaattacccaatttaatcagacacttaagtcttttcctaggcccatctgtgtacttcctgtaaaatctagtgttagcaaaaaactctactgagtcagtttggtaaggaccaccggccgtcaatatcttccatatctgatagatagggttcctcatcttctaccaccctccagatgatgtctggtcaccctgcctgcctttagcaagaatcttgataggttgatttaaccag

SEQ ID NO: 187371 - DNA, 321 bp, Homo sapiens
gctgattcatttaattagtaaatatttattgagcttctaatatgcaccaaatatttacatgatgctgggatatggcagtgaaaaaagcagggaaacatccctgatctagtagaattgcattctagtagcagaacgttccagaattgtaaagggcagaaataaaagtgtttattccttggaaatggtgtctactaagcccaaagtacaacttcacttacatttcaagaaaaggtattttttaaataaaaagttgccttttacctcaacattatgcaatctacctggtaagatcatagatatgtctttctacattatgaccaa

SEQ ID NO: 187372 - DNA, 740 bp, Homo sapiens
ctgtcccattgtaaaggtgtaagttatataggcttgaaaaaaattggcgggtaaaaatcacaaaatgcagtcgaatatatatatgaaaacttgcattaggtgataaagtgactattttaagagattcagcatgcatggatattagttttgattaatgtgtacaataatttacacagtatactctagtcaatttatgttaactttatttaaaacacaatttatttggccgggcacggtggctcacacctgtaatctcagcactttggcaggccaaggcaggtggatcacctgaggtcaggagttcatgaccagcctggccagcatggtaaaaccctgtctccactaaaaatacaaaaattagccaggcatggtggcgggcacctgtaatcccagttacttgggaagctgaggcaggagaatcccttgaacctgggaggcagaggttccagtgagccaagatcgcaccactgcactccagcctgggcaacaaagagcgaaactctgtctcaaaaaacaaaccaacaaaaaccacaattgatttgatgaaaattagttttaagtaaatgtttgtaaatagatattggttgaatttttggatatattatgttgatttaacttttaaaatgttgtttaaaagtgtgaagctatgaaaagcctgataatgtgactacagatatttcagttggactagaattctgactttgaaacttattaaattaatgcatactggaagtactttg

SEQ ID NO: 187373 - DNA, 172 bp, Homo sapiens
tgacagtaatcttattcctatcctcaaactcaaacacaaaaactctattcctattaagaacttccaaattcctctagactagacttccaaactggtgagctggagaagctatctcatagtatgttaatagttgtgctgtgaaaaaaggtgttttgtgttcagtacagttaaa

SEQ ID NO: 187374 - DNA, 393 bp, Homo sapiens
gtgagccaccgctcccggcctgaaccaccgcacctggcctgaaccaccgcacctggccagaatcatcttttaacagcttccaaacttggaggtcaaacaaggactttctggggaagcaagtggcaggcagcagctaggcgtgggctgcgcatccagcggattgagtgtgggcgggaccgccagcaaccaggcagaggggctgttctctgggttggggtcaggaacctcttctggcctcagcccaggttggcagacatttccctgcagggatccgggtccaggactcaggaggagggacagtcccacgggggtgctggggggcaggaattcctgggtgggccgaggtaagggcagcacagggtgacctggggccctgggcccggtggagctgag

SEQ ID NO: 187375 - DNA, 397 bp, Homo sapiens
gtgagccaccgctcccggcctgaaccaccgcacctggcctgaaccaccgcacctggccagaatcatcttttaacagcttccaaacttggaggtcaaacaaggactttctggggaagcaagtggcaggcagcagctaggcgtgggctgcgcatccagcggattgagtgtgggcgggaccgccagcaaccaggcagaggggctgttctctgggttggggtcaggaacctcttctggcctcagcccaggttggcagacatttccctgcagggatccgggtccaggactcaggaggagggacagtcccacgggggtgctggggggcaggaattcctgggtgggccgagtcaaggccccacagttgcctgcgcctggcccgtgactgtgacgtgcctgttta

SEQ ID NO: 187376 - DNA, 306 bp, Homo sapiens
gtgagccaccgctcccggcctgaaccaccgcacctggcctgaaccaccgcacctggccagaatcatcttttaacagcttccaaacttggaggtcaaacaaggactttctggggaagcaagtggcaggcagcagctaggcgtgggctgcgcatccagcggattgagtgtgggcgggaccgccagcaaccaggcagaggggctgttctctgggttggggtcaggaacctcttctggcctcagcccaggttggcagacatttccctgcagggatccgggtcccccgctcctgcctaagagattctattg

SEQ ID NO: 187377 - DNA, 374 bp, Homo sapiens
ctttaggcaactctttcctgctacatgtgatcttggtaagaccttgaaccacagtatcccaacatccctggaccacaagagtgggtgggtgtgctagcgagttaaggccaactgtatgaacaactcgcacagtcctcaaatattctcaatttcaatggctttcattcagactctccttcagtatgcctaaaaccacatcttggtgtcaaaaactacaaagagtctaagatcttactgtacttgtaaagtgacaagttagttcaccacagtttcatagatgctggtagaagatgacacaagactcctgcattggacacagaggactttaatactcgtggcaatagcaaaagccagactgttagcatttgcctaag

SEQ ID NO: 187378 - DNA, 329 bp, Homo sapiens
tttacaactccaacttcctcctcaacacacatacacacaatactgaattcagcggtccaaacaacgtttcacactatgtgacttgatgtcccctaactgcaaatatgaaatgcctaatgtgcctttgacttattttaagcaaagtagataaagcagggcatttatcttcatttttccttctccaagtccattcatcattacttagaaaatattgcagcggcctccaaaaagtctcactagttaatcactgaatgccagaacactcttgttttttttgagattgagtctcgctctgtcgcccagcctggaatgcagtggcgcgatctctg

SEQ ID NO: 187379 - DNA, 539 bp, Homo sapiens
gtgtaatttctggaataaacacagctgtgtttgtttctccacgcagcgctccagacagaacggcagcctggcccgccgcgtgcagctggaacctcgcaccttgggacagatgccgtcagggagccgagaaaacactcctcccgcaggccactgggagctgtcatgcaggcggatttgcaaggaggccaattcagggcccctaaggaagcaagtgatgagaccacagaggtgctgaggtcccagaggggaagtgagcattgagacacctccagaggccttttcccttcgggattgggggtcatgatcaggcaggacaacgggccttagagttgtcggccatgggaagatcatccctagtgtgatcagtccatgtgggaggaccgtgaaaaggtcagaggccagccctggaaccttccaggtgggaaaactgaagtccagaaaaggggaatggggggattagggtaagagacatggtctatccagcacctacttcatgccaggccccacaatagttcccagaagcactcacctggctctgc

SEQ ID NO: 187380 - DNA, 559 bp, Homo sapiens
aaaaatgaacttttaaaagtgtacaggttatagatagcttgattaaaatttcactatgaacactgccatatcaagaactaaaactactgcagatacgattttattatgaaaaaatcaagggacaagatgaatgttaagcaaatgtataacttctagcttctgcctggcaaattgaagggaaaatgcagttcacagcaaagtttcgaaaaagcatgtacccaatagaaagttggataaaagacacaatacttaaacatatgaaaagatgtttaacctcattcgtagttagagaaatgcaaattaaaactgtattgagatacttttcacttaaattggtaaaaattaaaaagtaagacagcacattcttttggaagggctgtgagaaacaggcaatcttatacataaggcaaactggggatatttagcaatatctaaagaaactgtatgtacattttctatttgtgccagtaattccacctctagagatttaccttaaaaataagaaaatacttagcacaaagtgactctttgcagtattcattgtaactgagaaatgttg

SEQ ID NO: 187381 - DNA, 520 bp, Homo sapiens
gagacaccttagtcaattagggtgctactttactgggcaggagattgaagggtgatggtttaacgacttttcactattactatttttaagttatattttctattagcaaatcaaagcaatctaccatttgcattttacataattcgtgtcagaaacaaacatctcaattttgaagatgggattggagagcttccagtattttgtggtctcaagctatttttagaaaattctttggtttctgcagttctccttagagcttggtaaatacgggtagaagagagtcaacatgtacaataataacagtgaaggagaagtggacccacttccgcagttaccgtgcatattatgggtttaatataaaatactcccagtgatccacatcggcctgagtgcacatgtcctctctccactttgtgtttccttttcccatcctctcgcttaaaaccgaccatgtgccttgggaataaatctcattgaggaactcacatgctcacagggaggagggcaagggtggttgagg

SEQ ID NO: 187382 - DNA, 771 bp, Homo sapiens
atgactggcctttttatgaaattttgacacctgtcaagaaacctggccctcgcagccctcatcttggctcccactctgtactgggaacagtctgcacgctgtgtggcattgtgtacgttgggtcaatttctggaaacggctcactctactggccaggcatcactagaatttcccccaacagctttaataatgccaagagcgaacataatagatggtctcatttgatccacactacagacctggaagatgcctcttttattatcaatcctacgacttaggaagtattaatagataagtacctcatagagttatcttacatataaaaggagagcagacataatgcagttaggacaatgtctgacacctagtaagtgctcaacaaatgttagctctcattgttcccaatttacaggtaagaaaactgaggtaccaagacctgctcaaggttccaggtttagtaagtgttagggcagaggcaagcccgggcagcctaactccagagcaggagcctttaaacactgcactattcccccatagccaaagggaaaccacagtgaagcaatttgtggtttcgtgaatgactcattattctgtcctggattttctgccagagaggcgtgtgaagttctctggtggttttaaaatatgtccacagattctttggtgcacccctcatcaagaggtggagtctgttgcttcccctaaacctggattggacttgtgactgccttgacttctgagactaggttagaaaaggcaatgcagattgca

SEQ ID NO: 187383 - DNA, 501 bp, Homo sapiens
ttaatttctcaaacatctagtaacagttgtggccacactcaaaaacttaacaacttccaatgccttcaaccgaaactatatgtgtctaatttgggcattcaagatacttataagattacttttaactaccttttctcccttatttttcacccaactcctacattttgggtcacagatcatagaaagcttttgaatggcctgacagtcttttaaaggttgttcggttgtagtataatctaccattttactacttttggctttatgcagttttggtaccacagctatttgaggttatgaacattttcctttccaaacaatctaataacccactctgattaaactagctttactttttttctttttgcctttagagatagcagagtaccttgtacacagtaggtgcttaataaatattaatccactcttgttccttagctgtactcatgcttcttcctgttttgggaatgatctccaacttttctttgtttgcgcaaaaaataa

SEQ ID NO: 187384 - DNA, 418 bp, Homo sapiens
ggtacggcaagaacaaaggatgggacaagccaagctagggcctcttctctgaagtttacagtcatatgtgaggggcagacattagccagatgacagcaaacataacagaacattataacggtaggaagtgatgtgagtgctcacatcagggaggtctggtaggagaaagaaatagatgacagaggtaggcagaaaggctagcacattctcagtcatctcccactcacacacacgctcaattaaagagaaaacttgtggctcacgcctgtaatcccagctcttcgggaggccaaggcagggatcacttgaacccaggagttcgagaccggcctgggcaacgtggagaaaccccatctctacaaaaaatacaaaatttagcctggcatggtggcacacacctgtaatcccagctactaag

SEQ ID NO: 187385 - DNA, 510 bp, Homo sapiens
gtgtagctaaaggtttgtcagttttatattttcaaaaaaacaactgggttatattaatctttcgtattgattttctagtcttcatttcacctatttttgctatgatctttattttgtctttcttctcctgactttaagcttagatttttcttcatttactagttctctgaggtgtaatgttaagttgtatatttgggaactttcttcttttttgttgtagacatttattgctataatctttcctcttaaaactgcttttattacatcccataagttctttgtgtatgttgtgtttccatttttatttgtctcaagatgctttttaatttcccttttagtttcttctttgatcagttttttgttcaggggcatattgtttcatttccacgaatttgtaaattttccaaaatttattctattatagatttatagcttcataccactgtggccagaaaacatacttgtcataatttcattcgtcttgaatttgttaaggcttgttttgtgacc

SEQ ID NO: 187386 - DNA, 691 bp, Homo sapiens
atggctcacatctgtaatcccagcacttttggaggctgaggcgggtggattgcttgaggccaggagttcgagaccagcctggccaacgtggtgaaacgctgtctctactaaaatacaaaaaaatagggctgggcgcggttgctcacgcctgtaatcccagcacttttcagaggctggtctcgaacttctgacctcaggtgatctgcctgcctcagcctcccaaagtactaggattacaagtgagccactgcacctggcccagaaaacatatttgataaaacaaaaattttaaaaattttaaaacccatcaggtttattcataggattctaaattttatatgaaaaagcaaaggacttaaaatatccaagacaaccttggaaagggataataaaggtggggcacttacactactggacttaagacttattctgaagttacagaaatcaaaactttactggaggtactgggataaagataaacaagtaagtcaatggaataaatagagaactcccaaacagatgcataccatggccatttggttcttgacaaggtgccaatgggaaaagaaaattctttaagaaatagttctggaacaactaggtatctctctacagaaataaatgaatctctacccttgcctcacaccatacacaaaaattaattcaagtggagcatagacctaaacataaa

SEQ ID NO: 187387 - DNA, 550 bp, Homo sapiens
gccatagttggtgacttctttcatgtcggggcaattctattccaaccccaagaaccaaacgtggggcctgcgggaagggagggcctcacacacagtcctgggtgagtcccatcagtttctccactgtctgccaccccatcttcccccgatgccccatgttctgtccctctgtccctgtgctctgaggatgtgtgagcctccactggctactataacaaatcaccacccacctaatgacttaaaacagcagacatggttgggcgcagtggctcacgcctgtaatcccaacactttgggaggccgaggcgggcagatcacctgaggtcaggagttcgagaccagcttgaccaacatggtgaaagtccgtctctactaaaaatacaaaaaattagctgggcctggtggcaaatgccagtaatcccagctacttgggaggctgaggcaggagaatcacttgaactggggaggtggagattgcagtgagccaagatcgtgctattgcactccagcctgggtgacagagtgagactctgtctcaaaaaaaaaaggc

SEQ ID NO: 187388 - DNA, 548 bp, Homo sapiens
tccccatcctgggttcaagcgattctcctgcctcagcctcccgagtagctgggactacaggcatatggcaccacgcatggctaattttcttatttttagtagagataactcctgggctcaagcgatctgcccacctcggcctcccaaagtgctgagattacaggcacatgccaccacacccagctaattattgtgtttttagtagagacggggttttgccatgtttgcccaggctgctcttgaactcctgggctcaaacgatccacccacctctgcctcccaaagttctggggttacaggcatcagccaccatgcccagccaggaagcttattcccagtggtctggctctccagagttgccacgctgaaagatgcttgctctggagagagtgagctccctgtcaccagagctatgcaagcagattcaggccagccctcccagagagcatgagatggggaatcacgcacagagtggaccgaaggagggattgaacaagaaggctcaaagggtcccttttgaccctgaagtctaggatttcgtgaagcta

SEQ ID NO: 187389 - DNA, 354 bp, Homo sapiens
cacagcctagcggcggaagagggcaacggagtggatggaggaatatacccctcacactgaggttcaaagctggtaggtgccgaagggcactcactgcagacctactgtgcaccagcactactgagtcaggatctccgttctctgggagctcagctgcagggaacaacactgtgtgtgcatgtttgcaccccctctctgtgggtctgtggtgagtggccagtgtgtgttcgtgtgtgtacagctgtctgtgggtgtggctgggagcttttgcacctgtgagtatgtctgtgttttgctggtagtattgtgtgtgtgtgtgtgtgtgtgtgtgtgtaggaagggagcaggcatctg

SEQ ID NO: 187390 - DNA, 236 bp, Homo sapiens
cacctgggaaatcgcacttatttttcaactgggaaggcaaacggctgaccttcaagttactaacatctacaggacttgaaaagagaagggagtctgtaacctcatcagaaaagactgaaacagtcagatactgttccccaaatattacagatttcctgtcttataggattctaagcaaataaccagaatatcactccggggtacaccttcctgtataagcaatgccctggactaga

SEQ ID NO: 187391 - DNA, 382 bp, Homo sapiens
tgctttctgggggaccacatttgctgaaaattgcctacgggaaatgactttctcagagtgatatagttttgaggactgagattttaaaagtaaatattttattgggagcaattaatttaggaagaatagtattatgcctattcctctgtagttgattaaagtttactaagtgctgaggtcttttcccttaaaacattactttgccatgttaacaatcaggtcatagaggaatgaattcatcttttgtgttttgctaaataatcagttaacaaacatattctgagcacgtttaaagtcaaaggattgtagtaggtcacaagagggagatcgaaagtataattacatagtgtctttccttctttgacatacaattgggttgagg

SEQ ID NO: 187392 - DNA, 117 bp, Homo sapiens
tggaagaatgctggggaaggtccttcagtctgcaggatacaaaagcaatttcagaattgcagacagaggtgagatatgtcacagttatacccagggccagggttagaataacccaga

SEQ ID NO: 187393 - DNA, 558 bp, Homo sapiens
acaaaatactcaggctaagttctgtaaacagaagatttactacatgactaagagaaaattatgcagttaaaagtccatttttattaaagggtggtgtaaggaccatggtgttttcacactgcagtgtggtgtcatatttgcattgttgacacctgttttacatttctcctcatctatctgttgcatgcgcttttacagatacactccaggtctagacctactgtacgacacaatcagcagctaccaagctccaaatgatgacatttcaggctcttatttccctaacctggtggacgccaacactgacattctagccacctcctgggagcatcagcgtgataatgctcaggaagaactccaaagggaacacctacatgaacactacacagatatttttactagcttctcacactttaggtaaagtttgctaaaatatgagtgtctctattctattccaatgaaaactatgaacactttctcaggtttctagtctgctgtggttacaagccaatcaaagcacatgtgtaatgcacagtgttgtgcagccatttaggtaca

SEQ ID NO: 187394 - DNA, 181 bp, Homo sapiens
ttcacctaagttaatggccccaactcagcagctgttgccaccctccctgctgagaatgaactaaacatgaagcctcctaggatttagtttgtgacacatctgatacatcgcctcttttactgcaaatatttattggatgtcatatctgtaagccttttctaggcagagattcattcattct

SEQ ID NO: 187395 - DNA, 206 bp, Homo sapiens
atgaaaacttagggaaatatgacaccaccaaaagaaaccaacaaagctccaccagtggactcagaagaattgaagatctatgaaatgtcagacagagaattcagaataagcctctttaaaaagttcagtgaatctgccaggcatggtggcttacgcctgtaatcccagcactttgggaggccgaggtgggcagatcacgaggtcag

SEQ ID NO: 187396 - DNA, 455 bp, Homo sapiens
catgatcatccctctgtccatgtgtcaagtgactcccaagtgaattgcagatcattggattatagcggtttgcagcaaaaaaaagtcagttaggatgcttttacagtggtttaagttatagaaaattagagtatagagatacaagagtgattgtggaggtacagttaacgacatttgacgactgactgaatgtaagagaaaggaagaagcagcgaggggtggctgacatttctcatctgggtgtctaatactgtcatttgctcattagcctccagagaaggcatgagagaggaacactcttattggaggattgtgatagactcagctcaggtcatcctaaatgcaaggtcccagcaatacagccccgtggaagtgtccaggaagtgcagcaagtgtgagttttgcagtcaggggaggactcagaactatcgatgtggattgggaggttatcagta

SEQ ID NO: 187397 - DNA, 145 bp, Homo sapiens
tttatattatatcccatcacctatttttgcttaacctcaatttctccatttgaaagatttagcatgcaaatactttagctacacaaaatttctatgaggccaacaatcagatattttctcttcttcaatcatgggacaaaacttg

SEQ ID NO: 187398 - DNA, 387 bp, Homo sapiens
tctcctgcctcagcccccaagtagatgggacaacaggtgcacaccaccacagctggctaatttttgtatttttagtagagacggggtttcaccatgttgggcaggctggtctcgaactcctgacctcaggtgatctacccaccttggcatcccaaagtgctgagattacagacgtgagccaccacgcccagcccatttttcttatctttaaaataatttgttgactaagctaatggtcaaatttagtgtcactaatagtgacacaaatcttcagatctgatgcagattttaggatccctttgcacgatttcttgccaaccatgtttaacctgaattcaattgagatctaacttccagtttaagtaaatccgggtcagagagcaacat

SEQ ID NO: 187399 - DNA, 332 bp, Homo sapiens
agctagggctatttcagattgaacaaaccgaaacagtagtaggaatataatatgtattatccagaaatattagtttgaattaacagtataattcaccatccataagacatacacacacacacacacacacacatatatataaaacctcctgagtcaccaaagcaaacacattccacattgcttcaaagtcagcttcacagcttgtagggtagggatgtcagtttgagtctaagtgagattctggtatgtctaggctggtcagataagaaacaatttcactggtggggctcaaggagccctgtaagaagagttgggctctttgactttagcct

SEQ ID NO: 187400 - DNA, 328 bp, Homo sapiens
gcagtagattcactctagaagattcattctgatggctgaaacttccagaacatggataacgtttcaagacactgacatgatggggaatattaatttgaatgtgctattttcctatgatagcattttaagactgtaagtataaacagctacacaaacaagcccttatgtgggttcagatgtccacaacaacataactttatttttctacctgcagcgccacttttactcaagagaagaaaattaaattttaagtaattcatattaagcaagcaaatcaaggattttcagctggtttagtgattctctctcaccctttctcctctgagtt

SEQ ID NO: 187401 - DNA, 348 bp, Homo sapiens
cagcctcagtcaccccgggaccccagtgtccagcggccagtgtgccctcaagcccccacgagggcgcgcatgtatccagctgaaacagacattgaggcctttgtgacgccgccttcacatgtgaacaacgcacagtggcagagcggttgagcaacccacaggtcagtccaggggccaccaccaagctctgtgggtcaggcttccgtctccacacctgcatggatgctcggcccatgaccacccggtgtcaaaactgcaccctggtgcggggggatggacccacagcttgcggctacaccccaaggcctgccacacagcacagcccaccctgcaacccctcccgtgcgt

SEQ ID NO: 187402 - DNA, 1093 bp, Homo sapiens
gacgtccatgacacttacccatggatccatgtgctgacttcatttagaaggccaatctaaaacaactgggtttgtggctacctctttaaagttgtttgtgaaggataatttgttttttaatgcactttagtttgaaagtgagtctcttatgtaaggaccatccttaaaagaccaaaaatgccttgttagagtgttaaggagttttgacatgcagtggttccacaaacacagtggcttactatccttatacactgtcttataccatcattctctccatctctcttggtcactactctctgctgtcactggttaatcactaggtgccaagagcttactgaataaaagcttggcaattagaataaatggggagggaaggaccttatgaatagtccatttagcctaagaaatggcagatttagttcttctcttccaaaagataaaggtatatcctggaattgtacttaaaacttacagatgactaacaaatatatactttatatgtagttaatatttagatctgtcttatttaatacttggaggctagaagaagcatctttaggggaactatataatcttttgttagcattttctctgcattttaaaaaatcatttcaattcaaacatttatcagtgtcatgaaatcagtaatgactctttaacaattcaggtttgaactctgcattagatgtctctttaattttttaatatttaaaatttagttgacatttttttcaccaggtgcctttagcggttactaagataactgacatcagttgtttctctgaaataagtgttgctgtgggaataattttaatgttcaaggtgatatcatgggggagttttgtcttttaaaacattagaagcattttaaatattaagaatcaaatatttatagatcaaaacttgtgttttaagtattatacgggacctgtttacttatagtaaatgtgaatgtacacatgagttgttgctgaagctgacaagcatattacatacatgcattttccctgtgccctcatagttgcagttagagttccagtacctgtaggctcacctgggaggcagattagacccaaaggtagatgtttttccc

SEQ ID NO: 187403 - DNA, 172 bp, Homo sapiens
tggctttgtccctaaacacttcctctctgcctaaccacttcagttgacagctcatttgtaagatctgccacactcttttattcagcgtctcctaaagatgccacctctcagatatcaccttaacacacttcttatctgggagggatttgaaatgctttgggtgtccctggtg

SEQ ID NO: 187404 - DNA, 352 bp, Homo sapiens
acactattttactgacttgttttgagaattggatgaaataatgtaagtgctcaagtttcagaacatgaacactggagttatatagatatagctatgtgttttgagcctctgtatgtcaaaaagtaactgttaccttaatgtttatgatattagttttcatacaatcagtagtatttgtttgagaactaaacttgttctaaaatggatttttctttctatgaatgttttaacagggaatgccttgtttagttttgacaagttttctctatgctagctgtttttagactcagaaatatcccccttatggtggagttggcaacagtcaaagacagacaaaggctgttggatgtgt

SEQ ID NO: 187405 - DNA, 598 bp, Homo sapiens
aggaaagaggtctgctggtcatctaagtgcctttgaatgaagcaacaataagggtagattttgatttatactacaaatataatcttatctagagtttatcttaaattttgttgtgctgacaaaagcagagcagactaataaaaaatgtcaagtgccttctttgtgaatatattaataatcttttgtctgagatttgcaagacaaaattgagcaatgcttgaatgagtttactactgacatcaacaactgctttttccattctgccctaactctacggacaaaggcctgtttaatggctgctactgattgttaaaagtttcaaaagcatggagggtggtgacacatataggaaacctggagctaaaattgagtaaaaggctgttgcaaaaagtcttcactctgacaccatgggctttaaggtggcatttcattgtcagatgggattcagtttaattgctcacaagcaacaatcttgcttttcaaaaaggcaagtagcattaactgaggaaggttgtgtggttctagggagaaaacattaactaactggcagtggaaaacaaggaggatttagtccttagtctgccactaactgattgtg

SEQ ID NO: 187406 - DNA, 1100 bp, Homo sapiens
acacacacacacacacacacacacacacacaaatctgaaatcctgaccaatgaagacataagaccaacctttcagaaagcctaaatcaggcgcatatagatgaccaatttatttctagctcttagtaaacccacagaattccaaatcagcatcacagtctaatggcaaaactcaaaaggaaacatgaatatactgtgatctacttgtcttgagctcactgttggcctcaccattttatgatcggcgtcatggacactgggaaacagaaaagacggagaaatccgggaagcggctgtttcacttcagtgtgaagctcctactcaacaatcgcttagttatttgtgacctctcacaacactcatctgttctgtttctacaaaatgaataatccaagtggcagtagacatcaggacacctgttaccagcctgtcttttgccaagtaggaacctcagaatgagatacaactccatgaagaaccatctcttggtatgcaacaaggtcttcagtcagtcagtcaatcaattcagcagagctgcatgatacaagatcaatatacaaaagtcagctgtatcatcatcatacacaagcaatgaacaatctgaaaaagattaaggaaacatttccatttaaaacagcatcaaaaagaatatttagcaacaaatttaaccaaagaagtgtaaaacttgcaccctgtaaccacaaaacactgttgaaagaaaccgaagacctaaataagtggagggaaaaaatcccatattcatggatcaaaagacacagtgtctttacgacagcaacaccccccagggtgacctgatgattcagtgcagtaactatcagaattccaacggccttttttcaaaagtgatccaaaaatctagatggaattgtaaacctcttacatactacaacttacagaactatacaactttttcttaaaacttttttcagagtagaaaagacataattaaaatgtctaggggccggggtggtggctcacgcctgtaatcacagcactttaggaggccgaggcgggaggatcacttgatgtcaggagtttgagaccagcctggccaacatggcgaaaccccatctctacaat

SEQ ID NO: 187407 - DNA, 762 bp, Homo sapiens
gatcgagccggtacctgctgttttcaatggaaatgtttcctttatctttttcagattgttcattgcttgtgtatgatgatgatacagcctgtcttttgccaagtaggaacctcagaatgagatacaactccatgaagaaccatctcttggtatgcaacaaggtcttcagtcagtcagtcaatcaattcagcagagctgcatgatacaagatcaatatacaaaagtcagctgtatcatcatcatacacaagcaatgaacaatctgaaaaagattaaggaaacatttccatttaaaacagcatcaaaaagaatatttagcaacaaatttaaccaaagaagtgtaaaacttgcaccctgtaaccacaaaacactgttgaaagaaaccgaagacctaaataagtggagggaaaaaatcccatattcatggatcaaaagacacagtgtctttacgacagcaacaccccccagggtgacctgatgattcagtgcagtaactatcagaattccaacggccttttttcaaaagtgatccaaaaatctagatggaattgtaaacctcttacatactacaacttacagaactatacaactttttcttaaaacttttttcagagtagaaaagacataattaaaatgtctaggggccggggtggtggctcacgcctgtaatcacagcactttaggaggccgaggcgggaggatcacttgatgtcaggagtttgagaccagcctggccaacatggcgaaaccccatctctacaat

SEQ ID NO: 187408 - DNA, 171 bp, Homo sapiens
catgtgtggctgacagcggcagcttctagaggtggacaattgcaggggggcacgatcctggctggggagatgggagaaggggtcacggtggaagggtatttcagataagtcctaaagcctatctagattcccctacttagaagtagaagaagaggatccgtcgttcatctt

SEQ ID NO: 187409 - DNA, 249 bp, Homo sapiens
catctcccgtctactcagctgcagcacccaattaaagccttcttcctcagcaatactcaatgtctcaatgattgtctttctgtgtgctgagaacactgaagccctggggttttggtaaaaatacatgtacacttttaaaaaccgcaattaatgggttgtggtatattgagaaattggagtggcatcaacttggccaattctgaggaaacacactgtgcttaagtgtcagggccctgtctcctgacctcg

SEQ ID NO: 187410 - DNA, 460 bp, Homo sapiens
aagaggatagcataaggtgtccagggtacgaaggaacttggcatgtgggagggaatggaaggtcgggagctggagccagtaagcaagggaagcatgacatgaagctgaagaaacagcactggataactgggcactgcagatgatgggagtctgattttcaatctgaataccctgagaagcagttgagaggatttacttgtgggaataatatgatcatatgtatatttttaaaagatcactctggctagcatatggagaaaagactggaaagagacatgaatggaaactataaatatgagaagggtatcctcgagtaaaggatagcagtggttttaagggtgttgtttcccaatatgtgacataagcctaggccccttgctgtgtcacacagtgaggtcctcgaggagctcaacatttcagtggaaagaagaaaatgtatacctccaactcaaaacagagt

SEQ ID NO: 187411 - DNA, 172 bp, Homo sapiens
ctacccttagtttcagttttctcctaatctactttggtatcatggccagtcacttcactcactcttgctaataccctaaaccagtgcttctcacactgtggtcaggggcttccttgggattgatgttgaaatcctgggagtatttgatgttacctatgaagagcttgtggag

SEQ ID NO: 187412 - DNA, 438 bp, Homo sapiens
tctctcacaagcctgcaggtctgacaaccaaccctactcacatttgaggatgttacagcactcagtcatagcaggtgtggtttttgaattccagattacatcattagtacctcatcatctgttttcattaatcaccttacattcttgacttttaaaaatttggattgcttattcctggtcaatttgcaacccatctcattagctaaggacactttttcatatgtaaatcagctgacatcgtggtccagcatattgaatctctgaaaaattattgaactcagatatttattcagataactattgaactattgaaaattctgtttccagtatcactcttatatctgttgtataataagctaaaaaatgccatgccaggcatcccactgattctcttatgggctttaataggactgaagtggctccttcaaatcacacacg

SEQ ID NO: 187413 - DNA, 463 bp, Homo sapiens
agtacattagtgactttggctggataaatttgatacataaagaatggcatcattaatgtgctaactaggtcaaaacaatttacttactttaaaagtgaaaaaacatttgactctttaagctattttaagcttttatttaataaaatatgtcaccaaaatatttgaagtgatacattttttaaagcatgcacaatgcagtagtaacccatctgtccctaacccaacatttattgaatgtctattatattccaacactaggagggatgaataaaaagatgagcacatattcctggccctcaaaagagttgacactccatcagcaagatacatctctaaaacatgatttcaattaccagtagagagtgatttgacatgatatagaaaaatttgaaaatgtacatatcttagtaccatattgtatatacttctcatatatgccgtagagaactcttgaagatgagca

SEQ ID NO: 187414 - DNA, 498 bp, Homo sapiens
tggcttggtgatgcatgcatgtaatcccagctacttggtaggctgaggcaggagaatagcttcagcctgggagggagaggttgcaatgagccaagagcgcgccactgcacttcagcctgggtgacagagcaagactccatctcaaaaaaaaataaaaatacttttcaaaaatccaaacctaaccacaccatatgaaatgttacttctgtgggaagactatatggtttgcattttggtccacattccacttattagcctagacgtctctgatctcacagttttttattttctcctttttgggggatgggccatgatactgctgaaatgctgacctacatctaattctatatccaatacccgttatctacatggctgaatgcagtatacatttgggttcactatcaggggaggggtatggacaggatatcacacagcaaaacaatagcaaagcagtagaaccaagatcttgatgctctgacatcgttgttcctgttctcc

SEQ ID NO: 187415 - DNA, 148 bp, Homo sapiens
agaaaatgactgacaccaattcaagacagtgattaattctgggtaaggaaggaaaagggatgaaaatgaggcttgattctatctctgatttttatttcttaaaagagagagaggccaggcaaggtggcttacacctgtaatcccagtg

SEQ ID NO: 187416 - DNA, 285 bp, Homo sapiens
acctaggtatctcaaaaattttttttaaaaaagagcaagcatatgtggaatattgagtaatttatcagaactgaggcataaaataggaatcatggatcaggagggagtgggaaaatggtaaaacaatgaagctactgagggaagcatagcccatattgtgaggtcagcatcaaataatgaaacaaaaaatgttttaagccctaatagtagcagtaattgaaaagaatagatttgagatctataaagtaaaatcaatgtcttaaagattagaagaaaaaagggaga

SEQ ID NO: 187417 - DNA, 281 bp, Homo sapiens
ttttttcatttttttgtagaggcaaggtcccattatgctgctgaggctggtctcaaactcctgggctcaagcaatcctcccatctcggactcccaaaatgctgggattaagggcatgggccaccgtgcccagcctaaaattttatcttaaaaaaaagttttaaaaaaattctgataaaatacaactaagataaaatttcccaccataacaccttttgtgtgtatagttcagtggcattaagtacatttatgcagcctgtgaatggatgtcgccaccatcca

SEQ ID NO: 187418 - DNA, 359 bp, Homo sapiens
ctgttttcaccaccaccacacaatccagttttccagcctcggttccattccatccacttagctggctcccctcagctcatgcacatactacacgtgctttaaattcccaacactaactaacagtaaccttctctattattagtaccttttgcagttgactgtcctatagtaccaaaatacattttgtggtttattaatacagaccaacagcactttgaaagcagtgacagcatggctgttggggctcccgtggccctcgtgttcctcctattccagggtggcagtcaccatgggcattttcctcactgtagtactgctgatagccagcacagtcctgaattcagtagggaggtgctcaa

SEQ ID NO: 187419 - DNA, 555 bp, Homo sapiens
gttgctggcgtgggcatatggagtgggtcatgcacagaaactgactaggacaggtgcagtgggtcaggcgtgtactcccagcactttgggaggcagagatgggaggatcacttgaggtcacgagttcaagacaagcctgggtcacatagtgagagcctgtctctatattcaaagaacaaattagccaggcatggtggcacatacctagaggcctagctacatggaaggactgcttagcccagaaagtggaggttacagtgagctatgaccaggcatctgtactctagcctatgcaagagagagagcacgtgtctcttttaaaacaacaaaaccctgatgcatactagtttaacagactatcacagtcctgtcaaaaatactactcaggtgggcacagtggcaagggtctgtgcccttagtaattagtaaaactaagatgagagggatcccttgagcccacaagttcaagacaagcctgggtaacatagtgagcacctgtatctatattacaagaacaaattagccaggcatggtgacacatacctagaggcctag

SEQ ID NO: 187420 - DNA, 469 bp, Homo sapiens
aggagactcttgcttgcgagaaaatataccaaagcccacattacttttctccttattggaagaaagagaagcagccattgtaccaagctatcttctggtggaggtctgctaaggatacacggaggtctcagcaaagggaagaaactatgtgatccaagggccaccctgctcctcggccctgcccatgttaactgaccattgcactcattctcagatctgtagccgtcttcctgtctggaagctggggcaaccaccaccagtcagcacttcagggtgacagcataatttgccctccttgtgccaggtacggtcacctggtttgccgcattcacattttcaggtggatgaccaagcggaggaactagaagagtctagtgaagcatccagagactggatctcctttcacatctggtttgataaactccgaatgaaggagacccccagcctcaggaaagcacctgtccttcca

SEQ ID NO: 187421 - DNA, 479 bp, Homo sapiens
ccaaggtcccacttcctaataccatcatattggtgattaggatttcaacatacaaattttcaggggactcacacattcagtccaaagcagttcctgttgattagctgaaataatgtgacagagctgtactgttttccaacagaaaaggtacttttaacttttctgttagaaattttgatatttttcctgagactggagaaggtaaaagagtatccccatttttgtgcatctgtgtattaaattggtatgtgaataaaagaggacctatggtttataaaacagtgaaaaacaaagaagtggagtagagagggttagtatcattggttcatgcagttttttaaacatctgtcctaatctaaccaaattaagtgcaatgtagtaattggacttttgtattaccatattttgcctctcttcctatttcttctgcctctgaagtaacattgcagcttgtaagattgacaattatattcagtctg

SEQ ID NO: 187422 - DNA, 499 bp, Homo sapiens
  misc_feature (420)..(420): n is a, c, g, or t
tcaggtactcaagaaaatctatttatttgaacaacagatatatcaatgaatcctcaggagagtaaataccctcccgtcaagaacagatgactcactatgctgtttactcttcaactattttttttttgagacggaatcttgctctgtcacccaggctggagtgcagtggtgctatgtcggctcattggaaccttcacctccaggttcaagtgattctcctgcttcagcatcccgagtagctaggactatagacatgcaccaccatgcctggctaatttttgtatttttagtagagactgggctggtgttgaacccctgacctcaggtgatctgcccgcctcagcctccaaaagtgctgggattataggctagagccactgcacctgccagattgctttataattgtttgtttacacttcnctattcttcccagaggctagaaaccatgtcttattcatttttaccttacctgttgtgaaacattgaggtaatccgtgag

SEQ ID NO: 187423 - DNA, 302 bp, Homo sapiens
ccaacatgtctaaaacattaagtctgccccttcccagcacctggaaccaggctctcttccagtattcctgtcttagtgaaaggcgatgccatttattcatctccacaaagcagtaatttacctccctctctctcaatatctgcaaattattttttcttccttccttttttttttttttttttgagatggagttttgctcttgttgccccgggcggggggcaaagggccccttttgggttaatggaaccctccgcctccggggggggaccggggctgaaattcgaaaccagggccatagtttt

SEQ ID NO: 187424 - DNA, 340 bp, Homo sapiens
gctttacatacattatctcatctatcctatcaagaaacttgcaaatctggatcttaaccccattttacagatggagaaattgatttgtgaatgttttgtgtcccctgttggccagcaaaatgaaccgacctatctctgccccaccaactcctttcttgcacctgaggagtctgaatctctacatttgtctttctatcttctcatctttcattggttaatcacacctcaggcaatcttttatccatacgtgtatatacacccctctccccttttcatgcctttgttttcaatctctttcttccaaatgctgcccaatcacgtcaagaaaaggtatttgtcc

SEQ ID NO: 187425 - DNA, 461 bp, Homo sapiens
taggggctgggattttaaggccagtatggatgggagataagacctcgggctaatgtgatgtggggagctagaattgatctcctatgtgaagctggaagccgaaacaggactaccatatgtttgtgagaaatgagctagaaaaattccatccactggtccagggaagcagattgttaccttctcagggtcttagatggaaaaagagtggacaataataataaattagaaccacactcttattaccatgcatgaatatgtgtacagtcatctctcagtatctgtaggggattggttccaggacccccactacaggtgccaaaatccactaatgctcatgtctgttatatggagtggtgtgctatttgcctatactctatatagatcttcttgtatagtctaaatcatttctagattactatacaggttgagcatcctaatctgaaatcagaatgtcacaaaat

SEQ ID NO: 187426 - DNA, 210 bp, Homo sapiens
gaaagagaaactaaaacccattcacatgaatgtaattaaagcatttaaagacctaccatttaaatcttaattgagaattttgtcacactggttgaatataaagatacctactaaaaccactgatttaggttactctctggaagcctttctagactcttagctcttataggcagaagtataaatcagagaagctagtgacagaataccaaa

SEQ ID NO: 187427 - DNA, 357 bp, Homo sapiens
attgtgaatgatgttgctatgaacattagtgtacaagtatccgtttgaatccctaccttcaattcttttgggtctatacctaggagaggaattgctggttatatggcaactctacgtttaactttttggggagccaccaggctgcctgattgtagtttgaatttgcagttctcttactgtgaggttgaacatcttgccgcatgattggactctttggcgttctcttaccacacactctgtgtgcatgagtcaggcccgtgtcagggctggggcgttgggttttcccttttgcctttcctgttgggctttccctgccacgtgcctggcgtagtagctctttcatcagttcttctggaa

SEQ ID NO: 187428 - DNA, 383 bp, Homo sapiens
caagctccgcctcccgggttcaagcgattctcctgcctcagcctcccgagtagctgggactagaggcgcgtccaccatgcccgaccgttttctgttatttttataattcaactagaggtaactgcagggttaccaaaaacctcattagactccataaccgtagatttacatataacaatcttgagtgataaaataaaaacttagacaaaataaattcaacagagtttgcaaagaatgactcacaaccaggcaaccctcaaaaccagaacaggttcagagagctcccatccacaatgtgggcagtcaatatagacaggaaaaggctgaagaaagcagaaataaggaacaaaaagcagatgggtccttttaaagttaatttcctt

SEQ ID NO: 187429 - DNA, 330 bp, Homo sapiens
agaggagtataccaaaagcagacattttaaacattgatagtcacgtaagggtgcccagcaggaggaagttactgtaggaagctactgtattgcagaaaaagaaaagaaaagcaaactcactttccaaaggacgtgtgggtgtgtgtgaaagagagagagagtgcacagcctaagtcttcattctctctaatgtaagttaatagatattgtctgatatttataataacttatctaagtagttgaatgggaatgttaataaaaagtaggacggtgagtgccagaaatcacacacacaaaaaaacttaaacaaattgcctataaggagggact

SEQ ID NO: 187430 - DNA, 202 bp, Homo sapiens
ataatgaggctccgtggaggccaagagacagaacaccaactatgtgaaaagcagctgcgaggtcaagagggatgatgatcgaagagtccattggcatgacagcaaaatgttacaaatgaactaaaaagaacagtttagtagagtagccctgggagcagggagagagttgcaggatatgaagaaatgaatggggggtgagagg

SEQ ID NO: 187431 - DNA, 542 bp, Homo sapiens
aagagggtaaatttattaaaataagtcacattcaaggagaaaaggccacatgcatgtgcgtgtgcacgtgcacacacacacacacacacacaagcagaatgaagatttcttttactgaataaaagttcaacatgaccaagaaaaagtgttttagaaatatggcatcatgaataggaatttgcagcaccatttcaaaaggtgtttgctggttaaaacaaagttttgtcaactgtttcttttttcctgtgggggggaaagtgtacctatcaaatattgagaaattggaaataagatttttttaattgttgtatcataaacagtacagggaaaaatgggtaaagataatttttttcaagtttggaataaagttattaaaaaaagacattatatgggtaattctgaataaaggagacactttttaactgtattgacactaaattagttttatatgtgaaggtcaaggctttactgggatgaaaggtaataagatgaagtggttaaccttaacattatctgaacttgagatattaaccaaggcacgc

SEQ ID NO: 187432 - DNA, 416 bp, Homo sapiens
gcagggaagaagacctggaagagctgtggaaataacacatctacagatatattttgagcaaaggtcagtaggtgagggaagtaaatctgtgaggctaaagaacatgccttttagtgggggaatgaaaacatgtgatgaacaggggtaacaaagatgtcagtgcaatacaagcccgaaagcaagtggagacaacacgtccctgcagtttctctaagggtaacacaggtgtctatgtccaaagcagtttcgttggaaaaaaatggttgagatgatcatgtgatttcaacttttttgaacatgaatatatcactcaccgtgtgattagaagtggggatgaacttgaactatcggacctgctggcaaaactgctactcgagggtggctagctgttacatggccaatggaaactaatcaga

SEQ ID NO: 187433 - DNA, 355 bp, Homo sapiens
acatcctagccacctcaggcccaggacaaaactaaacattagcccccagtttaaatatgtcccttggtccaggtgttgggagaaaataatcagcaacctcagctgagtgagaaaaagactgcaggtagggaaaatggataaacaatgggaaacctgtgtctccttgtgtatgccctatttcttcccacattgctatttctccaggacccacagttgacaccccagttgggagaaggttccactggtcccaagaagctgaattaaaagctggcttcttccggtaccagaaacaaagtcaatgcgaacacttctccaaataagagttacaatagtgttgagagtcgccatcttttgt

SEQ ID NO: 187434 - DNA, 415 bp, Homo sapiens
ggtcgctcatgaatcggacatcagccacttcttgtttgaagttgtccacaaccacctatatatttctcttttctggatgcttcatgtaaatggaattgtacagtatagtaaacacagtttttatctactgatttttatattcaactaggttcaacatgtatccagaaccaaatgtttaaattttctttctagaagtttgaaaatatttatcttccttgattcttactactgtttctgctttctgtctctcatattgaaagagactttcttttaaatgatcatattcattcattagcttcttatttttctcttctagtatgaggtctttctttctactctcaataaagcctctttggatattaattactgtctctttatgatcctctttctgatgaacatcaattagttgctgttc

SEQ ID NO: 187435 - DNA, 591 bp, Homo sapiens
acgctatcctacgccaattcaggacgtgattaagtatagactcttaaaaatctttgcccaagaaaataaacttgttcctgaggagaataacttctgaccagtcttaaaagccagctgtaaagaacagcactctctgtcaatatcaaggaatataaatcgtatttgctcaccttagctgctgtacaagctccggacagctctgaaatcaaagaaaattatgttaaaacattaaaactactttagcaactttgaagatatcaaaagcctttctctttttctatagcacatgttttacaacaaaaccattaaaactacagatggtcctcatattaaaatattaaaaagcatcttcttcctacttggtgaaccacaggattagggtgagaaatttaaagtcaaagcatatgaaatagtttttaaaagaatctactttcagtagcttgtttaaaacattaggaactctaatgccatacatggaattcatatcaaattatctggttacacagattttacattcatctctattacataatttttcagatcatctgttcttgattataatctctttgaaggtagtaaccctgagtcatt

SEQ ID NO: 187436 - DNA, 500 bp, Homo sapiens
accctgccacttagaaagtacatgagctatttggaccatacgaactaggggtggttaagcagaaccaccaaaccagccctggaccaccaacctccagataatacaggacagaaaaaaaaaacttccctctcattcacgtcaccactatttttggtatccgttacatacagccaaacccatgtaccaagcagatcatcctacataccaacaccagaaatgtatcgtatgagaaaggaaaattgagacccaatctcacttatgattatagatgcaaaatcctaaataaactgttagcaaatggaatcaagtattatacttaagaaaaattatgactaagttgggtttatgtcatgattgcagggatgactttaacattagaaaatacattaatgtaagtctccacattaagagattaaaaattaaaaccatatgatgatgccagaataaattcaatacccatttataataataacgcttaataatctaggaatagaaaggaa

SEQ ID NO: 187437 - DNA, 421 bp, Homo sapiens
tccccagaaaagcacccctgagcataccgtgtaaagtaaccacgcgccctccagcataatctagcccatccccctagtttattttctttggaggattgcatggtctgaaagcatcttattcgttcagttgtttattgtctctccccctctgacagctatttgctatcattgtccagttctagaaatgtagagctgtaaaggcccttggaaaactcaaagccctattgtccagaggtattaacagaaacgaaggagggccaagacttgctccatctcacagcaaagcaggaacaaggtcaggactagaccagggtctcctggctactcctccaatcaccctatctcagtgggatactcctcagaatgcccacgacaatctttcaggagtcagtgatgttccccaaaagcctctgccactttg

SEQ ID NO: 187438 - DNA, 303 bp, Homo sapiens
gggggctgcagcctggcgggggggtccctgggagtcagaggtcagattggatatctgtgacctggtcaatcaggggccagtgcagggggcctgtgtcaggagggtaacagccctgtctcagggatctctgggggcatttcagccagggttgggggctggagctgctaccaaaggttagggccctctgtagttctgagcagggcttttgcaaccctggctgagggaacatgggagctccagccgtttttgtttttgtttgtttgcttttttttttttttgagaaagagtcttgctctatcaccc

SEQ ID NO: 187439 - DNA, 177 bp, Homo sapiens
gagcctatccagataagtcacttaacagctctctgcttcagtttctgcacaatggacatccgtacactgcacatctgtacaatggggatgaaatcatcggccgaggggagtccgaggcggtggatcatttgaggtctggagttcgagaccagcctggccaacacggcaaaaccctgt

SEQ ID NO: 187440 - DNA, 377 bp, Homo sapiens
agcatctgaccactgattattgtgcactctttagtactaaatatatgtgtgactcttgaacagagtcttattcctactacaacctggcagtttttctgtaaatataagaagaaagcacataatgttaactgagtagttacgtttggttctttctttgttccttttttcaaagaaacatcatggtgatgctaattattgccaacaatggatggggtcactatacgctattcgtctatttatttatcgctaattgataagattagtctatttaaagctctcccccagtttctcatgaacatagagtcttgatttcagaccagtgatgatggaggccatgtagctctgttcttttgcagagatgagtggcacatgccatg

SEQ ID NO: 187441 - DNA, 493 bp, Homo sapiens
agaggatctctacctaatggctgtaccaacagaaacgcgtcttctaacggcatatttccttgcattttggttctcatatttttgtaaaaaacaaagaaatgaaaacaaagtgcccttatggtactgttctgaactagaagatttgaatttcagggccgctaggagagtttcctctgccccccttttaaaaaatgtcttcaggcctaacaaatgataacatctattgttatgaattttttttccttccacagtgtgaccttggagatacctcatcatatcacacaaaggtgagctttttagaaacctgtcttgttattctagctaattactttgcaagatatcaagctcagtgttaggtcacagctctagacatcataagctgtattgtgcctactaaaatatcgaagcaaattatttgtattttctttgttccttaagactctcataattcttaaatgattgagaatctcaaagagtatatgcttatattgat

SEQ ID NO: 187442 - DNA, 392 bp, Homo sapiens
aaactgaaagaaaccacagaccttttgaaagacgcagtggacagtagcaccatgaactgaatggaaaactgtcttcagacggtgacacacactcccgcaggggagcgggacaatccaggccataggggaaggccttaaccctacccagtcctggagctgatgaactgagcaatgggaagtctatgagaaggaaaggcattcggatgtgtcttgcgtgcattcccagactccagtgggatgggagcgaagccattcctgatcctgtctcacaggggacctcacggaagtatgtagtcagaagtatgtagtcggaagtatgtagtcagaagtatgtagtcagaagtatgtagtcggaagtatgtagtcggaagtatgtagtcggaagtatgtag

SEQ ID NO: 187443 - DNA, 272 bp, Homo sapiens
cagaaggaagagagagagaaggggtagctgctacatacttctaaatgatcaactctcatgagaactcattcactattgtgaccaaggaagacggtgctaaaccattaaaaaccgtccccatgatccaatcatgtcctatcaggcctcacctccagtattggggattacaattcaacatgagatttagtggtgacaaatatccaaactctatcaacctctaatgctgacctcactgcctttcctcctgcccaccatcagctttctcctcctct

SEQ ID NO: 187444 - DNA, 304 bp, Homo sapiens
ctctggactggcaggccaatcactgcaatggacagcaaagagaacggaatcagtgttgctgccagccctgcagttctcctcagcataaccactaaagaggaaatttgagtcagatgttactttggtcagctccttataagcccttgttctcttcagcattttgagctcttagaaagacaggaagtcactccttcttgtattgctctggtgggaactaagcaatcaatttaccactaaagctagaagatgtagtataggataccatggaaatctttgagctggatgactaaaagattaggcatag

SEQ ID NO: 187445 - DNA, 231 bp, Homo sapiens
aaaccatacgaatcgagctcgtacccctttgcaggcctcaagagaaccccttgctctggggagtctgctccagccccactggggctcctggagcagtgcccaccttggggaagcaacaacagctaacaacaacaggcccttcctactgccaggcacagcacaaaaccccccaaagtgcacagggttcaaggaggtgatgccctttgaggggttttgtgctgtgcctggcag

SEQ ID NO: 187446 - DNA, 238 bp, Homo sapiens
ctttcaaaattaacactcattaaaaagtatgtgatttgcattagcacattcttattttgtgataagagtctacaagaatcactcttaaattatggcagcagcctatccccagttcctgggcttaaacacaatatgacaaaagaatcataagcaatgtgttaattagcctgtttctgattttaccttcaattccacatatttcatgattttcaggaaatctgtttattctttattattc

SEQ ID NO: 187447 - DNA, 411 bp, Homo sapiens
gccctctggtattcatgctcttgtgtaatgctctccccttgactgtgggctggaccaagtgacttgcttctaactaaatttagcaaagatgatgggatctcacttctgttattaggttacaaatgactgacttgttggtattctccactgcatgatcagcttgcaagctttgattgacaagctgccattttggagaggcccatgtggcagagaactggaggaggtctcagaccaacagacgggtcctcagtccagcagcccacaaaaaactgaatgctgccaattacatgagtttgcttggaagcagagccttccctagtcaagccttcagatgatacacccccaagcgccggctcgtggcgtggctcatcgggtggctcttggggggctcttggtgtggctcttggtgta

SEQ ID NO: 187448 - DNA, 455 bp, Homo sapiens
taactgggactacaggcatgcatcactattcctgactaattttatttttgtgagatggggtctcaccatgttccccaggctggtcttaaactcctggacgcaagcaatcctcccacttcggcctcccagagtgtggggattacatgcatgagccactgcacccgatctgtttattttcctttacctcttcaactgtttctcttctgtccagcctctgaaatgctaagttccccagggtttacttctaagcttacttctgtgtatgttctccctgagcagtttcactctcatggctttaaatactatctgtaagccagtgggactccagtgtatattgtttgagcccacatttctagtctaaggtatctccaactccctgcttggcatttctgttgagacgttttactagcatctcaaatttaatacctgtgagactgaacttttgatttccaacc

SEQ ID NO: 187449 - DNA, 332 bp, Homo sapiens
tgtggacttcagttctgctctcatctcttatctaccataccaatttttataattaaaacaggaataaacaaggtgcttaatgtaatctgcaagggagaaacagggcgattgaacagaagggctgcattctggtttcaagcacagggcgggagagtctatatatggtgcagagggtgctaaaattgtaaatataaattcttaaatctgccaaataatggtctgtaaatagtgtaaaataagaatgttctcatttacatttaaatagtttagatttcttgtttttcactacaaaaatataatattagtgcaaatattatctggcaatgaaagta

SEQ ID NO: 187450 - DNA, 345 bp, Homo sapiens
gaaggtctgtgcagatggctggtgctgctgctcaagcagaaagagaaacttctttgtggcttgtgtctgctcccaacacaggagagacttggggtgtccagtcagctgtggtgctcctactttggattctcattgaagctgaggcttcctctttaaggacacacctgccaggccagcatgctcatggtccttgtcctcctggcacattctttggtacagaggttaagatcctgatgatgtgagagtgtgcctcctagagttggtcctgttgacacatggcccctgagtgccacggaggtttggagatctcttttgtatgcagggcctggatgagctggtgcattg

SEQ ID NO: 187451 - DNA, 551 bp, Homo sapiens
accctaatggaactctcagtacttaaatacatcctatattgacatggtagtctcatttctttcacaggtttaagaaagaactctagggttaaagaatcaatatataagaatattttgaaaagatcaagactatcagcagatccagaatagaaccaagtatatactgcaacagagagtattattaatctccatggccaaacacactctgcaaaggtacagttagcaccacagaagtaaagcatttcctgatatgcaaaggactggaagaaattgtttaaaggtcattttgttgcctaggaagcactgggaaaatgaagagaaaaaaatgtgatataagaaaatattaacaaaataccaaaagcatgaatttcatttaacaaaatgaatttttaatatgttgcaagtaaactgaactgaaaaccaaactctactttcttcacttaacttttcaagacattttatcttcattttggatggaacttctatgggcatttgatcctaatttttttttttttttttgatatggagtttcactctttgttgcccaggct

SEQ ID NO: 187452 - DNA, 466 bp, Homo sapiens
tacccagttgaatgcgatcttaaaaagatcactcccttccccaaccagcaccagagacctgcttctttaatagatgtaaccattcctttccttccatattagagaaatttaaaacatgtttgttctaacagcaaaatgaggcctcattaacagctaagtcaaacgtaagcaatagatttaagagtttttcttgataacggaggaatatgagatatatgaagtacagagacaaatagatactaaaggatagactatgatgcaaatactaacataatccagactgcatgtgcaacacacttcaaattttcagtgtgtatactttatctttcaaaaaaggaaaacatattagatgtggctatctctaggtagtaagacaactttttctgtatgtgttcctatatttcccaaatgtattacaatgcatatatactatatattatggcaggggaagagttaatgctccttg

SEQ ID NO: 187453 - DNA, 643 bp, Homo sapiens
gaagaacaaaagttaaattttgatgaagtccagtttattttttctcttttgctgctagtgcttttgtgtctcatctaaaaaaccactgcctaatccccaagatcatgaagatttatggctatgttttcttctaagagttttatagtcttaatttttacatttagatctttgagttcgttttcgtatatggctgaggcagaagtccaaattcactcttttgcatgtggatatctagttgttccagcaccatttatctcatttccttaataaatatttaatgaaataaacagccttttttttttttggagacagactttcactctggttgcccaggcttggagtgcaagggcatgatctcagctcactgcaacctccgcctccggggttcaagcgattctctggcctcagcttcccaagtagctgggattacaggcattgtaccaccagtgcccaaaatttagtatttttagtagagagtggggtttcaccatgtgggtcaggctggtcttgaactcctgatctcaagtgatgtacctgccttggccttccaaagtgttgggattacagcgtgagccaccgcgcctggcgaaacagaactaattttaagaagcctaacaaacccaactctgaggttctagtttga

SEQ ID NO: 187454 - DNA, 538 bp, Homo sapiens
atgtgcacatgtaccctaaaacttaaagtataatattaaaaaaaaagattgtcacaatgatttttccatcgattcaactatccatccgtccattcatccataactttggttgttcagaaagcaaaggattagaagccagaggttttaggagaggagatagaacagaaagttggataacagtcagaaagctgctgaagtaatccagacaagagataacagttgctttgactgtgcaggtgaaagtggagatagaaaacagtgggcagaacaagacgtatttcagagatagaacagatggcacatgctggtggattgaatgtggaaaacgagggacagaaaggaaggaagggtgactcctgagtctctcgcttgaccaattagaaatccagcattttctatcatgggaaaggcaggaggaataaaagatgtttggaacttaaaagatggtattcaaaatcatgggaatgaattatggtatccagaagagaataagagaaagaagagagcccaggaactcaacatttagaaggcagggata

SEQ ID NO: 187455 - DNA, 732 bp, Homo sapiens
cccttattcttgaggagtttatagtctcacgggggaaataaaaaaataaagtttaattaaatcacagtaaattaaactctgtgataaatataatacaggccccctcaaaaagaggattctgtaaaaaagcaggtactgaatatttcagaatatatgttggtcattattttcttgatgatgccaattctccagtcagagatggtttacactttacaacatttgaaaaaagtaccttctacttaaggtagccagtgtgcacagggattaaacaatgattaaaactgtgccaagaaatgaatgtctaatagccaatgtatccaaattcctaatctgtattcctaacatggcaagctgcacacaaataatacacaaacactatatctctagttccccagactctcttaattctcagcattcttttagcatttgcacatcagattgtttacattttctgatttgttgattataaactgcttattctcatctatttcaagacttagaaatctgtgccatatttaatcaaataaactcatgctttctctttaacagagttgtaaaaacaatgattagtttggcccaactgccaaagcaaacctggctatattttcatttcttagttctcgaacgattacctgaatttttcattgttctgaggaatgttagaaaataagcagctgctaaaagcaggggccgcaatttgtcacaacaaatgttgaaaaaggcacggaagct

SEQ ID NO: 187456 - DNA, 370 bp, Homo sapiens
accagagaaatgctttcttccttggcttgaagatgatgtcatcaaccttcagggccctcagaatcccttaaataataaaacagtcagagcacatgaataccgggatgctttcagcactgcatatgtcaagccctgaggctcccagaatccctggagacgtatttgtgtgtctacacttcccacctgcactagcggtgaccacacacacagtccggtgaccacacacacagtccgctgaatctgccggtcaaggtatctatcttcaactgccctcttccagagggagctcccacaaaaaggaccagaattaaaaggaggaggaagaacatcatcggagctgctgagtgtgaaaagaccagctctcttgcag

SEQ ID NO: 187457 - DNA, 251 bp, Homo sapiens
agcctctgtctcaaataaaataaaataaaataaaataagaaatagaaaatagaaatgaatgacaacatagcatctacatggaaagcgtgcactgccctgtaaaactgcttgactgcttctgctttccttgactgccactaagcttgtccagagtattttttttttacatcctctgttctccctagctccagagcttaagaatttattttctgtgtcctccgtccaaatatcagcttggccgaagcagtatc

SEQ ID NO: 187458 - DNA, 320 bp, Homo sapiens
cctcagcctcccgagtagctgggattacaggcatgtgccaccatgcctggctgatttttgtatttttagtagagacagagtttcaccatgttggccaggctggtctcgaactcctgagttcaagcaatcctcctgccttggcctcccaaagtgctgggattacaggcacgaggcactgcgcccggccaggaattcatttttgtccttgattaggtgatgtcaattgatggctgagagaaaaaagtctgtgctaaatagcctggcctgggctccctagagagcaggctcttgggctattgggagagcgcagggtgggaaca

SEQ ID NO: 187459 - DNA, 489 bp, Homo sapiens
gattacaggcatgagccaccacgcccgtcctattctttttattcatgtgtatgttattgcatgtatgtgtgtggggggcaggtggtagtgcatattttatgtatctttcacttctctgttgtttgatgaacttcttccatactcctctttggtatcactttcttcataaatctttcctgactccccaaatcctttgctgtattgctttttactcttcaaacttctattatagaatgtcacactgtattgtaatttactgtccatctggactgggagcacctgagaggtatggccttgacttgtttatgtttatgttttgaatgcctctatagtgcataatacttaataggttctcaatacgtatctattaaactgaactgttgctagattgtcatttgacagtgctgtttcacaatccacagatctgaagcaacagattggaaaagtggtggggagaatagcttcctgtattccttcacttccttgaat

SEQ ID NO: 187460 - DNA, 300 bp, Homo sapiens
caactgggaggaaagtcagctcagtcggagagaaaaagacattagtccagcctggatgttaaccttgagaagagtgggaggtgggagatggtagactaggtgaacttcaaggtctgtgcgtctctccaggtctttgaagtaattctttacagtgagtctgactttcatagaagtttcatttctgggaactaaaggagcttttacatactcttcttgttctcctcttattcatgttgctcttaacatccgaatctaaatttagttcaatttttatccattctttatgttctcctctctaca

SEQ ID NO: 187461 - DNA, 251 bp, Homo sapiens
cgacgcttaatggctgtagcagagaatacaggtatctaacttgcacggcagaaagacaaatggagagaccaggggactgggatgaaataaggaaacacttaagtttaaaatgctgggtcttaaaaaatgtgatgatacctacttgttagtaagatccattttcgatctttcttaagacatatcaatccgtccttagagggtggctatgtcaaagccaaactgggtctatgtgacagccattcaggtaacag

SEQ ID NO: 187462 - DNA, 256 bp, Homo sapiens
gaaggaggaggaggaggaaggaataatggaaaacagaatgagagtattttcctagtatctatacacttgctattagaaccctcctctcccatctgaatcaggaaggcttgtcagtcaatgtaaatatgcatttctagtccagtgactcattggtctgagaagcaggcatcaaaggaactaaaagaaaaatataatttcttgtttgttcccgtgtttggtgaatttactgcactagaggtcggctttctctatccgt

SEQ ID NO: 187463 - DNA, 712 bp, Homo sapiens
ttacaacaacaagatttgttttgctttcacaatttctgtgacgtttaccaaaagggcattgtcgattatgcctgtaacttttttcacctaaaggcaccttgtgttaacctgatatatctagaaagggtcagggaaattgaaatattatttttactattcctttgcttatgctgtactttaatgcacatatatttttacatttattatgtagtataatgtataagtatttgtacatatagttcaagtataaatgattttattttagaacaagctttgaatatatttttgtcaaagcttagagcaggaaatttagctcattcaatctgtgtaacagatctggaatataacctaattaacaaagctagtccttattttccaaacatcagtcaaaccagactctggcttaggaatattccaacaagggccaaactatcccattccagtgtcatgccttaacaggaatatggatgacagagggaagaaaagtcattcttgggatgggcgttacagcatcttgattatcactaaaaaaagtgggaaacaaaatttcagaattccccttgatttcctggtggttttacaacttggcaatgtaccagagtaagattctaaggtaaatgaaggacaagcctttctttgatcaaacgggaaaaaactgccgtgaaaggtgaaatgagaaagcggaacatacgaaaagctggcaaagaacatg

SEQ ID NO: 187464 - DNA, 312 bp, Homo sapiens
cacaaattctatcatattcattccaagaataaaactttcacttttctgcataggagtaagtggaaaatggactttcattccttttcccaatttaggatgaatatttattcagtagctacgttgttttggcgccgtgtcgggatacaggtgcagttcctttctagatttcacattgtctggaatgttccatgtgttgatccaaaatatactttatgttccgcaaatgagaggaagagcttggaggcctggattcttttaccacagtagtttttaaacaattatttgaaacaattcagtgttttgcatatttta

SEQ ID NO: 187465 - DNA, 121 bp, Homo sapiens
gcaagaagccaaaagaaggcccctatagtaactgctgaatcttcaggtaaaagacctcttgcctctaggaagtcttcccaactgtatgaactccagagaaacgctgcaaatggtttggcag

SEQ ID NO: 187466 - DNA, 195 bp, Homo sapiens
tcaaacacttgtcactctccagtgcaggttactagaggctctaaaactccaggaacctccagtgattttcacattggcattgccataaattccacactatgtactttctcctaacaccaagagtatatatgaccctggctggataggatgacccaagcatatggagtgagaagcgcgagaagtgtgttgggaatt

SEQ ID NO: 187467 - DNA, 390 bp, Homo sapiens
cttagttagctcatttctggtcttccaaagtgttttagcaaaaggaacattgaacaaattataggtactgaggaggcttagagtcaagacatttccttgaccttgttcaactcagctgtttcccttttacttattctgtaactgtagattccattggatatttgagaaatgctcaactaataatattactggaaattctaacaataattgaatttctgaaatttatgattttgagttagaatttctattttatttaggatttgtgtattactgtttataaatcaacatgcaatttttttgtcctctgtgtgttattctgttagaattgttatgaggattatgctagctttctactataaacaaggaagctttatatttgtttataagctc

SEQ ID NO: 187468 - DNA, 489 bp, Homo sapiens
aaagtgtaaaatatggccaagtcagaaattttgtcaaaagagcctatttttaatggataagccagatttctatctaaagtagttgatttgccctggtactatttctacagccaagtttcctcagctgtttttgattgttaaatatattggtatcactagggttaagaattgcttgaacatattgggttcttttaaatccttaaaataaccatattatgtatgaaggctcataaaattagagctggtagaaacttaggtagatcaagggattcttagaaaagtcagttatcagctgtaccagctccaaagtgacactgtaccatctgctaagtctttctacagctactgaaggacacatgtactggataaaaagatcattccttagaaaagccaaaaagaaaatttcctgtgctaagttgggtctagcaaagattttctgttttgcactttcatttgacctaaaatactattttagaagttttttaaatc

SEQ ID NO: 187469 - DNA, 447 bp, Homo sapiens
acatataaacttataaaaaatgaaaatgctaattgttttcacacgtactgtttggtagcctccctttggtatgttcccagaccaaaaattattattcttccccatgctttttttcagctacataatgttctattttatggaagtacatcatttccataattgaatttcttattaagacatattatttgcaaatctgcaacaaatgtgcatgttatttttagacgtatgtttggttatttctttacgatagagtcctagaatcaccggctgaggcaagggagatgcacatttgaagcctctttattcatcttgccaattgtcctcaagaaacattgtttcaagtcccattaatgcaagcaatgaacaaaagtttttatttttctggatactggatgcctctggcttatttttctttctattctgtttctttaatagacaaaacaaaag

SEQ ID NO: 187470 - DNA, 534 bp, Homo sapiens
agagaaggtctatgcctctgagacaaggtgtgtggtctcagtgaacccaaatccctcctagaagactcacttagcaaagaaaagagctgcttctcaccagttgtctgagacagtcactagatcctaaacacaaggagggttgggtgtgtatatgttcaggggtgggatgtgtgctattaaggagaatcactgggtttctgtcttgcataactgttctgtccatggtgccatcaataactgagataaggaatatagaaacaaacttatcagtgatgataataaacttagctgggaatatgacacataaactaaacatttctgtaggtagttaaaaataggttttggagttcaggaaatagttggggccagaggaacagtttgagttgtggtgtagaaggtgtctgttgaaagcttggggatgaatgaggttctgtgacagttttctgccatttgcacataacttctgtggggtttcaattttgttacatttggggaagataaaaacaatttattcttttttcagcaaaaccaaat

SEQ ID NO: 187471 - DNA, 568 bp, Homo sapiens
tactggggagcagtgttgctggttcatattctaagagtatgtttaggattatgagagaccaccacactgtcctccaaagtagctgtaccattctgcattgccacattttggatttggcattctaataggtatgtagtggtgtcttgttttttttttgtttttttgagacagagtctcactctgtcttccactgtactacagcctgggcaacagagcaagactctcccccaaaaaacaaaaatctgctgttccagccagtacattatttatttcagacattgtaatttctatctgttgatatccagtttgagtttttttatatcttccgtatctgtaaagaacttttggaacgtatggagtacagtgatcgaatagttgttctaatgttcttacctactaattctaactcctgggtccgtttcagttgaatgatttttatcctcatgatgtgccctattttcctgctttttgcatatttggtgactttgttgttggatactagacaatatcagtattaccttgtcgagcactcgttacttttgtatgcctataaatattcttgagcttt

SEQ ID NO: 187472 - DNA, 413 bp, Homo sapiens
gaggtggaagttgcagtgagccgtttggtcgatcactgtactacagcctgggcaacagagcaagactctcccccaaaaaacaaaaatctgctgttccagccagtacattatttatttcagacattgtaatttctatctgttgatatccagtttgagtttttttatatcttccgtatctgtaaagaacttttggaacgtatggagtacagtgatcgaatagttgttctaatgttcttacctactaattctaactcctgggtccgtttcagttgaatgatttttatcctcatgatgtgccctattttcctgctttttgcatatttggtgactttgttgttggatactagacaatatcagtattaccttgtcgagcactcgttacttttgtatgcctataaatattcttgagcttt

SEQ ID NO: 187473 - DNA, 283 bp, Homo sapiens
gctgaccactatgcagtacaagagccaggccttggagacggtgttcatgctacaagcagagcccgtcaagaaagcacactataactaagtacaaacaccctttcctcctacaatgcctctccagtgcagcctactgacaaaacttaacattttgcccagtggcaaaagaaaaacgtttaaaggacctagctccacttccacagagcatgcaaaaagggtttacaaatggtctctgacttgtgatgttgtaaaagcaacacacattcagtagaaaccatacttc

SEQ ID NO: 187474 - DNA, 134 bp, Homo sapiens
tgttgggatcacaggcatgagccacggtgcccggcccacacagtagttttaagaacatggcagtagttgccaacatttaaaaattgagagagatcctataaaattcagacttgtgggtctcctgggagggtagg

SEQ ID NO: 187475 - DNA, 401 bp, Homo sapiens
  misc_feature (390)..(390): n is a, c, g, or t
aaagatggccactgatgtgatgaacacaccacctacgatgtatctttcatttttattttgtttaaatttttctttgttattatatatgtttcaagacaaggtctcgctctatcacccaggctggagtgcagtggcactagcttggctcactgcaacctctgctttctgggttcaagagattctcctgtcttagcctcccaaggtgttgggattacaggcgtgaaccaccgtgcccagccaagatctacactattatgtcactccaacctggatgacagaatgagaccttgtgtcaaaaaataaaaataaaaaaatgaatatgtagctggaattctgtagttttccgtcatccgtaaggctattccgtttcttttcttattggaaaggcanagtaaaggctt

SEQ ID NO: 187476 - DNA, 177 bp, Homo sapiens
ccacacacacccactcacatgcacacacctgctcacgctcatgcatgcacacgcctgctcacacacacacacacacccactcactcatatgcatatgcctgctcacacacactcgctcacacctgctctcatgcacacacccactcatatgcatatgcctgctcacacactcgctca

SEQ ID NO: 187477 - DNA, 446 bp, Homo sapiens
gtcctgttttcttcagtgacagaagagaacttgggtcacaccgctgccctcccctcccaatatagttatgtcactatttaaacttaatttttatcaaagtaatacatgcaattagtttaaaattccaaccagggacaaaggcttatgcgggcagtaaaacacagaagttgtgtcctatctcttccttccctcccgtccttcccaatcctccttcccactcaggtaggttggcttatggaaaacagaactctctgtttagtcccccttctaatccttttctgtagcactcatcaccttttctagaaaactgtataatttacttattatgtcttctgtttgtcttgcctgctaaattgcaagcttgggtaaggatctttgctatgttcactgatgtatcccaaatgcctagaataatgtctggttcaataaatatttgttgaattgat

SEQ ID NO: 187478 - DNA, 381 bp, Homo sapiens
cccactcatcctcaaagaattttatagccacatccctgaaagtccagcatccctgagtaagagctgttctcgactctttttctttcctcttcctcctcttccaggcttcttcccaagtaacatcggtctttatgtcaatcacactgcagtgtgaccaccccttgtgatctgcttccgagtttgcaggacgctctattttaacataacttttgctctgaaaattgatcatactctatctaaattttgcttttcctcaactttatatatcctggaaatctttccttttctatgaatatagatcaatatcatctaaaattggctgggcgcagtggctcacacctgtaatcccagcactttgggaggttgatgggggaggatcac

SEQ ID NO: 187479 - DNA, 358 bp, Homo sapiens
gtggggcagcaacaagatataggtgtttgcatgctgttctcaacctgactactaaagtcatcacctaaggaagatggaatgtcaacatggatccatgttttaaatttttttttttctttgaaaaagctctgcaacttcagcataaagtgtaaccttgcagttgctgaggtaactgtttttctccccctccttaggaatagcagaacaaattaggggaagaaaacgtttgtaaatcgtcagtacatggacaccctaaggctgcaatagctaaatgtttcattggaatcctaggtaaccaaaatgtggtcagctaaaaggtgtttctgttttcaatctgatttgtttcttgagcaattta

SEQ ID NO: 187480 - DNA, 603 bp, Homo sapiens
aagtccacatggcaatatttccacccctcacatctagatggaaaattcttacattttctcaacaatatttacttactgttttctttggccagatgaagtactgtgtatttttaaactttccaggaagacagtttattaagataatacagtgtaggataatcaaactgtttatttttgacttttgatttaatcttcctttctgtaatctactaaagaaaacattagaatcatgcatttgcctttcttggattgcgagaatcagttcaattagcagtggcgggtttttttcctgtttatttctactacaaatgtaacccctcttggctctcattcttcccttggggtaatttttgttttaatgtgtaatgcctgctcttcaaattaacatcaaattttattctgaagtacccacagttgaattatcagtggaaaatgcacccgcaaattctcaagatttgaagggtgagaagagactccaggatcacctggccaagctgcacatttatgcagctgaggatggttttgcttggagaggagccacacagcacatgagtggcacactctccttttccctttgaacttctcatagaaccttgatcaagc

SEQ ID NO: 187481 - DNA, 354 bp, Homo sapiens
cctggctaggctcaagcccatccctccagaagtgagtagcaggagagacataaaagtaattttctgagatcaaccagtgctggatgggtttggatatgagccatgtttataaagatgggtgagatacaatcttaccactgtcctctccgagggtctggtggggactccatgcaccaatatgaaccgtaaaggcaccaggtggggttagctaagtgctctgtgaaaggcagggcagcgagttacctggagcaggaagagagcacatccaggtggggtgatctgggcagacttcctggaggaggcagacaccaagctgggccatgaagaatggatgggcaggttgggatgggggag

SEQ ID NO: 187482 - DNA, 265 bp, Homo sapiens
gggggaatttctgtctagttcttctatcaactaaaagaattagttgaaaatactaattctagttttttgacagagggattctgaagtctcctagtaaaattatgtatttgtacatttctccgttgacgtctgtttttcttcacatattttgtagctctatgtttggcgcatatgcatttaggattgcagggtcttcttgttgaattttttaaaaaataatttaacgatgactttttcttccttctctgataatttgtgctttttt

SEQ ID NO: 187483 - DNA, 214 bp, Homo sapiens
cataggcaacatctgttagttgatgtagaacatgactgcaacacattatagcaataatattttggattttgttttctgattcaaaacagtgtgtacgctaagagggttggttgtttgtctttgttttttgttgtttttgtgtttggcaaagcagaaattatgcttaatttgtttcaataaataaagcttaagcttctctggaagaaaacctcaa

SEQ ID NO: 187484 - DNA, 590 bp, Homo sapiens
ccagcctccccacaccagccagggcaagcttcccaaaacacacatctgaccctgcccctcacctgcagagacccttccactgtgatccacagcgccccacgctccaggaataaagtccaaaccactaagcatggctggcctggccccagtcaacaccctaggcactcacctacctccaggcttctgcacaagctattccatttctgcagcccataacaccaacctcttcccactggctgtcgagaaaactaaactctctgacccgcatccctccttatagccaaaggcatcagcccctcctcctatgatcatagttctccccttccagacaaatgcatatgttcacaaagactttcagggcataaagtatccccttaaggatgtggctgctagcctcatctttgacacagtgtcttgaaatatttgttgaaggaacaaatgataaataaatgaatgaatgcacatataaaatatccctgtgaggctctgtttctgagttggtcagagatgtagcctggtgaggagaaatgctcagagccagacaactggctccttcattctcctgccaaggtcagccttcaataaaaaac

SEQ ID NO: 187485 - DNA, 944 bp, Homo sapiens
  misc_feature (845)..(845): n is a, c, g, or t
  misc_feature (848)..(848): n is a, c, g, or t
  misc_feature (850)..(850): n is a, c, g, or t
  misc_feature (852)..(852): n is a, c, g, or t
gtctctttttactagatcatggctgttcttcccacctcatccctctgaaaataaaaatgtattgccctccccaccatccatcatagccaggccactaacttgacttggtgcaagagattcttgctgcgaactttgtagagccagtgtgcagatagaatttggctttgagggttcctgatggctttttagtctttaactgtgtgtgtaccagtctcacatttggcccaaacctcaggattctccctctgcctgtcttacttcatggtactagaagaccttcctcgccactctctccacatgagagagtcagctgccctttctcctgtgcctctgcaggaagaactctcttgcatggcacatctcagctcctcattgagggatagttttctttgataagaaacctggagtccatttactctgacctctctttaaatctatatccagagccactagcccaggaaaaacttgggtgacccgtaatttctcttctcctgctgtccttttgctcttacgccccaccccaactccccttaaattttacaggcttatgacagtttgtatgtgctcagccaatgagcagaaaacctggaaagaatttctggactttagcccaccagtttgtctggttgactaacctgctgagagctaaaattggcacccattgccccgtgccttcaggcagtctcctggggcagagtatgccaccatccgaatatcaggcactgagtgggatgtgggtgatgctcacatgactggctagagcttgggggtggggtgggggttaactactatttttttggccatgatctctttccccttcctttttttttaattaaataaatggntcnantnaaataattcaagcctgccttcaaaatgaaattgttgttgtttttagctaattatttagtcaaaaagcaatagaaacccaaagttgttgtgtt

SEQ ID NO: 187486 - DNA, 740 bp, Homo sapiens
aatcccagatactccggaggctgagacaggagaatcgcctgaacctgggaggcaaaggttgcagatcatactactgtactccaggctgggtgagactccatctgaaaacaaaaacaaaaacaaaacaaaaaaatctgttgcatttggccgatcgctttggctcatgcctgtaatgggatggattttatccaaatgtcccccaaaaagcgctgtagtcccacctgcgtaccctctgccttagaacctcatcaatgctggggatactaaccctttatatttttcccaatgtgaatggagaatgtgaacagggcttaaagaaaatgtaaacggtacctaaaatgcaaccctgtggggctctgagttggccggcagggtcctgttttcccaggtgggatgaagtggggagtgaaaggggagtgattctggtcttcaacatgccaagtgggaggaagaggaaacactggcaggggctccaggtggttgtgtgtgtgttggcaggtgaggtgggggggtttagtgacaaggggagcatgaagggattatccatgccagcccaaggcctgggacccagcagcccactgagggagctagagaggcaggagaatgcagtgggaaggatgcggccacctgaagctagactgtctcagttcaaatcccagtgtcaccacttacttgcagcataattttgagcaggtgatgtaacccctatatcttccatttccccatctctcttttttttt

SEQ ID NO: 187487 - DNA, 849 bp, Homo sapiens
tattccagcacttagggaggttgatgcgggtggatcacctgaggtcgggagtttgagaccaggatggacaacatggtgaaaccccatctctactaaacatacaaaaattagccgggcatggtggcatgtgcctgtaatcccagctataatttttgtatttttagtagagatggggttttgtcacgttggccagctggtttccaactcctgacctcaagcgatccgcccacctcagcctcacaaagtgctgggattacaggcatgagccactgcgcccggcaatgggatggattttatccaaatgtcccccaaaaagcgctgtagtcccacctgcgtaccctctgccttagaacctcatcaatgctggggatactaaccctttatatttttcccaatgtgaatggagaatgtgaacagggcttaaagaaaatgtaaacggtacctaaaatgcaaccctgtggggctctgagttggccggcagggtcctgttttcccaggtgggatgaagtggggagtgaaaggggagtgattctggtcttcaacatgccaagtgggaggaagaggaaacactggcaggggctccaggtggttgtgtgtgtgttggcaggtgaggtgggggggtttagtgacaaggggagcatgaagggattatccatgccagcccaaggcctgggacccagcagcccactgagggagctagagaggcaggagaatgcagtgggaaggatgcggccacctgaagctagactgtctcagttcaaatcccagtgtcaccacttacttgcagcataattttgagcaggtgatgtaacccctatatcttccatttccccatctctcttttttttt

SEQ ID NO: 187488 - DNA, 800 bp, Homo sapiens
tggtagacatttgcatatattatactaaataacattaaattacctgaaaggaaaggaaatgagaggaaaaactagtgtaatgatttctcaaaagagcctgttcatttcatctggttgtctgattctgatgccagcctggattgtgggtgttttatttttctccctatttcaagtaatcaaaagttcaggtcactgaaattggcaacaaaattaaaataattttagagtttgatgaatctatacatggttaattttggactgagatgaatgggaagttaatagatagcagatatctgaactttaaactcttgaaagaagatgtatggacaagaattgactttgatcttaaaaccttttcccctgagcattgcttagaatggtgttgcaacgctgtcatcagcagcagattaaatgccaatttaggatgcacactttgactcaaaacattagtgtaggctgccattgcctcaaggtggtgattactcaagctgttagttctgctctgcccttttgtttgctatttccttttttgtagtgtggtactgtttgttcataaggttagaagttttagtccttatcctgaaggttgaagataatgttgtaacgcgtgagccaccacgcctggcctcacctgggactcttaagtgatctattcagggacaaaatcaggatggtagtgcacagacaggatcttgacattgatctggaataacgaatcatgctattttgttatccagaattctttgacaatttttgtcttgccctttccctttcaacccttcctttaaaaaaagaaaacg

SEQ ID NO: 187489 - DNA, 474 bp, Homo sapiens
atttgattacctcagtacaaacttatttccaactaaggtcagattctaagggactggggattagggatacaacttaccttttttagggaacacaattctacccataatagatgggtgcaaggatgtaggtcgaaggctggcaagtgagcctagataaagggagtgagagaaaatgaagatgctaatgagaacatggggatggctgaccatggggcccacactggaagagaagcagattctggagaccaagagtttgggtgatggggtaaaggctaaggattagcaggcaggaaattacagagcaagttggttcagcagcagtcatggtacgagacgagcctgggagagtggggacttcaggatctaagatctcggattcgtgatgaggctggaggtttggctgtgactatggcaggtcagctgcagaaggtaatttgttactgggagatgatccagttgaggtaatccgtgagg

SEQ ID NO: 187490 - DNA, 515 bp, Homo sapiens
ctgtcccttcctcctcttttcctccttcttcctacctcgaatgtggttagggtggctagaagtgacaaggattagggctatttgcctatgtggtgacaaagacgaaagatgaagacgaaaaccatgtctgaacatggctgaacagaaagaaggagaaggaattgtgtgttgtcattccagccctgggctacctgccttcaaacttgttattatatgaaggtggtgagatgttattatctgttcatttggggatgtaacaggggtggttaccctatttggttaaacctctatatttgggattctattacatgcagccaaatgtagcccacaagtaatatgctgctcaaatatttgttcaattaatgaagattataataataaccgctcatttgctgagtggttaccacaaattaggctccattctaagtaatttacggcagattctaataggaaaattctggagaatactaagccctacatgaagaaataggcagaattgtgtggaagaatttggg

SEQ ID NO: 187491 - DNA, 408 bp, Homo sapiens
aggaataaggtggtattgtgttgtatatcttcttttgagaaatgcttattcatgtaatttgcccacttttcgatgggattattattatttttttcttgttgatttctttgagtgccttgtcaattttgaacattagtcctttgttggatgcatagtttgcaaatattttctcccattctgtgggttgtctgtttattctgctgattatttcttttatgtgcagaagctgataatctgctgattatttctttttatgtgcagaagctttttagtttaattaggtttcatctgtttgttgttgttcttattgcatttgctttagggttcttggtcataaactctttgcctaagccaatgtctggaagagtttttccaatgttatcttccagaatttttatggtttaaggt

SEQ ID NO: 187492 - DNA, 375 bp, Homo sapiens
agaagaggacagaataacttggattccagaatcaagagcttggctgaggcagagcatttgtgtggcttatatggcatggcccagagggagcgctgggcaaagagggatttaaggtttgaaactggattaagaaaagccttgaatgggggcatggaagagtgtgggatctcttgttgaccatggacagccacggatggttttgaataaggaagtgagccacagcagtggacaagagtacatcactatgagggaagttggcatgggaagagggaagaggggaagtgaagcagggaagacaagttaaaagacaattgaaatgtcctaaacaatgatcagtgtcagaacctcttccatggttttatgaagaatccacac

SEQ ID NO: 187493 - DNA, 381 bp, Homo sapiens
tgacctaacccaggtagactgaaccaggtaactaagcatcgagatttaattgctctagaatcttttgaggaatttttctttccctccattgaattgcatggtgcccttgttgaaaatcaagtgcctgagtatgtgtgtctgtttttgaactctaagttctatatccttgttctgttaggtctacctggccaggtagacctaaccccaaagtgacttgcctcaaagagatcaaaatccaagttctatagtttcatctccatccccctaacctgtaaatggctgcctgagaaaatgcttccaactacaaaatgactccgtcacttccgtatttctttttcttttctttttttttttttttttttattatactttatattctgg

SEQ ID NO: 187494 - DNA, 419 bp, Homo sapiens
gtatttttagtagagatgggtttcaccatcttggtcaggctggttttgaactcctgaccttgtgatccacccaccttgacctcccaaagtgctgggattacaggcgtgagccacggcgcctggccagtttgctcactcttacacattccactgacttccttaaaccttctggctaaaaggcgatgctacctctcaactagttctctacacaaatagcattttttgttagctccttgtatttgatgaacttctttaacaaagatgatagtatttctattttcctaatgattttgagagtggtattgttagtatttttttgtagtctgcaatcctatcacaggcacttcctctagtcgctagccttttatttcctccattttcccagagttctccctgctcccctgtgcttacttaactat

SEQ ID NO: 187495 - DNA, 817 bp, Homo sapiens
actcttgtgtgtggcaatgttggagtggtcccaagcatttttgggattcagctgtgggaaagttaagctgtggatatacactttgtttgagtttactgggatatatctctgtggttgcagtcactttgatgtatagttattggtggccatctcactgcataaatgatatccaacaatgtggatgtcactcaaaggtacaagccctgcattgtattgagacaggagtgtgttctaacacatctggcactggaatctgcaagtagaagagcatgaaatgtgtgaaaccaaaaagtggctggtggaaaaactttccactcacccgatgtcttagcctgaacatcagcctggtagaaagacttgcatgcagggaagtttatatggagtgcagtcccaggaagcaggagttcaggacaaggaaagtgaaatgagaaggagggaaagaaaatttaaggatctgatagcgcctaggcagcaggtgttcaattccactagaacctttttaggaacctatggaatggaatgctctcagaactgtctgcttaagtacaaaatgcggggggggcgtgaggggatttatcccgttgatttctccctcttgtttgcatatgcataactgcagaataagtttcaagagaaatcctaaggcaggaagtgaaatattgagcattagcaatgaggcagtgtctgcctgcactgatgcacgagcatgaagccactgcaagcctgcgtgaactagtcactgcggcagtggagggagtgagcactggggcctagggggttggaagtggctttttagaggtgtccaacactgtcagag

SEQ ID NO: 187496 - DNA, 762 bp, Homo sapiens
actcttgtgtgtggcaatgttggagtggtcccaagcatttttgggattcagctgtgggaaagttaagctgtggatatacactttgtttgagtttactgggatatatctctgtggttgcagtcactttgatgtatagttattggtggccatctcactgcataaatgatatccaacaatgtggatgtcactcaaaggtacaagccctgcattgtattgagacaggagtgtgttctaacacatctggcactggaatctgcaagtagaagagcatgaaatgtgtgaaaccaaaaagtggctggtggaaaaactttccactcacccgatgtcttagcctgaacatcagcctggtagaaagacttgcatgcagggaagtttatatggagtgcagtcccaggaagcaggagttcaggacaaggaaagtgaaatgagaaggagggaaagaaaatttaaggatctgatagcgcctaggcagcaggtgttcaattccactagaacctttttaggaacctatggaatggaatgctctcagaactgtctgcttaagtaccatatgcataactgcagaataagtttcaagagaaatcctaaggcaggaagtgaaatattgagcattagcaatgaggcagtgtctgcctgcactgatgcacgagcatgaagccactgcaagcctgcgtgaactagtcactgcggcagtggagggagtgagcactggggcctagggggttggaagtggctttttagaggtgtccaacactgtcagag

SEQ ID NO: 187497 - DNA, 346 bp, Homo sapiens
ctttgtaggagggtataaccatgatcaatttccccaatagatttaggactgttcagatcatctctttttgggtgagttatggtattttgtatcctcaagtgatttgttcatttccctgaggtagtgccatttattggcgtaatattttcttattgtcttcactgtccttttaatgtctgtaggatgtatttgatatcacctccttcatttctcatattcataatagtttatgctgtaatagtttatgctgtaatagtttatgctgtaatagtttatgctgtaatagtttatgctgtaatagtttatgctgtaatagtttatgctgtaatagtttatgctgtaatag

SEQ ID NO: 187498 - DNA, 135 bp, Homo sapiens
cttcatgtacaaataagattcttggtctctacagccccttgtctgggttcaatattgggaaaaatcaaagatcttccttctattgattccaggtctttagataataacttcactctttttttttttttgagatgg

SEQ ID NO: 187499 - DNA, 553 bp, Homo sapiens
acacatggagatgttagtacagtctatggtctagtcactttgctacctgggccagagttcttgttggtgaagaaaatagaggtcctgacagtttgaggaatgtgaaagagggtcctgcacaaccatagcactgtaatttatttcctgtggtttgtactgttttggacactgtatgtgcctaattggagtagattcgatagcatatgagaagaaagaattagtaagagtgaatcttcagaacttttgaagggttttctcaaatgcgaggaagatatggcccagtatctgggagatgtaggggcaatagatagttttaaaatcatatatttttaatttatttttgaagatgacatgaataacagcatgatatattcttttttaaaaacatttatttaaattgacaaatgaaaattgcatatatttattttgttcaacctgatattcagaaatatttatacattgtggaatgctaaatccagataattaacatgtgcattatcttacttttttttggtggtgagaacaattaaaatctactctctcagcaattttc

SEQ ID NO: 187500 - DNA, 739 bp, Homo sapiens
caggggcattcagaccacagcacctcctgtttaaaactcctaaaccccagctagccctgtttatacttctccataaaacgtatcccttgacgttgatgttatttacttatctgttttgttttattttgttttgttttttgagacagagtcttgctctgtcacccaggctagagtgcagtggcatgatctccgctcactgcaacctctgcctcccaggttcaagtgattctcctgcctcagcctcccaagtagctgggattacaggcgcccgcctccgcgcccggttaatttttgtatttttagtagagacggggtttcaccatcttggccaggctggtctcaaactcctgacctcatgatccacccatctcggcctcccaaagtgctgggattacaggcgtgagccaccgtgcctggactacttatctgttttgattattgatctgtttccctcatgagaatagatgagttataggtaataataagcggatctaagctaaatgttttgaataaatacctacaagctatgccaggctatcttcgtgggctgcagatcaaccattttgtccataaaacagaaaatagcatctccagacaagggctggatgcagtgtttctcacatggcttagtcccctcttcaaggctctgccttcccccactggcataagccacagtattttcttcttagagagttctgagatcatgtagtcaggtgagataaatgatgcctttattctc

SEQ ID NO: 187501 - DNA, 338 bp, Homo sapiens
ttgacattacctaggggaacatatcacagggaagagaactaagacagagcagtgtgccagttaggtttgagtagaggaggaaaagtctgcgaaagagactgagaatgcatgggtagatatgtagaggtaaacactgtagaatggtgctgagatgagctagagcccatagataatttgctgtctttcgctacaaggtggtgatttgtaacctgaatgagaatagttttagaagagtagttgggctagatgaaagtaggcttttgagtgataggccaggaaaaaagtaacagtaagagtactgttcattgagtttcaattgtgattgggacggaagatga

SEQ ID NO: 187502 - DNA, 411 bp, Homo sapiens
agaaaaaaaactggggccaggctcagtagtgaaagcctgtaatcccaacactgtgagaggctgaggtgggaggatcgcatgaggccaggagtttgagaccagcctgggcaacatagtaagaccccatctctaaaaaaaattaaaaaatcagtcaagcatggtagcactcacatgtagtcccaggtcttctggtagatgaggtagggaattgtctgaatccaggagtttgaagctacaatgagctatgatcacaccactgcattccagcctgggggacagagcaagaccctgtctctttaataacaaacaaacaaaaaaattggtctcagaatgtagtagaatgatggcatttcaaaaaggaaattccaatagttagatgaatcctattcattctttcctatgacgtagccc

SEQ ID NO: 187503 - DNA, 265 bp, Homo sapiens
ccaggtagacctaacccaatctgatgagaaggatggaaaatgcagggtgatccctcttgtaggtcaaaggaagtgggtctgatgaatgcagtggggacacagcctgcctctgtgtcagatgatccccaggcctacggctcggcctggaaacttctctgctcccctcgatcctgaaaggaggactgtgagcacaggtcacctcatcctcatggtgataaaagccaccaaaatgaagactgtgccttcttccagttaggtctacctg

SEQ ID NO: 187504 - DNA, 441 bp, Homo sapiens
agcagggtttatgttcaactgtcacggatctctaagtcgaactgaagtgtcatctaccgtgcatctagtctctccgttttacaaagatgtgacccgaggaaatatatccttgagcaattcctttagaaaaggaatttctagatttaaaccattttcctctcaaacatttaaagctattcaattcttccgtgtattctaatatccagtgctatatttaagagggaatcggattctttcttacttgtaggtggtctggtttttgccttttaagcttctgcaaaaaacaacaacaaacttgtggtattacactgactctacagatcaatttggggacaacttccatgtgttccaccaccaatactgaatctttcaatcgactgacgtggtatctctctctccatctatttacgtttgtcttgattttctcttgacagcgtttag

SEQ ID NO: 187505 - DNA, 345 bp, Homo sapiens
taaggaaggaacatgatcagcactgttaattaaggtatattatactcagatccttgcaatatgtaagctacactttgagaggagctaaagtgcttttaggggctacaaattaatgccatctccaaaagtgctgaaccttatccccggcctcacatttgtgctggggactctgaccttcatggtagcatggttattttgaagaccacctatcctatcacttacatttacatctgcaaacagggatgtctggcagccctgaaacttaatttcccactttggggttgaccagtcttgaattggctccaaagctctgtggtatcaatacagctggacactacaggccag

SEQ ID NO: 187506 - DNA, 312 bp, Homo sapiens
tctgagggagatggcctgccattgtgagaagaatggattgctgcttacgaaggcactttgaaatttaatatcccataattgaaagggatcactattgttttcttgtccccgctaagacctttttattttaaccaactaaagaaaataccaactttgaggatttccatttgcaagcaggtccacggatgaagttagagttcaagtctcagatctgatactaactaactgcatggtccaagacctgtgtttgatactctccttttccctctcttgcttctttcttcctttttcactttcccacattctttctct

SEQ ID NO: 187507 - DNA, 743 bp, Homo sapiens
aggaaagtttcataaagtagtaaaactgtaatttagatcttaaagaataggtaagctagtaggtaggtacataaatgatttaaccttttgaaaattcagacttaggtgtttaaaaatcatattggaggcttgcagcagttacagatattttgtcaggacataaggagatattgacagaaatggtttatgtttaagaaataaccaaaatgattagtatttaagaatgaggagtctaaagtcctgttcttggtggatttaaagggataaagaaaggaattaagagaactagaaaggagcttggaaataaatcttgcccatcttttccctgctgtgtaccccacttccacaccttccacaagagaaaggagagccagataatttgtatgttgtgtatagttttacagctaatcaggaaactaacaatgaatgtgctaaaataatccaaacagacaaagtgagtttgttgtgatttatgttttggtgagactaaggtgcttttggctgagaagtattcagagcctctaaatgaaaattctgacatgcatttggacattgaaatttcactccaaagttcacatttaaattattagtcttaagtatgagcacaggtttagttgaagtttagcttcttttctctcaacctatgatttgaacacatgatggatgtcagaggaaaaaaaatttacattatttaatatatgtgatgttaaaggaccattaactattacaaattgtgattaaca

SEQ ID NO: 187508 - DNA, 919 bp, Homo sapiens
atgaatttgttcttcagaataaaattaaaatatttaagttggagtataacctgcctaaatcacaatatgcttcatcaagactcatggcctagtctttttctcttaattgcaaaatatataatatatggatttaaacacagtgaagttagcacctcataacacagaatttgagtaacatgacaaagaaacatccaatgcctattaagactcttgctgtttttgagaatcttcagttgagacagctatcaaaataaatggccaatccttttagtacttacattctcaatattgacataaaccatcatctgaccctttacttcacaggttggcatttaaatacattctctccagtatcctacttctgcaatgacaagctcttcagtcaagatttttttctagccaatgttggtagaatacctaatgccatcagttttgacaactctttaaaaatcctacaatacttagatttaaacggatcacacatggtagaacaagctaatacctaccagctttggaaaagccataaatgaatgattacagatgaaggcattttctaataatttagatatcaagtgcagctcacctgccaaaaatggttctgccccagccattctgttcctaactcagagcaacagtgttcacagatttttacagcccagtccagataacatcatactagtcaagaacataaaccaggaccactaatctgttgcaagaagtcatagtttaccaaataatcaacaattgtgatgatgtcattgcctaaaccttgaaaaagtttaaatcagttaaaacaaaaatcaactcatcaaaaacagggaaagttttcaacgatgtattttaatcaagtatgaatggttccaagcattaactaatgttgaaaagacaaactccctgaagtttcaacgtgaaataaata

SEQ ID NO: 187509 - DNA, 559 bp, Homo sapiens
tggccgtcgtagatatcgatcgcgacagtgaaaaactgcggcggtgggatagaatacctaatgccatcagttttgacaactctttaaaaatcctacaatacttagatttaaacggatcacacatggtagaacaagctaatacctaccagctttggaaaagccataaatgaatgattacagatgaaggcattttctaataatttagatatcaagtgcagctcacctgccaaaaatggttctgccccagccattctgttcctaactcagagcaacagtgttcacagatttttacagcccagtccagataacatcatactagtcaagaacataaaccaggaccactaatctgttgcaagaagtcatagtttaccaaataatcaacaattgtgatgatgtcattgcctaaaccttgaaaaagtttaaatcagttaaaacaaaaatcaactcatcaaaaacagggaaagttttcaacgatgtattttaatcaagtatgaatggttccaagcattaactaatgttgaaaagacaaactccctgaagtttcaacgtgaaataaata

SEQ ID NO: 187510 - DNA, 449 bp, Homo sapiens
tctaagtctgatgacttttttttttgagatggagttttgctctttttccccaggctggagtgcaatggcgtgatcttggctcactgccatctccgcctcccaggttcaagcaattcttctgcctcagcctcctgagtagccaggactgcagtcacacgctaccacgtccggctaattttgtatttttagtagagacggagtttcacaatgttggccaggctggtcttgaactcctgacctctggtgatccactctcctcggcctcccaaagtggtggaattacagcgtgagccactgtgcctggcctctgatgaaattttttttttctttttttagttggagtctcactctgtcgcccagactggagtgcagtggtgctgaaaatttgaattagaaaatatcactattttggggggcaagggcctagttttccaaatgtttagtgcctg

SEQ ID NO: 187511 - DNA, 386 bp, Homo sapiens
gactctagaggactcccctcattctcctgacatcttaaccaaaaaaaagtccatttttagtttttaaaattaaaacttctgtttttaaaaaactcactgttttccaacatacatgggcaaagtgcatggttacacagagaagtaaatatgaggaggggctttataccccgtcttgaaatgaggcgcccagcaggttcttccaaaaccttaagaagcaagtcatggtttcttcttgctaactgtgtaaaggacaagtgcttcagggttcattctcaatagtgacctgaagaagaggcgaggatgcaggaagaggacaaagggcatctcttcacttcgtcctatattctcagtgggagaattaattacattatcactatatatcctta

SEQ ID NO: 187512 - DNA, 313 bp, Homo sapiens
tggcctggggcacgaggacagcggcccagagctccggtgagcctgcagcccagtaggtactgctagacatggcttcaccgcagtagtgcttttattattaaaatcactggcgtagtatgttttcaaactactcaaacgcgccaccccacactccagcactttgtgtttgtgctgcaaatgtcacaagattgacagcttctgctgtgggtgacaggagttacaggttctaagccagggacagcaggaccagatctgctatctcagaaagaatggtagtgtggttgctcacgcaagtaatctcagcacatgagaa

SEQ ID NO: 187513 - DNA, 498 bp, Homo sapiens
tcattcttaggagtctggagcatctcagctttcaaaggctctgcctgtgacttgttccctccaagcacagtctttaatctcgtgtctaccttaacctttccccaatccctcactaaggttgctccctgcagtcctttacaaagctgagaagatgactcattacttacaatgtctttccctttccctctgtgccctttgctcttggtcatttatttgtggacaaaattttaaaaaggtggaaaggtgggatagtatttctttccaaatcagagtcattcatacattcacttatgtatttgttcaaatatttatttagtgtggagcttgtgccagacactgttctaggcatagggcaataaaccaaacagaaatttcttcccttttgtagcttacattgtagtgtgggagataacgaaaaaatacaataaatggctgggtgcagtggctcacgcctataatcccagcactttgggagttccgaggcaggtggatcacgag

SEQ ID NO: 187514 - DNA, 470 bp, Homo sapiens
accatgaagtctccccagacatagtaggattctaaagtgtttcagagagaaagagtggcttaattgtaacagtattaattaaatgctgataaaaaccatcctctcaaaatttttctaattttaattataaatctaaatcctttatttaatcacactactgctgtgcttgttaatgttgcagcgaacaaggaaactagttacctaaagacatcaattagaaagcatcctcacaaaatgacacttcaacatttttttcttcacctgtgaaaacttgctaaatgcctatgtgaaattaagcaatctctaaagcaagaatgtctttgaactatagtgaatcaaaataatttaatgtttttaaaaaaaatttttttttaatacagacaaggtctttctatgttgttgcccaggctggtctcagactgctgctggcctcaagcaaccctcctgccttggcctcccaaaatgatggg

SEQ ID NO: 187515 - DNA, 229 bp, Homo sapiens
gttattaacgaaacaaaacaaacaaaaacatgcaagatatcaaaggaatactggcatgcagcattaggtctttggctcaatataagtgagtctaacttcattatgatttcacagttaatttaaaagactgcaagtacccattaaaactttaagacctaggaagccgggcacagtggtgcatgcctgtagtcccagctacccaggagacagaggtgagaggatcgcttga

SEQ ID NO: 187516 - DNA, 390 bp, Homo sapiens
cccctcagattccactcagtcacacagcccaggcctgattcagccttacaggcacacagtgagaaaggtgtacgactttttattttcatttccagctctccctcccactgggtacactagctcatgttgatgataccttcaagttgttaacactagagtgcagggaattaaggaaaagaaaccttacatgatacataactgatctggtgttggcaccttctggtggtggcttaagtccttaaggatgatttgggttctttgctgatcccccttgccaggacctcccaatagcacgtccctattgtagtccacttctgattcctttcctcaaattctctcttctagagatccactcattcaatatattcttggtgttgagatcaatgcctc

SEQ ID NO: 187517 - DNA, 389 bp, Homo sapiens
agattttggatgccgtcatcgagtttggagtacaactgtggagttgccctggagattatggtggggttttctgggcttcacactagggttgctctggggtttttatagggttactccaaaaggccacaggcctgtgctactacctggcccagaggaagggagggagataaggctgtaaaagaaagctagggagtttggagggggaaggacggaggtgacccagcttcctagaggaggggataatttgaagttgcagagcagcaaggctctgctctaccccatcttggtattcaagtcccaaaccctggccaacagcctcctttgttggcagtgagggtctgggaatgaagaaggctgcttgctccctggagtgatgacagtaccgggat

SEQ ID NO: 187518 - DNA, 263 bp, Homo sapiens
tactatgtagccattagaaaccaggttgtaggagaatacttaatgacaaaggaaaaggatcaggctgttagggtgaaacaagcaaattataaaataacttatagtatgattccaagtttggaaaaaaaaaggagtcaggagaggcataagaaaagggagagactgtgcaggagataggttttctttttttttttttggatggagtctggccccattcaccaggctggagtacagtgatcgaccacggggtaccggagctcaga

SEQ ID NO: 187519 - DNA, 549 bp, Homo sapiens
aagggacctaagagacagtttgatcaaatgtccttacaccctcaaagagggtttcctgatataacaggtccagcctctgtctacttgcccttttctattccaacttgtcaggagaagaggggccataccctgttaagtccagtgagtagaatcacttcattcatcaaggcgggacgtggcttgtttatgcatgaggtagttattccactctggtttaatttcttttaaaatggggatgatgacaattgtggttgttgtacagataaaaactcatgtacagtgtcaagcataggacccatggttaagagctattaatattcagaatattaacacatcacagggtacctgtaaaacacttcttaaagaactacagtgccttcaacctagcctggctcttatttatttgacacttcagtggggaacaagaattcaattttggccaggtgtggtggctcacgcctgtaatcctagcactttgggaggccgaggcaggtggatcacttgaggtcaagattcaagaccagcctggccaacaaggcaaaaccacgt

SEQ ID NO: 187520 - DNA, 247 bp, Homo sapiens
atgtaagctcactgactttggaatctgtcctgctggtcctacaaagagccctcgaagaagtgaggggacaggacctccggcctgagtcaccccccagaggcctctgcctgggaactaggctgaggaccttggactcttacttgagcgagacctgttagacagaggttgagtatccagggctaatctgttccccttgcctcacatagatgctgtgagccacaacacactggctggaaggtctgcctat

SEQ ID NO: 187521 - DNA, 316 bp, Homo sapiens
tgacacatagaatgtagagagaggaatgcatcacctacgcctccctaagaatggtagtactttcagtaacaatagggaggtcaagattataagggaaattaatgacatctgttttcaggtatcagtacctcaagagattaaacatgataattaaagtgagagccaaaagggttttgaaaaagttgggcaacatgatttgtgagtagtggagaggcatgtcctagttacgcagtgataaatagtcttgcatacagttcgtgctgttcaattctgctcacccatgggcatgttcggaagtttgtgttgaaacatgcat

SEQ ID NO: 187522 - DNA, 193 bp, Homo sapiens
ataattttcaagaattgaataaaggcatcacagtgaaactgcaaaagatcaaagagaagaagaaaatactttaaactactagagtagagacagattatgtaaaatgtacagttagactggtagcaaacttcatcttagcgataagagctgccaaaaaccaatacagcaatatgttcaaaatgcataattatca

SEQ ID NO: 187523 - DNA, 348 bp, Homo sapiens
tagggtctcttgggagggtgatagagaggagacagttccctatgtcaacaccttatctcagtcctccccagaaccttggccttgtcactgctgcagtctgaagttctcattttcccttcaggttgttggatttcctcatacacccaaacgtggggatcatctcccactcctaaatacttttgcaaagctgaagcttgttgttgctatttcctctctatttcaccttcacatcatcagcagacagtatcatcgcctgcctgtgggcttagctgcttttctctaggtctgaatgtgtgatgaaacaagagctcttccctctgactttgtgaccatctccctaagacccta

SEQ ID NO: 187524 - DNA, 351 bp, Homo sapiens
gtaaagtaactttgcatcatatttggcctaagttgaagtgacttgtttccatgggtagttctccattaccaaaacggttgggcgacctcgtccaggaatatattagagagggcttaggtctcagttgggtgagttgtaaggtttcttctaaccttgaaattctctacttttggtttgtacaggagttctctaaacatttctaataattggtgattcagtccccacctgagtattttccttcagaggtagcttatttcatggagtatcatgactatgatgtatcttgcgtgtgtgtgtgtgcgtgtgtgttttaataagagtctgggtcttgcgatgttgcccaggctaatt

SEQ ID NO: 187525 - DNA, 340 bp, Homo sapiens
ttgcgaaaccattctggctcacttaggggccagccttgtggattgtcattattcatagaaagacacagtgtctgctcccaacattgacctcacagtatgagagttgagtaatatgaatgaattatttattacttattcaaattttaagactcactggcctctaatagaaccaaaataagaaatttttttcttccttcttttccaataagttgatacctctatctatgcttctcacaaatggattctctacaatcaagtgattcctttcaatactgtggactcacaaactggctaattatacctgaattaagggcagttccattcaggtgattctacattt

SEQ ID NO: 187526 - DNA, 641 bp, Homo sapiens
aattttcttatatgttatatggaggtaataattgggttattacaagaattaaatgagacaatacacataaagaatttaactcaggacctgagatataaatgcttgatagctacttgcaattattgcattttctacctgtaaaaactctcccaatgctatccctcccccctccccccaccccacaacagtccccagagtgtgatgttccccttcctgtgtccatatgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccacggtgtatatgtgccaccttttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtcccaccaacagtg

SEQ ID NO: 187527 - DNA, 822 bp, Homo sapiens
gtgaaatcctgtctctactaagtacaaaaattagccagacagtggtggcatgggcctgtaatcccagctactcaggaggcaggagaatcacttgagtctgggaggcagaggttgcagtgagctgagattgcaccactgcactctagtctgggtgacagagtgagaccctgtctcaaaaacaaacaaatacctcactgcatggagccactgagatttggggattgtcgttactgcaccagaacccaaatcatcctgaccgctagggtgtcctaactagggtttcttcccaaaagcaaaggcatttttaaagttcgtgacatttaaacaaaagagcaaataccaatatctaccacttcgtcaggctaacaaacccaaacaaagccaacagccagaagttaaaataaacagatcattaggttgaaaatagaactgtcaaaacaggcacaattgacttcatttagtgattgcaaagaacatcaggcaagacacacgtgtggtcatcataacatttatcacatgcttaattgcacatgtttgactaagaaaaacacaaagtatttaagctcatctgtagttcaaagtgcctatccgtgtatttatctattcatcctgatgtatttattgagcaactcttttgtgccaggcactgtgctgtgttgcgggaagtcagggaccccaaacggagggaccagctgaagccatgacagaagaacgtggattatgaagattttatggacatttattagttccccaaattaatacttttgtaatttcttatgcctgccttcactgcaatctctaaacataaattgtaaagatttc

SEQ ID NO: 187528 - DNA, 869 bp, Homo sapiens
gagaagtcagcctcaaagaaagagctggccctgaacctgtgcagatcactccaccagctcccagtgcccagagtcctgggccaggcatttggtggcatgggcctgtaatcccagctactcaggaggcaggagaatcacttgagtctgggaggcagaggttgcagtgagctgagattgcaccactgcactctagtctgggtgacagagtgagaccctgtctcaaaaacaaacaaatacctcactgcatggagccactgagatttggggattgtcgttactgcaccagaacccaaatcatcctgaccgctagggtgtcctaactagggtttcttcccaaaagcaaaggcatttttaaagttcgtgacatttaaacaaaagagcaaataccaatatctaccacttcgtcaggctaacaaacccaaacaaagccaacagccagaagttaaaataaacagatcattaggttgaaaatagaactgtcaaaacaggcacaattgacttcatttagtgattgcaaagaacatcaggcaagacacacgtgtggtcatcataacatttatcacatgcttaattgcacatgtttgactaagaaaaacacaaagtatttaagctcatctgtagttcaaagtgcctatccgtgtatttatctattcatcctgatgtatttattgagcaactcttttgtgccaggcactgtgctgtgttgcgggaagtcagggaccccaaacggagggaccagctgaagccatgacagaagaacgtggattatgaagattttatggacatttattagttccccaaattaatacttttgtaatttcttatgcctgccttcactgcaatctctaaacataaattgtaaagatttc

SEQ ID NO: 187529 - DNA, 544 bp, Homo sapiens
gaattcacaatgctgctcaaaggtcctctctgcccatgaggcgtccccaaaccccaaatcacctgggccacaggctccaagcaccacagacatgataagcataaagcttttaggcgagtcagcattctcaatctcccctccttctgtgtcccatgaaaacagaggcctggggttttttttacttttttctttaaattctattccactccttacacttaaaaatgcctcattattctttagtaaatgctaggagcataaaatcttcttcaaagaagcaaaaactggcatctgttcctgctctgagaagtccttgaagatctcttgaaaggaaggtcatttctacctgcacctcaaaatagaaacaaactggctccctgttccagacatcacccttaccagagttgccccgagtccgggtttgcaaaagtttgggagaggtgtaagaaggagctgactagggcaccagccttccaagtcgcgggaaggtccaggatactggccccctgcctccacctaccagcagggcaaggctggagcaggcacg

SEQ ID NO: 187530 - DNA, 719 bp, Homo sapiens
tatgaattgtgtcatacatatttgttattttaagccattaagttttagggtaatttttaaatggaaaaatacatgatcataggtaaactataattaatagaaaaatctaatgccaataatatttaccattgattgaccgtcaaaactccattaattatttgctttccatttatatttatttttggatttcttttttaagagaatggcacctgtgacagcatactgttaatattacccttttatcgtactttaccatgccatctctgaagaatattacagaccattttggagcatggtgaataagaaattttcaccttaggagttcacttgaatagtcatttttatatttgtgactgcaaatcactcttaggggctgtacttccttagtactggtagcattattatccaatggacttttatagctttcattaggttttcttttgtttttgttctttaaagaacgttttacttatcttagtatttcatttttcatctatattatgaggcagtaagagtcttctgtttttccaaagtggagactgctttatatttatttcgtattgtctacagctgtagtgttcaatacattagccactagccacatgtggttatttaaataagataaaataaaaattggccgggcgtggtgggtcacgccggtaatcccagcactttgggaggccgaggcgggcagatcattaggtcaggagatcgagacc

SEQ ID NO: 187531 - DNA, 236 bp, Homo sapiens
tctgacccctcccttctttgacctctgggaggaacccaagttcctgtttctttatctttctttttaaatgtaaactagttatgtaaacctgtttattgtctcatttaaacatgtcattatggcctcccattccttggaaaaacagcttatcaaggtatcttttctcctagaaaagagctttaaaataagatattttgatttccatctgctagcttggaggctgggtaagagtatga

SEQ ID NO: 187532 - DNA, 124 bp, Homo sapiens
tctgccagcagagacgcacgttgcataacccaggcgtagggtcaactatcccctctgggctccatctccactgcactgtcacagagattccagcgtctgctcaggatacaggaactagcgagag

SEQ ID NO: 187533 - DNA, 443 bp, Homo sapiens
cagatttactgaaaaacaaaaaattggcaatgccaattatgtcactcattgttgtcccagggctcatcacctatgaagatgacaatagcaaaaatatccaccaatatttttccccaaaggtcccttaagagatgagccagacccctcaatgcctggtgaaagattttgaacaattcttaatactaaagccagaataatctttctaaaactcaaattgaatagcatcattctcttgtgaaaattcttcctattgcccttagagtaaagccctgatacctccttaacaaaacccacaagacactgcatgaccttgctaccactgactacctcagcctcatctcaagcaattctcctctccattttctgagctcatggcacaatggctttcttttagttccttaaaaacaacatgggcaatcctgcctcaaggcccttgatcatgg

SEQ ID NO: 187534 - DNA, 318 bp, Homo sapiens
cagagggcgtgcctgtgacagggcgggagctacaggactggacatgatcaccgattcagagggagggagggatgcaggcagaggcctaactccagcatgttagcatgtgctatggaagtgctgtccacaatggtggccaccagtcatgtgtagtactttaaataagtctgttgtggctgaggacctaatttgtaattttaatttcattttaaatttaaatatccgtatgtggctcatggctgctgtattaggaagtgtagatctagagaaacagctagaaaaaggagagagcactggagtcacagtaggggaagaggt

SEQ ID NO: 187535 - DNA, 567 bp, Homo sapiens
gtgattcaggtctcagggcactgtcgcccctactcactttgatgaagccagtgctgggttgctgctgaggtggggaggttcatgggccaggaactgaaggcagccatgagagccagacccctccaccacccccaagacagcagggaactcactccaacagccaccctgggatgctgccacagctgagcctggaggtgaccgtgaccctggctgacgtcggactgcagctttgtaagggagactgagccgggacccagacctacaaaagctgagatgataaacactgttttaagctgctgtgtgtcgcagtgactcgtgtggtagtggatttctagcagagccgtcgttcgtgtctgccttctctcagctcaacactctgtagggccacccatgccgttgtgcatgtcaacggtggattttttattgcgagtaatatttcattccattgcatgctcacacctcggtttgtttaactgtctacctgttgatgagctctgggacatatgcagttctgggctattatgagtaaagctgcttttaacatttaaatacaagtctgtgtatgga

SEQ ID NO: 187536 - DNA, 301 bp, Homo sapiens
tgagagttttacgttgaattttaagtttgaccacaaatatttaaacttccctggaccacaaatacagtatcttccctgtggtttatctggcagcaagtacatatttacaaatctctatatgtctgcctgttatttaaatttcttacagaagtgccaaggtctttagttgtgatttatcccctccccctccgtactggtaggtatagtcttcattaggcctaactcttgggaaaaggaggtatctttacaattgaagcttagaaatcttcctgattaaatttcctattaccgcttccctctt

SEQ ID NO: 187537 - DNA, 147 bp, Homo sapiens
aaatatgtaaaggggaagtcaaaatatcgctgtttgccaatgatatgatcgtatacctagaaaaccctaaagactcatccaaaaagctcctagatctaataaatgaattccgtaaactttcagggtacaaaatcaatgtacacaaat

SEQ ID NO: 187538 - DNA, 405 bp, Homo sapiens
atgtaagcatgatgctgataatagctaatctggagtgcttgccatgtgcctggcactttgccaagcattttcctttcattgactggtgagttcgctctacaatcccattcacttacctctctctggtaagccatggtgctagcaatggaatcagaatctgtctgcctaaccctcacaagtgtgtacactttacagtgagccatttatacctgtccggctggcaaaacagtccacaactgtctccttagtggctggatccctgctggctctgccccgatggaaatgcttttgccttctctgctcagtgatcactttagagcactaggacagaacagagcccagcttcgagggtgaaacctgatgctgaagaattcacagccacacatagtgtgtcctcttatccca

SEQ ID NO: 187539 - DNA, 268 bp, Homo sapiens
ggagttcaaatccagcctgggcaatatagcgagacactgtctcttaaaaacaaaaacacccaacacatttatagagcctctactactactatgtaccagcaaaattgcataaagcatgctttgtctacaatcttaggttctttcactcagtattaccttcagataaatcagttcttccagagataccctctgacttccctttcccacatcattatttatatactttgaacccaattaattctattgctgatttttcctcatttcatag

SEQ ID NO: 187540 - DNA, 266 bp, Homo sapiens
agtcatcttgttacaaagcaaaactaatctcatcattcttcaactggaaatctttcaatggcttcacatgacactcaatgtctaaactctagaaacccctgcatgaaatggccctggctcccttctcagccccatttcctgtgactctcctgcttgaatgtcacactcaagccagacaccttccttccagtaactccagtgtgccaagccatttcccattgtgttggaagaccatctgtgttgcttcctttgatagaaaggctttg

SEQ ID NO: 187541 - DNA, 365 bp, Homo sapiens
caaaatagtcctgattacagtctttttgccatttcaataagtgtcaataattttttcattaacagtatatttaaatgtgtctatgtttaaaaagcttcacaagcaaatctaatatagttccatggttgaaaattctgatagacactggttaagagtatggattctggaatgcgacagacctagtttcaaatgccaactctgcttcttgcagctgagtgactaagcaaattacctaacctgagcatctctctttctctgttgtctctctctctctctttctctctctttcactctatctctctcaagttagtgaaaagatccaatgaaggcccttaaactactaagcacagtactagtacccaaca

SEQ ID NO: 187542 - DNA, 1017 bp, Homo sapiens
  misc_feature (944)..(944): n is a, c, g, or t
gagatgaagtcacgctctgtcgcccaagctggaatgtagtggcatgatctcagctcactgcaacctctgcgtcctgggttcaagcgattctcctgcctcagcctcctgagtagctgggattacaggcccttgtcaccacgcccatcttaatttgtacttttagtagagacggggttttgccatgttgcccaggctggtctcaaactcctgacctcaggtgatccacccgccttggcctcccaaagtgctgggattacacgtgtgagccactgtgcccagcttactaggtaattttttcaaagtaaggtacctttgtgctctaaggctcacccctctccaactactcaatgaaaaaacaaaaaaatgctagtaccatgtgtattttgatttcatgttaattacatattttatttgctcagagtacaaattagataaaattccttttattaaaatattccttagtaaagaatctagtaatttgctattttatccatgttttatgttctaaattgataagttattttctcatttttaaaaaaactgatcatgtatttagtcattctttagtgtatagattgtttctacatataaagccagcaggttttctgtttgtttctctgttccattgtgtagagccaaagaggtttttattttaactgtgtgtcagtcacaggaaagtagttattgtttgggctccactatgaaatgtcatacttgattagagctacaaatagaatacagaataaaattagcgtaagtgcttttagttataaacagactctgaaaaaactgtttgcatcatactctttcagagatattctgtgcttcataaattgagttccgtttttcagtgattgaatagcaatcttgattctttaattcttcaggtgcttttgtgattttatatataagtaagagaatggcacctcaagcagccatttagngtaacagccatttaggtaacagccatttaggtaacagccatttaggtaacagccatatcagtaacagccattg

SEQ ID NO: 187543 - DNA, 594 bp, Homo sapiens
caatccaagtttggttgaatcctcacatggattccacagatacagagggctgactgtactttctaggattattaagtaatgagctcatttaatcttcctttaaacacagccctacctcatcttacagttaaaaaaaaaaagaaaagaatgctcagaaagggaaaggaacttatacaaaactcacaaccaaaaagcagccacgctgtgtttgaagccaagtctgtctcattttcaaacccatactcattccaaggttctctagtgcttccctagtaaagggttgcaggttgtgagtttcaaataagcaccacaagcatccagcaacagaaagaatgacctaatgtggtctaaagcagtgtctccaactgtagcatgcaacagaatgacctgcagggcttttaacagcacaggttggccaggcgcagtggctcacacctgtaatcccaacattttgggaggacgaggcaggtgtttcacttgaggtcaggagttcaagaccaacctggccaatatggtgaaacctcatctcttctaaaaatacaaaaattagccagatgcagtggcgggtgcctgtaatcccagctacttgggagg

SEQ ID NO: 187544 - DNA, 2264 bp, Homo sapiens
aaaatgagaaacccctacacagggctctatgtcccctcgccctctccagtcaaggccaccacaagccaagggaggtctgggcgtgagaggtgagaccctgtgctccccctgccctgggtggaggaagggggtgccctgccaccctgagaacaatggtgtgtgcagaagagaagggactgaaactctttgaagatgttccaggatttagcacccagggagcggcggagactcagccccaccagcctccggcacggagggaggaaagcgttccccaggctgctcaggagaacgtttgttgctgtagtgggcagtcaccttccaaccggggacagtcacccccctgctcggggacagtcacccccccgctcggggacagtcacccccccgctcgggcacagtcacccccctgctcggggacagtcatccccccgctcggggacagtcaccctcccggaatggggcttcctttctcggggctgggaatcaccctggatccctccccactcggggtgctcttgggccatctgagggctcctgggtcactcttgggccttctcagggttcctgggtcattcttgggccatctgagggttcctgagcccaatgacacttctgcctaggctcgcgctgcgggaggaagaagccaggcgaggtcccctccgtgccccggtgcagcctggcctgggagagaggagcccccagcgacaccgagagccaaaacagggcagagtttctcagaggtggcacccggccagggagcccctcgcggctacagggtttctccacggactcggccatctggggagagcagcccagagccctcgagcctcctgctgtattctgtggcctgggacttggggggacccattgaggacactgggacgcagccaaagggaggtgcagacagtgtgtactggcgtttccggggaccaagcccagaaggagcaggacggccacctcctggcctggaggaaaatcctgcttcctggcaagaaaaccacccctagaggaataggactggggtgcaggacgctttctcaggcaaccgcccctttccttctccaaaactggggcaggaaaagagcattcaggccaggcagcgaaaaccccagctctggtacctcccgccccagcagaggccgcctggaggcacggagttccggcctggatgaggcctgggaagcccagcgactcacaggccacggccgcttcccctctccgaggaaggaaaagtccctgcagcgcggcctcggctaaggctccggtgcccaagcaaaggaagggagcgtgcttgcagacgcctcctgctgggagcctgccacgcccgccacaccctgcgcggggacaaagctctccgtggctgtggcagggacacaccgcgtgtgggtggctgcaagccagcagccccgagcggcccctcccgctagactcccagcctgggccctctgtcctccaggcaacgagaacatggatgcctcgcttttcagagactcgcgttcttggaacttacaccctcttgggtttgctatttttacccaccctgagccttccggtctccatggcgacgcctccaaacagcagattccaggcggcaatgacgtcatctctccctttcctgccgcccaggccttggaggtactgctgcctggggccgggggtgggggtgggggggctgcagggcttccctggccccctcccatacccacctggtgctcccccaaccagagatccaaggcctgtgggccacggctgcgcctctcctgactccagcttgcccgtctgtccttgggggcagcgtccttccttctctcggccccttggagcagctctgcgggaaccccacagcagcccagcggattgaacgcaaaagacagccaccctcctgctccggatcctgggaggaggctacacgctggcgctgagacagcaacctgcctggcctgggaagccccccgcagcccctacatcagaagcttgctcttggcgcagtggctcacgcctgtaatcccagcactttgggaggctgaggcgggcggatcacgaggtcaggagatcgagaccaacctggctaacacggtgaaaccctgtcgctcctaaaaatacaaaaaaaacaaattagctgggcgtggtggcgggcgcctgtagtcccagctactcgggaggctgaggcaggagaatggtgtgaacctgggaggtggagcttgcagtgagccgagatcacactactgcactccagcctgggcgacaaagcaagactccgtctc

SEQ ID NO: 187545 - DNA, 2174 bp, Homo sapiens
aaaatgagaaacccctacacagggctctatgtcccctcgccctctccagtcaaggccaccacaagccaagggaggtctgggcgtgagaggtgagaccctgtgctccccctgccctgggtggaggaagggggtgccctgccaccctgagaacaatggtgtgtgcagaagagaagggactgaaactctttgaagatgttccaggatttagcacccagggagcggcggagactcagccccaccagcctccggcacggagggaggaaagcgttccccaggctgctcaggagaacgtttgttgctgtagtgggcagtcaccttccaaccggggacagtcacccccctgctcggggacagtcacccccccgctcggggacagtcacccccccgctcgggcacagtcacccccctgctcggggacagtcatccccccgctcggggacagtcaccctcccggaatggggcttcctttctcggggctgggaatcaccctggatccctccccactcggggtgctcttgggccatctgagggctcctgggtcactcttgggccttctcagggttcctgggtcattcttgggccatctgagggttcctgagcccaatgacacttctgcctaggctcgcgctgcgggaggaagaagccaggcgaggtcccctccgtgccccggtgcagcctggcctgggagagaggagcccccagcgacaccgagagccaaaacagggcagagtttctcagaggtggcacccggccagggagcccctcgcggctacagggtttctccacggactcggccatctggggagagcagcccagagccctcgagcctcctgctgtattctgtggcctgggacttggggggacccattgaggacactgggacgcagccaaagggaggtgcagacagtgtgtactggcgtttccggggaccaagcccagaaggagcaggacggccacctcctggcctggaggaaaatcctgcttcctggcaagaaaaccacccctagaggaataggactggggtgcaggacgctttctcaggcaaccgcccctttccttctccaaaactggggcaggaaaagagcattcaggccaggcagcgaaaaccccagctctggtacctcccgccccagcagaggccgcctggaggcacggagttccggcctggatgaggcctgggaagcccagcgactcacaggccacggccgcttcccctctccgaggaaggaaaagtccctgcagcgcggcctcggctaaggctccggtgcccaagcaaaggaagggagcgtgcttgcagacgcctcctgctgggagcctgccacgcccgccacaccctgcgcggggacaaagctctccgtggctgtggcagggacacaccgcgtgtgggtggctgcaagccagcagccccgagcggcccctcccgctagactcccagcctgggccctctgtcctccaggcaacgagaacatggatgcctcgcttttcagagactcgcgttcttggaacttacaccctcttgggtttgctatttttacccaccctgagccttccggtctccatggcgacgcctccaaacagcagattccaggcggcaatgacgtcatctctccctttcctgccgcccaggccttggagagatccaaggcctgtgggccacggctgcgcctctcctgactccagcttgcccgtctgtccttgggggcagcgtccttccttctctcggccccttggagcagctctgcgggaaccccacagcagcccagcggattgaacgcaaaagacagccaccctcctgctccggatcctgggaggaggctacacgctggcgctgagacagcaacctgcctggcctgggaagccccccgcagcccctacatcagaagcttgctcttggcgcagtggctcacgcctgtaatcccagcactttgggaggctgaggcgggcggatcacgaggtcaggagatcgagaccaacctggctaacacggtgaaaccctgtcgctcctaaaaatacaaaaaaaacaaattagctgggcgtggtggcgggcgcctgtagtcccagctactcgggaggctgaggcaggagaatggtgtgaacctgggaggtggagcttgcagtgagccgagatcacactactgcactccagcctgggcgacaaagcaagactccgtctc

SEQ ID NO: 187546 - DNA, 759 bp, Homo sapiens
cttcccacccctcccccctcctgcctcttggggtttcctccttcacatttacacacatacaatgcaggaagccttgtatgcatttaaggaagagaggatttggagatggacatttcttctgtaagccattcagtatgcctatgaagtacttgtggtcctctttaaatatatgtttgtttctggaccttatttctgttttactcaatcaggatttcagaatgcaggacctagaaatttgcattctattagaagactcaggttgatatgattcaggccactcgcagaacacagtttgagagactgcaagcaacaccttctccctgttcattgatcacgtgggaggcttagcaggtcactagacctgctagaggacaactcaagtagacatatcccccaattatgaaaaagtgcatttcaaggtaaaagtgacctcaacataaattggaattttgcagtgctgaattaattattgacacatttgctgagaagcaagcatggtttaaaaataaccacagtcacaacaaaaccacaaacctctgacttaggctttctaaatataagaaacaaaagacgaaccagaacctccagtaacttccctccaggccccagctttcactggcccgattttacctgaaagcatctgagcatgggctctctaggatctctcaatatgccccgtcccttcccagctcccagctcccatttccctgtgtcctttggctgcctaactctatacatcacaaagagctacagaaataa

SEQ ID NO: 187547 - DNA, 827 bp, Homo sapiens
tggtggcctcacagtaaatgggagcgtcaactataatcccagctctgaccagtgcactaactgtcttttctcagaactcaccctgggagctctcgtctgcggggactgaggtctcactcagcacttgaaagtacctttgagaatgaagaaactacaacagctttccaggaccctgtgtgcagtttcttccattctgtcctgaagggtcagtggccctacctagggatctgcattggctcttgtgcaagtggtggccttcattgggctgcttaccaatgtttattgagtgtgtccatttacacactatgcatagacacagccaccattagcacagacattgaacttcagctctgggatcacaccctaaggaatgtcatcaaatcaaggcttcaggaagcacaaataggcccccttcatcgtggaagggtgggaaacaggagaatcctccctttttaggatatatggaggagattttctgctccttctcccatgaacttctcactaatacagcccttagggttgtcccacttgatgaagtctcctgggataagtgtgctttcaaatatctttttcgctggcataattgcatgactgataaaagtttgcctctaattagtaattccacaagaaaatcaaggcaatcaatagctaatgtacaaaatttttcatagcaaacaggacaggtgtaggaaagcttgagtacttataatgcactgaaaatccacaaaactgagtttggtcaatactctcatgatccttcctcattacttaaatttcttttaaagtgctcgctggctaagattcagtagagtggcatctgataaaca

SEQ ID NO: 187548 - DNA, 458 bp, Homo sapiens
gggtattaactgggtgctgctaaggtactgtattaaataaattccatgaattaatagtcttacagacatcccacttttctactgaagaactgaagataacaaatatactagcataaaaggactgataaaaggggtaagacttgcctcaactctaaagtacagaaatcagaatgcagaaaaggctatctgaagaaagtgagaaaccacaaaccaagtgtaaatataactatgcaggtaagaacaaacaaaagtttcaaactgaagaaattaaggctagataaacagaatggaattggatagcaggaggcctcaagtatccagcaaacggatgaaagttttgtaaaacagctataagcaggacaccactacgagctctttatatttaaaatgcctttttagaaatagaacctagtaataatacaaaatgagtgggagagaaatgagaagcaagaaactat

SEQ ID NO: 187549 - DNA, 362 bp, Homo sapiens
acactatccaatatatgttccctggcatcttcctgtcttttaaatattctctgtacgctacagttctttgtaagtaaaaataagcttaatatgtctacttagcaaacaaagtttttccagatacctataataatgaggaaaacagtataaagaatgaagtatttgaagaataacttataatttgggggatttctgagaattctacttctttgtccctaatttccgaaggtaaatgtttgttgtgaatttggaaacactagactacagaaaagcaggcactctctagcctgggaggcccactgatcttaggagggtccatatagctgcttattgcagaccttgcactagaacccaggtctttt

SEQ ID NO: 187550 - DNA, 480 bp, Homo sapiens
aggatgtggatgtcatgagagcaatgtgataaatgttcaaacatgtggaactgcacgggtaaataagggtgacttatgagaggaagcgacagctgaatttgaagtgggaagaaggagcttgccagataacaaggagagaggaagtggccttctaggtgcagggaagtaccaaaacaaaggtgtaggagcaggaagggtctttaaacgttaggttaggtaagggctcttcacccagagtggccagaatgcaggactcggatttagagtggttggaggaggattcagaggccctggagacttatagcccgaagggctcgtatgaagactaagggggtaggactttatcttctgacatgtagttggctctgtaacatatttcctctgaattactttccctcctgattaaatcataaaggctttgaggacatctaagctcttcttattcccacctggatactcttccatatagaaagggagtca

SEQ ID NO: 187551 - DNA, 209 bp, Homo sapiens
attacacagaaaactcagacaaaaacacataaaccataggcacataccccacacaaagctatctatacacaagcacacgctcttccatcttgtgtacacttaccaggggaagccaacatgcaacagaaagctcattcagtgcctcccaatatactgcacacccaggctcactcaacattcatgcagccatccttctaatgacctactcg

SEQ ID NO: 187552 - DNA, 329 bp, Homo sapiens
gaccaaagagctacctctgagctagctgttacattaagttgagaaagtttcccagcagcttattgactgggtaagcagttgttcaggattgcttttcattgttgggttttggagtccacaggttagtgtgcaggagagtaaggcatgtgctggctctctttctcatttgagtgagggtgcttttgatttttttgtgaattgttctgtagtttgaagaatctagaaggacaggctatcaacagaggcagtctgcttaagcaaggtcgtcttggagtcctttctaacaatttgatgagcagtaaacctctgcaatcctgtctaatatttgt

SEQ ID NO: 187553 - DNA, 743 bp, Homo sapiens
cgcaacctctgcctcctgggttcaagcaattcccctgcctcagcctccccagtagctgggattacaggtgcgtgccaccacatggggctaattttttatatttttagtagggatggggtttcaccatattggccaggctggtcttgaactcctgaccttgtgatctgcccgcctcggcctcccaaagtgctgggattacaggaatgagctaccgtgcccggccctatacatctgtttagatgggaatgttgacgtggaagtgtatcacttcctgttttacgtccctgtgtaaaacaatcacatttccttattgatgactgtcttccaacagaaacgtaatcatcttcaaggttagaaaatgttttttaaataacttcaaccagcgttaaccaaactggttaattcaccaaaatgttaaccaaaattaaccaaatcaaatttggtttattttccaggtctcttttttcttttcttttttcatttttaaagagatgggatcttgctatgttgcccaagctaaaatgcaattgttattcacaggcatgataatagtgccctatagcctcgaactcctgggcccacatgatcctcctgccttagcctcctgagtattccaggtttttcttaatagtttaaacaggtagttctggtttggctatcagtagtgttgtcaaatagcttttgtttgcttaattttatttttattttttttgagacaagtcttgatctgttgcccaggctgg

SEQ ID NO: 187554 - DNA, 504 bp, Homo sapiens
tatttctggtctagatccttaacgaatggtcacactgtcttccacaatggttgaactaatttacattcccaccaacagtgtaaaagcattcctatttctccacatcctctccagcatctgttgttttgactttttaataattgccatgctgactggtgtgagatggtatatcattgtggttttaatttgcatttctctaatgatcagtgatgttgaactttttttcatatgtttgtcagatgcataaatgtcttcttttgagaagtgtctattcatgtcctttgcccaaaaagtagacattcttgttttaagtcttccctttgtgcttcatcttacagtgtctctaccccagaagtttagtgttggcattgattattcattgcttgctagcttggttttgaggggtagaagtgttcatattttccattctcggtgatcgttttcctacctaagcagtaagggacctctaaggatctggacccagttcctttttctgtctttctc

SEQ ID NO: 187555 - DNA, 501 bp, Homo sapiens
agagaagatgctgcaaatcctccctcctctctttgctggagatttaaatcttttgtgtcgtaaacaggtggaggaagtcagggcaggggaaacatggggaagagtgaatttgtggagtggggcgttttcataaaacggaggcctaggtagaaaatagcatcgagtgagaaaaggtgtgcgaagaaggtttgtgggcattattctcaaggcgcctttagagtaagggatggtggaagcccaccaagaagtagaaatgaaatgggtgtttctcaagaaaggtaagaataatctagaggaatatttctttatcaagtatcatgataaaactgacttgaatatgaaagagaaaaagtttctgattgtcaccaagtcagaatttatgaaccaaagtattgtttttggggttggggaataaacattcagaaaagacgactgactaagatgcaaatatcatgatttcacataaatgtcctttgtaataaaaaaggtaggaagtgggag

SEQ ID NO: 187556 - DNA, 483 bp, Homo sapiens
cattacatcccctcttccctcctggacacagcagtgtgatgcggtcaatgggaattagattttggagatggggcagagtggcactaggggcaggaggaaatgtacgaatacctgctgagaagacagaatcgatatgtgacaactgtaattctcagcacagtaattacaccatgtttacagggctctgcagagtcaccctattgatttcggaaaagtatatttactgcatcagaaacacaggtgcaatccctgatctgcactccagtctttcattgatcttgaacatcatagccagatacaaggtgctttagcatgcaatcctgcatctttgcctctgtggtttggctcagcaattcattatccatttctgtctatcttaccacacccatttttactctcaaaaggtggcaaacagaaacattcatttatttactcaaatcaccggttcctactttatgccaggtgctcacccaggtgctggtg

SEQ ID NO: 187557 - DNA, 400 bp, Homo sapiens
atgtgggagatgggagggaatcagggccctggagggacctgggtgcagaatttcagaaatatgaaggaactggggggccccgatgagatttgaggaaatctgggggcgctaggcatctggcaaggacagggtctgagatgataggagcaaggtctagggcgatcctaagtgctattgagaaagggttttcggagtgggctgagggtgagattgagggggtggggtgagttcttgagggactctatcttgttagcagaaagaagggagctggctgaggtgtgaaggcagcacatgacattcagtgcataagaggaaggagcagggtatgagggcagcacagtgcccgatggaatgcaggagatgggggctcagattgagggagagcagaaatctggggtga

SEQ ID NO: 187558 - DNA, 442 bp, Homo sapiens
tagcatccataaattatggaagagggtatttcccatcttcttaacacatgcaacacttctaaggggcctgcaaaaaccccagcagcctttcaatgtcccccacatcttagcacacataaatatttacatctgtcctatcaagaaacaaatatgcatgcatatcattattttggagatatagcgtgagcactttgtttgcaagaaaaaaatatgcatgcatatcattttggagatatagtgtgagcacttatatttgtttgcaagaaacaaatatgcatgtatatcattatttttggagatacagtgaatgcacttttccagttacatgctcaaaatggtatgctaaactgaaagtggttgtcattacccttaatttctgcaaggaataaacaagtatgtcctggtggcacattgctatgaataaagcagactatttcagggc

SEQ ID NO: 187559 - DNA, 138 bp, Homo sapiens
tattagtctgcaaaacatgagaataaaaggactaattaaaaaaatttaaacccttcgacttttatttcactctgttccttatgaaatagttgttttctcagctacatcgagacactcaacatagtaatctgcttagtt

SEQ ID NO: 187560 - DNA, 332 bp, Homo sapiens
cctttggcaacaattcattgaaacaaacattgattgaatattgtttacacacccactgatatcctagatgcgaggctaacatcaatgaccaaagaaagatttctgtcccccaccctccatggagcttatattctagcaataaaaacaaagaaaaaagtaaacatactataggtaaattacataatatttttgaaagtgattaagtactaggggctaacagaatgggataaggagaatctgggaatccaaagagaggagtgggggttcatgatattaaatagaaatgacactggggagaggcatgaaagagctgtgggtgccagccaggagga

SEQ ID NO: 187561 - DNA, 383 bp, Homo sapiens
cactctgtgtaatttccttaaatataaagcagaattcaaaatagggcttaccacatagggtgtgtgtgaagatgaaatgagttaatgtccacaaggcacttagaacagtgtctggtgcatagtaaatctcaacaaatgttagctattagctgttattatcacatagctactaaatgttaggacttgtacccgaatctagaccttctgtctcctagtccagaacacttcctagtaccatgtgcaatttaccttttagtaaatcattgattggatttccgcctcacattgaccttgttattcttgaagggatctttttctactttgtttactttgactttaaatttttcaagatcaaaagggaaatatgttcgaaagattcttcc

SEQ ID NO: 187562 - DNA, 205 bp, Homo sapiens
tagtcactagggaaatacaaatcaaaaccacgacgggataacatttcacactcactaggatagctagaataaaaaagacagtgacaagtgttggtgaggacatgcaggaagtggcacccatgtgcactgccagagggaatggacagtggtgcagccactttgggaaacagtctggcacatcttcagaaggttaaatccaaaggta

SEQ ID NO: 187563 - DNA, 103 bp, Homo sapiens
cacgttagcgttgaatatcaaaatagtacgttttgcttattaatgtctgtgggcttttttaggttaatttaaaactcttctgattaatacctttgctcaaata

SEQ ID NO: 187564 - DNA, 294 bp, Homo sapiens
gagtagcagttgtttgagaaaagataaaatacattcctgaactacactgtatgatgttagaaggtgtctttgtagcaggtctacagaaaagaatgtttgagaccttgaagaaaagtccttcagctgcccataaaaagtataaatggtagaaacataaaataaaataagtattaactgaagggaaattataaagaaaagtaatcatagttttctatatggctaaactgcattttatggtcatgatgagtaaatattgatctacgtggttggaaaattataactatattaaaagaa

SEQ ID NO: 187565 - DNA, 221 bp, Homo sapiens
agaagataagaaagaaagaaaataaatagaaaactaaataaaatggaagaagtaagtcaaatatgatggtaactacaataaatgtaagctgattaaatgtgtctattaaaaattggagaatatcagattagaatttttaaagtattcagttataagctattttcaaaagacccacttaggccaaaccacacaaataaagagatgacaaaagacataccaca

SEQ ID NO: 187566 - DNA, 558 bp, Homo sapiens
ggagaagaacaggcaaaagagctgaaaacgtagaagaatgagagtctgataaattgggggaagagtgagcagctgtggatttctcaagcaaaggtacagggtatgggggttaaggctatcaagtaatattactgttatgagtctgcaatgatggaaattccaagataacagttctatgatcagaaaagatggttatgaattgtcaattcactggatatcagattatccatcagttacctcagccctggaaaattaaatgacctagtaggacggtatctatcagacaggaaaaaggaatctacgtagtccttctaagagacatatgtgcttcgaaactggaagacgactactgccatgcttctggcttttgaaacaaagcagatataaaacacacaggcttgaggaggaataaaggcatcaggtctgccacttggccacttgaaagagaaggcttagatccactgctagaaacagaaaaagcagctgttagggttatctatggctttataacaaattactgctttattatatttcatgattgtatgggccagaaatatc

SEQ ID NO: 187567 - DNA, 346 bp, Homo sapiens
aaacaaaacaaaagttcattctggaacagacaaaactctagacttcagtacagaggatcacatcatgcttggagtgaatgagattccatacagaaaagtcctgatcagaaactatggatttgaaagtttctgaaatggctttaacactgactctccctcttgggactaaggacctgttatcaataatcaggcttttacaacagatccttcttgtgactagctgggaactagagatgattttttttttacaacaacttatactgactttatgaggagtatgaaatgactaaaatatctgttagtagacataaatatctcttgtaaaaatttcattcaccgaagtaaa

SEQ ID NO: 187568 - DNA, 248 bp, Homo sapiens
cactccccctcctgttcaatttgatccctatcattcttaggatgttcttctgaggcccattaagcaaaagcttatcctcagcatttaacactggaaattagagttagatgaagaagaatcaaaactatttcaggtaaatgaacattttgctacaccactactctgaattttctggaaacaaaatcacattaaatggcaagtcaccatttaatcaaatgatctgaaataaagctttccagaaacatcaa

SEQ ID NO: 187569 - DNA, 196 bp, Homo sapiens
gaacaaaaaaacgttttcaatggtctaggcacttcctttttcttccaaagaaatggtaataacaggacactagaagtacctttctgtgtaaagcaaacatcttgtcagttttccttactttgtacttttcagtctctgctgtttaccatttttgtccaggatcagagacctccagtaaaataaaaggaatttctgt

SEQ ID NO: 187570 - DNA, 548 bp, Homo sapiens
tttgctcggatactacagtcctgaagcaatcctgttactatttattttctttctttctctctctctcttccttccttccttctttctcttttctttgtttctctttgtttctgtctctctcgctctctccctctctttctccctttctttcgtttctttcttcctttcttcttctttttttttgtttttttgcgacagagtctcactctgtcacccaggctggtgtgcagcagtgtgagctcaagcaatgctcctgcctcaacctccccagtagctgagactacaggtatgtgccaccatgcccggctaacttgttactattaatgaggcctcacagataccttgatctcatggaggaactgccttgggaagtagatattaatattccagccactggaaaagtacatcatattccccaaagtaacttaatacactggcacctgctttatacatcggtctcatggtcagcatgaatcacaactcctaaactcacacagttctgaagactgatggaaatgaagattctggtttgtttttgtctttgtttt

SEQ ID NO: 187571 - DNA, 525 bp, Homo sapiens
agaaaatgaacagttttaaatctataaaacggaattcattacatttaacagattaaagaagaaaagacacaagatattctcaacaaatgcagaaaagcatgtgacaactgaaaagacttccctaacttaatcaaaggtatctacaaaaattcacagcaaatgttattctcagctgagaaatattctctttaaaattgagaacaagaactctatgcccactataatcgcttctaatgaacaaccctaatcacttccattgaacgtaagtataaagtatgccagcacatttaagaccaaaaaaatgaataaattaaaagcaaaaataactagaagaactaaaactgtcactatttgcaaatgatataattatccacacagaaaacacaaaggaatttcagaaaaaatattagaagtagtaagtttatcaagtggatgactaaagggtcaatatttttaaaaattcattaaatttctatttaacaataagttaaaatatttactaacaataaataagttaagatagaa

SEQ ID NO: 187572 - DNA, 489 bp, Homo sapiens
acatattttgcctatcttataggtgacatttataaacaaaggatttaaaaatatcatagctagataaatattccaaaatattatttcaactgagtgcttaggtactcatactggaaacagactgtgcccaattccaggtttaccacttactagctttatgactttggacaaggtacttaacttctctctactttgatttcctcatctgaaaaaggaagttgataacaattataaaaatatctaccttggctgggtgtggtggctcatgccagtaatcccagcaatttgggaggccaagttgggaggtttgtttgagcccaggagtttgagaccagtctggacaacatagcaagaccctgtctctagaaaaaaataaaaagttagcacaagctacttgtgaggctgaagtggtaggactgcttgaacccagatcaatgtcacagtgagctgtgtgtgtgccactgcactccagcctgggcaacagagcga

SEQ ID NO: 187573 - DNA, 725 bp, Homo sapiens
tatacggtgcgggttagcccagagccaggccagttgtaagtggtccatagatgtcagctgtgactgttctctcgctctgaatgtagacagagcctggtgcataaaagatgcccagtgaacatttattgaattttccttgatgggtctatggcttattaatcttagtgaactaattaaagagacttatctatctctcccatatgttggagagggacaaaccataaattagagaggaagcttccaagttctaatggagccccgcccttccatgcatggcacgaagaggataagaaaggcagtgtccctgtctgctaggcctgcccgattaggtggtaagcaaggcaaggacatatgcgattggccgttgtgtggcaacacggggccaattttgagataaggagcctagaccctgagtccttaagtcagggtcccagtgtagcattaagtggttgagagccccaggtcagaggtcagacgacccaagttcaagccccagatccacttatcaactatgccaccttgggcatgtgatttcacctctcctgcctgcctcgatttcctcatatgcaaaacagaaatagtgatggtctctatttcctaaggggatgggatgattcaacaagttaatccacgtaaagccctttagcactgtcagacacagaataaaagctcaatgggctaggcacggtggctcgcgcctgtaatcccagcactttaggaggcag

SEQ ID NO: 187574 - DNA, 187 bp, Homo sapiens
cctgaaaaagccagtctaaattctcctttataagaaatctcaaaatttttattgtaaaattaggataataactgcttactgcaggttgagtgagaggtagaaggcaacagaacactaaggtgagaattaattgccaaatatctgagacagtgagaaggctaccctggtatcagtgaaagaagaaggg

SEQ ID NO: 187575 - DNA, 379 bp, Homo sapiens
gaccatggccactgagaacttcccttagctcagccttcaagttcccttgtagtttcagttatcattacatcaaatgctgcaacaaacaaaaacaatcacatcttgaactttcctggtttcttatcatcattcatactcttcctttggcttggaatttattgcacagtcaaaatcatacatatctcttaaaagctgaggccttaaagccactttttccatggagcttctctaagtacttccagaagtagaaagcattttcatgtactttagaggtaggtagttcccttagtctccatctaacttgtgttataaatgtacagtgaatctctactaaagtgtaagtgtatgtgtctaatgaactaatagggcatttagcttt

SEQ ID NO: 187576 - DNA, 292 bp, Homo sapiens
aatgtcggtgtgtcttatgtcggtgtgtctaatgtcggtgtgtctaatgtcggtgtgtctaatgtcggttgtctcaaggtccttggagtcttcccggggcatgcacggtttgagagttagctaaggatttaaggagagatcatatgcagacaggaagcctcctccatttctgacaccttcatttctaggatctgctgctttaattttcagttcttctagcggcctttaattccatcctaacacctcaagccagtaagattgcaactttctcttgagttctagccacgcctta

SEQ ID NO: 187577 - DNA, 337 bp, Homo sapiens
agctcgacccaaatataatacttacaaataatcactggaaatcacacactcttccaaggggctgtctgttatcaccaaaacaagcagcattctgcacagcggggaccacaagagtttgggaacatgccctctctgtgcagtgttttcctgataacatacagcccttggaaggagtgtgtgacttccagtgattatttgtaagtattatttttctcttggggggcgctcttgatatacaactaacaattaataaggaagtcgaaacaaataaacttctttctttaaaggagccgaaagtcacaccaaaaataatgcataagcccaacttggacttctg

SEQ ID NO: 187578 - DNA, 687 bp, Homo sapiens
gtgaccaggggtccagggggcctgtatcaagttctgctcttgctactcactcctttggctcctagatctcagcttcttcttctgtcaattggggaaaaagactggacctatctgacttccaagatcttcataatgggaaatgagaatagatacgagaggtgctctttaaaaatggaaaatgtattaattataagacattgttctcactgaattggaaaagggatttttcttggagatgatggtgcttctgagtttaaacaattcagttttcaattttatctaaaagtcaggttatgggactggtgagaagagtatacagtggtcattgaaacgtggccccaaaagccacccttcatttcgatcacacctttctgacatggggtagagcccacgtggtaactacaggagcaacaatcagtatttatgcaacttataaatggttgatgcatcgacagcttcaagtttttgttttatttaagaacttgcaagttatgaactgatttcaagctaatacagaagtgttcagatgatagcataatgaatagccacgggcctacaccagtgtggtcagatctcaacattttgccttatttgatttacatttttgattatttgacttacatgtaaaagaatacataatttctgatgccactgcagcatcctgtataccccacctcaattccattc

SEQ ID NO: 187579 - DNA, 854 bp, Homo sapiens
  misc_feature (743)..(743): n is a, c, g, or t
gggcgttaggaatgactgcgtctgctggcccaacctgcgtatgcagatacacacgttgatgttttcataggcaagggttaaattcaacaaatgcccacagacgctgtgaaacttaaaatgggggaaatgaccaccaggagaattggttttatgaatgcagaacttatctcaagaataatgaactcgtggatggttgtcagtgtaccgtttttgtagtttgatacatctgccgtgacatcccaaggatacatctcaaggaatcaaaaagcttatttcgctcttgcgtgctagaccttccgatttaacaccgtttcttcattcacagatttatttgctctcgtgatccttcatcaatattcattgattttctactccatccgaggcactgtgtcaggcacagcaatgaaaataccaggtccattcatgcagtccttgtccacgtggagcttagattctagtggaggatacagataacaaccacaaaatgcacagttcacaatgtcttcacatttgtggagggaatgtagggtgctgtgaggttgttgaactggatgggagcatctgataaagatggaaggaccttggttcttaaagatctagtagctgatatttggcagtcctaatacattacagcctaccaaattattttagacctttcttgaggacctattcttataaataggcttatgtggcttgggtgttcctatatgcaaagggccgatcaaaatacactcttctcattncacaacacccaggcggcgcacggccaactctacagaagaaacccactgttgacaccataagcatccactcagtcttatagaacctgtgccagtgaatacgttaagcaaaac

SEQ ID NO: 187580 - DNA, 550 bp, Homo sapiens
cccatagagagccttggcactctgaaagcacccagaaacaaaggtaattgactgcactcaatataaactatggtcaaaccccaagagaaataaggaatatagaaacaaaaaaccccatccaattgacagcaacttcacaaagataaaggaacatcagccctctcagatgagagataatgaacgcaagaattctggcaatggcaattcaaaatgtaagagtgtctccttacctccaagctgtcacactaggtccccagcaatggttcctaaccagactgaaatggctgaaatgatagacagaattaagattcaggagaaagttgaaacacaatccatgtaagccactaaaatgatacaggagttgaaagacagcgtagccatcttaagaaaaaaccagttgaactctggtattgaaaatttcattgcaaggatttcataatagaggtggaatcagtaacaacagaatagagcaagctgagaaaagaatcttggagcttgcagaccagtccttcaaatcaacccaatcagaccaaaaaattaaaataaaaat

SEQ ID NO: 187581 - DNA, 453 bp, Homo sapiens
aattaatatatgccaagtgctgggcatacacatctggcacttcataagtactcactaaagggtagctaatgttattgtaccttgtaatcatattgtctcctttaacttcccacctttcttacactctcttcctcagttttctcatctttacaatgagaataatgatacctacctcattgagtttatgtgggatgaaaagtatcaagatcttattgtatagctcttagaatagagcctgacacagaatactcaataagtgttagcattattattactgtttatatctcagattttctctctttctctccaaatttacacatcttttcttcatgtgaaggaaaacttttttttttttttaagagacacggtctttctctgttgcccaggctggagcgcagtagcacgatcatagctcactgtagcctcaaactcctgggctcaagctatcctccc

SEQ ID NO: 187582 - DNA, 914 bp, Homo sapiens
ttgtgtatgcgacaccaaatgaataatctccaaaagtaaaaattgatataaattggattttcaaagaccaattaaagtatagtattggaaaggtaccagtaagataattaaaagacaaatcacagactgtgagaaaatatttgccaatcatacatctaataagagatcttgtattcagaatatataaacgcatttcaagacagaagaaaataacccgatgttttacatagacaatgactgagataggcacttcaccaaagaagttatgaagctgggtgtggtggtgtggtttcaattactcaggaggctgaggcaggaggattgcttgagcccaggggtttaaggctgcagcgagctataatcatgccactgcattctaacctgggtggcagagtgagagtatctctaaaaactaaaaaaaaaaaaagacatgaagatggtaaatgcaaatgaaaaggtgcttgtaatcatcgtcacttagggaaatgcaggctaaaccacatggagatactcctgaatatttattaaaatagctaaaatttaaaagcctgaccataccaactgttggctatgatgtggagcaactggaattttcatactctgggaatataaaatggtcaaacattttgggaaatgtttcgacagtttcttcaaccattgagcatatacctaccattcacactaggcattctactccttaaatatgtatctacaagaaataaaagcacatatccacacaaagacttgtacatgaatggtcatagcagatatatttgtaatagcccaaatgtggaaataatccagtatctgtcagcagatgaatggataaacaaattgtggtatatacagtgtaatgccacccagctatatgaaaggaataaactatagtatgtaaacaacatgaatgaatctca

SEQ ID NO: 187583 - DNA, 575 bp, Homo sapiens
acaaaattgctcctacctggtttggcagctccacgaccctgaaactagaacaagacctctcctccctgggtcgccagctttctgaccctcgaactacagcaatgttgcttctgcctgggtctgcgctccacgaccctcaaactagaacagcaacaccggttcctctctggatctccagctaagtgactctcagacttcaaaggcagcaccagctcctccgtggatctccagatccacaacattcaaaccaacatggctcctccctgggtcttctgtttcacgatccttaaattagaacagcagcaccatcttctccctgggtctccagctccacgaaactcaagctagaatagcagcaccggctcctctgggatcttcagctccacgaccctaagacatcagtggcagcaccggctcctcccctggactccagctccaggaccctcaaacttgaacagaaacaccagctcctccccaggcctccagctccttgaccctcataaacaatcccttctcatgaaatgtagcagtcaggaaaactgtagaggaagtaaataaataaatgttttcctttc

SEQ ID NO: 187584 - DNA, 572 bp, Homo sapiens
cctcaggcaatccacctgcgtcgtcctcccaaagtgctgggattacaggcgtgagccaccatgcctggctccaacatgtttctaacaggactctcataaaagaatggagacaaaacaggagaaaaaaattgcaaaaataatagatgaaaatttatctgtttttttcaaactgaaagggtcttctgagtggcaggcacaaggaattaaaaaaaaaaacaaaacaaaacaaaactcaacatctaaccactaaggatatacaaaagaccacaaaagtttctagagagaaataactggttacctacaaaggtagaagaatcaagttggtatcaagcatttcatcaataatcctggaagacagaaaagaacacaccaaaaccttctaaattctgaaggaagttattttgaaccaagaattgcataagtaggcaaggggttaactaagtatgagggataataaaggcatctttacatataaataactcagaaaatttactatctacagaacctcaatgaaaaaagtatcagaagctataaggacaacactagcacatcaacaagttattcaccacaat

SEQ ID NO: 187585 - DNA, 345 bp, Homo sapiens
ccatacccctgacagtggcaagagaggaaacaataagaaagaaaagagaagagaaaaaagaaaagaaggaaggaagacaaatggtcaatgcccttatggaacttaaatgcatatagtggaatagtaacagaagatttattaactgaccatctatctcatacaaagtgtaaggtattttatatgtaaatgaataaagaggttgaaataatgtctccttggtgaagttaaacagggacagtttcaagtaattggtgagttctaagaaaatgttaaaggaaggaaaggctgggaaacaaagcactgggaggggcccaagggcatttcaggcagagtgaacccataagt

SEQ ID NO: 187586 - DNA, 621 bp, Homo sapiens
ctccagcccccggaaaacgagctcctccgggatgcaggcgtcttatccaaaccctcctgtgattgtgtcggccaaaggcattgggagacagagcagtagaaaagctgagacagagaaaagaatgagaaagacccataacagagggcaaagtagagggtgggtgatggatttgtcaagagacagcaaaagtgaaaagaaaaaaaaagaaagcaggaggagaaaagtaactggagaaacgtagagaaacctagatgtacagagagatgaaggacagcaaggtagggagaggggcagcaaagagggaatctcatcagagtgagggagaggaggagggatttggagccagggcagacagagcagagtggtgctggtggcaaggagaacagagggagaaccacagcagggaggacacctggggatctgtggttccacatattggggacagggggtataacagggaagacggaatttaacagggagagcagaggatgcacagagatgggagaagaggcggaaatatatcaagattgaggacgatagaacgattggggagaaggaacagcaagaagttaggtaagttgcgaggatggagcagaagaggtggaagagaaggaatagagg

SEQ ID NO: 187587 - DNA, 357 bp, Homo sapiens
attacagttcatgagctgaattctttccagtctgtttctgtaatgccaataaccttagaatggtgataagagttttcaaagtttgtagaaaagaggaaaggaaaaaaggaagaaaaacagaggaaaatatgcaacagagaccatatgcaatcttcagagcctataatatctactatctggtcctttacagaaaaatttgcctcttttgtgattttcagtgtataagtcttgtacagtatttactaatttatccttatgtgttttataagttttttgtatgctatcgtaaatggtatcttttacattttagttttcagtattcaccactggaaaatacagttgatttttatatattca

SEQ ID NO: 187588 - DNA, 415 bp, Homo sapiens
actcctaggctcaagtgatccgtctgcctcagcctcctaaagtggtgggattcaggcatgagccactgcgcttggtctgtaatttattttaatgcaaaatgccacatcctaacatttcaattttaattttattagatttttatatccttgatagatcccactgcatcatgaggctgatagtcactggtgtaaagatgcaagcagttggtgactggtcttaatctgtaaataaaccacctctttttgcgtgtgtgtgcatttcagaatatgacacttttaatgaatgtccattgagttggtaatagtacctccttattttcacgtgtagtagttatcaacactgtacaataaacaaaaaagttaactactaataaagtaccaaaagtggatatttcgggaaaagaaagtaatgaat

SEQ ID NO: 187589 - DNA, 587 bp, Homo sapiens
tctcagtcactttgtgtccccaagaacctaacacagtgcttagcatggggcaaccactcaaatgtcaactgaatgaaagacccactgacacaccctttcgtatacttttctcacttgttctttattcattgagcctatttatccttgaaatactgtggtgtaagttgaaagaccttgggtttaaattttacttctgccatttgtgtgattttgaacaaattatttaatatctgagttgcagattcctcatctgtaaatggcaatagtatttaatctgtgagtagtgtatgtaaaaggatcctagcttgatatttggtgggatctaggtgaacaacaaatgttcccctttttattgtattaatagtaaaatgtatataacattcagttgtggaggacacttgggttgtttccataccttggatattgtgaataatgctgctgtaaacatgggtgtacacatacctgtttgcatccttgttttcaattcttttggatatatacccagaactggaattgctgggtcatgtggtaattctatgtttagctttttgagggacttccaatcattctctgcttttgttttttag

SEQ ID NO: 187590 - DNA, 571 bp, Homo sapiens
acatttagactaccaagttcttcgggttcagctgtttatggtctttcttgtcacttatttaacagtttcagaccataaggagcgtatacttttctcacttgttctttattcattgagcctatttatccttgaaatactgtggtgtaagttgaaagaccttgggtttaaattttacttctgccatttgtgtgattttgaacaaattatttaatatctgagttgcagattcctcatctgtaaatggcaatagtatttaatctgtgagtagtgtatgtaaaaggatcctagcttgatatttggtgggatctaggtgaacaacaaatgttcccctttttattgtattaatagtaaaatgtatataacattcagttgtggaggacacttgggttgtttccataccttggatattgtgaataatgctgctgtaaacatgggtgtacacatacctgtttgcatccttgttttcaattcttttggatatatacccagaactggaattgctgggtcatgtggtaattctatgtttagctttttgagggacttccaatcattctctgcttttgttttttag

SEQ ID NO: 187591 - DNA, 237 bp, Homo sapiens
cttcacttgtacacatgcttgctgacaaagatcttaaatcttcataaaatttaagatggagtagagaattttaaaatatgtacaaagacaaaatgtcctaaaaatactttgttttaattggcgatagcatcaacactgcagaacatcaaaagcagaacgtttcaatctgaaaagtccacaccataaaaaagacgatgctacttcagtccagacttgttaaccagaaatatcttcctg

SEQ ID NO: 187592 - DNA, 600 bp, Homo sapiens
gtcatattatttattattggagcacctgaaggtttggtaaggcattatatcaaaatatgcctagaatgggttgcacatcagtttcatttttaatcattgatgctattgcattaatttgtctatttggtaaaccaggtttcctcaaatgaaatgtgacaggtaaattttgacgtgactaagatgcaaaggaaagctctggaacaggggcttctcctctggatggggaggtggaggaggaatgtggtatgtgggtctgtgtggacaggtttacacattaggatgatgcaggaggaggccacagaaaggggcttttgagtactctctaattcagaggtttgatggctctctgggtaacctacgtaaagttgaaccatcctgtggcttgtcccagcatggtgctacaattagaagaaatgccagatcaaagtcaaaaatccttgaaaaacaacttaaatcttcactgaagtctcttgaaaaatgtccaagaaagtttgcatttataacacaagtaacacatgttaagtcctctttcacaatctctgttagttgcactcaatgttctttttctcctcccaaacttcttagcactttctaaaaacc

SEQ ID NO: 187593 - DNA, 315 bp, Homo sapiens
caaatcttaagatttaaaggcagaaggaaaggaaccggtagagaaggatgattgataatgaaggcagagcagaagaaaattcataacagaataaaactctggatccagttattataaacacgtggtacctcattctcaccttcatagctctttcttcctgtttggaggtagccgaacataaatatgttcggtgtaaatttggggtttttttttacttaatcaaaaatatacctagaaacgttgataacttgcagttttgtaaagtgtttccaaatctatggccttctaacacctggagtctgaaggcagtctgga

SEQ ID NO: 187594 - DNA, 365 bp, Homo sapiens
gtacccggagtgcatgtcacggaattgatttggatttatgattggtattattttcctcatattacatattcacagttgccgcctcggcctcccaaagtgctgggattacagatgcgagccaccacacccagcccaatctgtcactttaacatgtcagcataattttacaatacatccctgaaaattaataaatgccatttaatttactactatacttactgctcgttagctgttaaagttgtatctgagcagtatgtctgctcgcagtgggaacatggtaccagcctgcttcattcccacctcagaacctttgtgatgactctttgctccacctggaataaccactccccagatatatccccagt

SEQ ID NO: 187595 - DNA, 360 bp, Homo sapiens
ggaggccgaggtgggtggatcacgaggtcaggactccctgtctctactaaaaatacaaaaattagccgggcatggtgctgcgcagctgtagtcctagctactccggaggctgagcaggagaatcgcttgaagccgggagacggaggttgtcataggccgagatcacgccactgtactccagcttgggcaacagagcaagacttcgttgcaaatcaaaaaaacaaaaacaacccccaaaccatctaccactgctttccttctgatatatttagcagtaaagttaaaaacagttaacaatgaacacatactacacagaagcaagcatagtcctaagcatctgataaagagaattctcattta

SEQ ID NO: 187596 - DNA, 403 bp, Homo sapiens
tgaagcctggatttgtcatgtttgaagtgccacgttttagttcttaaggactgaggagtgggagggggctgaggtgagaccccagcaacctgctggaattaagtaaggctcttcagtggtatttacacataagttctttggaagcatgtacttaaacttactaaatccatgatttggtatgcccggtaatggcccagatggcttctgagatacagcatgacctctcttccgtgtccccaccacactttttgctttcctcgtgtagcaccatcacattcattttgtgctatggatttcccaatccagggctgaggatgtgtccttgaggttccttgggttctcattagattacaaactcagacgttttggtttcgtgttaatgataattgaaaatgttttacaa

SEQ ID NO: 187597 - DNA, 380 bp, Homo sapiens
gtgggagtacatcaccttatttgatatttgacagtgtgaagaatgtgtaactattgggattattcccattttacagttgagaagatgaatcattggaaagtgagttgtgaggacagaattggaatatggaacttctatcttctgttaagaaagcaaaatttgacctctgccttgttaggatttttggttgggcctaagaattacattgacataagatacattaacaagagaaagcatacaaatttgtaaaagtttcatgtgacatgggagactttataaggaaataaggacctgaagaagtggcaaaatctaaatgcttttatactaggttgaacaaagggaggcatttgtggaaaagcaaccacattttgtagggaagc

SEQ ID NO: 187598 - DNA, 899 bp, Homo sapiens
cgcttgggtccccttccacactgtggaagctttgttcttttgctctttgcaataaatcttgctactgctcactctttgggtccatgctgcttttatgagctgtaacactcaccacgaaggcctgcagcttcactcctgaagccagcgagaccatgagcccgccgggaggaacgaacaactccagatgtgccgccttaagagctgtaacactcaccgcaaaggtctgcagcttcactcctgagccagcgagaccacgaacccaccagaaggaagaaactccgaacacatccaaacatcagaaggaacaaactccagacgcaccaccttaagagctgtaacactcaccgcaagggtccgcagtttcattcttgaagtcagtgagaccaagaacccaccaattccggacacattttggcgacccagatgggactttcgcctatcaccaagcggtgagaccatcacctatagctgagcggcgagaccatcacctatcaccaagcaaatcaaggccatcaagctacagatgggcttacaaatggaacccaaaatgagttcaactaacaacttctaccaagggcccctggaccgacccactggcacttcccctggcctagagttcccctctgaaggacactacaactgcaaggccccttcttcaccccatccagcaggaagtagctagagcggtcatcggccaaattcccaacagcagttggggtgtcctgtttagaggggggattgagaggtgacagcgtgctggcagtcctcaagccctcactcactcttggcacctcctctgccgggctcccactttggtggcacttgaggagcgcttcagcccaccgctgcactgtgggagcccctttctgggctggccaaggccagagccggctccctca

SEQ ID NO: 187599 - DNA, 1594 bp, Homo sapiens
cgcttgggtccccttccacactgtggaagctttgttcttttgctctttgcaataaatcttgctactgctcactctttgggtccatgctgcttttatgagctgtaacactcaccacgaaggcctgcagcttcactcctgaagccagcgagaccatgagcccgccgggaggaacgaacaactccagatgtgccgccttaagagctgtaacactcaccgcaaaggtctgcagcttcactcctgagccagcgagaccacgaacccaccagaaggaagaaactccgaacacatccaaacatcagaaggaacaaactccagacgcaccaccttaagagctgtaacactcaccgcaagggtccgcagtttcattcttgaagtcagtgagaccaagaacccaccaattccggacacattttggcgacccagatgggactttcgcctatcaccaagcggtgagaccatcacctatagctgagcggcgagaccatcacctatcaccaagcaatgggaaacactcaggcatcaacaggctcacccttgaaatgcatcctaagccattgggaccaatttgatccacaaaccttgaaaaagaggcggctcatttttttctgcactatggcttgggcccaatattctctctctgatgaggaaaaatggccacctgagggaagtacaaattacaatactatcctgcagcttgaccttttctgtaagagggaaggcaaatggagtgaaataccttatgtccaagctttcttttcattgaagaatcaaggccatcaagctacagatgggcttacaaatggaacctttacaatccctgagctagacataaatacaccaatcggcactctgtatctagctcaaggtttgtaaacacaccagtcagcaccctgtgtctagctcagggtttgtgagtgcaccaattgacactctgtatctagctgctctggtggggccgtgaagaacctttatgtctagctcagggattgtaaatacaccaatcggcactctgtatctagctcaaggtttgtaaacacaccaatcagcaccctgtgtctagctcagggtttgtgagtgcaccaatggacactctgtatctatctgctctggtggggccttggagaacctttgtgtggatactctgtatctaatctgatggggacgtggagaacctttgtatccagctcagggattgtaaacgcaccaatcagcgccctgtcaaaacagaccactgggctgtaccaatcagccggacgtgggtggggccagataagagaatgaaaccagggcttgggacctgcagcccgccatgcctgagcctcccacaccccctccatgggctcctgtgcggcccgagcctcctcgacgagcgccaccccctgctccacggcacccagtcccatcagccctcactcactcttggcacctcctctgcccgggctcccactttggtggcacttgaggagcgcttcagcccaccgctgcactgtgggagcccctttctgggctggccaaggccagagccggctccctcagcttccacactgtggaagctttgttcttttgctctttgcaataaatcttgctactgctc

SEQ ID NO: 187600 - DNA, 866 bp, Homo sapiens
aaagggttttttttaacttaaagtttccagaacagtcctaacaaaaaaattttctagtgatggatacagtggaggcatataagtgactttttaaacttattaggcatagcaaataagtctttatgtacttggtataaatttgacttttataactgttcacctttcctgatgtattttaacagacatatcctgttgcaatgatccttaataaaatgaaagagatcttagcatttggtaagaccaatgaaactgcttttgtgcccagatcacagaaaagaagctccctgggtatccttccttagaatttacttttatgtctgaaatcaggatgcttcctttttttggttgtcttctttgtttttgttttaaatgtgtaggtccccagaccacattctgttttagggcttctgtaaatactcttaggaaagtaagtcatgaaattctgcctcctcgaatttcataaaggatttgtttgccatgtgctctgtcctgatttttgcaacatatcaaataagccagactgttgaatgacaatctggttttaagtgtattacatacgcatgtataaatatccttgttcggggtcaactctacagtgactgtcagtagtgttattggttcaacttgaccttcagaggtttccctgcttcacgaccaaatggatttggcatctgacaggaccgcagtgtcagtaaaagcttcatcccaagaggagcagggttccaagaaggaaacttcctggagggcaaatctccataatttgagataaggaagaatacagtagcaatttttgaagatcatgtggtcagttctctgaatctcttggaactatctttgatattttagtttcttggactgaatgtcac

SEQ ID NO: 187601 - DNA, 357 bp, Homo sapiens
catgcctggccccctttgctgtttctaaacacccagactcattcccactttagaatttgttgtttcttctgcttgggatgttttgtgcccggtgcctcgtggtcacttaagtcatgctcaagtgttacctcctcaggcatcccttccttggccaccccaactaaagacaccttctatggcagtgtcacactaccctgttttatttttttcatagccctcttcaccagttgaaaattatctttcatttttttacttgcttattgtccatttctccctgcccagaatttaacctccatgaaagcacggaaactttctgtctcattcactgtcacacccacaacacttaggacagggcct

SEQ ID NO: 187602 - DNA, 497 bp, Homo sapiens
ttgcctaattgccctagctagaaggtcctgtatgatgttgaacagaaatagttaagagtggagatccttgacttgttcctgatcttacagaaaaagcatctagtctttcaccattcagtatgttagctgtgggtttttcatccatgtcctttgggttgaagaagtttttctcctagttgtttcagtgcttttattatgaaaaggtattggattttgccaaatgctttttctgtgtctattgagatgatcatatgtgtgcaattttgcaacttttactgatatagtgaattacattaattgatttgcagatgttaagtcaaacttacattcctaggagaaattggtgattatatattttaaagtctaatttattttttctttttccttttagatgaaaggaaaatttgggaaaattttattttttttattgtgataatatatacataacacaaaatttaccatcccaaccatttttaggtttataaagcattaagtgt

SEQ ID NO: 187603 - DNA, 524 bp, Homo sapiens
acatatatagaaatcttaatatttaatttccgggaggctgaggcaggagaatcgcttgaacctgcgaggcagaggttgcagtgagccgagatcacgccactgcactccagcctggcaacaaagcaagactccatctcaaaaacaaacaaacaacaacaacaaaaaaaattaatatttaattccaaaggattcgcagcatcctgaggtccatctgtgaacactcaggggtctgtggacctcagagtgagaatgatctggaagtaggagggcgataactggcagatacactggttgaggggctaaagcaactgcccacgccagtgacggcaacagcctcaacttgggtaaaggctatgaagacggggcacacagaaagtgtctgggacagtcttcaggaattagtgatcaatataagtaataaaattatgaaaatcgatatgctgtctgacttataacaggcatttaataaatgtttggtatgtgactgctggaaagacatccatctcctattccaagtgacttct

SEQ ID NO: 187604 - DNA, 608 bp, Homo sapiens
atatactagggatggtgtgggaaagggagatattatctcggggggagatattagaatgctgtaagggcaagtgggatttgagcccaaatttgaaagtggggcaaggttagaacagcaggttatatagcagaagagaagttcaaaacagaaggaagaagttgaaggtccagaggtgggaaaggacacaggatattctgggaatagctattaaacaatataacttgtgtgagtttagtgtgtatgtgttgagagtcaggagaggatatagtgaaagcataagggtaaacatagaccaaattatcgcaagacctgcaaaatcttggtggcaaaaggtttggcagttgattcgtgtgcaagagcaaactaaaaaatattttggagcaaggagcagggggcagatctctgttggcaggcaggatgactgtgtcagtttgaagatggactaggtgcattttctacagtttagggtttttctgagtagctttacaaagtcttctgggttgtgtttctatggcatttaaaatttcgttcctgtgtgccatggtctatacaatgacatttaaaaaataccttttaaactatcaagaacatttagttcctgaaaacag

SEQ ID NO: 187605 - DNA, 144 bp, Homo sapiens
accctcaccgctacaaaatattcaagaattagctaggtgtagtgccatgcacccatagttccagctacacaggaggctaaagagggaggattgcttgggcctgggagattgaggtaccactgcattccagcctgggcaacacag

SEQ ID NO: 187606 - DNA, 134 bp, Homo sapiens
ggcaggccaccccgtggggttcttgtgctcagtggcagcacacacccctccatccacctacaccttccttcgtacagagttcgtatcaagtttatccctcttgataaacacgctccctgcctcgagcactactg

SEQ ID NO: 187607 - DNA, 222 bp, Homo sapiens
gtttcttctgggcattctaccactctagtctagccccggtcccagaattagggggacgctgacccccaacaggcatttttcccctctactccttagaagtcctctcctaaatacatctgtactttttgcatcaggagtttcaaatacttgggctcaccacagacagatagaaggtagtcaaaagcagatacttcaagcactatccatcacaattgccttagg

SEQ ID NO: 187608 - DNA, 239 bp, Homo sapiens
actgtcatgcattgctgatgggagtttaaaatggtacaaatactttggagaactgtctgtcatttcttgcaaagttaaacgtatatctaccccataacctagcaattccccttccaggtatccatccaaatgaaataaaaacatacgcctgtgtaaacacttacagatgaatcttcatagcagtcaaattcataatagcaaaaaaatgaaataatcaaatgtttatcaatgggagaatg

SEQ ID NO: 187609 - DNA, 400 bp, Homo sapiens
tagccaaacttatttactcatcttttcctccctggtcctgcccttcttttactgtccctgttcaactatccttcctccaattctgtctcacttccttttgctgtaaatcatctctcgttctgcacagcacgttactgcccctctcccaaggcacctatgtccctttcaatattctactacaggcacgtgtgggcctgttacacctgctctgttagaaggagagttgtgtgcacagagatagtatgtttcctatccacgtttgtatctcatctccctctgtcagtcatagggccatacattaaaagaggtttactaaacattccttgaataaattagtagtcaacttttaaagattttgaattttatgtctgtaattttcttaatattttctcataaattt

SEQ ID NO: 187610 - DNA, 260 bp, Homo sapiens
catcatcatgatttactggattaaaagagcacaaatttattgtttcaaagttctgtaggtcaaaagtcaggaatggatctcactgggctaaaatcaaggtgttgggtcatctggcttgattcctttctgagggctcttgagtttgtttccttgctcatgcagatattggaagaattcagttccatgcagttaaaggactgaggtatgtttcctcactggttgtcaactgggagctaccctttactcttagaagctccttt

SEQ ID NO: 187611 - DNA, 233 bp, Homo sapiens
tggtcaaaagttctttctctggaattcatgataaatgaaaagaatcttggcagtttctatgtcattctgcatctcacaagcaacgtgcaattcttcatgtcactacaacttggttattcactgaaacaactgatcttattacaaaacaagttaaagaaacaaacaaagcctccttcagttcctgccttgattcattattagaattcacctttcctttcacctcacccacaatc

SEQ ID NO: 187612 - DNA, 362 bp, Homo sapiens
aggttgtagtgagctgagattgtgccactgccctccagcctgggtgacgagagtgagaccccgtctaaaaaaaaggtccctgcttaccccactgccttggggaaccccctctgtcccccacacagtctccgtatatgcctgagtctgtgtttggtcttcctcgtctctccacagcaggtctgccccgtgggttgttggccgcggtcggatgctcagccgcttgagaatgctgtctcctgcctgggtgcgtctggctcccctctgcgcgtcctgtttcgtgttattttttagagtttgtgcatttctctgtgtactttggtacacaaatgcttctttgaagttaatacgtggcaatcaagctt

SEQ ID NO: 187613 - DNA, 363 bp, Homo sapiens
tgctgtgaaataataaacatcaattgttttaagccactgtgttttggggtaatttactatataccaacacaaaattgatgtaaacgcccatgtaactcatgttatataggctttaaaagaaaagaagccgtttaataagagctatgcttggtaacaaaagacattttcataaaacacacacagctccccactcttacatgctcaacagaatacagcattgcaagctctttgcaagaaagacgaatgtgtcgcttcctttccacccgcatcgcaccatggaggaggcagtgaatgaacggacatttaatgctggcaggaagctttaatcaggactgtgctttcctttgcccgcactggagaatc

SEQ ID NO: 187614 - DNA, 579 bp, Homo sapiens
tctagagtgtaaaaggacttgcagcctgcacttctaccttaaaacatttttggaagtttaaaaaatgatattaataactttctctgctatcactgatatggttataatgcttgctatggatgtttccatgttacctttctaaatattttttaatcttttacctttctttgagtaacatagctctttaataatttattaagcttgtttttttattacctttgaccaaatgtgttattttttccattcaaacacatttcttcacaggttatatttttctggttgtttcaaacacttaaaggtagaaagatgtattttttaagagatgtggaaatttgaaagataagggtgaattttcaaagtaaaatcagtatgttttttaagatacttaagaattaaagttttttgttgacatttggatataagtatgttgagggtagataatttagaactaataaacaaatattcctcagtttatttaggaaagggaaacagatgggaatattggactttattgaggtaagtttggcagtctttgttatttttagaatagttatagttatgagctaaacagtaattgtg

SEQ ID NO: 187615 - DNA, 576 bp, Homo sapiens
gccaaaaatattttgttgcttcctgcacttctaccttaaaacatttttggaagtttaaaaaatgatattaataactttctctgctatcactgatatggttataatgcttgctatggatgtttccatgttacctttctaaatattttttaatcttttacctttctttgagtaacatagctctttaataatttattaagcttgtttttttattacctttgaccaaatgtgttattttttccattcaaacacatttcttcacaggttatatttttctggttgtttcaaacacttaaaggtagaaagatgtattttttaagagatgtggaaatttgaaagataagggtgaattttcaaagtaaaatcagtatgttttttaagatacttaagaattaaagttttttgttgacatttggatataagtatgttgagggtagataatttagaactaataaacaaatattcctcagtttatttaggaaagggaaacagatgggaatattggactttattgaggtaagtttggcagtctttgttatttttagaatagttatagttatgagctaaacagtaattgtg

SEQ ID NO: 187616 - DNA, 480 bp, Homo sapiens
aagagccctgtggttccatacaccaatacttggtgctgcccgacttcatatttttggcagaatggttgctggttaatgatgtcaccttgtgagtttaagttgcgcatccctcattactaatgagtttggacatctttttatttgtctattggtcattcaccttttctcttttgtgaagtgtatgtgaaattccttcttttttattggatggtcttttccttaataatatttctttatgtattttggttacaagtctttttcttagttatatgtgttgcagaaatcttctcccaagctgtgattttgttttgctttctcttcatgatgtcttttgataaacagaagttcttaattttaaagtaatagaaagtagaagtcgtttcctttatggacagtactttctatgtctagttgaagaaacctttcccttctccaagatcatgaaggtagtctcctaaatcatcttctaaaagctctctt

SEQ ID NO: 187617 - DNA, 489 bp, Homo sapiens
ctgttttctagagctaactcttgtatgcctgggataaacccagtttgcaagtattgtattctgtagcacttgctagatttgattgctgggttttgttcaggatttttgcatccatgtttaatgacactggcttgtatttttccttcttgtattgctctagtatgacttcagtagcaagtctgtgcaagcctcataaaatacgttgaggagtcatcccactttttctctcctctagaataatttctgaaagattggaattaaacgttcattgaatgtttagcagaactcacatgtaaagccttttggacatgtggttttctttatgagaagatattcaacaactgattgaatttttaacaactatagtattattccagttcttttctactctgttggtaaattatacttttctaggaatttatccatttcttatgacttaaaaataattgtcatgaagttttttatgacatcatcttgctcttaaatttc

SEQ ID NO: 187618 - DNA, 286 bp, Homo sapiens
tttgttcttacaccaaatgctttcaccaagccaacacagtccatgcttggatgaagataaaattacaactgtctatctcacacaagcgattaattgcacaagctgccctgtgcccctgtgcctttagcaagtcacttgtacataaataataccagatacgaaaggcctgtggaaatgaaggcagaagttgaaaccatctcaaacataattaactctaaattagctgagtgaactcttagaataacagtccatttataaatcacactagtttttctgtcctccagtt

SEQ ID NO: 187619 - DNA, 156 bp, Homo sapiens
gcctgattatttaatagtcttctaactgcttctgccctgctcctcttcagtctattctcaacataacagccagagtaattctgttgacaactaactcagatgacatctctcctctactcggaactcttcaaaggctccccacctcactcagagtca

SEQ ID NO: 187620 - DNA, 616 bp, Homo sapiens
ctgggcaacacagcgagattccgtcttcaaaaaaacaaaaccaaacaaaacaaaatccacatgctcatggtttgccttctcttagggagccaaatactacctaagttttgtcagctggcaggctctgctaatagaatgtcacttaaaacaccactttgaatctaagggcaatgcaatgcattattctgaactattactaaattagttattcctcaagcagcaatttgcctatttttgctcttacctaatttttaggaggaatgatagacaaacattaagcattggtttctctctagatcccgtcagtttcctcaaacacagtagtctcctctgttagaccctggtgtgctgctgggaattactgggactcactggccagctgctgtctcttctctgcggacctctttgcttttagggagcaggaaactaattcctctaagtgttatacacttggagaccctttagcatgaacaacggtgaagaaacagaagctctcgttgctttcctgcatcagacaaaaggctgtggccacttaaataccacatttttacttcctttttagttcagttgagggagcaggtgcaaccctgcagcaagataaagctgacccttgcta

SEQ ID NO: 187621 - DNA, 427 bp, Homo sapiens
tgaagccaggcatttgagaccagtatgggtaacaaagtgagaccttgtctctattttttaaaataataaacaagtaaataatgttaaaagaaaaatcagtcagtatagttggtcatattaataaaagaaaaatgatcatttcaataaattcaggaaatgtgtttgacaaaattcaacactcattcacgatcaaagaaagtaaaaaaggagaaacttttaagcaaacaaggaataaaagattactctcccaatctgataaaaggcatctgttaaaaatctatagctaacatcacacttaatgcattccccctaatattggggacaaggatagggatcaagtgcaaggaatcacactctcatcactacattcaacattatactgaagttcatagctagtctgataaggcaagaaaaagaaaagtaataa

SEQ ID NO: 187622 - DNA, 388 bp, Homo sapiens
gaacgaacagaaaaggcacagaggatttttagggcaataaaactattcactatgatactgtaacggtgattacctgtcattatgcatttgtccaaacctgtagaatgcatgacatcaaggtgaacctaaatatcaagtccctaaactagggactcaggtgacgaggctgtgttaatgcaggttcatcaaccataacatgtgcatcactttgctgggggatgttgacagcggggaggctatgcgtgtatatggtgtatctctgtaccttcttctccattttgctgtgaatctgtcactgctctaaaaaagaaactctatgaataatttttttaagtgacctgctctgtctggcgagctggttcttgggtgttgtatgtctcactggggt

SEQ ID NO: 187623 - DNA, 223 bp, Homo sapiens
cctagctcaaggcttgggacagaataggtactcaaaaatattcactgaatgaatgaaaatatattatactgaatgaatgcccaatttttgccttaaagttttttgtttgttcatttgcttcctctagccctctgggccagttaattataaagtcacttttagtttctatatttgatgatcttataatctactagtccacaatgcaagatatagcaggcctcca

SEQ ID NO: 187624 - DNA, 205 bp, Homo sapiens
gatggtattttttccggggtgggggtggggaaggcttccattaaagaaagagacatcagcagacccaggctgagtgggcactcgataaacagttactgaatgaatgagtgctttccctcaaatgccagcgctcaagaaggtaggattagagtctttgttttgatttggttcattaaattactagtattttaatttatgggagaaa

SEQ ID NO: 187625 - DNA, 289 bp, Homo sapiens
tgctttccccccacgccacgcatgccaggttgcccttcctttcagaaatggtggaagtcctgcaaaatgcaataaactgaagtaatgtagcttctattaatacaaagtaaataactcagatttactggattttaaaccttattccttgggtaaacaatctgtgactgacttcacaccaaatatttgttggcggaggatttggactttagggataaaagtggatacattttttattttacaaactctgtatttgaacttaattattggctcttcaattttacgttaccag

SEQ ID NO: 187626 - DNA, 315 bp, Homo sapiens
aaaaggggcttacatttccatatacttgatcctcttctaaatacttcgctcatttctagctcatgatagggcagtagaaaagccccctggtatctctgagccatgatttcagtatcagtataactgttatctctacttacttccaaggaacaatgaaaaggtgaattccctaatatttttaaaattattttaggaaaaagccatgcacagtcatgcatgcctataatcctagctacttgggaggctgaagcaggaagattgcttgagcccacaagtccgagaccagcctaggcaatatagagagacccagtccct

SEQ ID NO: 187627 - DNA, 197 bp, Homo sapiens
gaggatcccactatacaccctatacacctatacaccaggtaaaggaaatgcgttattaattgaaatctgcatacaccaaaacgatttggtctggcttctagaatagtcagtttcctgatactcatcattgcttccatcagttcttgtaaaatacaggaaggtgagttcacctgtagggaatgggaagtggtatcaca

SEQ ID NO: 187628 - DNA, 109 bp, Homo sapiens
cacataggtgggttatatgtgggatgaactgtgctacctacactgcccacccactcccctcctcttcaatactctaagagaacacctgcattatctgcttttgttaaca

SEQ ID NO: 187629 - DNA, 279 bp, Homo sapiens
gaactcctgacctcaagtgatctgcccactggggcctcccaaagtgttaggatttcaggtgtgagccaccacgcccggccaacctttttgtttttttttagcagcattcagctctctccatgcaatctttccccccatctttcttcattccttttccctgaacttcatttattcagcctatcttgagtatataatgtagcagtattagaataggccttaaactattcccacaaaatgtattgtgaagaattatgaattgctatgacactctcagttacc

SEQ ID NO: 187630 - DNA, 243 bp, Homo sapiens
tgtaaatgtaatatttttacatcttatagaaacttagaaagtttcaaactccacatatcacttatttatctcattgctacccctctttttcctcttctttgggtacattagaaggaatacaacttttgttctggatttatacaaagaaacaaactggtgttttctcatatcattcccactcttagagtcttagaaggtttcaaatttgcaaacagagatgcattggatatggtaatgagatta

SEQ ID NO: 187631 - DNA, 533 bp, Homo sapiens
gttttactaggtttaaataacttctaaagaaaatacaagtgggcaaattagctatgtaataacctacatagaaaacagttgggcaaattacctgtggatatgcagattctacttttgcaaccctggacctggactttttatttttttttttggtgggtcacaaataatcttggttatcaataatgtgaaaatattaaaaatgaattcattttaccagtacatagtattactcttagaacataaattagatatcacgtggtatcaagagctgtgcttactttggagtctagggcctgctttttggactttacagcaaaaagataagaaatgtactcatgacatgtcagacaagacaatgtgaggcactttgtggggagaccattagatgatcccccttgcctgctcttgcagacatagtactagtatattccttatcaaaagttggcatttcatctcatataaaatattatctggacagtttcattttttctatttggctcttcccttactgtgccttcctgcattattggcag

SEQ ID NO: 187632 - DNA, 984 bp, Homo sapiens
gctatatctctgccagttatgtttctttcataatatgtagctcacgctagttctgaaaatgacctatcctcaagagtgtgtgtgtgtgtggggggggtcttcctcaagcagtggctcacaggagactagggggtctgtgaaactggccagagggatgtgtcaacacccctgtcttaagcaggaagtggctgtaaggacaagactgggccgagctttgacaacccacacatgttatgcccaaagaactggatcccagattctagaaaataaagtgtggtctccattcactgggttctgagagcttggcagctccgggtaggggctagggttttccttgggaaagtggacattccattgtcagtcaccctgggaaggggcaaatcccggcacagaaagtgaggagagggaaaggggcggacattgggcccagaaccctgttgtgagctgagcgctggtggagggaggtggggcaggcagctgccaccacaaggaggctgggaggcacccaggcatcaggtgggtctcccagaacagcctgggtctgtgagctctgagcatatctgacctggcttctacctctgcgcttctctgggtagcaatttccagcctccagtgaagtcttgccaaagttcacagccttaaggaaaattaacagaaggacctaggccacattccaggtcacagggggaacagccttactccattccccaggcctgtgtggaggggacaaaccgagggcaaaggaggaagctgctttgggaacccaggacatggcaggaagcaaagcgaaggcttgatccacgtgctgttgccatgtaagccaggcgctcaaacactcccaaggagcttctgaaagaccagagctctcagctcctggaggctggaccttgtgacagttcagtctctgcagccttggatcagtggtttaccttctgatctcttattggcgtctggtggtggttgtggggaaaccaaggcaggaaa

SEQ ID NO: 187633 - DNA, 953 bp, Homo sapiens
attttgcagttactttgttcttcttgctgttagcctgtaaaagtccttcagtcctttctaatccactggggatctagaaaccaggtcatgaaatcgcaggattgaaaggaaccttcaaaggctgtctgggggggaccaagaactctgtgaagtaggagggtgagtcacctcgccttaggggactctggagatgggaggctggcgaccacatgtgctcctcaaccatgaaaaggtggaactgctgacaggagtgaggcatgtgtctaaaatgggaaaagcaatgacagtaacaggaacaccccactcaactggagaagactactcgtaccgtgacaataatcttgcccttacgacacatgggtccggagctgagaaggcggttcatggcaatgggggagcatccagtagactggattaaagggtctcgcctttccagcagaggatgtggactcaggtggtgtgttctggattctaatcttggtcatgagttttttaaaaactctaaatacagggcttgagtcacacagggaacctgccacaaaccagagacactatggggccccagatgcaccagacacacagatgtaccccaagactgaaggggaaagctgggacaaactgatcaagagtattccatttaaaagcatcaccaaaattctagtttgcaagttttaaagattaaagtaagaaaatttctccaaagtgtcagattagcacattcacaactcggcaagagctccttgagattccaagtgtctgtccagtctgggagcaaaacagggcagggcactccaggctaaggtgccccaacaggtgtccagtgacacttgcctctggtctcccgcatccaccctccgccctcccacgcttgcttgctgactctcacctggcatggtctctcactcaaggttgtcccgggctccaatgtcacttcttaaacccagacacccacc

SEQ ID NO: 187634 - DNA, 869 bp, Homo sapiens
attttgcagttactttgttcttcttgctgttagcctgtaaaagtccttcagtcctttctaatccactggggatctagaaaccaggtcatgaaatcgcaggattgaaaggaaccttcaaaggctgtctgggggggaccaagaactctgtgaagtaggagggtgagtcacctcgccttaggggactctggagatgggaggctggcgaccacatgtgctcctcaaccatgaaaaggtggaactgctgacaggagtgaggcatgtgtctaaaatgggaaaagcaatgacagtaacaggaacaccccactcaactggagaagactactcgtaccgtgacaataatcttgcccttacgacacatgggtccggagctgagaaggcggttcatggcaatgggggagcatccagtagactggattaaagggtctcgcctttccagcagaggatgtggactcaggtggtgtgttctggattctaatcttggtcatgagttttttaaaaactctaaatacagggcttgagtcacacagggaacctgccacaaaccagagacactatggggccccagatgcaccagacacacagatgtaccccaagactgaaggggaaagctgggacaaactgatcaagagtattccatttaaaagcatcaccaaaattctagtttgcaagttttaaaatccctcgaattgatgtagtcttggcgcgtggtcttgtaaaagcaaatacatgatagggatcacatttttggacagtgtatctttaaggaatatgattgtccatagaatgagtgtccgaaactctttctcaagacctgactagatggtgattggggtggtgcctctgtacctcgatcattggcaggaataacg

SEQ ID NO: 187635 - DNA, 556 bp, Homo sapiens
cctctgtcccctgcattccatatttcagtaaaagatatcatactacccaagtccgaaacctaggagtcactagtgtgaccatcctaagcactgcccaccaactacttccaaagctctttctaggtacacaataaaattccatttttctgttcctttaagttaggtgtggccatgtaacctgctttggtcagttaaatatgagcagaactgacatgtgtcactattctgaagaagctctgagaaccactgtttgactcttttcctccaccacaacgactggcaacattcaaaagatggctgggactcatcaacttcatcccagagtgaataaccacaatgagtaaagttcccacccccacgaatttagtctaaaaaatattttgtcagccaggcagggtggctcatgcctgtaatcctagcactatgggaggcagaggcaggcagatcacctgatgtcaggagtttgagaccagtctagccaacatgatgaaaccccatctctactaaaaatacaaaaattagctgggtgtggtgccacacacctgtaatcccagct

SEQ ID NO: 187636 - DNA, 536 bp, Homo sapiens
cgctgacagattttagaaactggcgggaataaagaatcagacatttaatttggcagggcagtcttgtacttcagataaatggatctggatttgtgatgccttcttcaaaatattaatttctcttttgaaaccaaatcatatttggcttcaatatcttatttaaaatgcatttttacttacatatcatctgctttgagctcttaaatagcctgggagttagatcatggactttgagcttctcaaggattagaacagtgttcttctcacggtttgttggtacttgcccagcatctggtaattacaataactccctgggagattcaagggaaaatttcaagccaagtaagaactggaagggaaagacctccacatccaaataaagatacattttatttaagtaagatttgttgagttgctatgctgttgtgggatctgtgctaggtagtgagtttatgaggatgaatgatacagctcccggcctccatgtttcccatgtattagggaacacacaacagcacgttgtcaagggtgatcca

SEQ ID NO: 187637 - DNA, 168 bp, Homo sapiens
ggcctgtatttttattcctttaagtaatttgtaactaactacaaaggcctctggtaagatggcttttgtttctagttggaacatggagaccaagagaactctctagaaaacagatttggctccactgctatgggacttcacacttacctccacagaggggctcttctg

SEQ ID NO: 187638 - DNA, 430 bp, Homo sapiens
atggcaacgtgtctataacatagatctacttccgttgtactatgacatagttccccctccattttcctatagcacagtcccaacctcccttttcctctgacatagttccatcctccctcctcctatgacgtcctcccttctcctctggcatagctccatcctcccttctcctatgacacagctccatcctcccttctcctctgacacagctccatcctcccttctcctatgacacagctccatcctcccttctcctctgacatagctccatcctcccttctcctatgtcatagctccatcctcccttctcctctgacacagctccatcctcccttctcctctggcatagctccatcctcccttctcctatgacacagctccatcctcccttctcctatgacacagctccatcctcccttctcctatgaca

SEQ ID NO: 187639 - DNA, 412 bp, Homo sapiens
aagctgtgatatgtgtccatcccagagcatgtcttctgttactgttaatcagagtgtgtgtcacacttcctggggccactgaagtcactaaccccggcagaaaggatcggaattttcctactctaaaaggagaaatggcaaaatatagaagctaggctggtgggaaatagagaagagggctatttctctataaacatgttatcgaaaaaaacaatgccttggcggggcacggaggctcatgcctgtaggcccagcactttgggaggctgagacagaagaatcacttgagcccgggaggcggaggttgcagtgagccgaaattgtgccactgcactccagcctgggcgacagagcaagactccgtctcaaaacaaacaaacaaacaaaaaacagtagtgttattttttgaagt

SEQ ID NO: 187640 - DNA, 239 bp, Homo sapiens
cgcaagtgggtgggagagaaagaaatgggttaaaggtgactccaaggctcctggcctgagcaactggaaggagaaaggtttgtatgctcagacagagaagaccccggggagcacagttcaccagcacaaaaccaaaatgcaccatcacagaaagaatggctgcctttggggatccttgctggcagcaacactgtaaggaggtctcccttcctttgcagtcagcttggcagaagccacct

SEQ ID NO: 187641 - DNA, 442 bp, Homo sapiens
ttccttaaaggggggaaggctcggaagaggggcaggtgggctgtaaggcgaatgattacattcttgtgagactctagttagtgccagtaaatctgcattttacataagataaggtgaatgaatgtttgaagagaaaaaagggcgtaaaggaagaatcaattatgcagatgtctctgggcaggtggaggaatgactgatctcatcttgtcttttttctgcacctgggaagcgaagcttgtaatagacatgatcaatgtggaatggaacagacttcagttttaacctagaatcagattgtagacgtgaagttacaatgagatgttcttgtttatgggatgccagcaaagaatttacttaggaatgatctatggggcaacccttccagacccctgaggctttcacttttctgcggggtttggctgatgcctgatgctcctaacag

SEQ ID NO: 187642 - DNA, 159 bp, Homo sapiens
aggaaattatgtaaaggtattttccactttttctgcatcagagttatatacacttcaggagaagtaggctccaaaagctgcacttgaaagaaaggactcttccttttaattgcaataattgacctcctactgcatcttccaggagactgaagtttaggc

SEQ ID NO: 187643 - DNA, 171 bp, Homo sapiens
aaactaaaagcaaactgaaacaaaaacaactgtattttaaatgaattacttaaccacattaagtaattaagtataattacttaagtatatgtgtcactataacaaagtacctgagactgggtacttataaagaacaaaaatttttttttttttttttttgagacagtctcg

SEQ ID NO: 187644 - DNA, 641 bp, Homo sapiens
cagtaacagcagaatacacattctttccaagtcatcatgcgtaccatagaccaatacagatcatatcctgagccataaatctcaaaatatttaaaagaaccaaaatcatacaaactagaaatcagtaagattggtaacaggaaaatctccacaacagttggaaactaaacaacacagttctaaataatccatgttttaaagacaaaatctcaagggaaattaaaaattacatacattgaactgaaagaaaatacagcatatcaaaatttgtgggacacgtcagctaacacagcactgagagggaaatttaagcactaaatgcttatattagaaaagagaaaaactatcaaatcaataacctaaacttcacctcaagaacctagaaaaagaagagcgtaatacactcaaagcaagcagaagaaggaaaaataaagagcagaaatcaataaaattgaaaacaaagaaatagagaaaagtcaagaaataaaaagctgattatttgaaaagaccaataaaattgacaaaaatggacaaaataaagataagacatgtattattaatatcaagaatgaattaggataccactacagactgtgcagatatcaaatggataagggaatgctgtgaacgattctacatat

SEQ ID NO: 187645 - DNA, 348 bp, Homo sapiens
agatcatatggtgactctgcgtttagctttccatatatgcctgggagtgaagtttctggatcacatggtgactctgcgtttagcctttggtatatgcccgggagtgaagttgccggatcatatggtgactctgcgtttagctttcgggacctgcctgggagtgctgttgccagatcatatagtgactctgcatttagccttttgaggaactgctggactgttttccacagtggctgcgtcattttccattttcagcagcagcgtgtgatggttctgatttctccacaccctcaccaacacttgttattgccttttattgcctttatttttcattgtggccatcctagt

SEQ ID NO: 187646 - DNA, 472 bp, Homo sapiens
gtgctgcggtgatcgaggattatcataaaattaatctggtacgatatgtcgttcctacagcccctgctcctaaagagagatgatccacacaacagcatggggtgagtagggagatttataaagtgtttaaaaaacagcatccccagagcacagggaggaggcttgcctccccagttatgcagcaaattaggtcacagttccccaccccatcctctcccaagcttcagtggctgactcatccttcgtgggaagacctctctcccattcaagactgggcagccagccaagagacaagagggtttctgcctgcctctccaacccagctgggcacagtctctgtctcccccataacctccttccccatctgtgctccgaggtgatctcagcttcctggctactggcaaaggcttcaggatttactagacagccctaggaaacaggcaagctgagaagtcctcaacagccttagcta

SEQ ID NO: 187647 - DNA, 394 bp, Homo sapiens
tcatttaatcttcacatcataggtacaattgtcctcattttacagatgccgtgtctgaagctatagaagcttatatgagttgtcctagtcacaagaatctagtgaacagtggagctagcactcacattcaggtctgcttcactccacagactgctcttagctgattcagtgttcttctgtctaggtctaaattaaggaaggagtgacattgatccttgagctgaatttaacttgagtaaataaagggaaactcagaaaaattaacaaggttgcatgctggaacttgggcatctcatgacagtttatgaattgccagatattagaatgtccatgtgattgaatttatggctgaatagcaatcaaggcagatgcttattttgagtgtttatagcat

SEQ ID NO: 187648 - DNA, 580 bp, Homo sapiens
agcgtgtgtgcactatattggctgactcttgccgtgctcaggctcatgctgctgacaggggagagaggggacattttggagtccaaatcttgcatcatttcattgaagtgttcaatgtcatggctgtaagaagtaacccattttaataactggcatcaaaggatttaggagagagaaacccagtatccagacccatttccgtcagtgacactctcctcgtattgggaggattggccagaatcgtctgattcctgtttctgatttccttcctcactggcatcagagtattgcactataggaaaactaatatctaactgagctccaagtgctaaataacagcatctcatgttcattccgggtcaccaagaggttcagggtgaccaagtcacaaactataaatttgaacatttgatgatttttgcaggagactgggtgaacaaaggaaaacccgagagatacataaaggtggaaactaggatttctcatttgaattatttaacatgcctcactctaatggttataaatataaaggaaatgcaggttcttcaagaaggtgaaacgaagttactgaatttaagtt

SEQ ID NO: 187649 - DNA, 318 bp, Homo sapiens
gttggtcaggctggtctcgaacttctgaccccaggtgatctgcccgccttggcctcccacagtactgggattacaggcgtgagtcagtgtgcccagcctagaagttaccattttgttggtccaaaatagttattagtggtttcatataattcatcctgtacctagaagtagaattgctggatcaaagggtagttgtatgttcagctttagaagataggtatttataaacatttttttggtgtgccctgccagctgtgtgtgagagttccattttccccacattttcaccaaatacttggtattgtcagtcttttaaat

SEQ ID NO: 187650 - DNA, 484 bp, Homo sapiens
gaacatcagaaatatctacattttgtcgtctcacctgcaacataaataactgaagtagtttaaagcatctctaggttaaggcagtcagatttcgcagacctcttgtatgaaatgtgaaaatcaaagagggaatacaagcaagattattgacaggagtcataatgcataaatggaaaaggtcatgagatttgtgtgtgtcattaaaaatgccttggagatctcataatctggctgactctatacttgttgatttaaagctgtataacctgttttgttcctttttcaagtgatgctgcttaatgctacaaagtgagtattgttttttctgtgatgcctttgtaagaggaagttaattctgtgttcattattgtagctcccactgatgaagtatgatttgggccatgatagtttaaccctactggttcttcacaagtttaacatccccatgttacctctaatacatgttatttcattttcacatctt

SEQ ID NO: 187651 - DNA, 312 bp, Homo sapiens
cgaccttgctgatgctcaaggtatttgtgattccctgcctcattgtgattaagcactgccacctggcttccatactctgggatcaatcaatcctcaaggatgttaagtccaattctgtatcagccgaacctactgtatcagccatgtcctgtagaaaagagacaccactgaattttctcatactgcataagcccatctcagcagcagattcctgaaggccttcatgaatggcatacaatctattccagcactttttttttttttttttttggtgtggctttagtctaccaggtaccagggtgattcggccat

SEQ ID NO: 187652 - DNA, 2923 bp, Homo sapiens
  misc_feature (2112)..(2112): n is a, c, g, or t
  misc_feature (2270)..(2270): n is a, c, g, or t
  misc_feature (2389)..(2389): n is a, c, g, or t
agctaaagcccactctcccaggaaatgcttctgctctaagactcaaacattccctgttaggtgaggtcactgacatcagaaatggcctccccctttagagctggccctctatacacaggtagtgtaattttgtattttttcttattctctgtggtagagattgttggttgactgccaacatctattggcccatttctctaaataacagaatgtttatctgggcacacacctgcatggaattagaatgatatttcccagtgtctcttaaagaaaaatgtggccactttattaaattcaggtaatggcatataagtaaatgatgatgtgtagattgcaggagccttctttaagagacagctggtgtacctctttttcctgtcccttcctttaatccacagcctggaacatggatgcttgcattttgaatcctgaggacaaggactacttgcctggatagtagggtgataggattatgtggaacagagttgccgtattagcctattagtctagtaggactcacttttagactttgtttatagagataaataaactttttgtttgtattattttttaaagcatagttattttgagttttgcttttggagacagatcttttattgcattcccctccttcccccaaaattcttaggttgaagcattaacccaaggtacttcagaatgtgactttacttggaaatagggtcattgcagatgtaattattaacagttaagatgaggtcattaaagtggtctctaatccaatatgactgctcttcttataaaaaggggaaattggggtacaaaggcagacacacgcacagggacacacacacacacacacaaacacacacacacagaatgctgtgtagatgaaggcatggatccaggtgattcctctataaacaaagaaacggcaaagatcgccagcaaatcacaagaagctaggaacgaggtttggagcagattctctctcacagctctgagaaggaatcaagcctgctgacatcttggcaagcctctagaactctgagacaataaatgtctgttatttattttctagccttagcaaaccaatatacaatcttagccaattaaaggctgactagaataaccttagcttaatctagggcaattttcacaccattcagacagcagaaactacatacacatatccatgtacccatctgaacttctgtcataatttctcagtctatcaattttagcagtgtggccaaatgtcagtttctctggaatgccaaaataagggaattttgttgtggctgtcctatgaaaatgaagctctgtcacagagaagtgtgtgagccaaatccaaatactgagtttattttactgtccaaatagaatattttcaccccagtgaagcaattgtaagcatctcatccaaagcatattcactatccttgagtattcttggttgcttattgaatgaataagtgaatgaggtggatttggctgacactaacctttgggattacctcacagcttgccagtggcaagcttagtaagtactgggccatagtgtttgaggataggtctctagagtcatatgtctctaagttcaaatgctagcctcctgtattagtctgttttcatgctgttgatgaagccatacccaagactgggtaatttacaaaataaagggttttaattggacttacagttccacttcactggggaagcctcacaatcatggtggaaggcaagaaggagcaagtcacatcttacgtggatggcagcagacagaaagtatgagagccaagcaaaatggatttccccttatgaaaccatcagatcttgtgagacttattcactaccatgagaacagtatgtggaaaactgcccccatgattcaactatctcccactgggtcccttccacccacaacatgtggggattcaagatgagatgtgggtggggacacagccaaaccatatcacctcctttcctagttgcttggtttggaagagttatgtaatctttttgagcttcaatttcctcatctataaaatagggaagatgctagttactctcttatagggtagttatgatttattttatgtgaaatgtttagaatggtccatgccatgatgnactgcagttggtttgtactggctcacaatgaccaatagtacaccttttttctgattctgccaatcttcccatcctcacatccagtgacatcatattggtagtttgaaattaattggccatggtgagaatatttacactacagatatttgcaaatactntacaacaggggctagcttgccagcacaccgttggttagatgacatccgtaagttctgtataaatcttaacattattattactcagtaggtactcctgctcccttatggttttgagaagnccttcttctagttaaataaatcattttgaattaaaataacactgatgggactcttagcaatgttttacctcttgggaatcactgcctacatttgtggtctataaatctgaatccttaattcactcggattgatttttggctccgtgaaagcaggagcttttctcactgctgtagcccccacacatggcacaggcctgggacagagtaagcactcataagtatttgttaagtgaaaaaataaatgaatgaaagtatcccaaacacttgcattttcaaaaggttttgacatccacttccttttcttctcaaagctacgctttgagatggataggtcctattttacctctattgcatcgatgaagaaactgcaatgcaaagaagtgtctaattagtcatttgcttcctttcatcaaatatgtccattacaccagtgtttctcaaaatgtgttccatagatcataaatcctgaaggatgttaatagttattatgtgccaggggacccgtggatatataagtttggaaaatagtgaagt

SEQ ID NO: 187653 - DNA, 264 bp, Homo sapiens
ttgaccccatcttccgtgcccatattgaagaagtagtctgtgaaaacttgttggctttctgacgccttcctaagtgtactggaatactctctataaatatgcagcagctgagatgggtgagagcaaggtgagcagtcagagtagtatagattgaattcaaaaaggctgagagaacatgggacagcattataaacattgagggatgatgaacaaaaacgaaatgagtgatcatggtgtattctggggacagggacggaaggatca

SEQ ID NO: 187654 - DNA, 627 bp, Homo sapiens
attcataatagccaaaaagcagaaacaactcaaatgtccatcaatagatgaataaacaaaatgtggcatatccaggcaacggaacattattcagcccccaaaagcaatgaaacactggtccatgctgcagtgttggtgaaccttggaaacattatgccaagccaaagaagccagatacaaaaggccacaaaattatatgagtccatttctatgacagattggaacaggcaaatccatagaaaggaagacgaatggttgccaggacttagggggagaggagaatgaggagttagtgcttagttgatacagggttcctggtggggatgatgaaaacgttctggaatgagatcgtggtgatggtgacataactctatgaatattttttaaagtattgcattgtacactttaaaattttttttgtaaaggcagtttgccaggtctcgaactcctggactcaagtgacccacccatcatggcctctcaaagtgctgggattacaggcatgaggcaccatgcctggcatgtatactttaaatggggaaactgggtgaagggtacatgggacctccctgcactgtctttagaacttcctgtgaatctatcacaactcaaaataaagacaaacca

SEQ ID NO: 187655 - DNA, 276 bp, Homo sapiens
gaagccaggagttcgaggttgcagtgagctatgattagtaccaccgcacttcagcttgggtgacagagcaggaccctgtctcagaaaaaaccccacaaaacagtaatagagaagccacataagcagatgctcgttaggagccctgactatttaagaatgtaaacaacacaattttagaaccagtggcaaggagggtactggacatttccatcttccccacgtgcctccttatctttcacatgttgtttcactctgtctcttctcagcattgggtct

SEQ ID NO: 187656 - DNA, 271 bp, Homo sapiens
cacacccatgggtctctatctcacacccacgggctctatgtcacaaccagaggctctatctcacacccatgggctctatctcacatccacgggctctatctcacatcctcggtctctatctcatacccacaggttctatctcacacccatggactctgtctcacacccatgggctctatctcacacccatcggcggtgacgccgatgggtggggaatgtggtttaggtaggatgaaatgggaggatgatgatgaggtacccatcgcgtgtg

SEQ ID NO: 187657 - DNA, 254 bp, Homo sapiens
acgagatacaatctaggagacgttataactgtgggtcgaaaattaaccacttccttatatataggagtttaagtgaatatttccagaagagtacgatccaacttgataaactcaaagcaatgattatcataaaaggcaagttttagaggtttgtatacaccatgatcctttatatataggagtctcccctccacccctttttccatggcttcactttccatagtttcagttacccattgcaacacggtctctca

SEQ ID NO: 187658 - DNA, 281 bp, Homo sapiens
tccctgtcgttaagcaatgtattcatagaatgaaattctatataggagtgtttttttctttttttaaaattaaccacttccttatatataggagtttaagtgaatatttccagaagagtacgatccaacttgataaactcaaagcaatgattatcataaaaggcaagttttagaggtttgtatacaccatgatcctttatatataggagtctcccctccacccctttttccatggcttcactttccatagtttcagttacccattgcaacacggtctctca

SEQ ID NO: 187659 - DNA, 338 bp, Homo sapiens
cacagctgtggcgtgtggaatcctggttggacccagacttcctcccaagcagatgaaaggattagggggcagagatgggggtggagggcagtcctgagatcaggatgagctactttcccataatcctgaatgtccatcctgtggcctgtggatcttctgcaacttattctatgttagtgcagtcagtcagatagtgcttatgtattgaacacctcgagatgacaacattgagcagctgccaagcggaaggcagagtcctaggcactgtgtaaatggataagtctatccatttaatcctcacaatagctcctcattaaggtaatttttactatccacag

SEQ ID NO: 187660 - DNA, 237 bp, Homo sapiens
aaaaataaatgtgtaaaaggataaataaaattatttgggggttgtaaatgctctaaataaaatggtttacagaatgatgtagaatggttttagtggtgaaactctcttaaagtggccggggaacttaactttgaagtaatgatttttgagacataaatgatgaaagtgatgaaaggaggcagctacaaaatatttgggtaaagagtgttgctggaaaaaggaatagcatatacaaat

SEQ ID NO: 187661 - DNA, 357 bp, Homo sapiens
ggactatgtggaaaaggcagcagacagaaatctttgatgtttttccttggtgccatgtgatacctaaggcttctttcacttgactctgtcccatcctattctcaaaattaaagtcctagttttacaagggaaatataccttgtaaaaaagtcctagttatacaaggttaatatgtttgtcaatttctgtatgtcttatgccacatcctctgtctcctcagcaggataaggctatcttgcttaggaacatagccatgttgaaaaggaggaaaatatttgctaatttccctttcctccggaaacacacagtattaacgaaacgtgtttggccatattgttctaattacactatgttctt

SEQ ID NO: 187662 - DNA, 397 bp, Homo sapiens
agtgaatcccccggatgagacataagaacccagagactgattaaacagtcaacaacccttggctgtgcacgtgcatggtgtggtaggttcgctgggttgggaagcagcagggagggccaaagatcctccactacaaagaacttgcagcctgatcacgtggatatccacccatgtaggcttagactcacacactagcaccaacctgtgtgaaaacaggaaggcaacatggtgtagtatactggttctcaaacatgactgcccgttagactcagctgggggcttcacaaaaatcccaaagcccaggccacaccatggagcaactaatgagaactgctagggtaagacccaggcatcagaatttaataaaacctggctgggtgaggtgggcagatcactt

SEQ ID NO: 187663 - DNA, 458 bp, Homo sapiens
ccagaaccaagagttccatgaggtggaggatcccagtatctatgacattaattgtcaacagctctgtaattttgtgagtgaacgtgatttctcacgtgtctgtcaggactttggtttggtttcttgaggttttgttgtaaggagtgaatgtgaaaatgtgtgtgtggtgccaggtacagcatagctgtgtaataatgattaatggaggtaattttcgaatgtgtggtgtagtgtcctactctactgcatctaggacattgtagagaagcccttagtctgtccagaaagccctgattatccttcaggtactgatactgacaactcatggttaggagactcctgtctttaaatgttaccagaggttcaagtgagctatattcattgctgttctattagattttgagattacagctgttttggatatcaggttttaattgtctctgccacatacgatgtta

SEQ ID NO: 187664 - DNA, 298 bp, Homo sapiens
gcctcatttctacatattacggtctccagggcatattgttaactgcaaaaagccaggtggcagaaaaaagtgcataaaatatgctattgtttaagacagatatattgataggtatccaacttacaggttttaaacaatggaaggagaagccatacataaaagttgcccactgtgggaagtgacagggatataaactaaacttccttcaatatactttttttggtagatctgacttggtgtagaaattgaacactctagtctggcacggtgaagagacatgagaggtgtagaaattgaa

SEQ ID NO: 187665 - DNA, 168 bp, Homo sapiens
cggccaacataagcaactttttatttaaacttgacctttggcacaggactctgacagtctccctgaatttacgttttagatctggcattgccatttatcttatctaggcttagtgatacaaaaattcagcggtgttactgtcccggaatcctctatattccttcctta

SEQ ID NO: 187666 - DNA, 584 bp, Homo sapiens
atgccacacggcatattcagattctcgagattaggacatagacattttaggaggtcattaatttcctaccatagcatgtattattttattttggcacagttgtggccagaggaccactatcagagacctgagtggatgggaccactttagcagctagcagaaatccatgtatcactgcccagtgtgtcttccttgcccacgtgaagcctcaaagcagcattgccgtggatctgcctgattgggaaagaaactgtatttccctcttgctttattacagttctctcttctatggacttgggcacctgtcccacagtaacctggccaggggtctgtctgcgagtgcctgtgctacagtgtattcagtctttcctcatcatcatggaagatagtcttatgctaacttccccagtctccatgggaacctcctcttcagtgcatttaaagacagttattccttccctggttgagggatctgtatccaagggtgagaatgagatggctgaaggcaatagcatttttccttcatatcaaactcatgttttccatgcacccctgttggtcccttcccaaagccttcctggtgt

SEQ ID NO: 187667 - DNA, 442 bp, Homo sapiens
aaagattcaaaagtaaaaaaggaaagcacaaaagtactaaaaagaaaggtgggaggtctatatatttttttaaaatcttggagaaggcaagtcacaaaacaaaagccataaatgaaaaatttataaatctgactacatgaaaatttaaaatgtctacaagagtgaagaatgccataaggaaaaagacacattgaagaactcactggcaatcatgccaccgtgtttggaattatatttaatagggaataaagacagagtgatactcgtctaatctctgtcttttaatatcttatacttcccacttcattataattaataatcaaggtacactctagcccagacagaggcaataaaacagtataaattggatgactcttttggagagtaatttagtcatttgacctttaaatttataaactgatctatcaactccattttgggg

SEQ ID NO: 187668 - DNA, 429 bp, Homo sapiens
agaaaacaaattcatgcatacataggaagttcatatggcagagatggcattagacatcctgggagggagggattattcaactgatgctgcagggacaaacagctttccatactgtaaaattaaaccctacttcagaccatacagaaaatttcagttggaaaatatatatgtattcattacctcaggatctgaaaagatatcctataaatgacatacacaaaaagcacaaatcaaaggaagtaattagtaagtcatgtagcttttttacaggttgctctaggtattacattatatatacataacttatcacagtgtacttgtgtcattgttttaccagtttgagtgaaatataaaaactttacctctgtctatgcttctttatcctcccccatttataatataattaccttaaatattataattgtctta

SEQ ID NO: 187669 - DNA, 423 bp, Homo sapiens
tggcttcaagcaattctcctgcctcagcctcccaagtagctgggactacaggtgcacatcatcacatccggctaatttttgtatttttttgtagacccggactttacatgtgccatgttggccaagttagtctcgaattcctggcctcaaacaatccatctgccccaacctcctgaagtactgggattacaggcatgagccaccacacatggccaggggcttaagtttcaacatgagttctgcagggacagacatttaaaccacagcaaagaggatgagccctcaaaagatactgagaagcagcaaccagagagatgggaaaaacagctggtgagtgtggtgggccagagctaccaccaaatcagaaggaagtgtcagcagcatcccaggaagaggagggagcctgtatagtaactgtgggaa

SEQ ID NO: 187670 - DNA, 281 bp, Homo sapiens
atttcaagagcaagactgggagggaaaggtttttccaggacttctcggagaaattgacccaagtgttaggaatttgcgtttcattaagagatgaaaagtggatgactacagtaagaactgtaggtgaaatgtttcatagggctagctttatttagccatcattccaagaagcaatgatacctattcttgttgacaaattaggcagaaggataactctagggcctgccaccatgggaggtaaattctcatgaacattagttcctaatgagctatcacgtttt

SEQ ID NO: 187671 - DNA, 502 bp, Homo sapiens
  misc_feature (26)..(26): n is a, c, g, or t
gccgacctagaggacccccgctgcgnctcacatcactttcttctccatatatgtgtctgactccctctaccttcctcttctaaggatacatgtgactgcacttagggcccacttggataatccagaatcatctccctatctcaagatcctttaatcatatttgtaaaattaattaattttgatcatatctgcaaaaattctttttctaagtagggtaacagtttaagttccaatgattaaaatctgatatctttaggggtcattattcaaactactacaaataatatattttatttgacccaatatatccaagatgttatttcagtttgtaatcaacattctataataacttttctaaatctaggtgccttttgatgcttacaacaaatctcaattagaatcagtcacatctcaagatagagagcaacaaaataattgtgggggacttcaatactgaaagcactagttagatcatcaagacggcaagcggaagaaacagtgg

SEQ ID NO: 187672 - DNA, 618 bp, Homo sapiens
ttgacctaatcctggctcttgggccaccttggttaatggactgctcttctcagagttcctcaggcccttaagacctgggatggctcctgcctcacatgcaacagtggcgagaggcacccatgatgatctgatgccggatgaaatatgcagacttaggtactgtattactgcttagacttaggtaatgtattctactgctgtcccctccactgtggcagacatctgtcatcagttacagcttcctcaagtggacccagattccttcccctggcatctgttcaagcagccacagccagttggcaaaaggtggcaaaaaagtcaggatggtcctcaaaggccaaggcagaaaaaggacctgtgacttctggatgcttctgcagggaactgactgctggtatggtgcctttaaacataaatgcctgccccttaggccaggcatggtggctcacacctgtaatctcaacactttggaaggccgaggcgggtatttacttgaggtcagaagttcgagaccagctggccaacatggcgaaaccccatctctactaaaaatacaaaaattagctgggcgttgcggcacatgcgcatagtcccagctacttaggaggctgaggcaca

SEQ ID NO: 187673 - DNA, 312 bp, Homo sapiens
ccctcccctggcagctgcctctctctctctcttttatcattcctcttgatccgtcatccagagaatgctagaaggcatgagaatgtaagttccaaataggagttggtgcctgttttctatcttggtttattttcaaaaccctttttgaacttttgaactgttggtacccagggggcaatgtgcaggggagttgataaataaagataatgttgatgtaagtacagtttctttcatatgtaactagagaagcatgtgagttttcagataagcttttcttagaaaaaataaaattttaaatgtcaaagttttttg

SEQ ID NO: 187674 - DNA, 404 bp, Homo sapiens
tcagaaactggcgatatgtacaacatacatgacagacaaaagtttggtattcagaatgcattatgaactcttacatatcagtaagtaaatgatgaatgcttagtagaaaaatggagaaacctgtcaaagggcactcaaagaacaacaaacataaatggccagtaaacatatgaaaagatgctcaatctcattagtcatcaaagaagtgcatgattaacatccgtgagctagcattttacatttaccaaaccggtaagaaactacaagtttcatgatatcaagtgttagtgaagataaagggcagcagaagtgcttataccctgctggtaggagtgtaaatcagcacaaccactttgaaaaatttgttcatatttttagtcaagttaaacacatatacctcctat

SEQ ID NO: 187675 - DNA, 129 bp, Homo sapiens
agacaacctcaggatctaaaaagaaaaatcttccttccctactatttaataaagaacgtaaactttcactactcatataatcatctttaaccaaggactcatacctaattctttaaaataaaagttaca

SEQ ID NO: 187676 - DNA, 359 bp, Homo sapiens
cccaggtgtgctggtcccaggtcttggtgaggaccaactctagtcactaggtggagggaacgaagtaccgtaagagagcaaggggctgggatctcaggattgttccagattgctctgcatctttcccctgcccctccccactggtaatgttgctgtcttatgaaatgaagaaaattgttaagtgtctaggtcactatgaagtctctggtatttcatagtgtgtcctcatggtgactgctcagggatttgatttagatctggattagcctgcctttatcttgagtcttccctccctactgtctgttctctactagtagtcaatgtgatctttttcaaactgtaatgagagcaagattcta

SEQ ID NO: 187677 - DNA, 178 bp, Homo sapiens
cctcccaaagtgttgggattacaggcgtgagcccctgctcctggcctggcatgtacttgatataggagcagtgtctaaagctggctgattgccccgcaccgtcattttaatcagaatgactcatttttcccatctatagctagtctcaaaaattaataataaattacttaaccctcca

SEQ ID NO: 187678 - DNA, 410 bp, Homo sapiens
aaatgatcctttccatcccctccagatcaaaaatcaaggatctgtgtctgagccacatgaaaatcaattgtgtcttgtggcctatatgatgaatttttcaagtgggaggtatgacaaaagtggcctgttttcctgaaaccctgagtggtagtcattgtgaaagccgataaaatatatttttcaggctaattgttatatttttcagaccaattatgtgctgttaaaatatgttgcaattgacaagtttataacacagcttgaaatttttcattgacattgaaagctgttgagatttatttatcagtgatgcctcttcttggttagaactggctcttcgtagcacaggacaccctgtcatatgaaggcagacccaggcaagaggatgctggattcttgtaatcaggataagt

SEQ ID NO: 187679 - DNA, 350 bp, Homo sapiens
ctcaccaaccctccaaggatcaacttgattctcctgcctttctttgctctcctgggaccctcatcctggccctgcggcttccatcgcagcctcctcccagcatgttgagctgcgctcttcctcttggggagctgctctcccacaagcctttcaccagacccgtcgtgccctcagcactggacatctgacacccttggcctttgacaccctctcctcctaccctgacccagtagagaaccccatggtctcagtggcctcaaacccccaggggcacattctcaggcaaaccatcactcccctccaaagagcctaggactcctcccgtctaggaggaggaagagataaaggag

SEQ ID NO: 187680 - DNA, 430 bp, Homo sapiens
tgactctagcgcatcccacaggtgccagcgtgcgtgtttaccgcgccctcctcggaagcccctctgggctcttcttctgctggtggattcttctgctcctcttcccacgtggatttccaccgcgaccttgccacgtaccatggcttcgggccccatgagtttcacacccaccatgggtgatgcacgcctgtgaggtttggtggtggtgagagctttgcagcaggaaaggcgggtctggaggatgcctcaacccagggcgattctattcccagggggtgtcaacacggaggctccagaacacatccttctaaaactccctggaagccctcacgtcccccgaggcacagcacccagggcaaaggccaggccttggatgcagggaggtaggaggagcttcccatggacacactggagaagaacatgctccttc

SEQ ID NO: 187681 - DNA, 486 bp, Homo sapiens
aattaaggggtttcttaattgattcagatgtgttctaaataccttgtacatacccagtgaaatatatacttaagaatcaatgtaattatcttaatactctttcagatttatgcttattcaacattcatgtaagaaatattgatcaagcatctgttgtatacaggcacattgctaagtactggttgtgagctatgactgagaccgacatggtccctgcccggccaagtattttgtaacttatagaaataggtatccctggccgggtgcggtgactcatgtctgtagtaccagcactttgggaggccgaggtgggccgatcacaaggccaggagatcgagaccatcctggctaacacggtgaaaccccatgtatactaagaatacaaaaaaatagcaaggcgtggtggcacgcgcttgtagtcccagctactcaggaggctgaggcaggggaatcgcttgaacccaggaggtggaggttgcagtgagc

SEQ ID NO: 187682 - DNA, 536 bp, Homo sapiens
tagctgggattacaggcgtccagctaatttttgtatttttagtagagacgggattccaccatgttggccagcctgttcttggactcctgactcaggtgatccgcctgctttggcctcccgaagtgctgggattacaggtgtaagtcaccgcactcagccgatttaggcttttgaaaaagcaacacttgttgatttcttttagtgttagtttgccagttggtgtggaaaatgactgttgagtccattttgaccacacatgatacttcacacatactgacaggaagtgttgcaggtggctgtatacgtgaatgtcttatggcaagagagcaaacccgtgttccatagaagcatacctccaacagtaagcatttatatggcactggcttatagtcttccttttcattcactgtgctcccagtcaactcttctgtaaatttttttgagaacagggtcttgctgtgtcacccaggctggagtgcagtggcacagatacttggcttactgcagtctcgacctcccaggctcaagcctcctgc

SEQ ID NO: 187683 - DNA, 381 bp, Homo sapiens
ggacagtgcttgtgtcttactcatttttgtgcccctcccttgtcctataatatacccagtgtaggtatctattgaataatgctgaaggttgtgcacagatgtcagctgttattatcttccttccccctgccaccccaccccagctacctggcttcaggtggtcttgtcttcatctcagcagggactgggagcttatgctgtcagtgacttgctgcacagtgctatgatgtggaaacctcctgctataactatcgtataacttcttacatctttgtggcactcagatgttccttagcttcctcaagtctccaacagcctactgatggttgacagaaaagactggccaggcgcagtggctcacgcctataatcctagcacttt

SEQ ID NO: 187684 - DNA, 161 bp, Homo sapiens
ggaggactttttttccatttatctgtgtatgtctaagttatgtacgattattaaatactaagtagacaaatttacttactgtttttaggaagcatataaaggaacaaaggcaaatagttagaaaatcacttaatcgtagaagcatagatttctataaaact

SEQ ID NO: 187685 - DNA, 307 bp, Homo sapiens
acgtgattccctcaatacccatgctgggaaggtatgaggagctgtctacattttatggatgacaaaacagacacatagtgcctgtgtggctagtccggatttaaaggctagtaataagtggagatggtatttggatcccaacgttgagttactttctagtactaagtaggcaatataagcccaacctaaactcgttattttagttttgaaaaggataacaccataggttattcaagtaacatatgttactgaatccaggcttcatttgtcatatcttataagtgagtgtgttattatctgtgcatgt

SEQ ID NO: 187686 - DNA, 220 bp, Homo sapiens
gtggtggctgatgtcaggatggtggaatgtttttgagtatgttctctttctctccatatccctctcaatttttctctctttcccttttatcctccgcctgctcttgttgcaaaaagatttcatgatagctgagtgccaagtacgtcccacacattataggggatgcaaagaggaatgacacccttcctgctctcaactttctttcattcactcaacaaac

SEQ ID NO: 187687 - DNA, 733 bp, Homo sapiens
ctttgagcattggcctcagctgctttctgcttgtggctgcccaaactcactgggtttttgtttcctccaaagtacagtgcttcctgttggccttccttctgcctgatgtactcttctgtagttctttacttggataatttctactaattctcagttttcatagtaaatgtccatttttcagggacactttccctgactacctctaagctaggttaggcccttctatcatgtactttctatattttttccttattatgcttatcacaattgtaattaattatttgtgtgattattcactgtttaacatatctccccaccagagcctcaggggcaaatattggctctgctgtgtttgtctctgaatttttagtatccatcatagtgcttggcatatagtaggatcttgccttgtggagtaaagtatttgttcaataaacaaataggaaggccattttctgctgcgatcaaaaactgttttaagcttctttggagaaatatatatcaggctgtggttgaatcttggtgaaatttaactgccaattaggaaagtagctgtaaataattgcttaacacagggcattgcatgcaaaaggaccatctaatttgtgttctctgagtgaaaaaaatttaggcacagagtcctggggtgcagatggggataatcctgcacagcccagcacaggattatacagaatatgtaagtgtgaataaaaaaataaacatggatgtagaa

SEQ ID NO: 187688 - DNA, 728 bp, Homo sapiens
gtctcttcatctttatgaggaattaaaattagatagtatatttagttcttaaattctgtgattttattaactgtcacttgtttttacttttgactttaggttaatcagatcttaaaactcagtactaactaatgctgggaacttatacagagaagtctgctgagttgtggtgggaggacacagtttccatgtttgaacattagaattccttgcctcttaatcaagactgaagcattatctgaggaggaatcaggaagcccaattttatacatagttttaatgctagataaaaattaagtgtaattgtagcttagactagatatcatgatagctttcagccaagtgagggtgaaataaataaaatttgtctaaatagtactaattagagtgataaattatactttttttctaccctcatacatataatttgtggttgtgattcttatttgacattattggcatatttaatagtttccatgaattgaagagtcacatggctgtagcttataaatatatcatagttttctaatgtagcaattagaagtcttagagatattttgcaaatggtgttagaaagtcattgattatcatctgtataactagaactccatgaatcagcggcttatggctccagagcttaacacagtgcctggcacttaataaatatatgttaaatgaatcagtaaacatttggaatgtttatgtgtaggtgaagtcatagctgtaag

SEQ ID NO: 187689 - DNA, 374 bp, Homo sapiens
acagaggaagagcaagcaatcgggttagaaaacacagtcagagtgcatctcagtgttgtgggaactctgtccaggaaactccggccagaacttgaacagagcgaactctgggccaaaccagcatctaaacagtaataagaaaagccaccaagcagccaccccaaagaacaaagtggagagaacacacagggaagggcagaacacgctgtgttgatatttttctgctcagagagctataaatttgtaacttattaagcagcacatggtgagtctgtcattggcaactatgggaaggagaagagttccccattttttattagaccaaaaaacaaagtcacagaggaggtgatgcaccctctggccttactcgacac

SEQ ID NO: 187690 - DNA, 870 bp, Homo sapiens
gcgagttatcgcttggaaattagaggaacaataaacagaacaaatgcctgcaacacggttctatgggcccttttcctttttcctgtcttctgtctcccccgacctgttctattcttcctcctctgccccctggccatggtatcgactttgtgcatctccatctttggaggacttatctgatcagaaagatgctgcaggtcttaggattggggacatgatgcccccagaattatccatgatggtgagagtttgagatgaacaacaacagcaaaccagtaattgctcttattaaaatgagtcagaagaagtattgaggggcaggtgctagttttactgcagcttcacctccagtcccaggaaaaactgggtttggtacaagcgggatgggcaggagtccggtggagagaaggggcatgtgaaaccctgggatatgagactgaatgaacagaaaagaggagagaagacagtagtgggcagattctgtggcctaaatactcaggcgggagctgttttggctgggatttggctgtcagtatgaaagtaatttgatttcatagagagtgaaaacaaggacgagattccttgagctctttcccttctccttatttcagctcaagtggcaaggcctcaggatggatgcccacagccctggcactggggagcagagaggctttctcggggcacaggcatggcagggagcagcgttgctgtggaagaggtcttaaacaagcaaacaaacaaaccaaaaaaaaaaaaaactctgtaaaatctccttttccttttgtgttccaagtagttctgcttctcttcgcttttccagttttaccctgcattttgggtcagggtggtttagttctcctcctctgttcc

SEQ ID NO: 187691 - DNA, 505 bp, Homo sapiens
ttttcttcccagcccttctccctgttctgcgacatggactgactcctaaattcttggacgcagcacttatttttttcccgatacccgtctccgtctttcactccctttgtgaggatagggcgctagctcggctgcctcacagctggcccttcagtccctacactgtgaatggttgtttctagggaaaagtccaggctttcaagcccaagattcttgttctttgttcaattttgcagtaacaacacctaacatttgtctgcagagccttaaactttacccctttttgcctaccttgtttcctgttacctttgaccccaaccgcgaaaaatcacagtcctctttctagtgggacacttaaattttacttactgaaaaccaacattttaactcactccaaagctagtatattctaacgtaatgctcctatattaccctggacaaatagttgagtagtcagggataaaatctagaagtacaacataataaaaagcaaacgtgacaaatc

SEQ ID NO: 187692 - DNA, 536 bp, Homo sapiens
aaaaatcacagctacaggcaaaaatagagcagcctgggaaaagtcaggctgcacctggacagatgagcaagcaggattcagcacagaagccttctgttctttgtgtgattagcgagctcccaggaaaaatttcctccctttttcaggcatatacccagtgggctccataggaactcacacagggaggagggggccttcctaaaacaaatccacagttatacaaacaagagaagtggtgctttgtacttgcctagggacataaccacaacaacataaataaggggtagttatgcagacagctttacagattagaaaagtgactcaaacagctagagagataagaggagtttctcataaaagctttgtaattcagctgtcaaagcagcaacccatttgagatcccctctgccttgtgaaaagctttcttctctcgcttattcaactttcactccaacctcaccctttgtggccacgccccttaattttcttggtcatgagacaataagcttggataacaccttagacaaccagaccac

SEQ ID NO: 187693 - DNA, 626 bp, Homo sapiens
ttaatcagcaaccacaactgggtccccagaactgccgggtaaccctctctgtgctgccagtcacattccctccccatctctctgtgtccctccctcactgtcactcatagcagctctttccagccttttccactggtctcaagtcacctgccccagtaccagatcatctctcctcttacttcagagacaaaacagccactcctaatccacatctccacctgtcatgaggaaggggctgtcccacctcccattcctctcggtctcagtctccagcccttgtaggtgagccctgggggtgccacggggggcgcagccctccctctccactcccaggccccctctccctctgtctgcagcagagctggctggggcagtgctgtgtcttggggcagatgcaaccttggctttctgatggaaacaggctcatgtcagggaagcacactgaacagcagcaaatgaggctcaacctgcaaacggcccatgctttccttgacctcccagaaccctgttgctcaattctgctttctgccagtcactccacagcaatggctcggtaaagggatccacttaaccctgttgaatccatgttttcttttgtttcatggtttcagaatgttccgcggaac

SEQ ID NO: 187694 - DNA, 560 bp, Homo sapiens
tagatttgtaaaataccaatattgatgaatgtgggtaaacagttcatttcatgatccacactgctgtgaaccaaagaagcagaggtaggcttgtgtttactgaaatccagactaggaaagagaaacctatagctcttcttttcccaattcttagactgagacacaacctagcaaataaaatactatcttaaaatgcctctctttataacaatctacagaggtgattcaactgtgatatctgaaaatggaaactctgtaattctggcaactcaattacaacaacctttgaatttttgacaaatattctccaactgtaataaaaggttctcacctttttcagaaatcaaaaatcactaacttctacatcactggaactattaatatccatgctcccaagcatggagacagtgggtatagagagtgaaagaatgagtctgattacaggtaaatcttgacatataaaaactataacctatttactgctataactggcatctaacaaaacgcattattttgaactatggatgaaagccatatctatcctaaatatcttctatcct

SEQ ID NO: 187695 - DNA, 581 bp, Homo sapiens
acttggaaaaacgttacatgtctcattcatcttagggaaccgacccagtcccaaaatatgaactagcctgcctcaccagttattaacaaataagatttccttttgaaaacctcagggataggataaaggactgtgttgcagtgtaaccagacctccccctcaccccccagttcccccaacacatctcacatctcactggtggcttctcttttctttttcccttgccttttgtgtcagttttttttctttcaaatatcattatgggtaatttggaacatatacataatatggtggttacttatatctattagctatttacatattttattctgtagattgtcagctcatggtctctgctgaattttgatgtacaggtgtttcccttgttgatttgtatgagttttacatatataaagagtgttaatcttttatcacttttgcagtaaatgttttccccagattgtcttctaactttttaatgatgcttttgataatagatttggtttacatttttattggtcaaattgattgatttctaaacccccttcagatcatggtaatttcttccattgcttttacac

SEQ ID NO: 187696 - DNA, 246 bp, Homo sapiens
agtgagccgaggtcttgccactgtactccagcctgggcgacagaacaagactccgtctcaaacaaacaaacaaactaaaacaaaatttaaaaagcgttttcaagggaagtagatgatttgaaatgaactgaagatccaaacgtaaataagtagaagtcttacatctaaatattttaagaatttttacatcagaggtgtgaagaaacagatgttaacatgactacagagggccacgagggagaccaa

SEQ ID NO: 187697 - DNA, 312 bp, Homo sapiens
ttgacctcaggtgagccacccgccttggcttcccaaagtgctgggattacaggcgtgagccacctcgcctggcctctctatagacaattctttagctaaattgagggctgaggcttggggagtttcagtaacttgcccaaacagcttgtcaggggcagaagcaggatttgactctaggcctaacagatgcctttaaccagtaagcccatgtgtatcttgcgtcagcccaagaagctgtaggatttttggaggagtttctatgaagttgtcagtagggtgatttttctcctctgatctttgccaatggcctct

SEQ ID NO: 187698 - DNA, 723 bp, Homo sapiens
aagaaaactttcttaattagcagagtatcatctctgtgatttttgtgattatttgatcagtgtgctgagatggatacaatggcaagtaatgacaaaattaaaataagcatgcagatttttttaaattaagtgccaaaaaataatgggtcgtgcaaagcccttaaaaacactgtggcctaattctaaagttttttgctactatgctacatcacacccaacatcagttaagtgctcattctgtgacaggtagtacattacactttagcaaactacacaagacccctatgtgataatatgcttcggggttgtaaggttgggtgcgtttagtagtcttgaattttctgggagtatacaaacccaatattagtctagatgcccaaagatctatttagacgtcaaagtagaatggagagaaatcttgaccacaggaagctgtgttgtggcatttattttgaaattattttttcttgatttttttgccttttaattcttttgtgagttttataatgcacagaatatttttaaattattatatatataaactgattagtcttcaatttaaacttacacctctggggtcttacttgggtttctcctaacaatattatacacatatttgcaataatttctctcatactgcttttaactcatttaatttttcaactttttaagaataacaaaagtgatattaactgtaaaaatgctgaagtgacatatgaattt

SEQ ID NO: 187699 - DNA, 771 bp, Homo sapiens
atttcaggctttgccctccatgcagtctcttgttacaactactcaactctgcccttgtaatacaaaagcagccagagacaacaagtaggtaaatgagcatggctgtgttccaatagaactttatgtatgaacactgaaatctgaatttcatgtaattatcacatgttttaaatatttttattcttttgatttttttcaaccattagaagaaattataaaaaccattcttagctcacaagctgtacaataaaacaggcagtgggccatatctggcccacaggccaaatgtttgccaacccctgttttagaatattctatgtaatacagagtgtaaacaggtgacatctggctccaatgaatgatgaaagcacctcaaatttatataaggattcagaatcatggagaaaaggttagagaattagcaacagatttatttcatgcaatggtgacaaatacaaacacaaatatttatctcatgcgatggtaacaaatactgtactgtactccagcctgggtgaccgagtgagcttctgtctcaataaataaatcaataaataaaataaaataaaaaataaaaagttaactagcattcctgaattttacccatcctggatctctgctattcacattggtgtcaccaagtgcattttccaagacaagacagtcattgcctaaaacaaatttcacctgttgtatgcaattatttggttctcctgtgctgttacagaattcagggatcctaatcactcgctcaggcgggaataaaaaaag

SEQ ID NO: 187700 - DNA, 821 bp, Homo sapiens
agttcctctatacactttcctgactcaagaggaaggactgtccgtcccatccccacaatgccccttcctccaagggagggaacagaaatgggattgggttgggggcaaacactgccctttgccctgatatggagaggagagtaaagaccctcggcccgggaaggtggaccctgcctccaggcatggcctaaggccaggtgaggagtggggggctgtcccaaaagtgtgacctggagctcctgggcacctgaacacccgcgggctgctcctggtgactccctgtgtgcccctaccccctgcagagggtcacctccaggagcccacttgaggcactgaaggagggccaggcacctgcctacggccccaactatatttgatttttataccatgttggaaagttcacatttctactcactaaatacagcagtttgattttgcatcataacctaggctttattttataagttctaatttataagtagcatattacttgggattttaattgagtaataaacacattattttaaatgtgctcagatgcagccagcatttcacactcatctgagtttgcaggtgttttactaaactcaaatggcctttcttaaattcaatagaaacatgctcagaattataatacaacaataatttaatagttaaatataaattcatcagtaacagcacaaataaataggtttcctccttagaagaaaattaatttttatgaaagtcagaagcttggttttacttttctttttaatgtggaataaactgaaatgtgtcaaaatctcaccttcatttttttctcaataaattaaacaccg

SEQ ID NO: 187701 - DNA, 199 bp, Homo sapiens
tcacacctgagtcaccctcagttggtttttagagaccaccctggcagtagaacaccagctcttcaaacctgacctggttgctgccaggtttttaacacagtgctctgcatactgaggtaagaacagaagcaaacaaaaaggaacactatcttggcttgcggaagggctcattcttggttcttcttccacctctgttgag

SEQ ID NO: 187702 - DNA, 182 bp, Homo sapiens
gactctagcggatccttaatcttccgtgcccacagtaagattcttggtaagtatgtataaaatgagttaactaggttcggagtcatttcaaaactcataattttagtcatttaaatgtacatcagctattcatatctatacataagggggactgataaaacaggcctgagtcatttggcttt

SEQ ID NO: 187703 - DNA, 421 bp, Homo sapiens
tactgacgatgcttacaggaagaacaaccactgtgtgtgaagctttgtgccagctgcccgatggacagcgtaaggcataacagcctcaggcccagcagcgcaggcaacgaaaagtagatgaacgagtccatgattttaacaaaatacactgaagaagtcaacagggggctgtagtggagaaggctaggagttggggtgggagtagggatccctcttttagcatcagggaaggcctcactgagtaggaaatagaagctgaaacctgaaggctgagaagcagccagccccgtgaacagggaacagcactgcaagcagagggaacggcatatgcaaagaccgtgaggtggggaaacgttaggcaagtttgaagaacaggaaggaggccagtggaggtggggctgggtaagggacagtgagagtg

SEQ ID NO: 187704 - DNA, 326 bp, Homo sapiens
gactgccgggcactccctggagttgggtggggaggtctgaggcccatcctcccactctcactgtcgttgggccaaggccagagcctggggacttggccaggtctcggtgttggccccatttgcatctctgtccccaaggttagtcggggctagaagggaccttttgggcccagctcttgcttcattcctggggccagcatccctcacacacacacttccagggatgaggagctcacgcagcccctccatgggacaggaagacccttcttccatgcagcttgatgtcactctctcactgggtccagcccctctggggcttcaaatct

SEQ ID NO: 187705 - DNA, 349 bp, Homo sapiens
aggtaggattttatgactctgcaagaactatagcattattgggcttggagtgccctctaatgcagaaatgactccggtggccgaaaacatagatcaagacgttcaattcccatcaaaacacctggaaagctttccaaagaaggactggtacagcaaagactacaataaatactactaactccccagacattgataggcatccaaaggcatcaaggccgttcgagaaaatatgatctcaccaaacaaactaaataaggcaaccatcaccaattctggagagagagagatatgtgatctttcagacagagaattcaaaatagctgttttttgtttgtttttttggcttttt

SEQ ID NO: 187706 - DNA, 423 bp, Homo sapiens
gctcggcacctccttactggcttcctcagaaaataatttgggtcacgatagaaaagacaaaagagttaagcaggtttgtattgaaagaagtgacaaattgcagttaacttaaaatagtttctattcttgctaatcttccaaaatagcgacccatcaaaaaatcaataggttttgagatgcattttaaaaatgcagagtgtgcaaaatatataagcgaagatcatgggatacataagggaccaagaaattgttctgagttgagatgataaccatagtaggattgtggtctgtttagtggaaagcctaccggatgctgagattgactgtctagtacctgtataagtaatttcagagatggctgcagtttgaaattactcttttaaatactctgtagttaatccttagcattgtctaatgtggttc

SEQ ID NO: 187707 - DNA, 703 bp, Homo sapiens
tacaggaaaaatagttactgtacactggagaaacatgacaaacaccatccttaaccaaatgatgaaggttaacatcaccagtgacatcatgcaggcatcgtatactcccagatatgatgcgacaagaagggcaccggaactagtggtattccttctcaaaatctgtaaccacagtcaaatcacaagagaagcaacagactgagcctgtactcctcaagactgtcagggttatgaaagtcgtctggcagttcctcagatgaataaacagagatttaccatatgacccagaaatcccaatcctaggtacatagccaagaaaaatgaaaacctatgtctacataaaaactcgtacataaacgtatataacatcatcactcataacaggcaaaaagcagaaatcatctaaatgaccatcaatagacagatggataaacaaaatgtggtatatccttagaatagaatattattcagcctttaaaaaatgaatgaattctgctacatgctacaatacacatgaaccctaaaaacatcatgctaagtgaaagatgcaaaagaccaaatacggcatgattccatttatatgaatgtccaggatgaacaaatccacagacacacaaagcataactgtggttccaagagctgaggataggtgcaggtttaactgcattgaagcacaatgggagttttggggacaattgaaatt

SEQ ID NO: 187708 - DNA, 436 bp, Homo sapiens
  misc_feature (324)..(324): n is a, c, g, or t
gtgccactgcacttcagcctgggtgacagagcgaaactccatctaaaaaaataaaataaaataaaaagttaacaggaagagggctaaatttcagggtttcttaacttaggttaaagtacttagggtccaaggataggcttcacctggtccacagacccttaaaattataagtgaaattttctgtatacagatgtggacatggttctggcaagagagactctgatcttcactacattttcaaagatgctctgaccaattgtgaattagtcacttaagattttggaagaatggctcctaaagcgggtgatcatctgccctcacganttacagtgcctcagcatcacatgctattcattttgcacagcaaaaccaggaagtgaatatgactgttatccctacttcacaagtagaggacactgaggccctgagaggttaa

SEQ ID NO: 187709 - DNA, 499 bp, Homo sapiens
tggaggtcaattgtatagcaacatgaatagacttatcactactgaactgcccactttaaaataggtaaaatggtaaattttagtgtgtgtgtctgtgtcctaccacaattaaatttgtatatagtaactgtatggatgtgtttcaccaagacttatcaaggtaacttcatgtgcaaatggtgcagaaagacactagatgcagagaactgagtatcacgatgctcgtacccatgcctgagattcacaaacactaccattttcagtggatgcagacagagtgattacaaagggtgtgtgtttgcatgtgtgtgtgtgctgcccaggaatggtcaatccacatgtttggacatatgtataaatataaataataacatacatttcaaaagtaggtatgcttcatattaatatcattttaaatccaagattactcacataactgctgttttttttctcccctagcaccaggaattctaaagacagagtattcatcctgtatatc

SEQ ID NO: 187710 - DNA, 246 bp, Homo sapiens
gatccacagaaacagggaactcaggcctcagagactacatgaacatgtcctcccaaatcaataaaaaaaattaaaagtttctacatgcaagtatttttgtgggtcaatatacaaaaacacttctccatttattttattttatttcatttcatttttcgagccggagtctcactctattgcccagggctggagtgcagtggcgatttacaggctcaaacccactgctgatcagtccacagaacagtt

SEQ ID NO: 187711 - DNA, 245 bp, Homo sapiens
gatccacagaaacagggaactcaggcctcagagactacatgaacatgtcctcccaaatcaataaaaaaaattaaaagtttctacatgcaagtatttttgtgggtcaatatacaaaaacacttctccatttattttattttatttcatttcatttttcgagccggagtctcactctattgcccaggatggtggaggacgcctgtagtccgagctacttgggaggctgaggcaggagaatggcgtga

SEQ ID NO: 187712 - DNA, 446 bp, Homo sapiens
tactattatgacaaatccttaaggataaagcaactgacctcaagacatagagatatccccagttaaagagagtattttcgagacaacaggagaaagccctggagggagaataaagcaggcccaggactacagggcatatggcccaggcatggcttgctctcccagccctgttcctcccgactgtcaacaggtggccacttcagtgcaggctggggatgggctccgggagcagatttacacagtcctctaaccccggggcttccacaccacatggagaatgctgtgacacactttcctagtgcctcccttctggggtctacacatttacagtcttgcttctttgaactctaagaagttcctgactggtgattctatattttaaaaaaagagaggtaatataatgtgtcagtgctttgaaaatagtgattgaataagacaaaatagct

SEQ ID NO: 187713 - DNA, 433 bp, Homo sapiens
tcctgtttcatttctaaatatatatttatttcaaaatggaacctgtgtatctattttcacataacaccatattatgagactttccccatgacatggaatattctttgaaaacaaaaagtctttgtctgttttctgttgctattacagaagacctgaggctgggtaatttatcaagaaaagaaatgtatttggctcatgattctggtggctggaaagtccacgattggacagttgcatcaggtgagggcctccgctccaggcagaaaacaggagggaagtggaagtgtgcaaagatcacatggcaagaaaggaagcaaaaaagaaaaactggggaagccagacttttgtttttttcagggtctcacactcacccaggttggagtgcagtggcatggtcaaagctcactgcagcctccaacatctaggcttaagc

SEQ ID NO: 187714 - DNA, 464 bp, Homo sapiens
tcacacacacactcacacacacacacacacacgtgtctccaggcatcccctgcagcctttggcttcacacataccacatcataatgctgctgggaatggggaggttcctccgctaggtccatcgaagcacccagattaaaatatggtgaccattttattattttatcagaccagaaaggagaagccacggcccttaaaatataggtgcccttaaaggaaaattgaatgaataattttaagctgaatacgagtgtggaaatccaagttacatgataaccgctggcctgatgttctcatggcacagtcttgattaatactttttagcctactgctatatgtttactgaacccctcaggacaactttaattggttctgaaaaagcctgaatatgccacattattctagaagatgacagtaacaggttgggtgacctgtgaagcagattcgcaatcaaaatgaatgat

SEQ ID NO: 187715 - DNA, 675 bp, Homo sapiens
aaagcttaacatcatgccagctggtgagagagaagtgtttgcagggtccagctctagtatcacaagcagcacaataaagagtggatttggaagcaagaggcaatgaattgataaacaacacatccttagtaagtgctataagaatatttgatcaggccaggtatggtggctcatgcctgtaatcccagcactttgggaggacgaggtgggtggatcacctgaggtcaggagttcaagatcagcctggccagcatggcgaaacctgtctctactaaaaatacaaaaattagctgggtgtggtggcgggccccagtgatcccagctacttgggaggctgaggcaggagaatcgcttgaacccatgaggcggaggttgcagtgagccaagattgcgccactgcactccagcctgggcgacagagtgagactgtctcaaaaaaaaaaaagtgtttgatccatagaataaatagctatgcagcatacagaagactttaatcctatctagctcatctctgggaatgggagtaacaagctcctataagagcagacctagcgttgtgcttaggggcctggactctggagtaagatgacatggatgtgaatcctagctttgccttctgctagcagttaggcagctcatctaacccctctgtgcttcagtttctccatctgtaaa

SEQ ID NO: 187716 - DNA, 381 bp, Homo sapiens
ttttttcaggttagacagagaaaaggagtaaaaatattaaaaagttttgaggcaaaagcttgaggtttctttggtctctattgtctcagtaaaatagtagaaaggagttcagatgctaaagatcctgacaaaggtttagaataagcatcagaagaaatataataggaaaccatcacaaaaggaacacaaaggagagctgagctgcggtaaagatgccaggactttgctggaatctcagatgggcagactttgagattttccccagcaagataataaagttcaggcttacaaactacgattggtgtgaattactgaaatgtaatacaatgtgaggtctggcaaagaaatatgacagagggtcccgggttgttaacaagctca

SEQ ID NO: 187717 - DNA, 453 bp, Homo sapiens
cagcctcccgagtacctgggattacaggtgtgcaccaccacgcccagctaactgggaaactgccacttttaaaaccatcagatctcatgagaactccctcgctatcatgagaacagcatagaggaaaccgcccccatgatccagtcacctcccaccaggttcctcccttgacatgtgagaattacagtccgagatgagatttgggtgggaacacagagccaaaccatatcagcttatgattagcacgtgaaagaaagaaacagtgatgaaatagagagtaacaaggggaatccactttctataggagatgaggaaggtgacccctgagcggtgacttgatagatgacaacagcccagctctgggaaaaagaaagcagaaagaacaagggcaaaggcctggggtgggaaagagcttggcatatttgatgaactgggaaaaaaacccaggaggct

SEQ ID NO: 187718 - DNA, 760 bp, Homo sapiens
gagtattccaagatgcagtgctgttttttattggtatgctgatccagaagtttgtgtgggaaaactctcaaaaataaactctctttgtagaatttctctttatttcaaaaaaggtacttttgtcagtagtatttattcagcatctgatatttatacattgtttttcttgatgcactggaggaaataaagagaggatgggattggttgacctgagcttacattctaagagaggaaatactatacggtactcatctatactatatgtggacatttgcaattgctgcgtttatgtttcgctactggagaatattttcttacagttatcttattgggtaaccaagtttactcctttaaactactaggaaaaaagtttgccattttattttatagaggactctactgtcttttaaaatagtgaatattgtctgaattttaagattctggatcattagcaggactgtcattttattggtgcacttttgagctcctgtactatttagatttactggaatccttttgacttgtcagcatttctgttttttcctgtttttcttttttctttatgttagcagatgggaaaaatagaaaagtagatgttttgaaattctgttaagaggaaacagctgtgcccaaggctaggagagaaccattgaggggcagaagcaggcaggcacgcctggagcctctacctttgggattgaagtcttcacccaacacttctggcatctcagatgtgaatccagttggagcacccctaaga

SEQ ID NO: 187719 - DNA, 265 bp, Homo sapiens
agtctcggttatgtctttataagcagcgtgaaagcagactaataccccaacacttaatacagatctctcatttcatcatgcaacaatcccttaaaggtagatacttttttctccctattttaaagatgtggaaactgaggcttagagtgattaagcagcttgggaggctgaggcaggagaatcagttgaacctgggaggcggaggtttcagtgagctgacatcataccactgcactccagcctaggcaacagagtgagactcagt

SEQ ID NO: 187720 - DNA, 297 bp, Homo sapiens
agtatctaacatatagtagacacccattatctattcaattgtcatcaaaatactacaaagtgactgcacagtggtaaatcaaaatatctattttggggtgggaaggggaaagacaaaatcttgcttacagaagaattctaaatgacgtaggtaaatactccccagtccaggaggtgatgcctaacaccccacccaccacagacacagatgcacacacacacacatacacacacacacagagtccttcagggtaggctacacttaggaacttgcttccaaggaagatgggggaaaagg

SEQ ID NO: 187721 - DNA, 489 bp, Homo sapiens
tcccccaagtcagcagtctagtctatccagcaaagtcaacctgtcattgcttccaaaagtctcgcaggaacctcaaacacagcatagtcctaacacttcatagctgaatctgtttacaaaatccacccaatgactacccaccacactcaaatccttccaatgacaagaaactcatcaactcccaaagcagcaacccttttcacctttgcacaactcctgagaattagacagttcttccctatactcatgaagatctacctctccaaagggctgatcttagccttgccttacccctttgagctatttagaaaaggctcaagaacagcagaaactacgatttgcagaccacttccaatgtacagtgtaagctttagtttactgtggcatttaaccctcacagcaatgcaagaggtagaaactgttatctccatttggttgataatggggtctacagagctgagagagataaaagtgatctggctaggatac

SEQ ID NO: 187722 - DNA, 439 bp, Homo sapiens
tctgtctcatagttgagatccagttttgaagatgtaaagcaaaaagcacaccgctgatttttctcccctcttgcatgtcaaaatactatgtacataccacataaacactagggtatctgttaaatatattttatgttgataccgtttttacttggcaaagttggatgcacaaagaatagtagtctcatattttaacaatgctgtggatttcttctgtagacatttatttcctgttacctgcaaggtgtttaggatttggatttttttttgatgttttggtctttttggatagttgctaaagttcttcactattttacctaggctatccttataaataaataccatgaatttttaaaaccacacaggtcacttaaagtctctctttcttggaggtacctaggctgtaaaatgaattttgtgagttatctagagtaagtaa

SEQ ID NO: 187723 - DNA, 338 bp, Homo sapiens
aggctgcaaggcaatggcgcgatttgagctcaccacaacctccgcctcctgggttcaagcaattctcctgcttcagccgcccaagtagctgggattacagacgtttgccaccacgcccagctaattttgtatttttagtagacacggggtttctccatgttggtcaggctggtctcaaactcctgacctcaggtgttctgcctgccctggcctcccaaagtgctgggattaacaggcatgagccaccacgcccggcatgatttgggaaatattttaaagaaaagaaaatgaatgctgacctaatagagagtggagagcaaagcgaaagagcagttatg

SEQ ID NO: 187724 - DNA, 530 bp, Homo sapiens
gttagcttagatttagggtgcagaagacacagtgccttacacctcagtagtactgaaaactgaaaatgcatgattttcaacataaaacaactgagaattaggccagcaaggcaagaatatgaagtacttatttttcataatcaaacaaatgttctttttaaaagctattgtctcaattcacattacctgtaaagcttcagaacttttctccccttgtacacaaaaatgcatttaatccccaaggacgtaacattaggattcattgaatctaggggactggtgatcccatgtggctgaacagttgaatttagcagttgaattagcctgaatttattatagtttctgtgagtttcataggtgaggaaggccaaacttgagatggttaataaggtgagaagttggaagaagataaattgggaaacgctggtctggtaacagttttggaaacaaacgtatcctagctataagcagtaacttattagagagatgtattccatgtcattaatttcctggtactactgaggtgtaag

SEQ ID NO: 187725 - DNA, 269 bp, Homo sapiens
gttagcttagatttagggtgcagaagacacagtgccttacacctcagtagtactgaaaactgaaaatgcatgattttcaacataaaacaactgagaattaggccagcaaggcaagaatatgaagtacttatttttcataatcaaacaaatgttctttttaaaagctattgtctcaattcacattacctgtaaagcttcagaacttttctccccttgttaaccatctcaagtttgccttcctcacctatgaactcacagatactatatat

SEQ ID NO: 187726 - DNA, 539 bp, Homo sapiens
agatgttctttatgaggttgaggttcccttgtatgtctagtttgttaagtgtgtttatcgttgaaagagtgttgaatttttgtcaaatgtgttttctgtgtctactgagatgattatgtgtttgttgtgtgtgggttttaatttagtgtattacattgattaattttcatatgtaaaaccaacatattcattctgggatatatcccattggttatggtgtataacccctttttattgctggatttggtttgctagtactttgttgatgtttttttccatccatataagatattggttggttgtttttactcgatgtgtttggttttggtatcagagtaaaactggcctcataaaatgagttgggaagtatttaatcctcttctatttcttggactagtttttgaaggattgtacaacctttaaacatttgatagaatttactggtgaagacatctgggtatgggctttgtgtaaagttgtgtttttgcctttttggggtgtgtgtgtgttagttattttttgttactaatctattatag

SEQ ID NO: 187727 - DNA, 416 bp, Homo sapiens
gagcaagcagacacatctgtgctgatccttcgaccttccttttttcttcgtgggttccagaaatgagagacaggaaagttccctctggtttgattcccggcctgacttttctgctgggggaagtgaatatgcttgttctcactctgcggggtccccctggcctgcccatcccagtgactgcgaaccagggtggtgccagggttggctccaaaagctggtgatccagacccttcctgggcccctggagaccccagtccctgtgatgtccttgcccaagttctagggctgcagtggccgtaggtgactggcccgggcaccctccctttgcgggagcctcgtgaaaggatactgtaagcacagccgcagggaggtcaccactggccctaccacctctcgctcggtattgaatggctagc

SEQ ID NO: 187728 - DNA, 439 bp, Homo sapiens
aggcaccagtggattgatgctcatgaatcaggtcccgcccccaggccaatcgtatgagtcttgggatggcctgccgggtaaggagcaccaccctgtgtggctgacccctcggcactagcatcagtgccatcgtgaccagcttttctggagtgctgactgtgtgcccaccgccacctcgagagtccccatgatatctcagttcctcctctctgcaaccctgcgaggtggctgctgctatcacccccgcttcacagaggaggaaaccgaagctcagggctgttgtcccccagggttcgacagcctgcgtgtgctccctgccttccagctttccttgtgggagcccctccacctgtttctccccatctaaccaagcaggttacaccccagggcttctgggaaatggacctcaggtttgcagctgatcttggtccaaatatgt

SEQ ID NO: 187729 - DNA, 613 bp, Homo sapiens
ccattgtcttccaattcacaaacatgtggtatctttccatttatttatgtccttttttatctccttcatcaatgttttctagttttcagcgtacacatctcttacctccttaaatttcctaagtaattttttgatgcaattataaatgggatagttttcttgatttctttttcagataattagcatatagaaacattgtatgttaactttgtatcttctaattttctgaacttattaagtctaatagttttttggtgaagtctttagagtttttttgtttgtatctttttttttttttttgagatggagtctcactctgtcacccaggctggagtgcagtgctacagtcttggctcactgcaacctctgcctcccgggttcaagtgattctgctgcctcagcttcccgagtagctgggattacaggcgcccgtcactatgcctggctaatttctgtatttttagtagagacggcatttcaccatgttggtcaggttggtcttgaactcctgacctcaagtgatctgcccgcctcggcctcccaaagtgctttgattacaggcatgagccactgtacccggccattgtttctttcatttctatgtctttgacaa

SEQ ID NO: 187730 - DNA, 294 bp, Homo sapiens
tctctctcctgccaccatgtgaagatgtgcttccccctcaccttctgccgtgattgtgagtttcctgaggcctccccagccatgcctcctgtacagcctgtgaaactgagtcaattaaacctcttttctgtataaatgtccagtctcaggtagttttgtacagccatgtgagaaaaattagagacctagggttagaattttagagtacaaggaaagggtttgttaacaataggaacaatgatgaagacttgcatgacactaacagagcatattttcttctttttttctagatct

SEQ ID NO: 187731 - DNA, 271 bp, Homo sapiens
ttatagaacatacaaatctcttgtttcacttagtgcatctgtgaaatgagagtagtcttaaatccttcacaataaaaaaaaaacctctgtctctgaacttctcactctggctgcaaaatggaatccgataattcaacattcattctctcttttttccttaaatgcaactctttatcagggacagcaatgtgccaagtttaaaacatttccagactcttctagattgaggatagagagtggctaaattatttccaattctggccaataacaa

SEQ ID NO: 187732 - DNA, 304 bp, Homo sapiens
cattcatcagacaaactgataaaagacactatctggttagcctgtccagatccattagaaacctcaccagaagattaggtcttactttcagataggtagttatcaggtaatgaagtctctcctcaatgcgcctggctcccgagcgaggttggcacttcatcctccactacatcttctatgagtatctaaatcctctctaccctcttctgactcttctgtcctctgctggatggggttcagtgagagaaatgcatcctagctgagcagacgaaaaaaaaaacaacatggttgggcaatcagctat

SEQ ID NO: 187733 - DNA, 422 bp, Homo sapiens
ttctttgcctttttaaaaacaagtgacaactctgcctagttcttaaaataaagatgaagtgatacttttctttttttttccctaacacacaagtaaaaaacatttgttcatttaataaaagtccatttgaaaatatacacttttatttttcttcatgacacttgtcaacatataacataatgaatattttatattttatttcattcagaatgtaaattgcttaaagacagaagcgtttgttttgttcaccctcgtatccctagttcttgaacactgcctaggttaaagggatgcttatgagctgagggaaagaaggaagtaagggagggagagagggaggaaggaatgaagggcacaactttaaataattcatcttctattaccttcttgggtattaatcaaatttaggctcagaaaaagtc

SEQ ID NO: 187734 - DNA, 395 bp, Homo sapiens
ctttatccatccacccatctctccaaccagctgacatttacggaatcctactaagcgccacagcctgtgctgcatgcagggacccacgatgcatgtatcagcagtgcctctggggccagctgttggcacagagcgggtgtgcagagccccggatgtgggaaagtacgagatgttccagagatgctcttagtcagcactgactgagtatttattgtgtgccaggtgctgccctatgagcctacagttcctcacttcatccttatcctcaccacacaaggcgcacagaactctcacattcccacgcagcagatgagggaataggcacagagaggttgtgtcagggctgaggacacacaggcctggaagggatagaggaggcctcaggtggcggaagt

SEQ ID NO: 187735 - DNA, 637 bp, Homo sapiens
cctcagagtacacttcagatgcaaactagaaatatgtcagtgtaaactatgaaagtgcagagcctttgcttcagtaaaactagatgcagcaaaaccacgggctttatgcatgactggtattgtaagagaggccacagggagtagaattaaatatgacacctccttgacatatgatcaaagctccttctaacctcaatttggggcaccatatatcacaaaccagacagcaagaaattaagtaaatgtaagtcttttttttatgccatcccaattacatcttgctcagttcacaaacatgttccagcaaatgctggaggagtttttctctctttaggagtcctccctcactttaccctgtttaacaaaagacctcacacacttagaaagaggatggaggcaggccagcttcaggacatgctgcacagggaggactgactgtcccaaagagggggctctacacccctctgacaactccacaatagaccagctacacacaaatgcctgaaataaggaagtccatcaagaaaatgaacagttggcgagatcaaggcttctggcccaaagggcctgcagctggtctggccattcatcaaaaaatctgaatttaaatggagacacattcgactgtgacatgtaa

SEQ ID NO: 187736 - DNA, 729 bp, Homo sapiens
aagaaaacaaatggagacggggagtatggtgccagtcctttaaatctcctggacatcggccaggtgcggtggctcaagcctgcaatcacagcaccttgtgaggctgaggctgaggtgggtggattgatcgggcccaggagtttgagacttgcagtgagctatgatcacgccactgctctccagcctgggcaacagagcaagacgccgtctcactatacatatgtagataaagggaaaagagagatgggaagtatggtgagagatgagactgaaaaggtaaactgggcccagttttgaagagttttgggagccatgttgaagagttagcactttatcatgattgcgttgggaaaccacggtgccccagccaacactgcattctttaccctaagagtgaaaacaatacggctgggcactgacgactcacgcctgtaatcccagacactttgtgggtccacggcggcggattgcttgagcccaggaatttgagaccagtctcagtctggacagcatcccaaggcctcatctctaccacagaaaatactaaattggctgcgcatgcgtggcacacacccatagttccagctttctgggaggactgaggctgggaggatggcttgaacccaggaggctgaggctgcagtgagtggtgattgcgccactgtaccccacctggcaaccgagcaagaccgtctgagatgattaagagatctcctctactggtccgcc

SEQ ID NO: 187737 - DNA, 597 bp, Homo sapiens
aagaaaacaaatggagacggggagtatggtgccagtcctttaaatctcctggacatcggccaggtgcggtggctcaagcctgcaatcacagcaccttgtgaggctgaggctgaggtgggtggattgatcgggcccaggagtttgagacttgcagtgagctatgatcacgccactgctctccagcctgggcaacagagcaagacgccgtctcactatacatatgtagataaagggaaaagagagatgggaagtatggtgagagatgagactgaaaaggtaaactgggcccagttttgaagagttttgggagccatgttgaagagttagcactttatcatgattgcgttgggaaaccactgaagcttaataaacagagaagggacatttctagatttaccttttaaaaaagttactctggctgcaggttagaggataatgataaaaagctagttatcatgcctgaggagggttgaggctaagtaaactgggtgtcttcggctctgcatatccttagaaatacaaattactctctgtctataaaagacacgggggcacatacatttctgctgtgattgcatcatcaggtctaactggtac

SEQ ID NO: 187738 - DNA, 247 bp, Homo sapiens
tgctgagattacaggcgtaagccactgtgccctgccctttttccaatttttaacacaactgactccattttgattctgataaccttcaaaagtgcttgctcatgaccattcaacagtcaaagcaagcagcttgttatgagctttgacactggatttggagaaggaaaaatttatactaatgacttaatattagtagccacacttctaaccagaatggtcattagagataagcacagataataggcta

SEQ ID NO: 187739 - DNA, 200 bp, Homo sapiens
ccatttccacactcacacctattaggtaagaagtaaaatagtactaaagctccactccctgccagcatggggccaggtatttacatacacatcactcttatttaacaactttatgagggcatgaatggccctatttatagatgagaataataaagctacagcatgtacatcgctcaccaacatggagaacacgtccgata

SEQ ID NO: 187740 - DNA, 351 bp, Homo sapiens
catttaactgaataagtttaatgaggagcataatatgtttcatgaagggtcattagttttatatttcccatttggaccattacccctcttccttaaccctctaaaaacagtttactcacaagaagaaaaggtatcgggagagatagaaataatataatttccagcctttacacagaaatacaaatttctgggccataccagagtagtgctacagggtcataggaaattgtgcagtgcgtgggtgttgaaaaagattccttcttttagcaaaaaagctctgcgtaattatcatgtctttgcttgataattagcactactccaacaatggcacaaagactcacaaaggcttaa

SEQ ID NO: 187741 - DNA, 351 bp, Homo sapiens
gcagctgtcactcatttacttacatatgatattgaccaatctctagttattatcactttgaggatctatttatttttaagctgcatttaaaaacctcatttactgtgttaaaacagtaatgacataaaacatacatacacatagattagcaaggatgctgggaacctggcattacactgctcttggctaagtaattttgtgattaatttgtgtgcgggcctacctgcaaaataattaatcaggcacccctggctgtgcaatctgccccactcttatttcttcttcatttttccatcacccacttcttgttcccttttccatgcatgattaagaaactgttatttatctttt

SEQ ID NO: 187742 - DNA, 296 bp, Homo sapiens
aggactttcctggacgcaggttcttggagaccctgactccaggcacctgtgaagaagatgaaagtctttctctggtaggccaggcattcagcgcatgcgccgtcctgacagtgcggagcccaacagctatattccccggtgtctgcgccagaggagttcaccagcagcagctggctgcactggctgaagtgcttgattctgaaagacagatggtaggggcgggacgggcaggcgatggggatggcccgatactcctagtgggcagcatttggtctactgacagtcctccctcccat

SEQ ID NO: 187743 - DNA, 177 bp, Homo sapiens
aaaaatgttccattatagttatttcactaaattgctatggtaactgggtcgtagccatttaagaacatatatacattagaaatttgaccttaaatgattaatacttaaatccagctcaataataaataagagcaatatcaatacaaaggatatcagaataactctcctcccttaaaa

SEQ ID NO: 187744 - DNA, 328 bp, Homo sapiens
cttgatgccctttcattcagctaacgttaacctgtttggtctcctgactgatgctgggaaaatttaagtttgaggcacttaataacaatgagcaatgggtagccccaacaaattgggaggaaaagataatggaggaagaggagagagggagaaatagagagagggtgatgcatgggagagaggaagagactgacgtcaatgctgggctgaccatagagtggtttacactgaaaggtgcccagagctttctacgtgttctaacaggctcccttgctcctaagcatcattttttactatggcagcgtctccttactaggcttctcaagtt

SEQ ID NO: 187745 - DNA, 753 bp, Homo sapiens
catcctcccgagtagctgggagtaaggcgtctgccaccatgcccagataatttttgcattttcagtacgagaggggtatcaccatgttggccaggatggtcttgatctcttgacctcatgatccgcccacctcggcctcccaaagtgctgggattacaggcgtgagccactgcgcctggcgctcctggagcagctttctaagcctcagagtttgcacttagagaacagcattttaggcaaaggggattaaacatttacataccctggaggcggtgggcgtcatgatctccctaacccaggaattctcaaactcagtactatggacatttggcaggctctgtttgggggaactgtcctgtgcattgtaggaagtttagcgacctctctggtttctatccctggatgcaaacagcccctccctccccagtcatgataaccaaaaatgtctgtagacactgccagatgtccactgggggacaaaattgccaccggttgagaacactgccccctctccctcagggaatttgtgagttgtacatgctgagtaggtctcctggtccttacccaggagccatggacttacctagcagaggagctggtgagggaagaagcgccccccaccgacctgcaaatttttgccatgtcccaacctgcccatgtggcctggacatgtggaaatgtgtcaacaatcatgacagatctgagagcagtacctgtcccagtgcgcaggcagccaatggctggggcctgcag

SEQ ID NO: 187746 - DNA, 460 bp, Homo sapiens
actgtgaaaggtccacacaacgggagaactggccttggctccacaggccacaacacgttctcagggaaacacccaagggcatctgtaagaggcacgctcagatgccacacttcttcccagcctttgcagggacctaatctcgaccaccatgtaatctccagcatttaagcagttgatctcactttagaagaattaggaggtagtgcaagagggacctggagaacaagactgctgaaagtcacatgcggcagttggaggctggacggctgtggctccctgtatgggtctctgtctgggaaatgcaacccattctaataaagagctttgaaagctggcctcgctttgacaggcacgagtggccctgaatacaaacacagccacctgcactcctttttatttttaaactggaagctaatgctcttgaacatccacatttatctatgttagaatattcacttat

SEQ ID NO: 187747 - DNA, 664 bp, Homo sapiens
tgtttgatattccggactttgcatctaaatttatacttgacaagttaaacttttcatcgtgtgcattttcccgtaatctctcaacagccaaagacaaggatagacggattagtgatgggtgaaaccaattcaacccaaaatggcaacacttaattacaagtcttgttgtttataattaactgtgtaaatcactaacttgaaagtttcttttcaaagtatttaaaaccaactcttttcccagggggatttaatactgtatattattgcatagttaagtattattttgtttgctctatgaacaagatgtgaaaatggcacattttaccgactatcttgctagcaaatttggaaaatgttcatgaattgcattactagcaccatttggtgcttctcagtatttttggacattttttgccttatatatgaaagccaatggaaagacaatccaactacccaaatgactatgagtaatttctgagagtggagagtgagggtcaaattctcaatttcagaaaataaaaaaaaaaaatgagcttccaaatgtatcttctgagatgcattcatttttctgtgaccaatatttagaataaaaaattactgagaacatactctgtgctagataccatatgttttctaatattctaatttagtattttctattgta

SEQ ID NO: 187748 - DNA, 280 bp, Homo sapiens
tgaagcggcacatggtcaggcttcattagctttctcaaatcattctgaagcagtggatgaattcttcccttaattcaaagaaattattgtttcctattgtcctcagtgagaagcatctttgctattactcagactagggaaactaccaggacacccattcaacttgtttctttctcaatttgtggttatgaacaagaattctcagtaagtttggactcaaccattgacttggaggaggcatcagtgttaggagtcagtgacttgctctgccctagaaatt

SEQ ID NO: 187749 - DNA, 457 bp, Homo sapiens
tcagtcggacctaaagcaagcccgacactgtccgcaacataggccaggtaggagatgtctttttttttcccctttcttttagagacagggtcttgctctggggcccaggctgaagtgcattggtgcaatcataacttactgcaaccttcaactcctcaagagatcctcctgcttcagcctcccaaagcactgggattacagattgagccaccgctcctggccagtacctgtttgggtccatttctgttaattctaacagctgtatcaattcctgattggtttccattgattgatttcccccacccgtatgggttgtgtctttctgcttttgtgcgtacctggacattttttattgtgtaccagccattgtgaattttcactttgtcgggtgccgagtatttttgtatttcttctgtaagttttcttggcttttgttctggaacagtcgggttactta

SEQ ID NO: 187750 - DNA, 481 bp, Homo sapiens
cttatctgtcttcacgtcaggccaatacttctgtccagtccccaggccatgggaccctgctgggccctgtgtatcacagtcttgttactcaagtgcagtcagcttcatcaacgtgcagcttcatctgaaagcttgtcagaaatacaaaagctcagcccttctgaatcaccatctgtattttaatggtgattgtatgcacatgagtgtttgaaaagcacagtgtcaaagagtccactccggctttcttctcatctctctcatcacaaccctctccaagggacaggctgataagaattttggttgcttctagaccaagtttcacataaccaagtccctggaattctctgccctaaagctcacagtccacccccatttaaggcatagaatgatctttcactgatgcattcccattgtgcacctggaactcaaatacatttgtgatcaagggataggcatgacgacgtggggagaagttgtttgg

SEQ ID NO: 187751 - DNA, 510 bp, Homo sapiens
ggggcaggacttgggagcctggctgtcatcggctcacatccacctctgccagcttgtgtggggtagggcctccttggagggaggccaccaggcacaggcctcgagtcaccagccagccctaggatatgaggagtcctgggctcagtcagagggcggtgccccaggtacccctgagagaggaacaaaggccccttcatggcaggagccagagagccagatcctgtgaggacaaggggcctctgtgaggagccagggtgggggatgcagccgggcctctccacgaataaccacacgtgtgcacacaggcacactcgccaacccaaacagcacatagggagccccactcgacattagacacacacgcacacagttggagccacaggtacgtacacacactgctgtgatgacacaggggcacacgtacacacacacacacacacacagaaacacacatgcactcaccggctctcacatctcaacagatacccgggcccacacagaccacacccg

SEQ ID NO: 187752 - DNA, 204 bp, Homo sapiens
aacgctgaggcagaagatttaaggccagctgacgtgtgttccagtagggtcaaacacactcctgtgagaaaccctgccggtccagaacatccatctagaggaaagctcatggctagggaagctctggatgggcagggtttctcacaggagtgttttgaaccatggaacaactgagctggccttaaatcttctgcctcagccttt

SEQ ID NO: 187753 - DNA, 202 bp, Homo sapiens
agaaaaagacagctttcacggcagagataagataattgagctgtctggcatagtgactcaaagccattgaaggttctagtcaaatgattcctctggttttgactttttaaatggctctttcactgttgttgcctctggcaactaccattataattggaggaaattttgttccgctaagaggctactccatttacggactcaa

SEQ ID NO: 187754 - DNA, 800 bp, Homo sapiens
aaatgtactggcttcagacacatggaagagagtctgagaatgttttgagtaggaatgttgctggagataaattatgggctaagaaatcagctgactgagtcgaccgtatagattttcccaggtcacattacttttccatttgtattctcaatcgcttttgaacacccttcatgcaagtcagcatatcaaaagatgattttatacaaggattaccgatttcaaataaataaagaaccaaaagaaatagatttcaattgcatccagactggttggagataaaatgaggagtgctacaactcgctgggccagcacagacaggagccctgggagcgctctcctctgagatcgatgaagtgagaataggccccagtaaagcagtggagaaaactgtcttcctgagccccctctagcccaaggattccagctattctttgcactcagcccccatggggttaatgatgaattattacaaacaatgaagacatttaaggctgaagactaagccatgatttgctgttctctgcctgttcacccccaactatttctaatcccactatttcctgatgagaacacacacttaaccagatattctacttcatttttggaaaatctcttgaagttgctttggatgagctgaggaaatgacatcatcaccccttgctggctgcaggagtgactgagcccttgggtttgggtggggttgggctgctggtgaacgcagaaggtgtggcgctgccgagagaactggaccccagaaccgctctgttctccaagtcagagtgacattcactcctcaggtg

SEQ ID NO: 187755 - DNA, 287 bp, Homo sapiens
ttcctggcttctagaacaccgatttactctctcttcatgagatccactattttttaactcactaacatttgcagcaacatggatggaattggaggtcattatgttaagtgaaacaattggtttcacttgcatttttgcaagtttaccagattaaagtaggctggccttatagcagcaataccaggtactgtggaatccaagtacccaccacttaggttgacagccttgggccttctttctttgcctgtgtagtgggggcatatgcaagcacaagggcagggtggggg

SEQ ID NO: 187756 - DNA, 207 bp, Homo sapiens
tcactcaatcctgtcaacctgattcatctatgaagtacgtgggaaagacatcgtcactgccccatcgtcagtgccctgtgtcatccctttacaaagagaaagcagcagaagtgggatatttgttgagtgtttcctatgtgctacacgtcctgctaaacacatcctgctcatttcatcctcctgaggaagatacactgtcatcatttc

SEQ ID NO: 187757 - DNA, 413 bp, Homo sapiens
caaaaaacatatacacctatattgtctggagaacatgaaagatgttaagaatgtaaaaagggatgatcttctatccccttaaaaacaaaaagacaaaggatccaatggccattgttaaaccaataattagaagtaatttttttaaagccacaaggcactgcatgaatcctgatattagaaattctttccactgagtatctatagaaggaagatcaagtatctgtttcctcttctcccttccaactctgtcaccttttggcccctttccttttctacctctctctcttcctgtttccttctatctcccattccaatcccaactctttgcactaaccaatttcctttttacctctcattttactgcaactgcttaaagctgccaaaaagtttatattcacggaaagaaatacaag

SEQ ID NO: 187758 - DNA, 637 bp, Homo sapiens
tccagctgtgagctgctgtcttcagcaacacttcctagaagttaagtagaggaaggaaaaggaggtagtctttgcctcagtaccacaccaattaggggttttgaaagaagcttgggctggggatgaggctgttgctattgattaaggtagggttctgatatcatctccttcagacactggctatatttcctccattcgccttgacaactaacagcaatgatggtggattaatcaacagtgtcctctaagcagtgctcccacagcacacataaatatgaagtctacataagtctttcaggatgcagaagagtcacaaggaatgaactggatatctgttgtgagaaggagaatgttacctgtgtcttgcagaagccaaactcttaccaagcagaaaaaccagaatccctcagatggaatttcattattggatcacattttaaagtcctaaaataccatttatgggtaataaatgtgaattcaatgctatattttgaactgaatgctcttttgaattaaaacacaaggtaggctctaaacaacaggcacagcaaaggactcttggatggtgacatggataaatgcatgaaaagacatgttttcctatcaaggagtttctattattaaatttgacctatct

SEQ ID NO: 187759 - DNA, 506 bp, Homo sapiens
atgcttaaacttatccatcctctgttccaaatagaaatcagttcacttggggagggctaccaagctgtgtattttcatggcctccctctacctcttggttgaatgtgcctcactgctctgaagctgtggggagtgagagtggcctgctcctttgtagtaaaacctctgcttacaagtagggcacagggtgggaaaggtaacttcttgccttgcctctcctggtggagaaactgttccttacaagtaagctggagtgagggcaattgggacacaggattttccagctgccacacctgaagaccttatgtcctggaatgaggagttggtgtaggaaggaaaccccagacttctcagctgtttctgcgtggacagagcttctgtcctacaaaactggggatgacaagaaatgctggcacccaatcttggggtaatgcagtatctctggagtaggacctgggtagagaggaaacctctggcttcttggctatatccatatagagtggagc

SEQ ID NO: 187760 - DNA, 574 bp, Homo sapiens
atagaattagttccatattggtggaacacatagcagaggtttgagaagggagaatttagtcaactgagaagttctcatgaaaggagcaagttgaagatcacagagacaccttgaaacaaaaagccaggaataacttccaacccaagaggagaacagagaggcctcaaaaccaaagctaggataagaaacttgtagcccaagagttatcttccagacaaagaagcctgagattccaacgcagcttcagagagtactcactcaaaatgttactgaaactgaaggctttttaatgacttagccatgcatgcaaaaggcattccctaaggtggcacagaagacggagcccccatatccaaagatagccaaggagaaagaaagacccctgttgccagagccagtgggcaaaggcaacagaaaaggagacaagggtcctaatgggatgagatcctttcggatttaggcttttatacaaactcctgagaactggcaggttgacagccataaatggggtaccaacatttctactcattggattacaagttctcaggcatccaaaatgatgaacaaaatgaca

SEQ ID NO: 187761 - DNA, 352 bp, Homo sapiens
agtaagcatataacagaagtaagtaaatatttttctcagtgttgtactcattcaaccaggagagcttgaattattattattgtgaaaataatccataaacactttatgtcatttattttaataaatcattaaaatttaaaattacctgtttttttaattataaaattcatcaaacaaaaaactataaagcataatacaataaatattttactcattacttaattttagcaaatctgacaatgttgacagataggcttcaaattttaaaacaaaaatttacaaatgcattggaagcccttgtgtatcccaatctgattccatcacaatctatctccatacctgcattgctccc

SEQ ID NO: 187762 - DNA, 598 bp, Homo sapiens
ttcactccctactccacttcccatagtctatgaactaaaagggaacaaaatattcttatcatttattattaaaaagataaaatattttagcatataaaaccaaatttatcttatgctactaaaacagaaaataaatgcttaacgagttttacttgaattacattaaatcacaaagtaacatctcaatacacacacacataatattcaggaaaaaaatttaaaaaacaacaaaacaataaaaaataatacaaataaaaatcaatataatagctatttacacagcatttgtattgtattaggtattataagtaagctagagatgatttaacgtatacaagaggatgggtgggtgcagtggcttatgcctgtaatcccaacactttgagaggtcaaggtgggaggatcgcttgagcccaggagtttaagaccagcctgggcgacacaatgaaactctatctctacaaaaaagttcaaaagttagctgggcatggtggtgcgtgcctgtggtcccagctaacttgggaggctgaagtggggggatcgattgagcccaggaggtcgaggctgcagtaagccatgattgtaccagcgcactcaa

SEQ ID NO: 187763 - DNA, 307 bp, Homo sapiens
tatttacaagctgatcctaaaattcatttggaaatgcaacatacacagaatagctaaaacaatcttgaaaaagaacgaagttggagaactcacattttccaatttgaaagcttactacaaagctacagtaatcaagacaatgtggtattggcataaggagaaaaaatgtatatcaaaggaatagaactcagagtccagaatcagagcctcaaatttatggtcaggtgattttcagtaaagatgccaagacaatcgggcaaagaatagtcttttcaataaactgtgttgggacaactggacagctgcc

SEQ ID NO: 187764 - DNA, 716 bp, Homo sapiens
acatgtattaagtgataaagtcctttaaaatcctaccaccagagagtaccactgttggatgtttggttatgttgtcctaatatctcattattatttgaagtacttaaaacattaattatgaaatacttagttcattcaaagaatatatgtatgcatctgtaagttatgaagcctagcaaccaggaacccattattcagcttaaggtacagaacatcaccagtgctgttgaccacagttctatgcctgcaacctctccccagtctgagctaacaaatattctgattttcaaaaattactgtcttttttaatgttttaattatgtgtatgtaccctcaaaaagttgttgcctttttgtgttttaacattataaaaatagtttaatactctatattctttgtaacttgcttttttcctgtttaacagcatgctactaagatttgtctgtgttgatgcaatagctctagttcattcattttcattgctacatagtatttcagtgtatgaatatactatgagttatctgttctcttgttagtggtatttgcacgagttccaattttacaacagtatcctagatgaaaaatataaatgcaatttatggtaccattgtgatgtttcattaatcctttaatgttcattaacataaatggcaccacttaaatcaaactaaaatgtcaggagagagctaagaataattttgctggatcaatgactt

SEQ ID NO: 187765 - DNA, 469 bp, Homo sapiens
actctagaggatacaccgacgcgagggattcactggcatgttcacagctgcttccggaggataacactggggctattgctaatgtgagaatttgcagactgtttaccagacattagaaaagtgaaacaggtgtatattttacttgcttatagcagtgaaaccaacttttgcttatagatttgtcattatttttgtccatggcatcataacatcatcctctgaaattcagaattatagagagagagttttcctccttctctgtcccagactctatacttaaatcatctttactacctgagacttacaaatgacattctggacttaagtgatgttgctttaacttagacatatgcccaggagtgctgtttatccttccatgatggtgggagtagaatagatgatagtagacagttaatctacatttatatttagctgttaagtctttggcagaaagtggggaagacatgac

SEQ ID NO: 187766 - DNA, 446 bp, Homo sapiens
tgattcactaaatctgcaattctgcatttctaacaagcttcctgggaacaccagtgctgccggtctttgtgctacactttgaggagtagggaactgaagggcccctgcttgcctccctggcctcatttcttgacacttccccaactctgttccagccatgcctcagttattccagctcccaaagtgcatcctgcttttgctcactgcaaagcctttggacaggctggcctccctccccagagcactctcaccctggcctggctgctcctacaggattggagatggcactttgcttagaagccttccctgattctctaagccctggaaacaaagagcatgtttgtggcctgggtgagaatgatctttatgctcagtgataaggggtgagagagctggcctataaggtgcagggcagcagccagaggtttcgttctacagcaggttct

SEQ ID NO: 187767 - DNA, 377 bp, Homo sapiens
gaggggctggggagggagcgtaggaactgagctgggccagggcagtgacagacttgggcctgcgcagctggtgggggaagctggtaggggtccggagccctggcgaggacacctgtggatcatgtgccctgacctcttgaccccacggtcctgagcccgtaggtgggatcaacaaaccaccggatgtgtatgtcaacaaccgcgtcagtacgtcagtaccagtgttgatcaacacctcgtgtgcctgggtcgctgcctacttcctgcttttgggagagtgggatgggccaagtgggtgtctagggagggactggatggcccccacccacatctcccaccgacccccccggctcagtgtccctgcctggagggaggcc

SEQ ID NO: 187768 - DNA, 687 bp, Homo sapiens
gatcataggaaggtaagactaaaatttttaaactagacttcttaaaatatcattcagtgcagtgatgacctctcatcatacaaatagatgagcaacttggctcaaaggaactatgttgtactttaatccattttcatcagacgaaataaatgtactctacctaatatgcatccatgtcagaaatatcacagcaagaatcagaaaatccattctgggctgggcgcagtggctcacgcctgtaatcccagcattttgggaggccgagatgggtggatcacttgaggccaggagtttgaaaccagcctgacaaacatggcaaaaccctgtctctactaaaaatacaaaaaattagccaggcatggtggcgtctgcctgtagtcctagctactcgagaggctgaggcataagaatcgcttgaacccgagaggcagaggttgcagtgagccaagatcatgccactacactccagcctgggcaacagggctacactcttgtctcaaaaaaaagaaaagaaaagaaaatccattctgcagcttgctaaggtgcccacataccctgaaaacgagtatcttgccaggtatggtggctcacacctgtaatcccagcactttgggagaccaaggtggctggatcacttgaggccaggagttcaagaccagcctagccaacatggtgaaactccatctc

SEQ ID NO: 187769 - DNA, 510 bp, Homo sapiens
ataaaaccagatttaatactacttcactgaaatcacacaactacttgatttaatctagtcttttcccaccatttccttttgagctctcaagcatatctgcctgtagcaagttctcatctgcacacgtcctagaaaagccaaaagcaaattctctactctgaaaaactgaggccaagaaggccacatcctgtgataaagccaaggacgcataatttcaagtccaaggatctctagaagaattcgtgtagctgcacatccattatagctcaatataacacaatgcagagtgaatataaatctaagactgacacacacacacctcccccaaaccaagattattgtcaaaagtatcggaggccaggtgcgatggctcacgcctgtaatcccagcactttgggaagccggggagggcagatcacttgaggtcaggagctcgagagcagcctggccaaccatggcgaaacctcatctctattaaaaacacaaaaattagtggggcatggtggcacg

SEQ ID NO: 187770 - DNA, 651 bp, Homo sapiens
ctaactgaccttcatataaacataatcatagagttgtatctccttcatgtctgaattatttcactcaatataactcgctactactttttaaatataggcattcttcggagttgcttcctaaggcctttcctcactctaacaatttcattcaatccaaaggcctcaaaactactatctgtctagcattttcattcaatccaaaggcttcaaaagtactacctcaatagagatgatcctggagctcttcagacatacttgagtattcttcaggaacctcaaacttaacacatccaaattctaactcatcatctctccccttaccctaaaaccaattcctgctcgcatattctgcctgttggttaatgggattatggtcacccctaaactagaaacctccaagtcatccagacatataaaatgttgttggtctagttcacaccatatccctagttaccaacatgcaggacatacagtagtctgcacttatctgcaattttactttccacagtttcagttacccacagccaaccacagtccaaaaatagatgagtacaatacagtaagattgacagaccatattcacataacttttattacagtattgttattaactgttccattgtattaggcgtcagtatagagttaatctct

SEQ ID NO: 187771 - DNA, 119 bp, Homo sapiens
agtgtttgatgggactcttctgattacctttctctccatagtcaactttggatagggtgctcaggacgttactttttagtttaataaacctttaggtttagttaaccatcttcattttt

SEQ ID NO: 187772 - DNA, 686 bp, Homo sapiens
tggctcagctatgcacaatatgttctttgttacactaaggtaagcactgaataggcacagaatcccatactgagccccattctaggtggagaatgagaagaggggaagtatgttgtatgtctgtactgcaagggtgctggccttggtatcttccacagtggaaagtaaatagatggtgcttaaaatggaaagaaaatttaaatagcagtatacacatcacttagcatatggagagaaacatcagaagaaacagctaactgttgaaagtggttgcctctcaagaatgtgacttgggggaaaagacagggggctgctgtctttcttaagagccttgggagcacatttgacattttaagccatagtatgtatatgtattcctttgataaaaattaaaactaaattaaaaggagggaataaatgtgcaatgctctagccatactttctaatcattaagctgtctcaaaaggcatgcacaacatgcctgactctttggagaggacacaaccttcactcctttctccttctcttccccattaacctgtattttttttctcttcatagtctttaagatcacctcatttattaatttgctggtgtgtgtgcttaatctgcctcctccagcaggaggagaacagggactgtcttgtttcttctgcatcccttgtgcttagtccccagcacacatt

SEQ ID NO: 187773 - DNA, 342 bp, Homo sapiens
tgccagtcaatgatggagaagatactttaaaaaaaaagtaataagcaatagcacaaagaaatagaaagttgagaggaaaattcgatctactttacttttcttgtagtctatcaagagaagtcaatcaaaatatttttcaacctgtacacaagacagaaatatttgctttgacttcttaaactgatttgacagaattttaagctttatattctatataatcacaggaaaattctatagaatcataataacccatttaattaggcaccttttcttgtagtatctatgccaaatatacatgaagatttaattcatttgaaagatacaggccgggcgcggtggctc

SEQ ID NO: 187774 - DNA, 1111 bp, Homo sapiens
taaacaatctggtacatgcaggcaatggaatattatttaactctaaaaagaaatgatctatccagccatgaaaagaaatagaggaaatttaaatgcatattgctaagtgaaagaagccaatctgaaaaggctacctacagtatgatatcatctatatgaacaggcaaaattatggggacagtaaaaagatgaattgttgccaagggttagatgggaaggagaggtgaataggcagagcacagaagatttttagggcagtgaaaatactctgtatgatactacaataatggataaatgccattatacatttatcaaaacccatagaatgtataacactaatagtgaacattagtgtatcaactatggactttggatgataaagatgtgtaactgttttatgataatgtgttgattgtaacagatgtatcactctggtgaggaaggctgtgcatgtgtgggggaagaaggtatatgggaattctctgtactcctgctcaatttagctgtgaatccaaaactactctaaactctattttaaaaatagaaaaaaggcacagattaccaatataaaaccccagaaaaagcctgggattttttaaaaccccaaaccttcatattctaagaatgtaatatgaagaactttctgtcagcaaatcagaaaatcctcatgaaatggaatttctaggaaaatacaatttaccagctcaagagtaaatagaaggctgggcatggtggctcgtgcctgtaatcctagttctttgggaggccagggtggatggatcatttaagtccaggagttcaagaccagcctggccaacatgtaaaaccccgtctctactaaaaatacaaataattagctgagcgtggtggcgtgcacctgtaatcccagctactcaggaggctgaggtgggggaatcacctgagccagggaggtcaaggctgcaatgagctgagatgctgccactgcactccagcctggacaaccggagtgagaccctgtaacaacaacaaacccaaaagaataaatagaaaatttgaattgtttatatctgtttaagaagttgaatctgggctgggcacagtggcccacgcctgtatcccagcactttgg

SEQ ID NO: 187775 - DNA, 850 bp, Homo sapiens
ctaaaccttatgaagacagtgctgaggcactttccttttctgatttcatctttttgggaatctgttttattgaaggtagttagtagttgagagtgcatttgctacaagcatatacttgtatcttcctagcttcatgaggaacagaaagaggtggatatggctcagggtgtggcagggacaattgaggacaaagtcaattcaaatttgtgggtcagaaagaatttttgtggacgtagtgtttttggagaaactctggatggttatatgtgcatgccttttcttcaaaaggaaatacgcaaggttgtagcatctaaaaataaacataagagtcagacaccaaataaatcaagttttacataacagttgtatgcccagtttgtttaggtgagatttcacattacagaaagtatttgaggagcatgaaaatgggttatcttctgtattttccagtttggcaaaagttcagaatttcatcacattgctttgccctaattttgcccagaattttatcttagcctctctctgacagtgatgaatcatgctcaaaagccattctaattggacctttttaagacagggaaagggatcagtaggcggattggaagaaatttcaagtcattgaaatattccattgagatttcctaaagggacaaaattgggcaaacataagaaactacgacttagatttggctacgtagtagaaagtatctcccctacatacatacaggcaattgtatgtatgaatcatagggtatatgtgtgtgtatactacacacacattcttttaaagagaattcatggaaaaaaaagcagttggagtgatcagatgtattgcaaaaacatacagaga

SEQ ID NO: 187776 - DNA, 389 bp, Homo sapiens
ccaaaagcctgacatctgatatgcagtgaaagatgacatctttctccatcccattccccaccgtgcaaaggaaagaggagcaccagcaggggccaacagctgacattaatttgccttctcttcttccttccctcctcttgcaattccgggagtatttaacccttcttcaaggtctcaagaatagtgaaccctaacagactcagccattaaaaatgctcagcaagtagcacattccaagtaagtttagagacagaccagaacaggaactgatgtaaacactattctctagagtcacagagatctttcagaaactactttgtgaatctgcaaagcttgggttagaatgaggtttaccagatgagttgactgggtgcctggagaatgaagtg

SEQ ID NO: 187777 - DNA, 436 bp, Homo sapiens
gaggctgaggcaggagaatcacttgaacccgggaggcggaggttgcagtgagccaagatcgcaccactgcactccagcttgggcaacagagcgagactgtgtctcaaaaaataaattaaaaaaatattttaagcactcatcttgttgattaggttgtttagattttgacatatatgcttaatttttgtccatttgacctgtctcctactgagaatggtgcgtttaattctccctataggtatttttctctatttttcgttgctttccctctagcatctgctttatataagtgtaatgtgtactatctccaccgaaggacaaccactatcttgacttctcatcttgcacattaatgatttgcatgttttgtctttaaataaatggaatcacatagcatgtatgctttttggttctgacttattttattcagcgtaat

SEQ ID NO: 187778 - DNA, 283 bp, Homo sapiens
ttcacctaatcattctatggtacatttggtaagtttttaatgccttgagaaataatttttaaaataggatgcttccctccttatttattagattatttctgtaagttagattcccaaagtgggattactgggtcaaatgttataaacatttttaaggcttttgagccattttggggttgaggaaaaacccttcttgttagagctctacagaagccaagtaatgatgctaaatttcctaatttgccgtatgtcactgtttgctctctgaacttaagtgaacttt

SEQ ID NO: 187779 - DNA, 292 bp, Homo sapiens
ttagacacctggagggcaatgatctggaggacactaactggaagaaagcataggcatccttaattgttgagaggacagaactggtacctgtgggtagctactatgtgaatggagatgtcagcttggtatgagaatttcataatggtagaacaaggtatcttgagtgacactacattacctactactagaggtgtttggtcggtgacagaatatctattggtcaaactcctgcctttggtcagagtttggactagttgatttttagatcccttgaagcattaaaatcttatga

SEQ ID NO: 187780 - DNA, 354 bp, Homo sapiens
ttgttatacaaggtggtgagtgtaatgatggtgttatgcagtgagaacatccagcctggtgctttttaggaagtgaagccagagctgtgtcttaaggcaggcagagtgtctgtatgtgaggtggaggtgagggagaggtgaaaggggagaacagttgggaagaaacagaagaaactgaagaaattacgaaaagtgacgatatgaagaaaggctaggaaggaataaaaagcagggtgtgaagtgagagccatttgatactgcttaggcaataaatggaaggtggaacatcagagatcaggcagattattgtcttctgtaccaaataactaagctctatactgaaaaccaacaatt

SEQ ID NO: 187781 - DNA, 682 bp, Homo sapiens
caggcgcccaccaccacgcccggctaattttttgtatttttagtagagacagggtttcatggtgttagccaggatggtttcgatctcctgacctcgtgatccgcccatctcggcctcccaaagtgctgggatgacaggcgtgacccactgcacccggcttgagcagggtgttctagggaccctggtgggctgtgtctcgggctgttgaacagtgactttgctgggcagcagatggttcctgggttgggacagtgacggtcatccttgcagtttgggcatcaggcggacgcacagtgcagactcagtctgaaaatagtcttaggagacttcagtgctgttttgtaaaaccaactgacataaagctgccgggatcctatttcaaataaatagtgttttagagagcttattacaacactcagcgtcccgacccctctggagaaacctgtggctcagcatggaagcatatggccagtgcatcacctggccgaggccattcccctgagttctgtggcgagagctgtcaactgacggttccagagtggaagcgtttctgccgggaaggcccaggccgagggcgatggtttctgccgggacggcccaggccgagggcgatggtttctggtgggaaggcccaggccgagggcgatggtttctgccgggacggccgaggccgagggcggtg

SEQ ID NO: 187782 - DNA, 178 bp, Homo sapiens
aaggtctttatgaatttctcagaaagccactaaacgagatgtgccttgaaaacgaaagagtaaactaagcaagaggaagatctggggtctagggaataagaggtccagacccaaagagaggccaaagatattccttgagtgaaggcaaaggggagcactagaatgtcagctgtgcaga

SEQ ID NO: 187783 - DNA, 203 bp, Homo sapiens
agtaggtaccctttctcagccatgtttacagccctgtctccatctctgtcaatcctaggttcttagcacagtatctggcacataacaggtactcgacaaactaaatctcctcgtctgttattttcctcctgttatttttttttttaaatctctatcacactctatcctcaggcaaccgcctcacaacctaactcctagcccta

SEQ ID NO: 187784 - DNA, 306 bp, Homo sapiens
taatatttccccccaatgccttctccaagccttggctccatccactaacttggtttccataggaatagacagagctatcaagtggcacggagtcaaacagcacaaatgagagaaggagaaaatgttactgtcaaaaaaaggcttttctctatgagaggaaattatggaaaggtattcttgactctgaggcttccttatccaatgccagatttttcaggtgctcttcctgactaatatagcctattttatttagattattatgaaaattaatgccttcattggagagccttttatatataggaaact

SEQ ID NO: 187785 - DNA, 601 bp, Homo sapiens
tgaacatgaaggcagagatcgggaaggcgccgaggaataacaaagatttccagcaaagccaccagaagctgggagaggaggcatggaatagtctgtccttcaagcccgcagaaagaaccagccctgccaactctttgatctcagacttctggcctccagaactgtgagacaagctacttctgtttaagccacacagtttgtgatgatttgttgtggtagctctagcaatctaatacaggtcttaactcacctgtttccagattgcattgcaaagcagaacccacttctgctctgccttgtattcagaggcaggccaaacacaaagtgattcaggaaggtcagaatgaaacattaagtaaagggatgctgaacttgacttgtgctaactcacaagagtagattgatacattatcaggaattttatgaggtgagtgttagacacagccattgaaaaaactataatcctgggtaaaaactcgtaattaaattaaaatacccagtacttgctaattattcaactacattttatccttcttcccatggaataattatgtagaatggtgtgctgtttcatgtctccctctccccccgccaacctcca

SEQ ID NO: 187786 - DNA, 402 bp, Homo sapiens
ctggtggggtcccggtattgtgtccgaggttagggatacaaaaaattggggggaccctgacctggtggctgctctcttcctcccatctctgcattccaaacgcacagcccagccttctgcattgaaaggaatgagaaacaaaacacactaaacagcacaaagaatgagaatgaccccttaagcacactctggggaccctcatttccaaagggtggggtgaggcttttccacaacggttgggaattatttaatggagttctcgccatccttttatcaaattgttgctcagattgggctgcaattttcttcaaagggaagaagaaattgctcgtagatggccttgataatagaaacacaaatttgtaaaataaattatttctgcggtaaaagcaatctcgggtg

SEQ ID NO: 187787 - DNA, 524 bp, Homo sapiens
gagtaactcattttctgttagtcggtagaatgcactttgatattaggaaaaaattgtttttactttaatgtgttccacattggagacccttattaaggctggtatgccttatttcccagttgtactaattaaaagcactaattatttccatgcttgtatgttggaaccatcttttgatgcatgaaagtttcgagagaattaaaaaaaaaaacactgactttgggaatcatgtgagagaattaatattctttagttccaattaaaaaaagttttatgtcagttcattagactttagcccctacttctttgatttcaagtctgtcctgaatttctgccatgtggagagcagttgccagaatcccctttctttatacagcagttactgtaattaatgctgaaaagggacttacctcattcctgatgctaataggcctcttaaaagcactttttatatctaatccttgtcatttatgagggagttgaactagatttccaagatccttcctacatctaaagtcattgat

SEQ ID NO: 187788 - DNA, 472 bp, Homo sapiens
gagtaactcattttctgttagtcggtagaatgcactttgatattaggaaaaaattgtttttactttaatgtgttccacattggagacccttattaaggctggtatgccttatttcccagttgtactaattaaaagcactaattatttccatgcttgtatgttggaaccatcttttgatgcatgaaagtttcgagagaattaaaaaaaaaaacactgactttgggaatcatgtgagagaattaatattctttagttccaattaaaaaaagttttatgtcagttcattagactttagcccctacttctttgatttcaagtctgtcctgaatttctgccatgtggagagcagttgccagaatcccctttctttatacagcagttactgtaattaatgctgaaaagggacttacctcattccctgactaaatacacctggattatttctcaagagagcaagaaatgggttgattta

SEQ ID NO: 187789 - DNA, 235 bp, Homo sapiens
atttggccaccacgcctggccgaatccctggttttaagcaaaattttaatatggagtttatggttgttggtataatgaaatgcggcaccatagcagttgatttttgtctttcagaaccacactggctttttgtattatttcaaatttgatagatgcccaatgtatgtaacaaaaattttccctcacgtgtatttctttctttatttatttgtatgttttgagatggggtctgact

SEQ ID NO: 187790 - DNA, 200 bp, Homo sapiens
taatgtatatagtatagaggctagagactccttttctttgttacattgtgaactttatccccaaatggcaggcgtgcactggggctatgaagaaaccaagacttttcttgatatcctccgtgagactcggttttatgaagcgcttcaagcctgtcatcggaagagcaaattgtatggggctgtagctgaacagcttcgag

SEQ ID NO: 187791 - DNA, 1086 bp, Homo sapiens
  misc_feature (62)..(62): n is a, c, g, or t
  misc_feature (162)..(162): n is a, c, g, or t
  misc_feature (191)..(191): n is a, c, g, or t
  misc_feature (336)..(336): n is a, c, g, or t
  misc_feature (344)..(344): n is a, c, g, or t
  misc_feature (627)..(627): n is a, c, g, or t
  misc_feature (919)..(919): n is a, c, g, or t
  misc_feature (964)..(964): n is a, c, g, or t
  misc_feature (995)..(995): n is a, c, g, or t
atgaatgaatccaggtggactgaatggaggatcctgaacatgagcagtggcattgtgaatgngtccgagcgtcactcctgcccacttggatttggccactacagtgtggtggatgtctgcatcttcgagacagtggttattgtgttgctgacatttctgatnattgctgggaatctaacagttatctttgnctttcattgtgctccactgttacatcattatactaccagctatttcattcagacgatggcatatgctgatcttttcgttggagttagctgcttggttcctactctgtcacttctccactactccacaggtgtccacgagtcattnacttgccnggtttttggatatatcatctcagttctaaaaagtgtttctatggcatgtcttgcttgcatcagtgtggatcgttatcttgcaataaccaagcctctttcctacaatcaactggtcaccccttgtcgcttgagaatttgcattattttgatctggatctactcctgcctaattttcttgccttccttttttggctgggggaaacctggttaccatggtgacatttttgaatggtgtgccacgtcttggctcaccagtgcctattttactggctttattgtttgnttactttatgctcctgctgcctttgttgtctgcttcacttacttccacattttcaaaatttgccgtcagcacaccaaagagataaatgaccgaagagcccgattccctagtcatgaggtagattcttccagagagactggacacagccctgaccgtcgctacgccatggttttgtttaggataaccagtgtattttatatgctgtggctcccctatataatttactttcttctagaaagctcccgggtcttggacaatccaactctgtccttcttaacaacctggcttgcantaagtaatagtttttgtaactgtgtaatatacagcctctccaacngcgttttccggctaggcctccgaagactgtntgagacaatgtgcacatcctgtatgtgtgtgaaggatcaggaagcacaagaacccaaacctaggaaacgggctaattcttgctccatttga

SEQ ID NO: 187792 - DNA, 377 bp, Homo sapiens
caagggagtcccaaaacagcaaccagcagatttctcagcagaatccctgcaagccataaaagggtgggataatataatcaaagtgtagaagaaaaacaaaactggcaaccaagaatacttaactcagcaaagctattcctcagaaataagggataaataaaaactttcccaaacaaacaaaaactaagtaagtttatcaccactaggcctgcctaacaggaaatgctaaagggagctaagctgaaataaaaggctcctaattgatacataaaacttataaaagcaaaaagcactaaatggtgtaagtaagacatagtcatattcagaataatactgtaaggatgatgtgtaaaggaattttctctgtattatgagag

SEQ ID NO: 187793 - DNA, 341 bp, Homo sapiens
taccagatagagtagatccttgctcttaagttccatttttcacacagttttagggaacagacacaagtccatcaagttctttgcaactgtgtagcaaggatggcctttactgcagtttccaataccttgtttttcatttgtgtctgaggcctcatcagaattgcctttaccttccacatttctaccaacattctgattatgaccacttaagtaattgctaggaatttccacactttccctacatttcttcccttcttctgagcccgcatcagaattgcccttattgctctgttcatggcaatatggacttttttctagcctgttcctccaaactcttccag

SEQ ID NO: 187794 - DNA, 254 bp, Homo sapiens
  misc_feature (77)..(77): n is a, c, g, or t
  misc_feature (109)..(109): n is a, c, g, or t
  misc_feature (114)..(114): n is a, c, g, or t
ggggcgtctagaggtcccactgatgctcacgctccagccagtgagacacttttttaacagaaatgccaagaattatngctagacaggtagatactattttttagacaantattngctttataaagatattttccttataaatacatttagaatcataaattaagtgatgtagtttaatccaaaaaacttgtcctgtttcagaatgttatggaatgatttcatattttcttgaaaatatggccgggcgcggtggc

SEQ ID NO: 187795 - DNA, 619 bp, Homo sapiens
atgaggatccggactggcgattttgtattttaagtagagatgaggttctgccatataggccaggctgtctcgaactaccgaccccaggcgatcctcccgcctcagcctcccgagtagctgagactacatgctcgcaccaccacacctggcagtagttctaattttaattttttgaggaactgttttctatcgtgatcgcatcattttacagtcccttcaacagtgcacaagattgcccatttctccacatactcaccaacagttgtcatcttctgttttttgatagtagccatcctagtggatgtgaggtgatatctcattgtggctttgattttatttctctgatgattagtggatgttgagcatcttttcatgtgcttgttagctatttttatatcattggagaagtatctattcaaattctttgcccattttttaaatcagttgtttaggttttttttccagagacagggtctccctctgtcacccagggtggagtgcagtggtacaatcatagctcactgcagcctcaagctccatgactcaggtgatcctcccacctcagcctcccaagtagctaggaccacaggtgcacaccaccacatccagctagattttt

SEQ ID NO: 187796 - DNA, 386 bp, Homo sapiens
catttttgagcccctgcatttgagtatggaagataaccaatatggaaacattcatcaagcaataaatattcatgaggaaccgacaatatataatgtgctaccttaggcactgaaaggaagtcctaacagtggatatgtggctgaaattaaattttctgataaaattaaaaaaaaaaaaagaaaaaaaattagctgggagtgcaggagtggtggcatgtgcctgtagttccagctactctagaggctgaggtgggaggattatttgagcctgggaggtcgaggctgcagtgagctgtgattgtgttactgcatttcagcctggataacagagtgagaactgatctcaaaatataaaaattaaaaaaatgaaaataaagggccactga

SEQ ID NO: 187797 - DNA, 586 bp, Homo sapiens
attgctttacctatgaaataaattcccagaacttagaatagttaacagcaatctgtttcctagaactagctgccaggactacacctggacatctgttatttacagcctcattattgacattttgtcaatagttctgacctatgccatgtaatctgttatagtcatagcatgccttcctggaaattttcatttgcctctattcctattgtattatttgggttctttccatatttgtttgttcaagattctctcatcattaaaaacaaataaacaaaaacctctacttaaccctcctcatcccattactgctctacttctcttccttcataaccaagtattatctacatgcattgtcttcacatcctgttattaattccccaatgcattaaattctggctcatcgtcctactacttctcgctgccattgaagctcctctttccagagtcactggttacttcctatttgtgaaatcagtaggaagcttttcagtcccagtcctactggacctctcagcagctctggccaatgctgaccactcccccaatccagaaaccactcttggcttctgtaacagtccctggctcc

SEQ ID NO: 187798 - DNA, 478 bp, Homo sapiens
taattgcaggcatcataatcagtcatattgtatttagtataagttttggtattactgtcttgagtatacataataccataataccagccccttctttcatgttttattaaattctttccatatttgtttgttcaagattctctcatcattaaaaacaaataaacaaaaacctctacttaaccctcctcatcccattactgctctacttctcttccttcataaccaagtattatctacatgcattgtcttcacatcctgttattaattccccaatgcattaaattctggctcatcgtcctactacttctcgctgccattgaagctcctctttccagagtcactggttacttcctatttgtgaaatcagtaggaagcttttcagtcccagtcctactggacctctcagcagctctggccaatgctgaccactcccccaatccagaaaccactcttggcttctgtaacagtccctggctcc

SEQ ID NO: 187799 - DNA, 699 bp, Homo sapiens
ttgagaaaatggtgatatgtctggagatccgtctgtatgataaatatccttctaaaatattcgctggctaactagaccatggcatcccatgctataatgaatccaggtgattcctcagctgggtgtccgctccccacattcccaccataacccagaaccataaggacttaaggcacaagagaaaagtcctcaaatgacatttatctgaaacttaaagcacatggcccccaaaagtaacccatttcctctgaaatgggaaggttctgaataaatgtaaagaaacatcaccatcagctggtgcaactggtccacatggcatttttccaaatagaatcaaaccagacatagacccttcttccacaacacccatctaaccaatgaagcagatgtgtacaaatgttagtgaatgggcaggtttgttaagtaaattttaaaaaaataactgtaaaagaaatatggtttatgaagtgtggctagagtaaatctaagtgatgtttatcattctcatagttttatagagtttttggtaacagctcattaataattggggaaagagaactactggagtgctaataactcattattcaaattgaattattaacatgacaatcttacagcaaatgataatcccattttctctgaaaaatatatttgtagagaatgaacattagtctccattataattcatatatacacaca

SEQ ID NO: 187800 - DNA, 167 bp, Homo sapiens
tataggcatttattgctataaacttccctcttagcactgcttttgctatatcccacaggttttggtatgttgtgtttccattttttgtttcaaaaatttcttttttaatttccttcttaattttttcattcacccaatggttgctgagagcatattaattttcatat

SEQ ID NO: 187801 - DNA, 384 bp, Homo sapiens
atggttctggaggctgggaagtccaagatcaaggggctgctctggcaagggccttcttgctgcatcatcccatggtggagagtggaatggcaagacagatcaagaggggacctaactggccttttataaggaacccagttccacagtaatggcattaacccatccatgagagcagagccccatgatctaaacaccttttattaggccctgcttatactgttgcactggggatcaagttgcagcacttggacttcgggcaacacattcaaaccatagcaggcaccttaataaaggtggaaaagggatgtggcagctacagtgggagggaaaaggtggctcccttagtgtgcttgggaggagggtaagagatgcgtttgcagttct

SEQ ID NO: 187802 - DNA, 890 bp, Homo sapiens
acgtttgtcaagtgtgtattcacacatttacttaaatcaagggactcaatgcttgcttttattttaaccatcttttactatttttagaaggaaactagctttagtagtgggttgccctgtatgttttctctttttgctcttaatatgccattgggtttttgtgtgtatgtgattttcaaaattcatgacttgaagtgcaaggacagatctagatgttgtttaccaagctatgtgacttctcccaaaggatctgtactttctttccttacaacagcttgaaaatcattattttaaaatccttaaatcactgtgtctagatcattttttacattgtgtgccatagacttacccatgggacaacagagctccttcattttggacaactactgtaatcatttttttttaggaaaaatggaaggtgccgggggtaatcatggccagtcaataattatataaaggagttcaaatactatagctgtcagttgatgaatttgttatgtagtaaaatgtatgactttgtatgggtttcttcagccctttttctgccactagcaaccagaatagcactttaccttttggttggctagataagtggctgactacctgtttttctcactgtggtgtgattggctaaacaatctcgcattaaaaattcaaatgtaaattgaattcacatgaaaaatcatgtttggttgtaaacctccaatgttttgattctctaatcatgttttcgtcacatgctgagtaaaagtgccttacaatgtaaaaattgtacagtactttatgttcccaagtagcatcatcatcttctgagtagtaattacattgtggtattaatatttagaaaaatggacctcagcagtgtatttactgtacatctcttaagtcct

SEQ ID NO: 187803 - DNA, 988 bp, Homo sapiens
ataatagtttcagcttcatagggtggttgggagagttattaggtaaatatatggaatactcttaaaataatgcttggcacttaataagtactatgtaagtattgttactgttgtctggctcatatttatttttctgatcttagcttagagtttatatcttccttctgggaagtcctttctgcccaaagctgagttacatattcctctttgtgttgccacagattcctgtgcctcccttgccatgttgtattgtcatagcctaattgtttcattgccacaagttctttttctgcttccatcacatcatcacatccttcttgattggcaaatagtaactactcaataaatatttgttgtctagcacatacatacagttcaaacagaaaactaaaatagactaaagtatgaggaaatcttggtattggaacttaactattgaggtttatttcaaagaattttattttgcagcttcttttgtatagctttgaaactctaaaatatttcctttttttttttttagttgccatttcctttgagtcagcaggcctttcatctggaccttgacccaagaagttatgatttttctcactgtttcactctatctcccagtctgaaatagagcattgcactttttagtgtctgagagatatcatgcctttgcagttaaattctcttctgtggctttggctggaatgtgagtaaatttccagagaggatacataattcccaggctgaactctaaccttgtgaactattttaatgtgtggcctcataaatgtaaattttttaaattttagaccaaggaggtgcttgttgttctgccttaattgcaacttctatttagaaagaaaggatctcttggctttaagatagaatcaagaggtgatagtagtgagactcaagtcctgaagataaaaacagaaagggccaaaagctcacctcttggttaatcaggcaggtgtggaggttatggaaatcctcaaagata

SEQ ID NO: 187804 - DNA, 555 bp, Homo sapiens
ctgaataactgggattacaggtgtgtgctaccatgcccggctaatttttaattttattttttagtagaggtggggtttcatcctgttggccaggctggtcctgaactccggcctcaggtgattcatctgccttagcctcccaaagtgctgggattataggcaccagccaccatgccctgtatagcccataatacaatattatgagctaatactgtgtatgtacttacatgtatgtgaaatagtataatgttgattaaaggttacttctgataatttatgcatactattataattggaagactatccagaaaaaaaaaacactaaaaaacaagagtaattactaaatagtgagtagaagagataaaaaggaaaacttggctaatcatagtgcggtggtgtttacacctgattgcaactagttacagatttgtttcttctccactcccactgcttcacttgactagccttaaaaaaaaaaaaaaaaactataaattaacatttaatcaggaataagtcaggaaaggaggaataaagaaagaaagataaaatagggca

SEQ ID NO: 187805 - DNA, 211 bp, Homo sapiens
aagggaaaaactgagatctataaaggaagggtaatgaaatgtctagcagatatttcaatggcaaaaattcataatgcttaaaaaagaatcttcaccctatagtagtatactgagctaaactatcatacaagaaagaaaagtaaatttattttaagaaagtgggccgggcgtggtggctcacacctgtaatcccagcactttgggaggccaa

SEQ ID NO: 187806 - DNA, 349 bp, Homo sapiens
tgggttgaccagtgggtgtagggttgactggctgtgaggtagaccgtggcttcagaggctagatcataaagggcacagtggcttctaccttgcactcctggatccctacctgtggggacatcccactgccatgcatatcatgagaacactcgagcagccctctggagaggcccatatagacaagaaccaaggcctcttgccaacagccagcccagggcaaatcacgtgagtgaggcaccttggaagagatcccacagctcttcagtattcacgtgacctcagccttggctgataaatcttaattgtaacctcataagacacctgaggcagaacggcccaggaagccact

SEQ ID NO: 187807 - DNA, 500 bp, Homo sapiens
tgggttgaccagtgggtgtagggttgactggctgtgaggtagaccgtggcttcagaggctagatcataaagggcacagtggcttctaccttgcactcctggatccctaccttgtgtaataaaaattttggggatgaagagataacatactaggttaagtgacagagccagaatttgaacccagttctgtgtgactcagaagtctgtgctcttaaccacactgcagtctcttgagaaagaggcttgtggttaccatgaatacctgacctggtcggtgtatgagtgagactggcagaaaaacagtaatgcatccaggccccactgaaggcatctgtgaatgatgtaaggcttgcctcttacagctggctcctagatcccgggcctcaccaccacttgtgctccaccacacctggctgggaaggggaagggtccattcacacagagacatgtgcacacacacggggacccgtagactttccttaccaccacaccttaacatgg

SEQ ID NO: 187808 - DNA, 684 bp, Homo sapiens
accaatttggtcatcagaacatggattggtgagcatggaaacagaacaaattacctgcattggtttgggggatggtttactcaggccatagtaagtctaggaagttcttcctgctctatttctgctgtttggatattcatccatcagttccatcagtactattttttagtatctttacgatatctttagtcttttggaaagtaatagacaaattctttccttctcattttttcccccaatataatgtgtacagactacttctgttagaaactcattaagacatatattattgtcattattttgattgataattatctgctgttgctgacagtttactcttgatgaaatttgaaaacaattcaagtctttgtaaaactgtgatacagattctcttccttttttgatgttaacatcttgaagaaatctgcaaggtctctaatggatagattcagccctttggtgttgtggctttagattcagattctggttctgccaccaagtagctgagtaagttgcacatgccacttgatctctttaagcttgtattttcttattggtgtaccttctcttgtacggatgatgaggcaattatgaattaatgtgtttaaaatatctgagcagtgcaaaagaaatgtatttgtataaagtcgatccattcatccttttaacaagtattaattgaac

SEQ ID NO: 187809 - DNA, 425 bp, Homo sapiens
gaacctattgagtctgatgcaaagcaaagctggatggtatgacatgagctttcgttgactctgccactgccccacaacctagatgtagttttccctaaaaggctgcattgataatttcatctttagacactggaactttcagaaggcttccaaatgttagttaaaaagtaaatgtgagtaggctgtgacccaaatgcacattaacgatttttaatatacattttgttttgttttgtcaacatgacctttaattaccttccagtggtaattttccttttcatggtactgtgtttatgttgaacaaaagcctcagaagagatttcttctacataaaagaatgaggcagttttgatttggggattaaaaaccagacttatttgttcttagatccatgtctcttaaaaaggttgactcaggtttctgtg

SEQ ID NO: 187810 - DNA, 219 bp, Homo sapiens
agaggactggaagtgataaatatgcgggtgactataattgcttgtattcttcaaaaaatcaaataataagacctcaggcacacccaaatctatggacattctatacctttttcttcaaaaatgtcaatgtcaaagacaaagaatgtttaaagatctgtcataaattacaggaaactaaatagacatgccaactaaatacaatgagtgatcctgggctgg

SEQ ID NO: 187811 - DNA, 664 bp, Homo sapiens
gaaggcattattttcttctttagtgcaaaggactgattactcataacttgcaagaggcagtcaggctgatggggactgttatcttatatatatatattgctaattagaaaatctttgagactaaaagttttgagccaagttcaataggcataaatgtaaagccccgtgtctagactttgtaggcgaactccagaagtccaggaaaggagagatgttgtttaacagcaattcatttgacacagaaatgagagtttgagctgttttaggaccttaatgagtctagaatgttaatactgtctccctgcagttatagaagctattcccaccatgatggacaccagttagacaactgctaaaatatccttatttcagaaggtggtcagatggtgaaaaccatatcatatgatcattagttagtagcgatgtaaatattttcagatggttgaaggactgaaccataaaattaggatagttattttgtgtgatggtaatgtgttgatgaattaggacctgggtaaaagttactgggaagcaaaccagttttggcacaataaaagtcaagaacttttaaagaatcggagttttttcagaattggaatagatggttctgtgagttagtatcttgtcactgaaattactcaagaattgcagggtgattccatga

SEQ ID NO: 187812 - DNA, 171 bp, Homo sapiens
gtgctgagatattctcagaggctgttatgcttattatgaggaatcaggaatgcattgtagctgtcacattgggttctgatgaccccatctgggggccgaatccctattgtaactgtcacatttgctttaagaacacgctacttgtgcatcccctgatttcccaggaacagg

SEQ ID NO: 187813 - DNA, 399 bp, Homo sapiens
tgtgacattctccaaagaccacaatagctctctagcatagattctaaccaaaataaaaactttgaaatgacagatagagaattcaagatgtgtgttataaggaagctcaatgagaacacagagaaagttggaaatcgacacacacacacacacacacacacacagaaaaacaattcaagagatgacagatgagatagatgtatttttaaaaaactaaccagaaaacctggaaattttcaaattaacccacttagacaaaaaaagaatttaaaatactgaacaaattgtttgagatatatggattatgtgaagcaagggagaagaaaaagtaagaagtttgaaaaacatatttgagggaataattgaggaaattttctccaatcttgctacagatgtata

SEQ ID NO: 187814 - DNA, 578 bp, Homo sapiens
agctcagaagtaaggagtggtctctaatacaactgtctcataaaagcaatgagaaggtatataaaatattttagaatcatccttggcataaaaaggatttccaatgagcacattttataaggctgaatttatttctaacaaaaccatgtgtacaaagcattgtcatgatagtttaatgagagatggcttaagggaaaaagtgtaaaatcgtaaaatgagattgagttttacccttccagggagtcaaatgaactactttaggagtataagttaaacaccctggggggcttttgtattttcagacaactatggagaaagtgaaaatgcttatgaattaatactgaggttctttgacagtggtttgtcttgggaaccaagtgtttggcaagttagcaagtgtggaggctgggggccaatgacccggcttggggacaagggcccagaaacaacccctttctttaggatgccggtgtgtcatgttttgtagtttctcctacaaatctgtgagttgtgtaacatatggaacattcactgcaaacagtgctttggtgatggctggatgagagagactcaaggtt

SEQ ID NO: 187815 - DNA, 510 bp, Homo sapiens
tcctgacctcaggtgatccacccacctcggcctcccaaagtgctgggattacaggtgtgagccaccgctcctggccttataaatttggcttttacacacacccatacgtacacacatacacacatacacagattggcttaattttttttttacttctacttttgtacagttcctacaatctacaagcactgtggctattggcagctgtcactgataccaaatagaattatctttagctcccaccctcaccctcacactcaaaactgcacacatgcaggacagaagcctgggcttgttcctttttctctcgctgtctcagctcccaaggctgagattactctgcttcatctggatcgcccatctctggggtctcatggctgagtttcagttccccaatcctacctgctcctcagggggccagcactggggctgcaggtaatattttgggttggcaggcagggatgcctgtgggacagcaaggtcacccctacatgggtcccagggtgggag

SEQ ID NO: 187816 - DNA, 514 bp, Homo sapiens
accaattactcaccctccttttagtagcagccattaatattctccattaatggtctctttccaaaacctagtccctcagaaatttccttcaccaagactctcctttgaaaatatctactcccaaaggtctacactcatctctttgagcagcatctttcctaaatatgtgtaataataaatttagccctggctaagaaacttgaagaagtgatcaaggatcattttaaagaaaaatgataaacaatgaacaaaaggcaacctgagtctgaagagtttaataaagggctcaggccgggttcagtggctcatgcccataatcccagcactttgggaggccgaggcgggtggatcacctgagatcaggagtttgagaccagcctggccagcatggtgaaacctcgtctctactaaaagtacaaaaattagcagggcgtggtggtgcatgcctgtaatcccagctactcaggaggctgaggcaggagaatcacttgaacctgggaggcggaggttgcag

SEQ ID NO: 187817 - DNA, 979 bp, Homo sapiens
aaacccatctctactaaaaatacaaaaattagccgagtgtggtggtgcgtgcctgtaatcccacctactcgggaggctaagacaagagaatcgcttgaacccaggaggcagaggttgcaatgagcccagattgtgccactgtgctccagcctaggtgacgagcaagaccttttctcaatggaaaaaaaaaaaaggcaaactgaataaatcataagcaatgagatatttacactttagcttttaatatatgaactgttgaaaattgaggcctgtcatgcattgtaaaataatgagcaaaaaaagtttaggctccagaattctgatactgtgcctggatttgaattccagtcctagcacttaccatctttgtggcattgggcaagtttcctaaaatctctaggagtttctttaatcataaaattggaaaaatggttataatctcaggttgtcatgaaaactaaacccaggatggcttatgttcttcacttgtcatttagtagatccccaataattattagttatctttccttctttatatattaactttttattctttcattcagggactttttttccttttaaatatatgcaatagttaaacaagtccctatggccctcatgagactgtatttacccattatgtttctctattggatcttttctatgttgttgtttatcccatcctattaaaaaacatgttatgtattccatcttaaaaacgcttttgacctttacatctctctgtagctactgcctctttcttttcccagactattgtctaaattcaattttaacctcagttcctatcctcttataacaagatcctcagtgacttccacattactaaatccagtgattagttctcaggcctcattttactttatttttcaggagcatttattgattctgccctcttttcttgaagctttttctttatttggcttctgggacacttcgttgacctttacctcctacttct

SEQ ID NO: 187818 - DNA, 917 bp, Homo sapiens
tctactaattactggctttgtgtcttccagcaaatgatttaatctccagtctcagtttcctcaactataaaatggagattatactacctattgtttatacgaagcttgcacatagtggataatcagcaaatattaaaaatcctctgctctctctcattctacaattccttgagaagttgaagcacagtgggagaagaaataagctcccacccaagcttttgctcatctgtgaggagtcggtctgtggtatcgtcagaggagtgtgaaaggaggaattttcttgagacattctccatgtagtctccatctttcagactacgatcatgtaaaggaagccaagggttttcacatacaccatcaccactccacacatcacctaccgttcttgtcttgaaaggttgatgtgtgttgcccagtggatgttgagccaatcagagatagaaggagaaaccttaggcaaccacctcttttttccctcactacttatatgggatgagatctgcgagcatcccagaacaaacctcgaagtgtaaacagtattttgtacatccagagagaagggtttcaagatagctgactagcgacacctggcacttctgcacaaagaaggaccaaaactgaacaatcacataacaagtggagcttctaagagaacaatggaattcatcagagaagtgacagggaacatctgaggcttggaaggagagggaagcaaagcagctggtccagctgcaatcagctcggagccaggagaaacccccagtgcagagagaaggtaagcaagagatcttcagcagtctacattgccacactgactcttacagtcctagccacaggagagcccctcagcccttgtgggccctgagactagtctaaggagcatcctcaagtcctccaatgccattagtccagagaag

SEQ ID NO: 187819 - DNA, 913 bp, Homo sapiens
tttggtggtgatgctaggaaagcaatttttctcaaaggcttggatgtggacactagtctggtatctaataattgctgcccactttttcctgacttcttgggagaggcattcatgagtccaaagctgaggtcaaaatcacttctgtcttatctgacattatctctcaaagcaaatctggattctagcctccagaatgcccatttcttgggccagtttttcactggtaaatctgcaagggtacaggttccatttaaaccatgctggttgggtatccttttgacttggcataaaatacttctccttcattatgattcacttgggtgaaagccaacagaaagtctggaaagatccactgtgaaaagatttcatctggactccacagacaccgctggccagctctcacttgcacaggatttccgcacaccgagccagccccagcccttgcttcaatattttcccactccagctcattaaacattttagttttttgttatatatttaagacactgaagaaagcataggaaaccagcaaaaattgaattttgctggaatttaagtttgagagcagcccgcaagaggaacacattgggtgggtagacatgttgtgctttttaatttttttcctgtaagatagtcaacaataattaatttgaacaagaaaaaaatggttgtcatacatatataaaagtaaagtctagaaaaataaaaagtttttgttttgacctaattcagattatataaaaatagaaatcacagtatttgtttttacatattttgaaaattaaataaccttgaaatgataaagtgcagaaaataatgtgaataataatgttgagttttctagtccctcttctgatccttcatcctggtagcttatatcctgttttgctgcataataaataattttattctc

SEQ ID NO: 187820 - DNA, 472 bp, Homo sapiens
cccttagttggctgaggaaaagatctcgcaagtattttttcctctgtggagtaaggaaatttcttcctggtttgggggaaagtcattttaaaaaaagacacttggtggccccaaagctagaagttatttctctcttaatgaactcactttctatgaattaagtcaagagcttattctccttagcgctcaaaagaaggcattgatctccctattttgtaactgctcagaaggaaatctgtgttcctacaagatcctgattttttaaatgggtctggatgtaaaaatgtttggcaatggaatcttgtttttgcccaccagggtcagtcttcaactcatcatgatgggaagacatttccttttcacagtcggctaccagccttcttctaattagccaaatagggcaaactcttctatctcacccataattttaagcacaaggtgatgataagatatatttactgtttttaaaaat

SEQ ID NO: 187821 - DNA, 326 bp, Homo sapiens
ggctagaccagtcgctcatttatcacttcaagagatacttattgtgtgcctactctgtgccagacactggattagacagtggagaacaagacacataagacagctacaaaacccctgttctagtggaggaaggcagacagtaaagaagcagaacaatagagaatgtaagagccaagtcacaatgaatgctattattattaagtaaaatcaagataagggggaggaaggacaaatctcctctacagaagaatgccaaataatttatggagatacgcgaagacgtttcagaacctaatgtcccattctctaagtgtggcctgtgttta

SEQ ID NO: 187822 - DNA, 608 bp, Homo sapiens
aggcagagtgtagtgaatagggaaaccccaaagtgagagtgcctgatgtgtttgaagaactcgaggtgtggccagtgtagctttagaaaagtaattgatgggaaatagagagaatggagggtacagatattttgatcataataaggtgtttgatttttacctataagtgagatgggaagctattggaagtctttgagcagagtagtgaaaaagtatgacttatgtttagcaaggtcactctggttgctgtgttaatcatagactgaaaaaggggacaagggcagaaacagaccaattggtagaccattagtacagattaagacgtgactgaaatggacagagtggtcacagtgagggtggtgagaagtggttgaattcttgatatatgttgaaatagagtccataggatttggtagtagaccagatgaaagtgggaaataaagggaggagtaaaacatgatgccaaagttttttgaccagagcagctgagagaatggagttggataattcttataaattattgcattaaatctgtgcatcatatcacatgcccacttaactacaggtaattttaccatataagcttgtggggggaaaagaggaaaaac

SEQ ID NO: 187823 - DNA, 110 bp, Homo sapiens
gaaacccagtaaatgtttgttgattgaaagatattaatactcttgcttggatgagagtgaggaaaaaggtattagtattggcttttcacaacgccttgtacggtttcttg

SEQ ID NO: 187824 - DNA, 568 bp, Homo sapiens
atatttgatgtgccaattatgcacttcattttgaggaattactactatttatagacccactttttaaaaaattatcaatgattatttttgaattgtattcagacttttttcctgttctagtctgaaatattacttctctaatattttggttaatatgaataatagtggcaaaatggcattttagaattattaatatttctaatattttaacacaagtttcaggaaacttggttttgattgttcacatttctattctaaaatctcaggttatctcctgaacacttttgggcagatgaagttttataccaaaaaatagttcttagagtgaattttaatttacatagaactcaatcgaaatgaagatttaataaccagatttctttctccaaaacatacacaatttgttattttagtaaataccttttttttttttttttttttttgtggtggagtcttgctgtctccccggctggagcgcagtggcacgatcgcggctcactgcagcctccatcctctgggttcaagcaattctcctgcctcaggctcctgagtagctgggattacaggc

SEQ ID NO: 187825 - DNA, 347 bp, Homo sapiens
catatttttgctatcaggctaacataaagtgctgctactgactgagccagcctaatggaatggcatcactgtttctgttggcatagttaagcagggggttaaaaattcaagtttttgggaaggagtttttttttttggagggatttcttttgcaatacgcaaccttcagacattccagaaagtaactgtggatgcattttagggtatagccagtgtcctttgcatctttcagtctgataggcaaaatcatattttagattactattaaaacagcatgctgatttattcatcttgtccttccttttaagaaatatatttcagaaatgctagtaacatcttgctcagca

SEQ ID NO: 187826 - DNA, 342 bp, Homo sapiens
cagcagcatgtgggtcacagtggggcaggttttccctcagaagctgaagtcctttcagccgtccatgtcaaaggaacagaaaaccaaacaggtgcataacccattttctgaccctaccagttagaaggtcaggcaaattaacaggttgaatgtgagaaccacttaaatcttgattctttgcttagaataccttctaatgatacaacgctatgggtcctcagtcaaatacaatctttaacgctcatgcaggaaatgcacttagagatagattcgcagaagcaacttcagcaggcagcatcccaagatggccccaagccacccccaccccgtacatgcctaaca

SEQ ID NO: 187827 - DNA, 377 bp, Homo sapiens
aaggaaagaactcccaaataaaaggaaggcaaagacccttcagtaatcatctggatttcctagtcagatgtctttccccactctgcaagcgagtctcacctctgtaaatatcctttaagacagtatgaactggatataaaatactatttctactctggaactgggactcaatttaaaaagtaaactccattagagctaaagattatcccaacatctacaacatttaatcctgtttgcccactaattcaaaataaacggctaaagatgtatttttatttatttatttttgagatggagtctcactctgtcccctaagctgaagtgcagtggcacaatcttggctcactgcagcctccgcctcctgggtttaagcaatt

SEQ ID NO: 187828 - DNA, 172 bp, Homo sapiens
atgacaccacccaaaatctcactcctgtcttaggatcaggctctggctgcccccaggcactgcctgttggtatctggaatagcacaagggctggccgctctgggattttcctctttaggggtggggacagtagggcaatgagtgaaacgagtagtcagtgatcatggaaagt

SEQ ID NO: 187829 - DNA, 294 bp, Homo sapiens
ggtgtctttccaagagcaaaagttattaattaatttagattaagtccattttaaaaatatttttcttctatggtttggtatgctaagaaatctgcccttccccaaggttgcaaagattttctcttttgttttcttctgtaagttttagtttttgtgtgagccattctgagttcatttttttgttgttgttttatatgaagtcaggttaaagttatttttctcatggtaaaagttctttttctccagttgtagcaccatttgttgagctgactcttatatttctccattgaattg

SEQ ID NO: 187830 - DNA, 537 bp, Homo sapiens
gtaaaatactgacatttggatgttacactaataagaagccctttcgtgcagatgaaaggacatgttatgcacagacaccctctgagaggttctcaagtaagagacaggtaacaaccacagatatgtgaggaaaacctccaaaatgaaagcaagagcttataaaatcaaacagaaataaaaaagaacctggaagaaacaaagcaatgcacagagaaggccaaagttataatttatatccttagaaggcaaaacaaagttataatttatatccttacagcaaaaagagaaaatatagcagccatatagaaagcaaaatagaatgctataactcatcaacaacagagaacacaaagtcgctctttgaattaaaaaagtagaatagcagaaataaaaaaattcagtaggaaggttggaagataaagcccaggatatctgctataaaaacaaataaacagatgaaaatattttttaaaaccgaaatataagaatgattagaattagattaggatctgtcaggggagaaggggtaccgagctc

SEQ ID NO: 187831 - DNA, 988 bp, Homo sapiens
aaaagccaaagaagtaagtaccaagttcacgtacaacaataaaaagctcaggaaccccccaactatctcactgacaaaccttcaggaagccctcctgagttaatacctaaaataacaccaagaaaaagctgggactcttccctggcggatcttttgaagtgagaaaaatcttttgtaaccacttttactgaagatgtgtaatgtggtttagaatgactgctgatactaaggtttaagaattatcttactttcccttatttatccataatacatattattttctctagaaatcctaaggaattttttagtactaatgtaataaaaggatttggccaaaccatgaaatacatgagaaatagttttcctaactatagaaaaccatatgctatcatagttatgaaggaagattatggatttcatggtatagacaacttaaacagatgtttatcaacacttcctgcagtcctaaagaaaaaaaacataaaaaaaagtcagatgatctcaggcttcttaaattacatgatgaaagactgccataatcagaaataaagtttaacatcaacatccttcagcctaaaacttaccactttttgtccaccaccaccttcctctttcacagcatgggctagtccactgcagaaatgtgttttactattttgtggagtgccagaccaagcagttatacagagacacaagaaaagcatgctcataccgtttatataatggtacccaccatgcaggaagagaattcttatcactagccctatctttgaaaccatgtgaaagacaatttaatagaaagaggcctaaaatatatctgcatagagtaattcagaagggaatgtgcccacaaccaaggcttgcctatctcagattcaacatggccagcagtttattttaatccgtctccccatcaccatctttaaattaagacacttcctgtttttaacccagtctcattgcttgcacacactgtgccaaatcttaa

SEQ ID NO: 187832 - DNA, 195 bp, Homo sapiens
cactcgtcccctttcaagacctgggcagaagcaggaagcagataagattggggtgcagacaataggaatgtgagagggcattgtggccacagaagggcagacgccataagagaatgggcaacggagccatgagcataatgcttttcagtacgataatagctcctgtgccaaagaccctgggcagtgtcaggatag

SEQ ID NO: 187833 - DNA, 355 bp, Homo sapiens
aaactaaactgaaagttctggcaaagtagaaagccatccacaacatttctggtgtacaaattaaaaagacttacatcctgagccataccactcattttatgaaggtatctctattccttggagattaaatcaagaaagtaattaacaggaatcaacagaacaacagtaaagtcacctggcacccagaagggcacattgtttgcttgctaaaggagccctccaaactctacagctgagaaagcatacaggggccctagagtcagcattcattccaaaaacacaggaatgatggttgctatttctgcttaatagatcaggacctcataaatgggtgtcatcttcactggacgaatca

SEQ ID NO: 187834 - DNA, 319 bp, Homo sapiens
gggggggggacaaaaagcacctaccgatctgttttccataaagtatgttttctcatgatttatgctaagccggagatgccattattttctttaacaagtgttacatgataccaattggttatatgataccgataaccagtttaagttagagtccattcaaaaccaccaggcatttaaatagaccttactttgaacttctaagtgcaggatctaaaaccactagtgaaatttctggagtcaattagcaaatcccttcatagaaatttctatcactgggtcttcgtgagcacaccttgcatctcctgaaatcccaattgcc

SEQ ID NO: 187835 - DNA, 322 bp, Homo sapiens
agattgtgaaaaaaacaaaacaaaacaaaacaaaacaaaacaaaacaaaacaaaacacaaaaactactgtgatgattagaagcactctgagattcttgggccaaaaagcactcgaaaagccccagctgctggggttcccccttggtgggaggtgcagggcacagtgtgattgggagtaggccaggaagctgctgatgccactatgcatgtgctcagaggggctgtctagtcccaggccaccttctaagagtcactctaatgagaccgattctccaataggctacactggacacacagaacacagcagaggaaaaacacacac

SEQ ID NO: 187836 - DNA, 641 bp, Homo sapiens
ataaagcaatactgctccaaaatataccgtgaacattagtaaaacttaaggaatactcccagtatattgttcgaatgtccacagtcgacatgctgtataaaaactaagtcattcacgtcatggtgcggtggctcacacctgtaatcccagcactttgggaggccaaggtgggtggatcgcgaggtcaggaattcgagaccagcctggccaacaaggcgaaaccctgtctctagtgcaaatacaaaaattaagctgggcacagtagcccaaccctgtaatcccagtactttgggaggttgaggtgggcagatcacttgaggccaggctagtcttggaatcctgacctcaggtgatccacccgcctcggcctcccaaagtgctggggattacaggtgtgagccactgcgcccagtcttttttttaacatattctggcccttgactaacagaagtttgttcaatatcctcatctataagatgggaatgctaatagtacctatcttatagaattgttttaaggagtcattggattagtatgtaaatttacacacttagaatgatacctggtacataattaagaactcagtatagggttgtgctgctgctgcagtccagcttcactgtctattctgatcttcaaac

SEQ ID NO: 187837 - DNA, 348 bp, Homo sapiens
acatccttacttcatgaagagaggctttgtgaaagattttaacagaaacagcaaaacccacacatccagaggagcattagcctcttcaaagacaacacacttcttattataaaaatgcccaccaatgctctaaacattttaggaacaactcttttaggactgccttcatgcatataacattcctttgaaattttcaactgtggcaaatttggttatttgaaagtggaatttggtatctgtaagctggaaagtacatttagaaaatgaagagaatcatcaaactgatttttttttttttttttttgggaaaaaggtttcatttttgcccccaagctgggggggcggggg

SEQ ID NO: 187838 - DNA, 263 bp, Homo sapiens
caagtaaaaatttccaatgcaacatacaggatatactagtatattaatctaatgaggaatgacttttataataagtaagctgaatcctgaatgactgaaagtttgcttaatgaagagatgtacagaagatgggacaggcattggagtaaaatgaaattcactatagtgggatagagtggttgttggtgaataattgagtagctaaggacagcactgttgctatacagtacactatattactgtcatccatcagctacctcagc

SEQ ID NO: 187839 - DNA, 285 bp, Homo sapiens
ctttaaagttttaatcatactatacatatatatatggttttgattcctgctttttcacacttaacacatcattagccttttcacatttctttaaatatttgttgaaggcagtttttaatggctgtgattattctaatataaatcattctgtgatttagcaactccctttttactatgcatcaatgtgtttataatttatcactattataaataacattgtgaagaatatcattttatgtaaatctctgggtacactgaatgttttctaggcataaattcataaaa

SEQ ID NO: 187840 - DNA, 340 bp, Homo sapiens
agctcaaatttgggagcttatgagcagatggaaatatcaaacttgagagtacattgggtttaaccacatttattacttctctgttgtataacacattacccagaatttagtggcttacaacctcaaccacaggttctgctgatcagaaatgtaggcacagtttggctcagtggatctaacttatggtcttttacaagattgcagtcatggcagatttttcagccccagtcaagtattcagatgacaatacttgactggggctgaaacatctgcctccatcatgtctcagtcatgtgactggctaattggtacttcccttcctctcatgtgggcttctcta

SEQ ID NO: 187841 - DNA, 431 bp, Homo sapiens
actcctttgactgacagaacagactctcagcaattaagacaccaactccaacctgactggtctaacatcacatgggagataacaagccctaaggaaatcaaagtatcttacccccaagtatatttttgacatagtttggaatggccctgcaaagccatctcttgttgggaaaatctatgtcctgcagagattcccttccctttctaggccttttcctgatttagaggagatttaactaagagtctgacaccttagagacatttaccatctattctcttgaaggcttcatctacgtaacatgaaccttggctttcacaacccaccttatcttaaacccaagctttccttctgctgacttttaactctttaggcaaagtttaactttttcagccaattgccaataaagctttttaatcaccccagttaccctg

SEQ ID NO: 187842 - DNA, 420 bp, Homo sapiens
tttttatgtctgtatttaagaaataagtagggttccctttttgcaaatgaatttccaagtttctctgtgctttctcctacttttcatgtacatctatctctgatcctacctttgatcagataggaaacctacatttgttcctcaagagttaaaaaatacaggtggtttttttcttagccttctgcagtgaatggttagttttttgaccacctagtctctctctgacttccaatctttgtttgcagtttgtcaattagtgctttgaattacgtgatttagcttagtaggcagcttccctaagcctggaaaaagccgttgaaatttgtagtcagttgtgtaacttgtcaaagttagtgaggaagaaaacgaaaagtattaactaaagagaatacttcagttgtggtactaaagtattcttga

SEQ ID NO: 187843 - DNA, 896 bp, Homo sapiens
gggtctctgatgcctttgccagataaaccccaggctcatggctggcgcctgttttctcattcttacctcattaagagtagtaatgaaaaacatgctcagtgctgaccgtgtgcctgggggtgttgtaggcactccacttactttaattcatttaattttcacaataaccttgtttttacttctagttgttatatgaaaaaactgaggcaaagagcaatacagagagttgcaaaaattcataccgctggtccaggtttgaaccaaacagtctgcacctggagtccttgtttgtaaccatggcaccctgtcttcacacatatctcatcgtggagttccatcttgtgttaggcatggcactgagcagcttcttttaagaacataatttgtagccaggcgcagtggcttatgcctgtaatcccagcactttgggaggccgaggcgggcagatcacgaggtcaggagatccagaccatcctggctaacttggtgaaaccccgtctctaataaaaacacaaaaaattagctgggcatgatggttggcgcctatagtcccagctacttgggaggctgaggcaggagactggcatgaacccgggaggtggaacttgcagtgagccgagatggcgcgactgcactccagcctgggcgagagagcaagactccatctaaaaaaaaagaaaaaaacatgatttgtaattatgtaaattactaattctacttcaaagtgccacacagccttcatgtgataaaatgaagcaattggtaagtctaagcattgagaaaaaacattatttttcccagctccattgcaacagttgggacagtgttttctctgtgcctatagaaacctcagctagtgtgccgaggagtctggtccctttggggaatgtggcagt

SEQ ID NO: 187844 - DNA, 797 bp, Homo sapiens
gagagcaagactccatctcggctcactgcaagttccacttactttaattcatttaattttcacaataaccttgtttttacttctagttgttatatgaaaaaactgaggcaaagagcaatacagagagttgcaaaaattcataccgctggtccaggtttgaaccaaacagtctgcacctggagtccttgtttgtaaccatggcaccctgtcttcacacatatctcatcgtggagttccatcttgtgttaggcatggcactgagcagcttcttttaagaacataatttgtagccaggcgcagtggcttatgcctgtaatcccagcactttgggaggccgaggcgggcagatcacgaggtcaggagatccagaccatcctggctaacttggtgaaaccccgtctctaataaaaacacaaaaaattagctgggcatgatggttggcgcctatagtcccagctacttgggaggctgaggcaggagactggcatgaacccgggaggtggaacttgcagtgagccgagatggcgcgactgcactccagcctgggcgagagagcaagactccatctaaaaaaaaagaaaaaaacatgatttgtaattatgtaaattactaattctacttcaaagtgccacacagccttcatgtgataaaatgaagcaattggtaagtctaagcattgagaaaaaacattatttttcccagctccattgcaacagttgggacagtgttttctctgtgcctatagaaacctcagctagtgtgccgaggagtctggtccctttggggaatgtggcagt

SEQ ID NO: 187845 - DNA, 817 bp, Homo sapiens
tttgaaacgcttagaaattgtgccctgagagataagccctcttttaatttgaaattgctgatgtcgatgttaacagaagttcatcatcatcactgcgggggtgaaatcgctgacatttggcgaaatccgcctgctttgcagaatgcgcgtttccttccacacatgccaggaatttctagcgtagctgggcctgtctcagcctgggcaggaacagagtgagggtcggtcctcctatgcttcccgttctgccgtgtgatgcagaggcttgtgtttgtgtgggtgtgtgcagtctcctcctcacccctccacaccctggttattgactgaccagaaatggcctgcagttcttttgggagatttcatccacaccataccttttgtttctgagtccatggtgaagaatacccatggaaaattgtgcagttagtgattctgtgatttttgttaacaattccaagtccaaaagaatgcagcttgcactaaaacgtaacagtccatgagcctatcgtgccctcttgtgttttctacatcctgtgagctaagagctgtatttacatgaacattatatgaagatgtcctacttcagttccatacgtagtttgagtggaacatggccacctccatctgttcacgtacatccatggctgcttccacccacaatgcaggggtaggtttggatggttgaaacaagaccttgcagcctgcaaaaccttaaatacttactatttcattaagaaagacctcatatcagggtactgctggccttgtaaaatgagtttgaaagtgtttgcatttcttcagctttctggcagagttt

SEQ ID NO: 187846 - DNA, 464 bp, Homo sapiens
tttgaaacgcttagaaattgtgccctgagagataagccctcttttaatttgaaattgctgatgtcgatgttaacagaagttcatcatcatcactgcgggggtgaaatcgctgacatttggcgaaatccgcctgctttgcagaatgcgcgtttccttccacacatgccaggaatttctagcgtagctgggcctgtctcagcctgggcaggaacagagtgagggtcggtcctcctatgcttcccgttctgccgtgtgatgcagaggcttgtgtttgtgtgggtgtgtgcagtctcctcctcacccctccacaccctggttattgactgaccagaaatggcctgcatgagagtgaaagcagccctggatgtaggtaaacagatgggagtggccatgttctagtcaaactttgtgtttggacactgaaatctgaacttcaacacattttcacatggcatggaatctta

SEQ ID NO: 187847 - DNA, 342 bp, Homo sapiens
gtccatgaaactgtggcaggttagttagcttgagagtagggtaaaacctcagacttcacaggtgctgttgctgttgtttaaagaaggggtctcactttgttgcccaggctagtctcaaatttcctgggctcaaatgatcctttcgcctctgcctcccaaagtgctagaattacaggcgtaagcagcagtgctcgctcagccttcatagttcttgaaaaaagtaatttgcctaaggtctgacagctagtaggtagcatatccaagattcaaacccaagctgtctgactcagaaacctttttaaactctctgctataccacagtggttctcaaagtgttgttcc

SEQ ID NO: 187848 - DNA, 482 bp, Homo sapiens
agagcattagtatatactgatgtggacatgagtgagtgagtgacagaattctctctaacttctgtcttcattggacttgtacatttttataataatatctgggtgggatcctgtgaatcagcggagaacaaatgaacaaaacaaatggatgaattaggaattgttagtggaagcagaacgccattgtcttcatatgaaggaacatatgccgacaatttagatttgtaggcgtgcactttctgtaatttgtttagtagcatctgtggatactccttacaatcgattccatttattgagtctgtgccaggcactgtgtggcattcgttttgtgcattacctcatttacttctctttgacaacagtatccgatcagtattaccagtatatatcagagctggttcccatctgcctcgaatgggattatttcttgttaatcaaatcatggcccaagggctgcgcagcagtgtttcatgctatttcac

SEQ ID NO: 187849 - DNA, 197 bp, Homo sapiens
ctcaggcaacaaattgtaatgatttattattagatttttttaagttttgaaagccattactgtccatattctctttgtgttttatttattggctcatgtgtttgtctgaacaacgcaaggccagagaacacatctgatttgtcattttatccccagcatcaagcacacttgaattattatcataataccaccaatgt

SEQ ID NO: 187850 - DNA, 223 bp, Homo sapiens
gaatagaaacagaacaaaaaaaacaatgaggaggatggtccattttctttctgcactagtgggaccagttgataagtgagcttgtccagaggacttgactaagatgcttaggaaattagaaaccatgatttgaggtgcagttgaaggtatggagagaggaaaacctagagccctcattgctgttgaaagactatcatgtggaaaaggaatttgacttaatatt

SEQ ID NO: 187851 - DNA, 305 bp, Homo sapiens
catatgtgagatctcccctacagcaatgctcagctcccgaaggagggcaatgaggacacagccaggacccttactgattccactcctagagagcaccaggcccatttaaccccaaaccaagtctaacttaccaacgcttgaccactcctatccaggaacatgttctttactcacttctcgcctagtgacttcaattcacaagcaagaagtcctttttacctgaaagccaaacaattcctccctgcttactcattctcccaagaaactaactagaagagaaagcatcagtgtctaaaatgctgatc

SEQ ID NO: 187852 - DNA, 316 bp, Homo sapiens
gaaactagctgttaaaggcttatcttaaataattggattgcattagagactgagtcttataagcaatgttttagggggagcttttgtttctagtttactttattggtaccaaagggttaaactaacaggtgctgtattaaaataaagtcatgtttgatactctgcatttcctacagcgttggtttcaggttgattttctctttccctatagaattggagctatttccccccacctcccactttttattatcaaacaatttcaagcatacagaaaatttggtaatagtaaaccacttgtatcttgaccctctagatt

SEQ ID NO: 187853 - DNA, 271 bp, Homo sapiens
tgggccacattttccccctcatcttaacccccagatgtgccaaactcaggcagccctggcctagagcacccctggtagagtcaagcctctggcctcaggacggtgatcccggggatcccacccctttgaccgcctcccccatcctgcatgaacctgggcactcccagagccaggccctgatggctcatccctcgccctgaggcattgggcctcaagggcagctggagctatgaccgtgttgggagctttcgtgagctgtcaggggcatgtt

SEQ ID NO: 187854 - DNA, 597 bp, Homo sapiens
ttaactatagtcaccctactgtgctgttgaacaatataaattattccttctttcgagctgtaactttgtacccatcaaccaacctctcttcgtgacaccgtgtcgccccaacccctgcaacttcccagcctctggtaattatcaatcttccttctactcgcatgagatcaccttttttagctcccatatattgctgacaacatgtgatatttgttttcctggcttatttcacttaacataatgacctcgagttccaatccatgttgctgcaaatgatggaatttcattttttaatgttgctgcaaatgacggaatttcatttttttaatagcgaaacagtattccattgtgtaagtatgtctcattttctttcttcattcattcattgatagacacttagatgattccgtatgttggctattgtgaatagtgcttcagtaaacatggaggtcaagtgtccctgtgatacaccgatttcctgtcttttgggtaaatacccagtagtggggatttagtagtctgatttagtggtcagtttttttgagaaacctctatactgttttccataatgactgtagtgatttatatatccaccaa

SEQ ID NO: 187855 - DNA, 205 bp, Homo sapiens
aacttacgataggccctaagatcacactgtgtgggcttgaaaatcacacagcagcatgtttacaatatacagacccctggtaaatatcaggcagctagctcacaaacagtaaatcagcatgatcccagttaaaaaatctatatgactagagacactaaaaatgttcatatttatcgtatgcgtgatctgctctgcattcttttct

SEQ ID NO: 187856 - DNA, 324 bp, Homo sapiens
aaattagaacatctatctagataataatcatatattttaaataagacataattacctttttatagtcttgtaatcatttagttcattataacctaaaaaacctcagaaacctaatttctcctttgccattgcatttatccatcgttttatacgttctgataaatctgatgtgtggatgtgccattctttgtttttatgctcattggattcagtggaatgtaagtattgggaaaatgcagggttggaactcagacctatttccagaactcttccagcatgctcccatatttatttgcatgttgttttgttctgattttggaagca

SEQ ID NO: 187857 - DNA, 304 bp, Homo sapiens
gaatgtattcagttgcacaccaaggtggggagtggagattggaagtagctgcctttgtggcaagaatttttatcaataatattgtccagaattgctgatgtatggtgacaataaaaatcagattttggtcagttttattattcttttctttacaaacagtgggcctttttattacctgcattaggggtgggccatacccaccatcttcatacaccactgaatatatttgtaattttaaaactttgcataaatggtatgctgcatgcattctttaataatttgggtttttttcattcaatactgt

SEQ ID NO: 187858 - DNA, 534 bp, Homo sapiens
tgccccgggacacagtacctcacccatcccccgactgcctggcaagggccagcaacacaacgtttacgctctctcactctcctggccttggccagttcaaagcctttggtgccatcacagagttccgaggaacagtccaatccccaaggcaggaagacccaggaacggccatgacaacgaattaacaacatgggaaagccaggggcaggagggtgaaccgaccatgtcacccaaggccacgctgggcacgtctgggatgccctgtaactacttactgactgacacacaccaccgcctttctgcaagatccgacctcgccacacctgacaaaactcccaggacacctgacattggctcagtcgtgctggcgcaggtgtaggcaccaaatgtcttgttttgtagctagggccacaaatctctgtctataaacatgcctcgtctctccacctggaccgccagggcatccagtaacaggataatgtcaaaacctcctggcattctggcaccttctgtcacctacctccacggcctaat

SEQ ID NO: 187859 - DNA, 295 bp, Homo sapiens
gaagtcaacctaaaaagtcaaaagcaattttctagcttgtttccaagtaatacttgtatttccaactgaccccaatggtcagaggagccgagacagaatggcggggaaatggcatttctcacacccagtgggcatggcttgagggttgctaacattttttggtctagattaccaagatggctaaatgtctaaatgttcatttctcaaaaggggtttttcttcatccacctttgccaccagctacctctgtgatactgaacaagtcacttcacctccctgggcctcagtttcctca

SEQ ID NO: 187860 - DNA, 476 bp, Homo sapiens
tacatatacatgcagacaaaaagtaaagatttgaaggctaaaaagctaaatgttgatggggatatttgtgagagttaagagttaagttatttttagtttttgctttgtgcctttttatttgcgttttctagctttcctacaaacaacaagcattgggttgcttatcagtgtaaaggtaatgtgtttctttttcacggcacaggacactggtttactctctgaagggacacagcctatattcccaagggctgatggactagaggtatccttaagactcacaaaccagaattccagttctcatgttatctagaagtactgcttccttttcattttggagagcagagaaggaagagacgatgggctgagtgaagaccgaccatctctgatcttaaagttccatttcggggaccccttgtagaggcccctttaaaacattaccccagcagttttaagcacaagtgcatggtagagtcccc

SEQ ID NO: 187861 - DNA, 329 bp, Homo sapiens
cagggtagaactgccaaaagacaaagaagtccttccatacatgaaacgagggtcagcctccttcatgagagatgcggctgacagcatgactctcagatgaagaagtaagcctgctgagggactctggtgatacttcacaatattacataggccctgcccttccaccccacagccccacttctcaggactcatggcaaagatacatggcaaaattatgaaacaatgcagcactgtgtctcataacatttgcctggaaacatggtgaacatccctcagtaggggacattttaaaaaatgatgttccatgtacataaaagaaaacccaagag

SEQ ID NO: 187862 - DNA, 153 bp, Homo sapiens
aggattctgtgtcaaaactattaatatttgagaaatacaatacttatcagagcctttgtatgtaaatgtctcatatacccctctaagaaggggagcgaatagtattttccaaacttacgtcaccacttaccatccacctgcatactttacacg

SEQ ID NO: 187863 - DNA, 244 bp, Homo sapiens
tccatcagaggaacataatgtctgttagtagcaattggtggtcattgcttagatccattaagggttgaaagatgttgatatccttttttaaaaatataatttcttctttaattgctaaaatattttgaaataaagaacttttcctctgctcactttttgttacactgaggtatactttaaatagtaaaggaaggataaatgcttcattctttccctttctcaattttcttcttctttttttttt

SEQ ID NO: 187864 - DNA, 259 bp, Homo sapiens
actcatgggtggctcttggggtggctcatagtgtggcacatggagtggcacgttgtcgtggctcattgggggctcgttggggtggcacctcggggatgggcacagatggggctgcctgccctcctcctggaaggagggagaacccagtctggcctggagtggtcaagagctaactctagactcagcaagacctacttctctctcctgcccctacttccttgctgctgacctgggcaagtcgctgaagcctctccgtgcc

SEQ ID NO: 187865 - DNA, 375 bp, Homo sapiens
ctttcccaaaacggagtcattttcttgactatcttcctatgtccattacctaatagaggttgtaggacatagttcctgtatattttagttatgatttgagatgatcctcttcttgttcacatagcgaaaggaagaatgtaatgtgagtttttgaaattaaatgattcaaaatttctatttagttgttttttgtttttttttcttttctttgttttttgtttgtttggtttgttttgttttggtggagtctcactctgttgcccaggctggagtgcagtggtgcaatgtcagctcactgcaacctccgcctcccaggttaaagcaattctcttgcctcagcctcctgagtaactgggattacaggtgtgcaccacc

SEQ ID NO: 187866 - DNA, 384 bp, Homo sapiens
atacctgtgtggcttcaccattgtgaaggaagaatgaagacctaagctgagccgggttgtcggcttcaacccaacattattgtcgttgttgttgtttcctcttccttaatagttttaaatgttaattgcactatgttaaaattctgttgtctgggttaaggttggggaatttgttgctgtgttttataaatttttgttaagttcataattggtgaagaaatactgcgatgcaggtttaacctgttatttcaatacagaaggcaccagaatatttttcaagccatacattgaggcttctgccccatgactcagctgaagcagctctgattgaggtcatcagtgccttcattaccagtcctgttgcttgttttagacctaatttta

SEQ ID NO: 187867 - DNA, 1400 bp, Homo sapiens
caaacctcatatttacaagttgctaactggaattgcatgattagattgagtaatcacacgtgtcggtaaaaagctgtaattacctaagaaaagcatagcatttttgtctgtgcagggctcacctatttcgtatgtctttaaaactttgaccaattataaatcttttagcaaggtagagagtaaaatcctatattttctgtggatgttgacacatgtaagttcctgatcattatttattaaacaattagctttaacatgtaagatggaatgggaaaaacatttaaacctaatgtgaattgcctaggtatgagaagccttagaactttgttagaaatttctgttttccatttctcaaatactgtgaccataactcatagtttatttataaatagaaagtgacacttcataatacctggcagctttcaaaactagattatatctgtctttgcctgaagggctccagtaacactattgtacaatattttcttctgaccatctggcagttcttaggaaccaacctctgtcaacattttatagctactgcactggttacagctaatcctttcaatgaatgagctggaaaaaatgtagatacatcaatatcgttttcctttagagcccatttaatacatgccctgttattattttgtttgatagggccattatcttctgtgagaatgaaaagtaatttgtcagaagcatttttttaaatttaaagatcaatctatgtaaatttttcttaaataaaagaaaccacagctttttaaaaaaagaacctcaaacataatcattaagagtctcagaaatgggaacttagggcttagattccacaaacatttttagctattattttctaatctgggttctaacatgtttagtctaataaccaagcctggattgggctatttctgagaggattttatgttaacagtggagttgacaccttggcaaggtttaaaaaaaaaaaaaaagtgtatgtttctcttgttgtttgctttaagaaactaggaagcaattcattccaatgtgggaatttttatgaatttttcttcaaaacgatttggtactctatggactttgaataactaatgattttaaagtactttattttgcagtttatgaataaaagttgtggaaactttccaatgttctcattctaacctatctttacttcataaaaacccatgttggttgaataattttcttagaaaggctgttagttatttctgtattctgaaatttacatttatcattgaattgaaatgggaaaagatattgatctttttttcagattcagagtttaaaactctgctcataataacagatgataaaagagattctcctcagcttcaccattccattacataccaccactatcatgagaccaagatttttttttt

SEQ ID NO: 187868 - DNA, 565 bp, Homo sapiens
cttatccaagggcccgcagaagagggaaatttcactcattttctgccaaaatgtccacatttgcagcatgagaagcccacagcagaaactgatggatgatttgacaaagtagagcctgcggcctctaaagggagacgcagcattccaccctgggcttgttatgtttgttctcaggctgacaatgactgcataatgcctaaggataattattctaattatagttacagcatatcatttcttcatggagatatgaacaaccaatcttctctaaattagcaattaaagactgcttattatcctgaaaaaccttattaatgtattcacaatctgacaatggacatttcaaaacatagacgatgtctaaaattcttggcatgctatcacaggatggcaattagatgctgatgaacaagcattctttctaatgaatgtcaaacttacatgactaatgaaggattctttgggggaaagaacaggagatatggagttgaaactgtctccagtcatgtcaccctaatgatctgactcatttgatgggtcactaaatgagaaaatgatactcatg

SEQ ID NO: 187869 - DNA, 612 bp, Homo sapiens
tgccacctgatatgtgtattcaacactgtgccccagccctttcctgctgagctaaacatcagctcttaactttgaacatgccctagactcacacagacagaccctcagaggtcttctctgtgctcccagagtgctttgttcagagtctggtttagtggcatggtaattaagagtgtgcacattgggagctaactgtttgactttaagtctacctgctgtgtgactttggacaagttacataacctctctgggcctcatttttcctcaaagccaccaaaaaagtcactgaagggcattgggggcatctggttcccaatgtaaggatgaaataagataattcagataattaacctggcccagaagctggaactttttggcccccaggaaacacgagtgttaatattcacattacctttcccaactatctccccttccaaactgtgaacttccccaggacaagggcactattccttaggtgcctgggacataataatcacacagctaatgtttgtgggaaaaaaaaacacatgcaatgactcaattctacttttaaaactggcttttcctccttattttaaaatgtaacttgctcaccttagggccttaaaaaaa

SEQ ID NO: 187870 - DNA, 277 bp, Homo sapiens
acggaactcaaatcatggccaactgattagaaaaggtcagcataattaggctaattatgggctcagagggaaaccatggactttcctcattgatttatgaccgtttgggaaaaatcctcaactgggatttttagtgtgataacgggacagaaaaatcaggatacatgatatatatatagggaaaagctaaaaccccggccttggtggatttcctatccctacccgcttccctggcccgccctctcccaacacacattcagccggttactgaggacag

SEQ ID NO: 187871 - DNA, 546 bp, Homo sapiens
aggtaggctgcctcaaactcaccatctcaatacaacagaaataaaactagaacatttcctctgtccttgacaaaccctttctacatttccaactatgctctaaaaaacaaatattaacattaagcatctgaagataagtcaaaataatatttctttattccatcaatctatacctaaagaatgactaggtccatgacatcaatgcctcaaaactaatcataacctcagcaggaactgctgctagggcatctcaactttttgcttgtcttccctgtctctcctcaccattgttatgcttaattttatttaaaaggctccaaccatcccaaatcctactcaagactaatgtcttaataaataaagcctaatctcatgaataaatatcaaccagtcctcaatatcataatatagtacacttacaattatatgtaacatctatttctggcctaaatggaatagcttgctaaagaccaacacttctacagtgaacaagtaaagtaggctgataaaaagaaaatgggggaaaaaaattgaaagcatcaaaga

SEQ ID NO: 187872 - DNA, 644 bp, Homo sapiens
ccttaggtgaacgacaccatccgtgaatacacagccacaaactgtactgtgaaggcaggctagggttatggggtacgtgcaggggacctgctgagattgagaggtctgttctccagctcaagagcctctgggatttaggtagctgtcaccatgtggcaggttctggcggggcgtcccaaatgggcctagaaccttcagggactgagcacacccagccctagccctctgttaactaggtcagcaaagggcctccagttccaccatcaggaacccattctcggcatcccatccaattacttaggaataaatcaaacctctgtggtgaagcagtcctttcactgctgggatgaatctgtaggtgtttactgactccagggaggagtctctgacacgcctcaggctacaaggcccctgaggtttttgaattttgcagagattgtgacacctgggagagagccaggacccaacctatttgcctgaaggtctgagtgagctgtgagcagtacagaggtgaccccagtgtggtggggactctgtccagccaggctggcagggagcagctgcagagagagtcccaccagcctgggctctgccagatgcctgccaaggctggtgcccacagctggcctccaggaggttgtgtg

SEQ ID NO: 187873 - DNA, 374 bp, Homo sapiens
agtgaccctaaggtgacggtggtttggacaaggatctctttgactgtctccttccatgaccaaacgctcctgtttagttctgataattgctggctgattgttcataatttgcaacagtgccctggggtataaatggcttcctagactgatccaattagaattcgatcagagctcattgaagggatagttccaaaggtcagtattgaagattggttctgactacaggagggctcttcccagctatctttccttatttttctctggcataatttatagttaatacaaaccatggtatataattgctggcagattatagtttcacctatatttccagtaagtttaccaatcttcttaatattgcccatcataacctc

SEQ ID NO: 187874 - DNA, 427 bp, Homo sapiens
gcttgataaatggctgtgtgtgtctccttcatgtcttccttaccctcaggagacaacattttgaggtccccctggctaacaaagtgccctttatgagaaaaatgaacaatcctgcagtcctcttctgctgttatttgttgtttctagtgatggtaataggctgacctacctcaaaccctgcctgatctcttcatgaataacatgttttcaaggctgttaaccaaaggcagagtgattagttctctctttgcagcgctgtttggtttcagtaacactagtttgttcagccgagcaataatctgaaagtatccttgagaacagtgtttggaaaaaggatcaggattgggttctgaaccaatttgaagaaaaatcaacacagatggaaacagcttacaaagtacagccatttaggtaacagccatttagg

SEQ ID NO: 187875 - DNA, 416 bp, Homo sapiens
ttgcccgaaactttgtagaattggtatttattgatttgtaccagctaagagttggctatttagtctctgacgtgctctttatggctgaagaaaaacaggtaactccttcacagaggagagattaattccctagaaaggaagacaaaagttttcatggacaactttggaaaggtgtgaagcattaaatatctatgacagcaagacacgggaatacacaagcctgtgttaaggcctgatcccttctgggccaggcacataagctgaaaatggtacctgagcaatttctgagtatgtcacgaaaaggcactgaaatacagaagtttctctatggaaaagagtgtcccggcttggaaactgtgtctgaagcaaaaaatttcctcaaaattgttcttcagaaagggagttgccgtctagta

SEQ ID NO: 187876 - DNA, 663 bp, Homo sapiens
ggattacaggcacatgccaccacacttggtagtcaactatttaaaaaacatctattatttaacattcagggtagaggttccaagtatagaactttagatccttactgcctgcttggttccctggattttttctcctagttttatttggggtacttactttgttatttcattttggttatgccataaataacacccaattttagcattcctgggatgatttaggcaagcttcagaaaagagtccagaagaaaatggaattggaagcataaagccactaaaattttttcattgttctctgatcattttttagctttggattttttgatcatttaacgtatcaatgagtagaaaggatttttcttgactaccacatagcttataaagtgaccgagtattctttccttagagattctacagtgtttaacatccactggtactcagtatgtttatgaatgaatatgtattaatggtagggcttttatagggtcttattttactgaaaattgaagataatcattcacatttggattacaagtgtttgtgttatgttataaacatttaatgccgtagcccaaatattaacaagcatggtcatattttggtattgccacggtaggtattctgggaagtgtgagtagttgttttttcctaccctctgtgctg

SEQ ID NO: 187877 - DNA, 207 bp, Homo sapiens
tcctcagaccacatgtacttctcaccaactggctgcaaatttggaggtcccaccatgccctcaagttcgataactcactaaaacaattcacagaatgcagaaaagcatgatactttctttctcttttttttttttttttttttttggaaagggattttggcccggtcaaaaaaaaaaacccagggggggccccggtccccctggttg

SEQ ID NO: 187878 - DNA, 321 bp, Homo sapiens
ggaagcaagtctgagcctgtgcccaggggatgcccaagtaaggggagggaggaccacagggcaatgcctgattgtggttcacttttaggttatgactttttaacaattgctttcgacttccagatcttctagaagttggcaggggtcttatctctttgcgtttgaggagtatgcagggaactaagcccaggactcgcagggttccctagctgtgtagcctcagacgggctactctgagccttaatttcttcaaccacaaaaagctgagccattggtcagatggcttctaacatcctttacctctcccttgttcttctcctg

SEQ ID NO: 187879 - DNA, 253 bp, Homo sapiens
atggagatgataataattgtcacccaccttacagggctgtttggaagactaaatgagttattagatgttaacagtgccttgcccatggtagatgttatgagaatgttagctgctattcttactgctgaattaagtccctagagcttctattctactgtcatattggtctttctcatctgaaactcctccttggtattatagggccacccactgctgatgtaaatcaacctatttctcactcagtggcctttgt

SEQ ID NO: 187880 - DNA, 371 bp, Homo sapiens
agggaaagaaacacccgggagaggaagttaaggacaattaagactttggcagccttcacgatggagaacctgtataccctcttacctctagattctgaaagcaaattaaggggcgttgaatggactggttttcaagcgcagaatgtagcagttcccgattcccttttccttagttcattgattctcaaaccttataatacatacaaatcactgaggagcccgttaaagggcatattctgggtctccctgtacttctctccacctcccaattcagattccccagatgtctgccatagggcctttcaagctggaattcagctgctgcgctgtgcttcctggcattttggagacacacattttgggaacacccc

SEQ ID NO: 187881 - DNA, 861 bp, Homo sapiens
cctggaaaacctaaaagccagcataggaaggaagtggaaaatgaaatgctgattgaaaataaatctggaagtccgggcgcggtggcttatgcctgtaatcccagcactttgggagaccaaggtgggtggatcacctgaggtcaggagttcgagaaattctgtctgtaccaaaaatacaaaattagccaggtgtggcggcacatgcttgtaatcccagctactcggaggctatggcagaagaatcgcgtgaacctgagaggcagaggttgtggtgagccgagatcaccccattgcactccagcctaggcaataagagcaaaactccatcccccacccccccaaaaaaagaaaagaaaagaaatctgaagaaaggaaaagagaattgaggataaagctttgggatacaaaatccaaaatcaaatgctagaaataagttcaaatatatcactttttcctaccaaacatagaaggattaacctcatatattaaaatacaaaatatcagtaacaaagcagcacttgcaaattaaagaaagaaaaacaatgggaataaaaattttaagtaaatattcacagaaagcaagctgctaccacaaaattaattttagttcaaataaaatttaaggaagaaataatgaacaacaggatagacactgcacatggagggaccatagaaccgagtaggtgaagcaacgtcaagtccaacgctggcctcgcctccaggacatacaaagaaactaacaggaagagcaggtctagagagggacgctggaactcatacttctgaatttaaatgggaaatagacaaaaatgttacgtgtttataaaagattttaaaatcacaacaaatgctgaatataca

SEQ ID NO: 187882 - DNA, 171 bp, Homo sapiens
tggaatctaccttctgttcttacacataatgtgatactgctcattaggtattgtgcagtcagtatttttaaatgcccactattttcaaaattatctaccagatattttgggagattaggaagattcatgagacatcttgtctggcttttaaaaaaataacatgttgattag

SEQ ID NO: 187883 - DNA, 391 bp, Homo sapiens
catctggacatctgacacgaggtctccgggtaattagtgggaaatgttgcaacatatccagggatatttaataaatatttcttgaatgaattaaggaggctcagcaactccacatttgctcacaccagaaaagtataacagagaagcttcttgtacttctctgggcccctcctaagtacctttaaagggccccattcctctgaccacactataagagttatatatagtaaccctagtgtcctgtcctcaggggactaatctcagtctccccactcttcttcagcaacctcatcccttatctctgctcaaagcaccacttgtattctaataattgccaatatttatttctagctcacagcacttcccccagcgccatcgaaaatcaaacttt

SEQ ID NO: 187884 - DNA, 854 bp, Homo sapiens
ggaaaagtcagcccctcctgcacgagtgggagctgcaaccttttagaattgataatcacaaacccctcagacccaaagtggaataaagaaaaatatgtaacattaggcattgatggaaaaggactagatcctagtgtaagcatcctaataaaaggagaggttcaaaaacgttctccagaaccagtatttcagactttctatgatgaactaaatgtgccagtacctgagattccaggaaaaactaaaaatttgtttttgcaattagccaaacatgtagcccagtctctacaagtcgcctatgtcatgtttgtggaggaaccgtaacaggagatcaatggccatgggaagcccgagaattggttcctatagacccggttcctgatgaattcttagccccaaagaaccaccctgacaatttttgggttctaaaagtctcaattattggacagtattgcatagctagagaaggaaaaggattcactcatcctgtagggcggcttagttgtcttgggcaaaagctgtaaaatggtaccacaaaaacagttacatggtggagttccaattacacagaaagaaatccattcagtaaatttccaaagttgcagactgtttgggcccacccagaattccactgggactggacggcccccgccaggttatactggatatgtggacacagagcttatgctaagctgcctgatcagtggacaggtagctgtgtaattggcaccattaagtcatctttcttcttactgcccataaaaacaggtaaacttctgggcttcccagtctatgcttcccgcgaaaaacgaagcatagccataggtgattggaaagatgataaatggccccct

SEQ ID NO: 187885 - DNA, 578 bp, Homo sapiens
ctgagactacaggtgtgtgccactgtgcccagcaagattttaaaaaatacgtatgcccggacaccactctaaaccaactaaatgagaatcagatatcgtgaagtcactaatcattttgctcctgggtctttatgacagttttgctcctgggaaactcctgggaatgtggtagagagagagaaagagatgggaaaataagattttaagaagtgttgctatgcattttgaaaataatttttatttggtgtttgtcttgagggaaggcggtaaacatttcaattgcctttaagtgtgcttggatgctggaacgatggttctttgaatgcagcgtcaaactggcattgggtcacatggcagccagcattaatctttatgccacatttataaaacatgaatgtcatgagcccactctcagagaccttataatttggagggttaggtcagatccacaaatctcttctatctcatggtaaaggaaacctggcgtgtagcaggagatggtgtgataacaataacatatcgcatgatcagtatttgtattcttcttagcaatattaaactttttgacctcctccatt

SEQ ID NO: 187886 - DNA, 261 bp, Homo sapiens
cagcatgctgagtagctaggactacaggggcacgccaccatgcctggttaacttttgcatttttagtagagacgaggtgtcacctatgttggccaggctggtctcgaactcctgacctcaagtgatcctcccacttcagcctcccaaagtgctgggattacaggcctgagctcctgggcttggcccaagttactatcctttcatttcaacctgcagaattccctttattttatcttacaggtcaggtctagtagtaatttc

SEQ ID NO: 187887 - DNA, 781 bp, Homo sapiens
gattagttaactgcggcctgatggcctagggtagctggtttcgaactcctggcctcaagcgatccacctgccttggcctcccaaagtattgggattacagacatgagccaccacacccggccacacatgtttttataaccatataattgggatgtgtgtggtgatttacacctgtaatcccagcactttgggaagccaaagcaggaggatcgcttgagcctaggagttcaaggctgcagtgaattatgattatgtcactgtgctccagcctaggcagcagggcaagaccctgtctctacaaaaaattgtttaaaaattagctgggtatggtagtgcacgcctgtagtcccagctactggggaggctgaagtgggagaattactggagcccaggagttcaaggctgcagtgagctgtcctgtgccacttgtatggcagcctgggcaacaaggcaagaccctgtctccaaacaaacaagcatataattgggccaagaaaatgttacatttccctgaatattgtaaggagactaactggagaacagtcccattctaaactgaccttttatttttcccttcttcagtcttccaaccttgaagtagtcctatctgttgcctcagatactgaacactgcaggctacaattatacaatgagcagattgattaaactgcaaatttaaatatcttaggattgtcagtgccatttggcaatgttgtatatcactggtcagctgtctcctgtttcctacaacagatatttagcgtattttttctttcaacaa

SEQ ID NO: 187888 - DNA, 537 bp, Homo sapiens
cttttttgagatggagtctcactctgttgcccaggctggagtgcaatggtgcgatctcagctcactgcaacctccacctcccgggttcaagggagtctcctgtctcaccctcccaagtagctgaagtgggagaattactggagcccaggagttcaaggctgcagtgagctgtcctgtgccacttgtatggcagcctgggcaacaaggcaagaccctgtctccaaacaaacaagcatataattgggccaagaaaatgttacatttccctgaatattgtaaggagactaactggagaacagtcccattctaaactgaccttttatttttcccttcttcagtcttccaaccttgaagtagtcctatctgttgcctcagatactgaacactgcaggctacaattatacaatgagcagattgattaaactgcaaatttaaatatcttaggattgtcagtgccatttggcaatgttgtatatcactggtcagctgtctcctgtttcctacaacagatatttagcgtattttttctttcaacaa

SEQ ID NO: 187889 - DNA, 312 bp, Homo sapiens
atgtatattcctcaatctccaagtattttgaaatttttctatcattttgctattaatttttagttaaagtcctcatgtttgagaacttattttgtatgattactgttattttaatttcacacatgtatgtccaatggccaagaatgttctctatcttgcagagcattccctgtgaggttgagaagatgtatattttgctattggaacgataattctataaatgtcagttggatcaagttactgaaataggggctgaaatctctatctataataataaatgtgtatgtttctccttgcggttatcagtttttg

SEQ ID NO: 187890 - DNA, 375 bp, Homo sapiens
ctagaggaatcccggcaggaggttcgtctcccgagagcctcacagcctcgtgggctgagaataggtgaagtcagggcacctctgtgcagagggaaggcggggtgtggggcccgtcccacgcctgggcgacccccatgcagcgaacctcgaggccgtcactctaaagctcagtctcactcagggtgccagaggtgcgcgccccaccctcagttcctagcctgggcctaggactggctgaccccgtgtgtggggccagggctcccgaacacgggtccaccggctgcacgagagtttccggggggccctacccttccgattcggcaggtttaggccagagcccatgaacccagtctgtatttttaaacacctgaagca

SEQ ID NO: 187891 - DNA, 241 bp, Homo sapiens
acatatacacctgagtggaatagaactaggagtccagaaataaacccatatgtctatgatctattgatttttgacaaacctgcctaaacaattcaatggatgagagatagtcttttcaataaatggtgccgggaaaactagttaatcacactcaaaagaactcctagctcacaccatacacaaaaattaattcaaagtgaataaaagacctaaatataagagttaaaactataaaacttta

SEQ ID NO: 187892 - DNA, 620 bp, Homo sapiens
acctcattcagccaagtatttgttctctacctcattcagtataaggcagcctttaatttgcttagaaggcaacattagaaggttagagttcagcaggaacatagaattttaaaatgtgacttcaactgaataaatttgaatttctgtagggagtaaagaatcaaaacacctatttaaagactgcaaaatatgataattatttttaaagtaattgattaaacctggtaggttttcccaaaatgaaaaacaatcagttctaaaaccaaagctgatttttagaaaatgtgaaaatgtaaatcaaccctatccataatagattctctaaaactttatcttacagtcactttcaaataactattcaaaaatgtaactgctatattaacgtcttaaaataatttaaaacattttaaaatatgaatactgtagtttaaaacaaagaatctaggggaaggaaaagtagacaaagaaatgccaattccagtccaaagctgtatttgccaagttttcttagaatgacttttaccgatttatgaattcttatacacagaatgcataatggaaatactgatttttgtctaaagtggcattattgactgctgctgtgatgctactataatgta

SEQ ID NO: 187893 - DNA, 171 bp, Homo sapiens
ttaatatggtattttcattctagaagagaaacagctaataattgagaaaaataatgcagtttcatacagtgataagtcctctgaagaatgttaacaattaggaaataggtaaggggagatagtcctgagctcaggaaagatgtcagggcttggagaaataaatttgggatt

SEQ ID NO: 187894 - DNA, 390 bp, Homo sapiens
agatttcagattatgctctgccttttatattcacaaaacaccagaggaggaagatgcaggcatcaatagatttagttgataaaaccccactgtgcccttgagtaccctctgaagcccaggaaccagcacattctactccagctctagacagcgctatctaacccagacataaaacctatcttcctaggctgccatggccacagaattgcttctcaactaaatttcactggaacaagaaaggacaggttggaaaacaacaggagcccaggtgataagggtcaacagaaatgacgatcatggctagattcctggggagagccatctgcaacaacatgtcatttaaacatgctggccagacccagaggcagatttcacagagcagaagtcttc

SEQ ID NO: 187895 - DNA, 234 bp, Homo sapiens
ggtgcgtttgaaatctgtcatgagtttaaaataacttgtgtcatcatcgatgtgtttattttcaactatattcaactgcttgggtgtaggcatcaggtaggtaaaaaaagtgggttttattatgagtagaggttttgccacgtaattaccatggagggagggaagagcaaaggagttgagagtatagatacaaaggaatgattactgtaatgtgggtaagagaggaatggaagg

SEQ ID NO: 187896 - DNA, 689 bp, Homo sapiens
atcgaaaaaggggtctggcacagagatagatgaatgaacactaacctcctccctcagtaccttgaacaagtgatgagttctctccgctttgtgcctttacacatgtggtcctcagggaggtaagctgcctttctactcccttctgcattccctacctccccctgcctaggacacttttaactcaattattcaagatgcagttccaacaccgaccttccctgagaaaccatccccaacaccccctggctctggcccgcagaagcccacacttcatatcctcccagagctctctattctagatgctgatgtgccctctgcggtcctcagtctgtccagtggactgtgtcctagtgggaggaactacatgtctgatctgtaaatcaccaactctaagcagggggctctaaatgaatgaaagggtaaatatatgaatgaatttggcaggtcatcttatatggttcctaatccttaatttgatacttttgtgctctccctgactttaactccagcccaccccaaattcaaccattctatttcagaaatatcatgcagattgacagcatgataaaatattacctgtataatttgataaggagcccctttttattttctctcccccaattccttgccatgtggctcaaaattaactgataagaatcactgataaataatcacaaaaaataccaggt

SEQ ID NO: 187897 - DNA, 208 bp, Homo sapiens
cagcgtagggtatgacacttttttgaaatacaaggtattaaatgccaatgatttataaatgtgtatcatatgccagaatattattatgtatcattaccctctagaagaggtatagtaaaactgttaatgtttccttaaggacctttttatttttctgatgataaatattggagttcacttaatagcttgtcctaataaggtagagata

SEQ ID NO: 187898 - DNA, 337 bp, Homo sapiens
tccttgttttctgtcccttagagcaaatggcagagaacagctctgattacagctttgacctaatttgtgttgctgttcaagcccttctaagacagactgcagggctttgggagacaaatcatgtgacctggatgccagttttactgtaggtttggaggtaaccatgaagagagatcagttgtaacaacttctagagcacctgggagcatgagtttggtcactggttcccatccagtgttccatatttccaagcacttattgggaagctggcccctgcttcttgtcaaggagtctgtgttcagaatttaataggcaggtgtccttgtctggaggacct

SEQ ID NO: 187899 - DNA, 256 bp, Homo sapiens
aaatgcacactttaaatagtcttccctgcaaaagaacacttctgggagccttgttttaaatctcattctctttttctctcaaaaaaaaaaaatgactgtttaacagaagagggaaaaaagcctccttgacacaaagcttttgttatccagttgatcagcaacgtgctttagatacttgtaagagggggaaaaaagccccacaacagacattgattttagaaaatcaataaccaacatttaataaaaggaacagagg

SEQ ID NO: 187900 - DNA, 390 bp, Homo sapiens
ttcatgcaattcttgtgcctcagcctcctaaatagctaggactacaggtgcctgccaccatgccgagctaatttttgtatttggtagacagagggtttcaccatgttggccaggctggtcttgaactcctggcctcaagtgatctgccggcctcagcttcctaaagtgctgggattacagtcgagccaccatacccagccagaatcttttgaggagtgttactgtagtggagaggagaaagatggggtggtagccggagggagaaatggggtcattttaaaattgagatgttcatatactatagaattcatctttttaaagtgcagagttcaatggtttttagtatattcagaaagttgtgcagtcctcaccactatctaattagaacat

SEQ ID NO: 187901 - DNA, 340 bp, Homo sapiens
ctttattcagttgtgctacttctcaaccttctcctaagctacactatgcaactgtataccccttttatatcactattactcagacagctcctacgttcctaactcccccaccaaccatctggagattaatcttgatcatgagataatttaccatagccactcctcagacctctacactaagaacaaaagataacagctttcaacttattatgctgtcactacttgatgttaattgggacttcattgaagatttgacattataatttttttcacaattaaattagtccaacagcaactatgttgctatagaaacagatccatattttcacagcaatccttg

SEQ ID NO: 187902 - DNA, 1223 bp, Homo sapiens
atggaggaaagggcccataaatgcacaagtgcctggtcccagcaaagccacacagtggcccttgtcttgctgatctggagcccctctgtgaaaaggggacagctgcggcctggtgaggcctgtccctcagggctctgtcagctctagatatccatgggggccctgagtgggcacctccaagagggctgttcatgaatacatggcagatccctcctccaagactccccaaaataacagagggagacaattgggggtgctgtggtctcctactgtggactgatcctaatgaaacctccttatttgcacatacaggcccataaggccagggaaattcagcttacattgtctgtgtgactttgggcaaatacttaacccctctgcacctccattgtaaaatggatataacatcatctagctcaagaagctttcaagaagattaaattagaaggcatgtgtcaggtgtccacccagtgtctgggtccagagttgtgcgcctctcctcaagcacctcccacctgctctgcaggcacacttcctggctggagatgggcacaatgctggtgagtgcctggtggtttagctgcctctcattatgtactgcagtcttgaaacatttttctttaactatttcgtatttcaaagagtgccttttaccattattccaaaaggttaaactttgctgctctttgtttcttgttttttcttttgccaaataataatattttaaaaagaaaaaagcctctataatctattattgcctgccactacaatttcataaagatgggatcataccaccaaaaagggagtaataatatcagaatacaggatagtccaagaaatcagagtaagcaacctacactggcacacacacacacatagagggagagagagagagagagagtacatttccattattctgttgtttcccggtttttcattctgttgttttccctttactgggagcagaccaaaccatacacactgatatgcaatgaaaacaaggtatgtcatagcctcgaggggaccctgaaaaaaccaggccctcaaacatcatcaatgattccctcccatcactaatttaattccttctggaagcatccactctatgccaaggcactgcattgggccctgcaggggatgcagaaacaagtaatccatggtccctaccctcagagagcagagggggaagcagtcaggagacaacagcaggtagcagaaggtaa

SEQ ID NO: 187903 - DNA, 506 bp, Homo sapiens
cattggtgaaggatctgcccccccaacacagctccacctcctactgttccagacagaaggctgctgcaaaagtctctgaaatgccttcaagggcctttttaatattgtattggctattagcactgaactcctttttatgcacatttctgaagactttttgaactttcccactgataatcagcttttctttttggccacttggccaggcttcaaattttccaaacttttaagctctccttctcatttaaatacaagtttcaccttgaggtcatttcttttgtcacatataggaccacaggctgttcgacacagacaggacacctcttaagctttgctgcctaaaatttcattccaccaaatacactctaaattatcaccctgatgttcaaaatgtcacaggtctccaggttaggggcatcgtgcagcaacattctttgctaaggaaaaaacaaaagtgaccttgactcctgttcccagcaagctcctcattttcatgtgagaccttc

SEQ ID NO: 187904 - DNA, 255 bp, Homo sapiens
cggcacgaggcaaagtgatggccctggtgggggggatgaggaacagggaaatgccgctgtgaggtgttaaggcacttctgcttaaactccatgtgtgaggagtgtgcctccctgtgcccttttagctttgaggctggccgtcttttggggtgttctcctcttcccacaaccttccctatctgagtaaattacaactccattcttccagatcaaaggcccaaaacctcctttcctcacacctcacattcagttaca

SEQ ID NO: 187905 - DNA, 233 bp, Homo sapiens
ctgacatagaacaaacctaaatcactcgtgataagtatacaagtaatgcttatacaaatgggcagatctggatttttagtaatctcaaacttagcatgtcaaaactgagctccttaccacccctgcctaaacctcctcttcccacaaccttccctatctgagtaaattacaactccattcttccagatcaaaggcccaaaacctcctttcctcacacctcacattcagttaca

SEQ ID NO: 187906 - DNA, 376 bp, Homo sapiens
accattaacatgtcttatttaggtgtgtcaagagctattttagaaggtgctggacaagctgtggaaagtgaatgtgctgtactagctgcacagcctcacagagattttataattacaccaggtggatgcttaaagtgcaaaataataattcatgttcctgggggaaaagatgtcaggaaaacggtcaccagtgttctagaagagtgtgaacagaggaagtacacatcggtttcccttccagccattggaacaggtaatcttcctgaacactggactgacatgaatcatcagctgttttgcatggtccagctagagccaggacaatcagaatataataccataaaggacaagttcacccgaacttgttcttcctacg

SEQ ID NO: 187907 - DNA, 552 bp, Homo sapiens
cctaaaaatatttctgaacacagagaaaagaacacagggctagacatactagagtagaattcaagcactgaataggccaaactggaccatttcaaatcagtaagagacaaaactcataataaagacaaaacatcttctaatcacagaaagtaaaactgttagtaacaagtggagaattttttttttttttgtatttttggtagtgatagggtttcatcatgttggccaggttggtctccaactcctggcctcaagtgatccacccacctcagcctcccaaagtgctgggattacaggcgtgagccaccatgcccggctaacacatggaaaaactgacaaagcataacttcattgaaaatccatatttaattaaagtctttatgagatcaaatgaaataaatatgccacataaaatgtaacaatattacagtataataaagtctattattatttgagcacctactacttatcgagcaatgcaccatatagtctctcattaaatcctcaaaagacccacttggcaaacaaaaaaaactgagacttcatgaggtt

SEQ ID NO: 187908 - DNA, 573 bp, Homo sapiens
cagcggaacaagcaattctcgtgcctcagcctcccaagtagctgggatcacaggcatgtgccaccacgcgcagctaattttgtatttttagtagaggcgggagatttgcttgaatctgggaggcggaggttacagtgagcgaagatctgcctactgcactccagcctgggcgacaatgagtccctgtctcaaaacgaaacaaaacaaaaatttatctgacattagaccctttggcatgaaataatttatggataccttctctgtagtaaattggcttgttatagattgtgtattccagagttttgtttgttccaatatataaattatacttgtcggactaccaaaattttttgctaagtagcatcaaatatatatcacattaactctgttttttttttcataaacaggttagaacttctttaactactcaagttaaaagggaataggttattttccaaagtgatgtcataaaaagttgaaataattacttaatttttggccacttttctgatagtttattgttttgtatacatagctagcagttttaagtcttaagtaaactggatttaccaa

SEQ ID NO: 187909 - DNA, 224 bp, Homo sapiens
tatcagctctactctaattaggtctaatgtccataaagtatgcacactcagaattatttcctaaagctggaaaatctttacaagttttcgttccttaattcttcgttcatctttttaaatattttctcacctcacggactcaattttttctttttcttttttttttttttttttgagacagggtctctgtcacccaggttggggtgcagtggcatgatcttggc

SEQ ID NO: 187910 - DNA, 354 bp, Homo sapiens
cccttagttcctctggattggtagaatggaacaatggaataataacacaattggctaagtccccggattggtagaatggaccaatggaataataaaaacacaactggctaaatttatggaggcttttcacctctgctaggctgaaggcactccccttggtattgctcaacctttgatccatccctttatcagctctcttctcatgaaattgtaactggaagacccaggcacatgggaatcaagatgactgatacaaatttactgaatggggacatcttgcactgttgtaagggacttgttcaccagctcatgaaaagccagaccttagtgcaagacacgtcccacagtgcgctc

SEQ ID NO: 187911 - DNA, 605 bp, Homo sapiens
  misc_feature (120)..(120): n is a, c, g, or t
  misc_feature (298)..(298): n is a, c, g, or t
  misc_feature (300)..(300): n is a, c, g, or t
caggtataccagaatatgtaggagcccaaacaactcaaagcaaaaacaaaaataaataatctgatttacaatgggcaaaagatctgaatggatatacttaaaagaaaacatacaaatgancaacaagtatatgaaaaaatgtcaacatcacaaatcaccagagaaatgcaaatcaaaatcacaatgcagtatcatcgcactccagttaaaatagtttgtatcagaatggcacacaataacaaatgcaagcaaagatgtggacaaaggggaactctcacacactgttgctggaaatgtnantaattatagccactatggagaacagtatggaggttcttcaaaaaactaaaaatagaactaccagagaacagtatggaggttcttcggaagtatgtagtcagctaattaactgtaattctttttaaaatttgagtggcagctttagggtttatggactactgcagttcatcttcaggcaggtgatatgagaccacttcaaacaaagtccaagaatcttacaatagtatttcttcattccctctcctccccatcttttggttactgttagcatgcatttggctcttacaaatgttatacattctgtg

SEQ ID NO: 187912 - DNA, 301 bp, Homo sapiens
tctctgtacaaaacaggaaggaaatgagatgaaatgaactgcattataagctaccagagggtgcctaatggcatcttcaccacatagaagtcccaggaagaaagactgatgattttgcatgggagagaagcccagacaagcaccagggaaggaacctaagcccaggaaggaaggaaagaaggaaggcaggacggtagaaggaaggaaggaaccaaagccaaggaaggacggacggacagaccagtcagcaccggaaggaaggaaggcaggaacctaagtcccgtaaggcaggttgctaggg

SEQ ID NO: 187913 - DNA, 634 bp, Homo sapiens
aaataaaaacatgaaatgtgattttgaaatatttaagatgattgttagagaaacattgttacatttcatattattcagtaatcctgtatgataaagtagctgttttttcataaataattatgttcagtttcctgtttgataacgcaaaatgtttcactgttttaatttcatatattctttcatatttcacaatatgcttcttgtgtgtagcagaaaccagattcaatagctacatatctagttgacttcatatgcatttacttcaatggacttcaacttatttggccctaaaatagcttttcattgtttttcccttggtataaaacaccttattcctctgtattcctctgtttctactggcattgttactaaataaaaggagaaattatctacaggcacataattcctaagatcccacctcttctacaactcctatctctgttacttcaatttcaaaagccacaaaatgacattattttttcagtcgtacttgtaaaaattatgtacaaatcttcaaaataaatttcagttaaaaaaagtatgtacacaaaatcttctacccaatgaataagatatttggaattggttaaaattattagttatagactaagcaaatatattatattttaacctg

SEQ ID NO: 187914 - DNA, 236 bp, Homo sapiens
agagaacaatggggaagaacagagaggtctgaaggaatgtgggggtgtttggttctgtgggatgacatgagcctctcctctgtcgtcccagaaaaacctccctactcgttatgtgacttcgaggctgtcaggacctgctttatgtttgggaattgaatgacatttttttttttttttttcctgagacggaatcttgctctgtcaccccaggctggagtgcagtggcacgatctcag

SEQ ID NO: 187915 - DNA, 708 bp, Homo sapiens
gaagagaaatccacattcctagagggtttgcattggcaccacagggctacagttggaaagggacaaagaacgtgttcctgcagtaaagacctaacaggtgtcagagctggctgccacgtcctcctgcagtttgccggaggaggtaagggcatcctgcatactttatgtgaggcaaatacttgctcaaggtcacaggtctgagtaattggtagagctgggatttgaacccagatctgtgtgttttctttccctttcccaggctgcttcccagaccactgggcagccagagggcctgggttttggaggcccccactccctaccccatgcagactgggtgtggcactgaatccgcctctagggtttctgggtttccatttcctcatctgtaaggtggtgggtctgaacctgtcattccatgtcacacgagttttgtgaggatccaatcagaggtcagatgtgaagagagttttgagtgtgtaaagtaaatacaggctctagcaaacaatgtcctggctgcaggcggcatttagggacaccaatgtattttgcagtccccacattagaagttcagttcaagttcagtttgaattagaagttcaagttgttatattctgtgcaaaggtgaagaatatgcatgggagatacaggggacaccgctcctgttgtcttagggacatttgtgggaacaatatactggtacgaagagga

SEQ ID NO: 187916 - DNA, 478 bp, Homo sapiens
gggtatacagttctactgtaaaagtagcctcttttgggattcaagaggccaggtagttttgaaggagaagggattaaagcttaaaaggtttgcgttctaaacctggcccttatcactttactacttgtgggacttgaatcaagtcattttacctcttgtaagcctcagtttcttcaactctaaaatatgggatctcagctttcctatttacttcaaaagctagtgtgagaatcaattaacatgatctgtaaaaaaaaattaacatgatctgttaaaaaaattttttaattgacaaataataattgtacatattcgttgggtatatagtgatgttttggtacatataatagtgacaagatcagggtaataagttctttatacatattgggtgactgatcgtttaattcataggatactttgactaagagaatatctcctgatccctccaattaactgcatacttaacaagtactaacag

SEQ ID NO: 187917 - DNA, 632 bp, Homo sapiens
tgacaggacaaaataattacaagaatcaaacagccagggggctacgcaaagactgggaaaagttaaaatacagaaacgcatccctgggagatagacagttgttcaagagttactttggttaaacaaaaggtcacacgtgtgtttatttattggtcaaattagaaaaatctttcaatatctcctctctcaaattctcgaatttcaagttttccttaatgttatagctcctattagttccttggtggtgttctcaccctaaaatttctttttaaaaaaaatttgtattttttttacttttattttaggtccagggatacatatgcaggtttgttacataggtaaacttgtgtcatgggagtttgttgtacagactattttgtcacgcaagtactaagcctagtacccaatagttattttttctgctcctctctctcctcccaccctcaactccctaaaatttctttaattttgaaaatgtacttgtttctttctttgcccccaaagaaaatatgatttttaaaactggaaagtgtcatttagctcaatcctttcattttacaaatgagaagaggggacctcataggcttcatagatgtgtagcaagtctacacatagcctagtctaaaagctag

SEQ ID NO: 187918 - DNA, 706 bp, Homo sapiens
gtaagggtcacgtttccggtctggtcattctgagctctgagcgtctgctgtgtgccccagactaggctgtgtcctagcaagagacaaaagatgaaagaggcacaggcgtgacagtgagtttgagttcaaaacagcatgcatactctgccaggctttgtgtacctgcagtgccctgccttccatcagtgttaattgtcacctgtgtgccaggtattgttctaggcactggggatgtgctggcgaatgtagcacatgggaaccctagccctggtagagcttttgttccagcatggagggaggggaatcaggactttaaaagcaggtggtgataggtgctctgaagaacaatgaggcaggggaggaaaatagagggagtcggtggtggggaggtacgacaattcataaacggtcaggtcagggaaactctggctgcatgaggatgagggggtgagtgaatcacgtggctgtccaggacgagaaccttccaggcagaggtggcaaagtctctggtaggtgccaaggatagaataaccctggaaggaaaaacccaaagccaccagcagtggttcccctttggaaggaatggcaacagggaggcgtcaaggagactgtttttcaatgcacgccttttattcggcttctgtatatttctaattacttcttcaaaatagcatttcaaagtgaagaaatggaacggtgaggtgga

SEQ ID NO: 187919 - DNA, 390 bp, Homo sapiens
ggatctgggggtgccagagagtggggacaaggggtgtaacagggaagaggggatttaatagggggagcagagggggagcaaagatgagggaagaaagaggcagaaatatgtggagattgggattgggacaatgaaaagtttgggcagaaaggaataagaggtggaagaagttgtaggaatggagcagaacagggggaagagaaggaatggagggaagaaggggagaaagagcaggagaggagaggggctcaaaatgaggagcagaaacctggggggaaacatcggaaaaaaagagccagggagggaaggtgaggatgagatatgtacagaatgagagagggaaacacacaggaaggaagaaggaggggaccttggttcaggtgagtggtg

SEQ ID NO: 187920 - DNA, 438 bp, Homo sapiens
cacagcccacttcatttgttcttctctaatccagacccaacctctgttatttggtgttgatttctttcacaaaaaggataaaagaaggttcatattcacatatatgctccagtttcttctatatgcatgtgcaccacattatggaaacagctaaaagcccctctttccttgcctgtaatatgggaataatcatacctactctgtggggttggtgtgagtagtaaatgtgacaaaagactgggcacggtggctcatgcctgtaatcccagcactttgggcggccaaggtgggaggatcacttgaggccaggagtttgagagcagcctggccaacatggtaaaaccccgtatctactaaaaatacaagaacaacaaaaaattagctaggtacagtggctcatgcctgtaatcccagccacttgagagactcaggtgggaa

SEQ ID NO: 187921 - DNA, 395 bp, Homo sapiens
ctccctttgctgtggtcttcagtgtaagacaggggtccccaacctctgggccacagaccagtcagcagcaacattaaattctcataggagcacaaaccctattgtgaacttcacatatgagagatctaggttgtgtgctccttatgagaatctaatgcctgatgatctgaggtggaacagttttatcctgaaaccgtcttcccctcccccactggtccataaaaaaaaaccagtcctgggtgccgaaaaggttggggactgctgctgtaagacctgtggcagtggccagagaggtggtgattaagttgtgtgttgcaggcgtgagccaccgtgcctggccttatttatcaacatttatggtgagaattggtcattcaagtggaactgatccttca

SEQ ID NO: 187922 - DNA, 160 bp, Homo sapiens
aacttgagaggccgggagagggtggagtgtatacggcatgtattagtatttactgtgttcatccctctgaacagttagttcagagattagagaagatgataaatcagcagatactggtgtggtcaggaaaagcttcacaaaagaggcgggctttgcaggg

SEQ ID NO: 187923 - DNA, 401 bp, Homo sapiens
gctaggttataaagaaacttagccggggcttccccaggaagaggtggaaagagcgaggcccagagagactcggtggcggtccaaagtcacagcgattcggctgctggcgaggacagggcctggcctttgagtctgcgggcgccctgcctgcatcgcttggcattcatgccaccccaagggcaaggaacccaggtagcagggcacccagcttccacacgagaaggcagcttacagagaaataggactttctcctgaagagggcacttcccgaggcgggggtgcaggccccggcaaagcccaggtgatggattcactgatctggctgctcccataccactgtgtgacttaggacagtcacttgacctcctgagcctcagcttcctcgtctctaaaacatgata

SEQ ID NO: 187924 - DNA, 923 bp, Homo sapiens
ttggggattggggatttttcctattttaacacaatcgtcactttaatccttcaaggtaggtattatttgctccatataaagatgaagaaaataaggactaggaaagttaataacttgccaagaatcacacaaggaatgtgtagtatttaaacccattcaatatatggcattcaaaccttcaaattctgggtacttctgtatctctctctaggttaaaatgaagctaggacatctcataaagccaaactattgtttagatttgacagaaggaccaacatcatataaagcaatgaatgtactgattcctccctgcagaaggcatcgtcatgatgtttaccttgcagagtgtcattcctggagctgaaatgctctgtacatgagaaaagtcaaggatctctgacattaagagctgcctaggccgggcatggtagctcacacctgtaatcccagcactttgggaggctgaggcaggtggattaccggagcccaggagttcaagaccagcctggccaacatggtgaaaccctgtctctactaaaaatatgaaaaattaaccaggcatagtggtggtgcgtgcttgtgttcccagctcctcgggaggtagaggcgtgagacttgtttgaacttgcttgaaaatgtggaggttgcagtgagccaagatcccaccactgcactccagcctcggtgacagagtgaggctatgtcacttacacacacacacccccgagcttccttatagctgtgtagtggtagggctcaactctggaatcatatgtcaggagagtaatgtggaataatagtagcctgaaatgtgatcccttgacggatctttaagcaataggcctttcctactttttcttacccttatggttttggatttaacctcattctcccttcttggtgtttgttcttgacctcagctt

SEQ ID NO: 187925 - DNA, 616 bp, Homo sapiens
tcttaaagctgtgtctttacatgtttgatttgccagctttgaaaatgcaagattcagcccggtgcagtggctcatgcctgtaatcctagcacttttggaggctgaggcaggaggattgcttgagtccaggcattcaagaccagcctggacaatacaacaagacctgtctctcaaaaaagaaaatgcaagatttcacatagaaatttagatttctgtcttgtaaaatgaaaacatctgactgcatggggcctgaattcccacaggagctgagtgaatggggcttaggcactctggtttgccctgtgccctctcctgcctctacccaagttgattgattaattgccatttatcgccattctgaaactattctgatccttacacttggcctacctcacacatacttgcaaggttgcttgctggtccttaaaacacccaagtttgggactctgcaagcttcattgtttagaattgtccatttcagactgagccaccacgcccagctctggttcgattttttcatttctgaccctcaggttgtcccagattcaaccatggtagccctatcagactgactcctgaaactctttgatactcccccatccgtttttgaccttca

SEQ ID NO: 187926 - DNA, 831 bp, Homo sapiens
ctgcggttcttaagagtctatttaactattcacttccagagaaatatatgacattaatttaaaaaatttcaatttcttaacatatatatgtattaaacatggttagaaaagaagaattcccaagatatacaagcatataaaacgagagtctctctttctatgtcccttatacccagtttcccctgccaaaagtaatcactgttccagtgtcctggtatccttccagagaatctaggcatatattgtcttcaaaattaaaacacacacatgtgcccggtgcagtggctcatgcctgtaatcctagcacttttggaggctgaggcaggaggattgcttgagtccaggcattcaagaccagcctggacaatacaacaagacctgtctctcaaaaaagaaaatgcaagatttcacatagaaatttagatttctgtcttgtaaaatgaaaacatctgactgcatggggcctgaattcccacaggagctgagtgaatggggcttaggcactctggtttgccctgtgccctctcctgcctctacccaagttgattgattaattgccatttatcgccattctgaaactattctgatccttacacttggcctacctcacacatacttgcaaggttgcttgctggtccttaaaacacccaagtttgggactctgcaagcttcattgtttagaattgtccatttcagactgagccaccacgcccagctctggttcgattttttcatttctgaccctcaggttgtcccagattcaaccatggtagccctatcagactgactcctgaaactctttgatactcccccatccgtttttgaccttca

SEQ ID NO: 187927 - DNA, 579 bp, Homo sapiens
ataaaaccaccagatcatctgggattcaagaagtgtagatatttgaatacaaacatggggttagagtcaggggaccttattaacagtcatgaagctatcctggtttagaacagaggttcaggtcaggcacttaaacccctaaattgggaagccactagcattgcttttgtaaaggctagaactctgctttgaattatgtgtctttctgccacgttgctccatcaattatcttttctcccctgtgtcttcagcatttccctcctcactgccctaccccgaacatgtaaacatgctcaggcacacccatgtgttacctgggggaaggtttcttcccttcatccttagttccccttcacttactatcctatcttcttcctttgatggctgttatttattttgttgttgttaatttttgtggatacctagtaggtgtatatatttatgggctacatgagatgttttgatagaggcatgcaaggtgtaataatcacattatggagaatgagatatccatccccttaagcatttatcctttaagttacaaacaatccaattacacttttattttattttttattt

SEQ ID NO: 187928 - DNA, 322 bp, Homo sapiens
attggctcatggttcttcaggctgtgcaggagacatggcaccagagatctgctcagcttgtgatcatgcctcaggaagcttacaatcactgcggaagcaaagagggagctggtgcatcacatgacaaaagccaggagctaaagagagtggggtgcggagaggtaccacacacttttaagcagccagatcttgtgaaaactatctcaaggacagcaccaaggggatggtgttaagctattcatgagaactcctccatccccatcatccagtcacctcccatcaggccccacctccgatactggggattacagttcaccatgag

SEQ ID NO: 187929 - DNA, 418 bp, Homo sapiens
tctaaatttgatttatctcaataaagcttttttttcatgctacttagcatgaaaacaaagaacaatttaatttccttatgggaagaaggactcacagaaaggtaccaagaagtgatatcatttgtgctaagtatatgttttactattctctaagtctttaaaaatttgaaaatacacacatagcaataactaaccagaatagtacaaatttgagcatgctggttttgaattacatattgctgtactaatgatgttcataaatgaattgtcaagacaattttcaatacaatggcagccaaataaataaatacacaaaacaccaagaacagggatttatattatacaagcaagtacatgaaatggaaaactaccatgagagccaacatacactggatttaggattaaggagtgtaaatat

SEQ ID NO: 187930 - DNA, 440 bp, Homo sapiens
tcttctcctagaaatctgcatgattcattctttcatgtctcctagtcttgcataaaatgtcactttctcggggaagacttccatggatactctgtcaaaatttcaatacccccacacttcttatcattgctccagttctttttttcttatttactgtcctctgtagcactagtcccatctactgcagcatttcgttttacgtttctccagtttgaatgtgagctccctagaggaagaagatttgactgttcacttagggcattgaatgtctggtacatgctagatgctcatgaaatatttgttgaatgtaagaaaagaagaaaggaaggaaaataaaagaaaattaacagaataataattccccatttgtaaatacattttaattttgtagagtgcttttatgttcatagtcacatttaatcttcacaggtgttctgtaa

SEQ ID NO: 187931 - DNA, 320 bp, Homo sapiens
gatcgcgccactgcactccagcgtgggcgacagaatgtggtgctgtgtaaaaaaaaccccaaaaaagaaaaacaagtttcaatataccaatgttttccaagagtttaaagaactctttttgtcatattgcctaggtgtttttcctctctattgaagttaaaccaagaaaaaatagactttgtgacgttggatacagttttcttgagtttgatattaagcactggatagttttatggaaccatagtttatacgtgttcctccgctctcccccgctcccctcccctccctcccctcctcaagtctgcccttctctctccact

SEQ ID NO: 187932 - DNA, 442 bp, Homo sapiens
agacctgttctagtcacactctcctatgagtctgccgtataggaagggcgttatccaccttccactgtactttggcctctctgggatagaattctataagcaggcacacaacagaggcagttccagatttcaactgctcatcagatggcgggaagatgaagacagatggtgcagccacagttcgtttgatctccaccctggtccctccgccgaaagtgagcggagtccagttgctacgctgctgacagtaataaactgcaaaatcttcaggctctaggctgctgatggtgagagtgaagtctgtcccaggcccactgccactgaacctggctgggatgccagtggccctgttggatgcatcatagatgaggagcctgggagcctggccaggtttctgctggtaccaggctaagtagctgctaacaccctgactggccctgca

SEQ ID NO: 187933 - DNA, 98 bp, Homo sapiens
tcaggctgatgtccaaactcctctcaactcatgctcaatgtatttgcattcccagtctctttttaccagaaaagaccctagaaaaatctattgaagac

SEQ ID NO: 187934 - DNA, 192 bp, Homo sapiens
gccacaccactagtttgaattttagtcacaaagggtgcagacttactaagaattcacagtggagacatatttctgttttactcttctaccaagaaccaaagccaataaagacccttattctcattatcgccctctgcagaatgagcttttacctatttcacttactaaggatgcagacttttgggaggcttc

SEQ ID NO: 187935 - DNA, 384 bp, Homo sapiens
ctgaaaacaacctgcgagtatcgtttccatggagagagatggaattttctgcctttctcacagctccctgaccagtgcgaggacagtgtgagcccacaacttggggcttcctttgaagccacctttatctgttgaccttggtggtctggaatggggtaggcaccaggactcccaggacagcctccaagactgtgattaggagaggaagctcagaggtccatcagtggtcatgtgaagagaatgaagaggtgagggggaagaagtccctagggaagaggcagggaggaagtactgggtggtggtgtccacaggggtggcagggacccactcggggggtcctgctctcctgcattgggcatgtgcctttccagttgactgcttctg

SEQ ID NO: 187936 - DNA, 361 bp, Homo sapiens
tcaatacaaacacgcagagttgttgtggggatgtcctgccctacacaatgcttagtgcatactgggtattccataaaacattacatcactctccgatttgaagatgctacttttcactgtggcattattcacaacagcaaagacttggaatacttagactacatcttctcttattggtcctcagatagagaaccttgccagttcctatccaacggtttaatctgtgctttccaaatacattaggcattctgattttggcacctttaaaaaattccctccacatccattgctctatatctgcttttattcttcatcgctatgaaaagttaaaaaaaaacagatgcaaacagagtttggaaat

SEQ ID NO: 187937 - DNA, 482 bp, Homo sapiens
cactagaatttaaaattgaccattgaatctgttttcaaaagatttgctctactgtccttaatttgaaaacagagcacttcagacatagtttaaatatattctaaatttagatactctgaaaatataattaggcaaactgtgaaaccttgctgaacctcaattgcctcatctataaaatgatgattatttaattttcctgtgatacttattttatcttttgtagtctctgtaagcaaaaggtttattatcactgtcctcagggtataggtagcacatggtcatttattccagcttctttacttactagctttgtgacttgtgtgagttacttagcctctgtgccttcgttttctgtctgtaaaatgggaataataacaatacctgcatcttagtatttttgtaagaattaaatgagttaatttatgcaaagctgtgcctgacacataataaatgctgaatgagtgttagctattaaaaaaaaa

SEQ ID NO: 187938 - DNA, 455 bp, Homo sapiens
gctccttctctaaactgtaactgaagaacaagtaagcacaggaaagctttccttaaaatgatcatctaaatggttttccacagtgggtttcctccccatgaggaatcgggctgagacctctaggctttccctactaaggtttgaataaagcccagaggcactagaaaagaggttttcaccaaattcaaaaatgttttggggacaataagtcaccaaaatatgatcttagacaagaagcccaatcacaatttttttttctggctctgacaggaataaagtggctttaaagggaaaacaaagtgcaaagttccttatacatcacggctgaatctttccctatggttatggcaaatacaaagccatctcatctattacagggcaataccctccaaatgaagatgagtacaaatcttacaccaagagggttcatgaccactctactgccacttataaat

SEQ ID NO: 187939 - DNA, 538 bp, Homo sapiens
atgaagtgatttggggatgttactagttttctgtgctgctgcagcaaattactacgaacttagaggtttaaaaaaatggaagcagccgggcatggtggctcacgcctgtaatcccagcactttcagaggccaaggtggatggatcacctgaggtcaggagttcaagaccagcctggccagcatggtgaaacctcatctctactaaaaatataaaagttagctgggcgtgttggcaggcacctgtaatcccagctactggggaggctgaggcaggagaatcacttgaaccagggaggcagaggttgcagcgagccgagattgtgccattgcactccagcctgggcaacagagtgaggctctgtctcaaaaaaacaaacaaaacaaaacaaaacaatggaagtttattctctcccagttctagagaccagaagtctgaaattggtatcagtgggcttgatccaggggtgggtatcagggatcaaggtgtcaccggggccacactctttccagaggctccaggggtgaatctgttccttcc

SEQ ID NO: 187940 - DNA, 146 bp, Homo sapiens
ttttcactcattccctagcctttcagcttctccgccatgttgtcaggcagcacatggcccccaccaagagctgagcagatgctgatgccacattcttatactctcaagccaccacagtcgtgagccaaataagcttcttttcttta

SEQ ID NO: 187941 - DNA, 393 bp, Homo sapiens
aagcgatcctcctgccttggcctcccaaagtgctgggatgaaaggtgtgagccatcacccccaatgtcatggggtctcttgcttgctagtccctacccagccaatttggcatccatattacctgcctggccctttgcaaacatttgagttgatgaccctattctaggaatttataaatttggagtctggaaccagacggcttaggctcaaatcctgccacttacttgctgtgggaccttgggcaggagtcttaacatctctgatcatcagtttcctcatctgtaaatcggccagagtagcagtacccactttgtaggctaacagatgatgtatataaagctactgagggcagtgcctggtgcttagtgacagctggatacaatttgtataatg

SEQ ID NO: 187942 - DNA, 456 bp, Homo sapiens
tgaccgctgctccgtcagatatcactgggtgttttttattctgtttcaccattccatagacccagatcccaacaaccattgctcttcagtaccccttccttcttaaccaatgggaggagaattcagctatttatactctgttaaactactgggtagattcagacaatagtttacacattctgtgattgttattattctttaaatcctcctttgttataagtatcaatttatactatttccttgttagggtttttaataaaaatatctgcattaaggtgttcattaagcaggtatgctgacaccttcatattctaagccaccatcttttcttacttgaatcttggaaaacctcctaactggtttctctttgtccagctgtttcattctccacagtatagctggggtaatctctacaacatgaacttgatcctggctagtcttctgcttgtggttctt

SEQ ID NO: 187943 - DNA, 660 bp, Homo sapiens
aggctgacactgaggaagacatttcctggatttttttcctgtgcccatggtgaggtccaaagtgacccaaataccacctaaatccctggatgctaaactccttgagggcagagacagagttatgaacctctgggtctccccataggtccaacccagcactaggtcttcagtggcgtctctaagaatgtcagttggtcaatttgttattcaatgggcacatgacaagttgcaggagtgcacaggtgctttcagggtatcatcatctcaaacagaaacagcattgtttcaaagagcctgtaggagtccagaagaaatacaggactttcttcttccttttgcaaaagctggcagtttaaagccacagggcattagatcaagaatgccatgaggctgaccagtgaggggcttgactttgagggctctgggctggttgggctggccatgcttacacttggaaagcagtaggacccattccctggttttgagcattcaaagtagccttggcttactctctgctctgagttctcacttcagtcttcctattctgaggttcaaagaactgcaaatagtcctcagacaaagcctgtggggtgtctccccagattccaggaactctccaaatcagatagaccaggattatgaaactcagcctcttctatg

SEQ ID NO: 187944 - DNA, 1070 bp, Homo sapiens
tgtgcagcctgggtgtgtgcatcattaaagctccagggagttccgtgcagctgagttttcgaacctctgccccagagccagcctgtctggctccaccacttcctagtgtgtgaccttgggcaaccagtaactcgctgtacctgagtttccttagctgtgaaatgaggaccatgtaattaccttcctatagagctggtatgagggtcaagtgggttcatatatgtaaaatacatgtctgcacacgaatctatcaccattttctgagcctggagtttagatttcctccctaaccggcttagttgttctctttgcacctggcaggtgtcagctcacatgccgcccaggtggagagaccacacttctgctagcctgggacagtcccagcaatgctgatgtcactgcattctttcccattaggcttactttagatcacttgaaaaatagttctattttggataataaattatgtggccaccctcttaaccctcttctatagcatgctacatataggtagtgatgaatggtaagtcccttagaagattagagagggcaacattataaacagtgcatcagagaattagtctgctcccccagaagagaggctcttgaaccacacagctacttttcctgcttcttaaaaaataaatcctacttttcttgaaaagaagttttgccaaggaagaaatctgatcagcttttttcctccactcatgactcagttacctggagttacagggaagccttcctgatttggtacacgttttagaaacaatcatatttattgcacaggaattgttcccttttttgttttgtttctgtgtcctgtagtggtgccctttcagtcggcacccagacctgccccatgcacatctacagccgagtttctcattcctttcctgatctagtccatggtattattaaaatgctcattaacagaatgcccacttaacacgaaatacttggtttcgtttggagaaatccatttatctggaggagggctacacataaagtatcactcttgatgaagtatagaaaactgaacttataagtcagttattcaaaatgtgtca

SEQ ID NO: 187945 - DNA, 390 bp, Homo sapiens
tgatcactctccctctccactccagctattaagtcttctcattttcactaatcagcaacagtaatgctccctatttactcctccagtacgggtctcaaattcatataactccaagccaggcaagtaccatcaattaagcacagcaaataaggggggactataaactccacctaggagcttacacaccgagtttcaaccccaaagctgctactacagtccatctctccatcctgttgttgctctgagaaatgcagcactggcgctacaagatattccaatttttcctaacagaagccacaaatccaaaacacacagaattttccattttttaaacagtgcaggccaaattaaaagtacctgcaaactgaatctgcttgtctatatacaata

SEQ ID NO: 187946 - DNA, 422 bp, Homo sapiens
cagctacttgggaggctaaggcaggagaatcacttgaacctgggaggtgtaggctacagtgaactgagatcacaccactgccctccagcctgggtgacagagtaagactctgcatcaaaaaaaaaaaaaaaataataataataataataaccaaatagaatatctagaaatgaaaaggtaatttacattgagaacttgctgtaagagttaaataggggttagacatagctgaagaaagaattgacaaactgaaagagctgaggaaattacccagaacgtaccacaaagaacaaagcagatgaaaaatataaaagatatttagagatacagaggacagagtccttggtttctcctgaaatgtatctaggattgaaatttctgggtagaaaattaaaattgtagtgaatgcagatgttcagctt

SEQ ID NO: 187947 - DNA, 398 bp, Homo sapiens
ctcccactctctgggttgtctgtttactctgctgattgttccttttgccttgcaaaagctctttaaagtcccagttatttatctttgtttttattgtatttggatttgggttcttggtcatgaaatccttgcctaagcaagtgtctagaaaggtttttctagtatttcttctagaatttttgtagtttcaggtcctagatttgtccttaatccatcttgagttgatttttgtgtgagatatgaggatccagttttcctcccctaaatgtggctagccaattatcccagcaccatttgttgtaaagagtgtcctttccccactttatgtttttgtttgctttgttgaagatcagttggctctaagtatttgggtttatttctgggttctctattctgtt

SEQ ID NO: 187948 - DNA, 392 bp, Homo sapiens
taggctctagggcagtaagggcaaccagtgccaagtttcattttaacactgacaggttggtcatggtgacccagagcacacttggagaattcttaggctacgtctgcagggttgccagtggctgggaaaagggaaagggtgaccacataggagccacaggtgtactgtctgtgaacttcaaaggctaccgtctgagtctaaactctgcaaggagtaaagcaaatgcattgagtaaactgagtgatggaaaagaggttgaaaataaagtgtttgataatacaagatgataatatcaacctcatcacaggggggccaaccagcatgtaaagatgtttcactgtcaacaatgtctcacattaagctttcaggttccattaaaaaattaatatgct

SEQ ID NO: 187949 - DNA, 606 bp, Homo sapiens
aagatactaagaagagagtgtttcatttaaccccttccatcactacccctatgagacatgattgcctttacttgacaggaaaatgaggttcagggaggttaaatgtatgtagaagattttagcaagaatattctgacttgaaatctatgttcttaatgatttaggataccagctcacaactcaaagcatgaagcatgtggcaatactataggaggtaagagatctcatgacaggaaactcgggttattcattcattcatccatctagtcattcatccatgcatatatccatctctccactcagtcactgtgtcaacagatatttaccatgtaactatctctgtacttggtactggggcagaggtgagcaaaacagataaagcccctggcctcacagtgttcacagtctaatgaaagcacaaacatcaatcagtgacattactgtgcaatcacaaattgagataatacttgaaaggaaagtaatgggagcctatgacaaagatctggatttggggtagggtcagatttaagaaaatgagacctgagagctgaactgataggcaagttgacattaattaggtggaaggcaggtgaaagaatggggcta

SEQ ID NO: 187950 - DNA, 346 bp, Homo sapiens
cgctcccctgtaccacctatcacagtggtcacaagacaaatttgaacttcgcgcctgtgaacttggcgcctagctgtaacgcttccgggatcaggtctgtcgctttccactcccacggatgttgcttatttgtcccaaaaccgccatttcaatactagagcgtgggcacccgaggccaattctgcgattaaaagtccctaacaactttctgataaagagaaaccatgtgaaatcgttcataacaaacttttatcctgcgagaacttggataagcgagccttgttccttacttgaattgtccagacctctaagtccgttattgcaaccactgggaaagggcgcgggg

SEQ ID NO: 187951 - DNA, 534 bp, Homo sapiens
atgtaggcttgtaagcaagggaaggagtttgggttctgttcggtctgcaatgagaagtttttgcaaggtttaaacatggaaatgctacacatcttaattcaccccctgttcctcaatgtatttactcatcatttagctttaattccttttacttcacttaagctttaactccagcctcttttctttggttatctttgtatttcttgacattaagtcctgctgcttttcttttaccctaaattctgtcagtcctctgacctttcttatctacctgccaatgatacggtctagcctctttggatgacatccatgatttattttttctttccagagattctcttttatagacaaatcactcagcccagtgtcctgccagtgatgaaaattggcagatgatagggtgtgatggaaattagaaagcaatgctgattttgtccttcttcaatttacactgtatgacagctattttgacttttcttgctgttcaccaatgcttttattcttatgtgttgtctggactttcttaagcaatag

SEQ ID NO: 187952 - DNA, 130 bp, Homo sapiens
ggaaagaagtcagacaagcaggccacatgctgtatgagtccacttacacgaagtgtccagaatacatacatccagagacagaaaggggattagccggccgggcgcagcgctcacacctgtaatcccagca

SEQ ID NO: 187953 - DNA, 221 bp, Homo sapiens
gacccttgggcagaccggggctaggggtggctctaccacttaccctcatgtgaccctggaggccacagaagtgcaccaggctccgagaggtggttccaatggttgcctctagcaaacttactgtgtgctgaatgcttcctgggcacccaggccctgtggcaccggctttgggagtattgtctcacttgagccacttgatggcccagcaaagtcactgccat

SEQ ID NO: 187954 - DNA, 422 bp, Homo sapiens
aagactgcagagaagaggaataaatagctaagcagttaaacattcattcacctttgaattgatgaagatggctggtctctgagtcaaagtaagcagactcttgcttaagagaaagaactgaggaagagcagggactatcggtagacttaattatgccttcaattgttcctatacactagtgcctagcatggcacctgatacacagctgtcactttatgaaaatttgttccccttcccctttattgttctgtttgaggactactcttagactttgcacttgacttaggtaagaactggtcttcatctctgaatattcaaggttataaagatacagataacttgaattcccttgtacgatgtgtgctgaacatgtctgctctgcctggtgcctggaatattttctttgtgtgggaagcttctaa

SEQ ID NO: 187955 - DNA, 353 bp, Homo sapiens
cgatgtaacatgttcatagttaggaagacccaatgtcataaaactgtgaaatcactcaaagactcaagtcaagaaaagccaagagttttgaagaagagccttccctaacagatatttccctaacagatatggaggttagcttttccctaacagatatcaagaaaattggaggtattttccttttctgttcctatgaaggaacatggctttaggagttaacactcttggctctctccatcctctcactctctcagaggaggaggcactttcctgattggtgaatctagagggcaaaatagcaactgggtattcttggctcagccctatctgggctcctgaagaaaagtcacctg

SEQ ID NO: 187956 - DNA, 135 bp, Homo sapiens
agaacacaggcaaggatctgcggagggaggacagacctgcagccatagacactgggggaaacacaacaaaatcaactgagtatgaagagggagagtgttttaaatcagagcaatgaaagaaagtgaaggagaaag

SEQ ID NO: 187957 - DNA, 474 bp, Homo sapiens
atcatacttggaaaaccagaaacataagagcaaactaattccaaacctagcaaaagaaaagaactaaaatcagagcagaactgaacaaaattaagaccccaaaatccagggaaataatcaacttaaccagaagttggttttttgaaagcataaacaagattgataaaccactgtctacattaacaaagaaaaaacgacagaagatccaaataagtacagtcagagatgacaaaggtgacattacaactgatctcacagaagtagaatgattctgagagacccttatgaacacctccatacacataaactagaaaatctaaaggaaatgggtaaataccatcaaggccctgccacatgggaggtcccttctgagcagttaccaacccatttttaagccccctttaaatttcaacaccaatgccagtaacatatcttttttgtctacaacttccaaagacacttatcatcactacc

SEQ ID NO: 187958 - DNA, 449 bp, Homo sapiens
cactattcatctgtgctcctatctaaaaccaactccttaacttctgcactggacctcaactcctcttgattattcagctgtcactatagcaataagccctctctctcacaaaacatgaattttctcctgtctcagcctcctgagcatattactaccgcatatgttcaaatagttgcagaaaatgtaatataaaatctcccaacttaaaaaattccttcctttaccccacgtctctctcatctaccccttttctctgatcttctcagcaaaactcctttaaaaagttgtctaagtgtgttgtctccatttcctctcctcctattctaaagaacctgctccaaaagtggagaattcattattgttccccactactccacaaaacttgttaaatgtaatattgaattagccttcatcattctgtttgacttagtgtagtagcatctgacaca

SEQ ID NO: 187959 - DNA, 388 bp, Homo sapiens
aaagaaaaagcaatcaatcagcctttaaggctgttgttgtgtaataaaaaccttgcttgacagttgaagtacaccttaactttttcatttaaaatttattactctttgaaaaaggagaacttgttgagcagcatattttcttttttcacagatgtctgattagcctgcaatattttggttctatttaatatacttttaactattttttaatgaatatgaatgtaaaaataatgttgagttagaatagaaatatctaactgtatgattaaagttgaatcacttataaatttgaaaaagcttcttgtcttctattgttaatgctcctagaatctcatgtttgagaacgaatgttcagtgtagccaaaacctaaatctgggactatatgtt

SEQ ID NO: 187960 - DNA, 367 bp, Homo sapiens
ctgtctaaaacttaatcttttccttttggaccatttgagattggacagcggagagaaacttggcttctctccctcttgcctattaacccatattaatctaaacaggacccccatgtctcattttactaatatgagcgatttcatttccttttagaatttccttgaccattgtttacagttgtatttctacagaaaaattcatttcaatttctaaaccaatgaaagagaacttttggagcacaatccaattttagtaattgcctatactttaaactcaaaaagtttgttgaaattaagtaaactctaaattccaagcttcaggcaccagtctacctaatttgtatttctcaatgtagcctccgccatt

SEQ ID NO: 187961 - DNA, 453 bp, Homo sapiens
accctcctttcttcatattctcctcaaaaaggttccaggaatctaccttttcatataccttgcccctagttttaggatccactaaaccattctgatcttcttttggtggcttagaattagtccatgtgtgatccagatcagaactgggatttccaggtgcaaagatgtgatccctggagtcattgtttttcttgccccagatttctggagctgcttcattgtttatctcactgggtgaattgtccagtagttctgaagaagaaaaggcaaacccactttttgccatggcccactcattcgggtccctaacagaaggtgtcttgctgcttgttgggtgcaaatcccaggtattttttaaagcttcatcatgatcttctttaccaaatgcactccaggctgggaatggcgccacagctgctggttcaccatcatctgtaggatttccccagggct

SEQ ID NO: 187962 - DNA, 795 bp, Homo sapiens
atttgagtattagctcttttctcacagtacatgtgatataattcctaaccccttaaatactttataaatgaagagcttccactaatgaaacctccccaaattacagttcagttttagggagacaaaggaaatgaacttcgggtataaaaaaccaaaatgaaactgggtatggtggcagacacctgtaatcccagctacttgggagcctggggcaggagaatcacttgaacctgggaggtggaagttgcagtgagctgagatagcgccattgcattccagcttgggcaaaaagagtgaaactccgtctcaaataagtaaataaataaataaaatgtgttcattgtagaacatttagaaaatatattaaaacagagagagaatgggaatgaacacccacaataccacaactagaacagcccatccctttctaggatttgctaacatcaagtggtaggttcaagaatgtcaagttatacctataaaataagtgaagataggtcaagagagggtgaaaacgtttccaggttccatcttactctgactccaatatgcacaactccaattttactgcattgcttccccttttagatgatggatttctagatttctagagctcaggatatggctgtgttacatttgtttggaatggtgcacatatattatgaaatgatgcgtatatatgggtaccagtttatgtatctctcttgatggagataaaatccctttctttgtgctaaagggccaaggtgtatgaccaacatcacttggtctccaaggcagtaatatatatagaaa

SEQ ID NO: 187963 - DNA, 532 bp, Homo sapiens
actacacccctgccatgggatccttgtttattgaagccctgtgtttttctctctctaactcaggcctagagcaataaatagtatatgaatgtctaaaaaggctagtaagcttggaaaagattatgtagatgtttaatgtatttcacacagctactgtgtgaaactggcgtttatttgttgtcttaaaagaactgcttgcattctagatttttctttctgctagaacatattgccaatcccatttgattgaagagggaaatcactaaaaacagggaatcacacaaactcagaatacactatattaagctaactacgcattgtatttagtttcacagatacttgtaactaaaaaggattccttgttagaaagttacatgtagaaaaaaattgtttcagtattgagaagttttttagtccctatttatttttgcttttattagtttaaaacagtttatgttctgttatggacctgattttgtgtttttttctaataaactttgtatcacagcttatcaggagtaaattaaactgt

SEQ ID NO: 187964 - DNA, 435 bp, Homo sapiens
ttatggcagttgtatcatgattccacattcacacaacattctttggtgaatacgaagaatgttgactaaaacctaatcccctcccatgttccaaataggtcatctcttatacttcctattgtcgacacgtgaataagaatatgatttgtatggaaagccacctttgctataaaattattttatcccgcttactattcctttttatatcatacctaatcattcccagtttgatatattgcttcttaattttaattttttttctttatttttaggttttacagtttgttgatgtacagttattcattatagtctctaatcattctttgcatttctgttgtctaatttgttatgtcccctttttcatttccgattttatttatttgggtcttctctctttttttcttagtccaggtgaaggtttgtcaaatagtttaa

SEQ ID NO: 187965 - DNA, 102 bp, Homo sapiens
tgtggtttatgtaatttatggaatgattggtataataggaggtacccaggcattactggaagcagaacctcgaggattgagaaatagtcattggattcagca

SEQ ID NO: 187966 - DNA, 348 bp, Homo sapiens
ctgttaagccaacagggactcagagaaagcaagggtcagggtgaccagaaatagagaaaaaaaagcctcacagaggaagaggacctggacctgagccacagaggatgggtagaacttagaaggagggaatgagcccagtctgaatgatatgtctacaaagtatacaatatgcaatgatgattaactgaaaaattgggctggccatttgtgagatccatgaataaaagtagatcagaaagtcagtgtgagttttaaatatatatattttattataaaacgttaatcacataatatgtgaaatcactattgataaccttttctattggtcctagtgttttgctatttaag

SEQ ID NO: 187967 - DNA, 376 bp, Homo sapiens
gcccagtttgtgatactttgcaatggcagcctgagcaaatatacaaactgtttctgcatggcactaatttatgtttagagctttgggaaacagggaactacagactgaatgcattcggatcttttggaatacaagctcaatttttattaggggccacacgtggtggctcatgcctgtaatgccagtactttgggagcctgaggcaggagtaccacttgaggccaggatttcaggaccagcctgggcatcacagggagacgtcatctctccaaaaatttaaaaaaatggccaggcgtagtggctcatgcctgtaatcccagcactttgggatgccgaggcgggtggatcacctgaggtcaggagttctagaccagtc

SEQ ID NO: 187968 - DNA, 239 bp, Homo sapiens
tccatttgcctccctggtcttgcctcctggaggcctgtagataggagacacccttcctggaaagacaacagcttggggacattacagataaggctgggcgggtgtgcctagctagcccagaataaaaggatcaccgagagaagttaggaatcgaccttccttctttctctttcttcgaggaggtggtgggatcttggaacaaggaaggtgtggttttttttctttatttttttttagga

SEQ ID NO: 187969 - DNA, 286 bp, Homo sapiens
catattgggggagtttgggggtttgtgcagggtgcatcaaaaagcactcgcatggaataaacatatcttgcacaggaacatatgacaggtaattgaatagtttgatttgaattatgtaaagacatgatcctgatggtagaaggatggtacagagtagacaaatgaggctaaaagatgaaggtgaatgaactcagcatagctagagagacagctgaggaggagttaagagattggagtctaatcaggataataacacttgtaagaaatcaggtaatccctggtccta

SEQ ID NO: 187970 - DNA, 521 bp, Homo sapiens
tgctggcttcataaaatgagtttggaagtagtccctcttattcaatttttaagaagagtttgaaaaagattgctatttgttccttaaatatttggtagaattcaacagtgaaaccatctggtcctgaacttttgtttggtgggtggtattttattatggattaaatcttactcattattggtctgttcagattttcctgtttctttgttattcagtcttggtaggctgtgtgtgtttaggaatttatccatttcttctaggttatccaatttgttggcattaaattgtttatagcagtgtcttatgattctttgtatatatgtggtatgagaaaggtagtgtctcctctttcatttctgattttattcatttgagtgttttctcttttttcttagtctagctaaagctttctcaattttgtttattttttcaaaaagccagtgctttgttttgttgatctcatttttttctagttttgaactcatttatttctgatctgatatttattgtttccttctttc

SEQ ID NO: 187971 - DNA, 515 bp, Homo sapiens
ggacaaagatgatctgatgtatcatttggcttaccaacattcctgtccctgttacattcctgtggtttcatggtggttgaaggtgaacctgacagtgctgttttacagagaagattgaagggaaggtgttttaagtcaatagagttaaagctctttatgttttggaaaaaatttgggggttattttaaaaactactcagaggtgatagagtattgtaattatcatatggaaaataatccaagaaatatagtatataaaattcacatttcattaacctggaaaattgactgattgtttgatgtatctaagtgttggacttagaagtggacagtattatattctcgacaaagagattatatttagatttctcagagaagtgtgtaatgattaaactcaatgttggaaccatttggttaatttaattataatttaaaataaaaccccttttgagaaaattcctgcataagacttaagtgttatttttgactagttcagactgtggcttaatatacaat

SEQ ID NO: 187972 - DNA, 700 bp, Homo sapiens
ctgatgatgtaaaaggaaatacagagaaaagcaagcatccttctcccactcctgagcctgtaatcatagggcctagggcttctctgcagacagaacccagccaagacttttcgtaaatgccatgtgcacttcagggcttggtttgttctattatatttagggatgcggtgctgagatgcttgcctgcagaacagcaaaaacctctgacttcattattgttattcagagtaaccagggtcattgctctctggcttgccttaaagccagcaaaggcaattgcccatccctgggcttttggtctggaagagaccgttggcatcattattcagccccctcacttttcaggtaaggagctaatgaagacaacattcccagtgacacacggcaagttactgtggtgttggggtttcagtgtcaggagtctcctctcttcctctggcatttctgctactatgccaggctggctcctttcagtagacataacatcattgaaaaataccacaagtgcccctgtggagagcagagcagatagccattaaaattacaaaagcttatgctttttggcccaacatttccacttcaaggcattcaattcttcctatagatacactcatgtgagggtaaaatgatctctgtataaccttattctttgcaacactgattgtaataaggaaatattggaagcaacccagatgcctat

SEQ ID NO: 187973 - DNA, 612 bp, Homo sapiens
cttacttcactcatccattgctaacgaagggagtaaggagggataagaggcaaattaaagtccagtactccggtagacaggagttggggtgtgtgtgtgtgtgtgtgtgtgtatgtgtgtgataacctaattgacaaagcaatcatgatgttttccatgagcctgatgttatcccatcattcggagacccattttgtttaatttgttttttcatatagtttctggtgggaaaaatgcattgctttagtaccgaaattaacttgattgaaatgtcttagactttatcattttccagtggctcaaagggttatttcccaagtgtttaattttttaagtacagtgtatattaatttcactgctactttctgacattcatcattccatgagaaattatcacagatgaatacatcagacttttatttacactccaattcctactcaatgtaaagttatttaactttgacgatagcatgcaaatttgataaagatgaggtttttaaaaacctgaaccatttattgatttgctaagtataattttcacatttttcttatagtattctataatacatctttcagaaggaaaacacttgaaaactagtataatcttcagga

SEQ ID NO: 187974 - DNA, 524 bp, Homo sapiens
cctgtccccaagcaaacatgcatacacacacacacacacacccgctaaaatcaatttctcacaactgagttatcaacatctttacgagagccaagggatatttcttcctagaatcagatctcgcagccacccaagatatttttacatggttcaggatggtagtggaaagtaaatctaattgtccatttcttggcaatgccttgtaggacatgatcagttatttaaacttcctgtgactaaattccccctatttctgtgacagattaatgccatttgccagcatataatgttagccaagttctggtaacacacagagggaaagcttcacgtaaaccttaagcaaagttattactctctggaatccagtatgtaattggcactccttaagaattacaattattatttttatattccttttagagtgtcttaggaacttacaggtcttcagagaaaaagctgtgggattttggatgagagtcacaaaatcatttgctctctagtccaagtgaaatcttttgttagaa

SEQ ID NO: 187975 - DNA, 351 bp, Homo sapiens
attctagtcactttcctcaatatttgtctccattccaaacctagtctgtgccctatatttaagtattgttattaatttgagtgaatcctaccagacatatacaaatatatgtatctatttaaatcaatatgccataagtggcaaaaaaataaagattagcaatgtccatctcctgcagatattaattccataccttgtacttggtaaaacatttgcttgcacaaatgaaaatattcaattatgctagagtaaatttacattatatagggatatctttcaaaaaagtttctctcctgttttgaatttcagctgtcttgaattgtcacttgcaaaatacttagggaagtttct

SEQ ID NO: 187976 - DNA, 499 bp, Homo sapiens
atttctggggtgggggctgccaaacacagtcatgggcctgtgatacagttggaaccaatcagagtcctttccaggaattcgtatcatcccagtgggagaggaagtcttctctttcctctggagccactctctggggtggtggaataacataagcctagagctgtttgcagacatctctgccgcatgaatcttgtcctcacttggatggaaggagccatattcacagaaaaagagaagcaagacagatagacatagtcttacacacacacacacacacacacacacacacacacagagacaccatatttgaaataaactaaggtgaagagagagtagagacaataccataagagaatcacactctgtagtgtactacttcaagataataattgtgagtgagaggtaatgattgaataattaaaatatttatgttccttggaatcttaatatgagagaagggtaccataaaagtaggtgactcttggaaagtgaaagaaaa

SEQ ID NO: 187977 - DNA, 281 bp, Homo sapiens
ctttgtcccatttgtcttcatccatctctccattcagctgcctggaatgcagatgtgatggtcaggaatccagcaggcatctctgacaataaagataggggctataccccaggagtggtgagcataaagcaggaagtttctaatgacttcaggggctagcataccagctctggactgcctcactctaggacatttttttgtttgtttgtttgtttgtttgttttttggagacggagtctcactcagtcgcccaggctggagtgcagtggccgcgatctcgg

SEQ ID NO: 187978 - DNA, 456 bp, Homo sapiens
tactgaaagccctttctttctgtttttgaaaaacaataaacagcagaagaaaaattactgcgcctcctttcccctcaaaaagggaggcctcgtctgttttcctcgctgtaacaattttcatgatgtcatgacgtgtcctgggctttaagcccctctcccttaaccagctaatcctgaagagaggctcacacttggtgagtgtggggtggcgctgggcatcccacggcaaccaagggacagccccgttagagttaatcactccggcttcacagatggaggaactgagtcttggaaaggggagactggagggggccacccagcaggtgagtgttggatggagctcaaacccaggcagcaagtcaccagaggcagctggagccactcactggcctacagtgcggggacacaccgtggtacccaaggatgtgtcaaaggcaggagtaagacaagcaggtt

SEQ ID NO: 187979 - DNA, 416 bp, Homo sapiens
gaaattgatcatacctacagtaacccctcactcagataaatatttcccccaagacagccaacagagacccttagagacactaacttaatgctaaccgagcaataaatgcagcgtacccatacccaagcatacagacccacccacccagtcccaaggctctgtcccctgccctaaggtgtctctctgcagcgtaccccctccccaatacccactgagggtccgtcagccaaagaggtgagtgtcttaacacagagaagcagaatctatccgactccttcaggaaggggacctggcaggaaggagccccgtccctggcgcttgttctgggagttccgtccaccccctcccctacctgccaagagctgcatccaggcgcagatcttgtagaccgtagccgtgttgcagaagaagaaaag

SEQ ID NO: 187980 - DNA, 238 bp, Homo sapiens
aaactttggagccagactgctttggttcaaatcctggctctacttttctgtcatctaaggcaagtcacttatcctttgtgtgccccagttctcttaaccataaaatgaggataatattaaaacttgcaaggactaaataaattagcgtatgcaaagcatgtagaaaatgttttccatgtaataaacactaattattactgtgataaccgaagggttccaaaatcaactcaatttttgg

SEQ ID NO: 187981 - DNA, 668 bp, Homo sapiens
gctaaacggaagaaaagttacctggcagcataagatagctatgaagaatctttcccccaccagaaagaagtttagcaaactattttactgaataaatctaagacttcctccttcccagtagttgcccacaattttcctccaatatgagattatgtctctattttgtaattctgctcagaaaacctgtcttaaaatctacacatattaaactataatatgtcataaattttaagaatgttatttaacagaggtaaatttatcatgaataccatatatttaaggtagcaaaacataaagagagtaataacctcttttgatactcaacagcagaccaggtaaagtccaaacagttctgtctcatcaaaataatgaaggttgcttgtctttgacctcttttcctgttacctctttaagagataacacacatatacatacgcttttgtagatgagaccattctaaaatttataaattgtgttgtatatctttgtctgcctgattaaaatggcttgtcttaaggtaacactgaactgcttagtctttcaataggaatttatttagcaactactttgtggtattgttttgatatactctatttttgtgtttcggctttttcttatttattttaattaaatcaatatcatccctcgtatacactattcttctgtgc

SEQ ID NO: 187982 - DNA, 614 bp, Homo sapiens
gctaaacggaagaaaagttacctggcagcataagatagctatgaagaatctttcccccaccagaaagaagtttagcaaactattttactgaataaatctaagacttcctccttcccagtagttgcccacaattttcctccaatatgagattatgtctctattttgtaattctgctcagaaaacctgtcttaaaatctacacatattaaactataatatgtcataaattttaagaatgttatttaacagaggtaaatttatcatgaataccatatatttaaggtagcaaaacataaagagagtaataacctcttttgatactcaacagcagaccaggtaaagtccaaacagttctgtctcatcaaaataatgaaggttgcttgtctttgacctcttttcctgttacctctttaagagataacacacatatacatacgcttttgtagatgagaccattctaaaatttataaattgtgttgtatatctttgtctgcctgattatttagcaactactttgtggtattgttttgatatactctatttttgtgtttcggctttttcttatttattttaattaaatcaatatcatccctcgtatacactattcttctgtgc

SEQ ID NO: 187983 - DNA, 1135 bp, Homo sapiens
cagcctctctgagtctgtcctctcatctgtctgtttaattaaatgaggtgtcatatatcaaatacttgattattgtaggcacttgagatgcaatgtttgcagctgggcgtggttgctcacgcctgtagtcccagcactttgggaggccgaggcaggtggatcacttgagctcaggagttcgagaccagcctgaccaacacggtgaaaccccatctctaaaaaaatagcaaaattagccgggtgtggtggtgtgtgcctgtagtcccagctactcaggaggctgaggcaggagaattgcttgaacccgggaggtggagattacagtgagccatgatgccatgatggcgccactgcactccaacatgggtgacagagtgagacttcatctcaaaaaaaaaaaaaaaaaaaaaaaaaagaaaagaaaagaaccaatgcttgttttgtggtgtgatttgatggctatcttattggctatctggacttcataatcccattttctcatcctcattgaaatacaaaataaataaataaataaaagcaaagcaactaccttaaaaccccaaattctggcatttgtttatatagtgatccttctgtatccatggggaattggttgcaggccccccagattttggatgctcgagtcctctatataaaatggtgcagtatttgcatatgacctacacatatcttcccatatactttgagtcatctctagatgacttagaatacctaatccaatggaaatgctagtaagtagttgttatgctgtattgtttagggaataatgacaagaaaaagaagtctatgtgtttagtacagacacagccgtccttttcacatttttacatttttaattttttgtgggcacatagtagtatatatatttatggggtacatgagatttttgaatattcttgatctgtggttggttgacttcagggatgcggaacccacagacactgagggctgactgtacgtagaatatatgcctttgaaacactgttttggattcagattttgtgtcttcaaacttttttttatcaaaatttaagtatatttctgaacagtaaggcattggactccatgccagggggtgcagaggtgagtgttctggtgatctagaaaggagttg

SEQ ID NO: 187984 - DNA, 951 bp, Homo sapiens
ctgaggatcagcgtccttcctgcctacctgtcctatgattccccgtggcctgtcaggaagatcccgctgtgctgcacggtccactgtgtggcttaccatgtggagtccaagatgtacgctgtggccaccagcaccaacacactgtgcacctgcatcccacatgactggcgaggagaaggcatttgagaccattgagagagatgagcagtgcatccacccccaggaggcggccttatccatccagttcatctccctagtctgctgggaggctattcccaatgccaggattgagctgcagaagtgggagcttgtgaccagcacgaagacagtgtcgctgcagcaaggagaccaggtcaggcttcaaaggctacgcgtggccgccgggacctgcctcatgcaggaggaggaggaggtcatgtcctgagggcggatcttgatcatggatgtgactgaggtggtgcccgagcccagccagcccttgaccaagaacaagttcagagtcctttacgagaaggagcagaaggggcccgtgactgccctgtgcactgcaaggccacctggtgtcggccatcagccagaagattttcctgtgaagcctgcaggccagcgagctgacgggcatggccttcatggtcgacaggcagctctacatccaccagatgatcagcgtcaggaacttcatcctggcagccgacctcatgaagagcatctggctgctgttaccaggaggagagcaagacgctgagcctcgtcatgggatgccaagaccctggaggtgtacagcgtggacttcatggtagacaacacccagctgggttttctggtgtctgaccacgactgcagcctcatggtgtacatgtacctgcctgaagccaaggagagttttgggggcatgtgcctgctgcgctgggcagacttccatgtgggtgcccacatgaacgcattctatag

SEQ ID NO: 187985 - DNA, 1114 bp, Homo sapiens
gtttgctctctttgtgtgctgatgtctgtttttgagtgtgcctggtctctcctctttcttgctctgtttcctcgcgtgttgggctgtggccgagtgtctctggccctctggctttactttcctctcttttggtgcctccgtcttgtggtgtcccccttccgtgtaccgatactggtgcccggggctccttcgatccttatctctcgtcctctgtgcttccggcctcttgtgctcttctgccgatcctttgtatgactccggttgtcataggttacaggtgacagggttgtcaggctctccagtgctggtgtgttctctagtgtcccgattctcagggacatgcccggcagccatggcataagctaccacctgccagtctgaagctctcgagatgagctcatcgtttgtcccggccgtaagacgatcttctgtgtcgtttgcaaagcatccgactaccgacatggccgcttaccaacaagaagagcagatgcagcttccccgagctgatgccattcgttcacgtctcatcgatactttctctctcattgagcatttgcaaggcttgagccaagctgtgccgcggcacactatcagggagttacttgatccttcccgccagaagaaacttgtattgggagatcaacaccagctagtgcgtttctctataaagcctcagcgtatagaacagatttcacatgcccagaggctgttgagcaggcttcatgtgcgctgcagtcagaggccacctctttctttgtgggccggatgggtccttgagtgtcctctcttcaaaaacttcatcatcttcctggtctttttgaatacgatcatattgatggttgaaataggtgagaactgaccttgtatgaaagaggaagtgaggccgggcacgccggctcacacgtgtaatcctagcactttgggaggccggggcgtgtggattgccggagctcaggagttggagaccagcctgggcaacatggtgaaaccctgtctctactaaaaaatacaaaaaattagccgggcttggtagcacgcgcttgtagtcccagctacttgggaggctgaggcaggagaatcgcttaaacccaggaggcgtaggtttcagtgagcc

SEQ ID NO: 187986 - DNA, 715 bp, Homo sapiens
catgtttcttgacaaagtttatttgaatatcatttgaagaatttaaagataccctgccttaaaaattagggtcatttatttttacctgggtgtcaactgcctttttatattaaatctgtgtctttcttttgaatgtaatctacatctctgtgtgaaagtctctctgtaacagaaaattcagatatttaggttgacgtctcattcatatgacaaccttacttttgtgcacaggccattgggtggggcttaggaccctaaactcattaaagggccaggtagagtgtgtggccctcttggactgtgatacctggccaaatttcccagtgatatatcattctcggaattaggtggaaaaggaactaatccattgattattttactagagtgtttgtggtactcttggatcttggtttttattatcctgtatcctttataaagcatgcttaatggatgtgcctcaagggaaagagaaaacaatcttaactgattatgttatgcatagctctccctgatgccacatgctgtaggccgagtagccagagtgtggatagacatgtattactaccgcatttacagcggactctgcttagggcagaaaaaaggttgttctatgacatcccaaagctattaaaggtttttttatttcacttttgttcccttaagtaaaagcttctgtccataaccacgctaaaataaagcaaaacccatttaaaga

SEQ ID NO: 187987 - DNA, 364 bp, Homo sapiens
acatttattaattcagtactttactgaatactgtgctgggcattgttctgggccatgaataagacagacctggcctggtgcagtcgccattgtatccagcccagttatgtagttatgtgccatttctaaactactttagaacccatctctttggtgtttgtttgtttgagacagagtctcactctgtcacctcagctggagtgcagtggtgtgatctcagctcactgcagcctcggcccccaaggttcaagcgaccctcccacctcagcctcccaagtagctgggaccacaggtgctctttttgttaagagtggaaaagccaaggtccatgtactttttttgagaaagacagcctgttggcttt

SEQ ID NO: 187988 - DNA, 310 bp, Homo sapiens
atatattttattataatttcaaaactccttttcaccatttttaaatgtattaagtagattcactctggcattacatacattcacattgttggtaactattaccaccatccatctctggaacattttcattttcccaaacagaaacctcatccccattaaactctaactctccatcccctctgccctctagccactacccttctacttttgtctctatgaatttgacggctctcagtatctcataagtttttcgttactggcttattttcacttagcatgttttcaaggttcattaatgttgtaccatgtg

SEQ ID NO: 187989 - DNA, 792 bp, Homo sapiens
ggactatttctaaatacagaaaaagctttaagcacaaatatatcatctctcagtcacaaatacactgaaaaatcacgcaccacatttaagtagactatgatctatccacaggccagaatattaagcaaacattagctacaaaaactccaaactaacacagaaagcattatgactgggcagtgtgacagagccaaagagaaatttatgtactatttgatttgtgttatgttttacaacaaaaactcgtagaacaaggatggaaaagagacactaacacctgctccactgggggccatttatgttgggttggatatattcaaaggggaggttttccttctttcatctctgtaaagtttcagcaatatgcatgtactctcatgatgaaactttaaaaattaacactttagaaaacaggaagtgaaggaggcccgctgagaagtgcattcacctgcaggtttactcagagcagcgccatctgtgcaaaggtcccgctgcccagggggaccctgatgtggacgtgaacccagcgcccatgcccgcttcttctttcccacacttccgcatgctcaaccattaagtaccaagaggttcgcccaggagctgggaggttaatatcggaaaatgtcaatactggaacagtggcgcaaagccgaaggttggcccaggaaaccgtctgaatatcacaagcctggtcatgtagggcctggaaaggaagagcacaacgtgtacccggcagagctgtgagtgccacactggggacccaggtggagcgccggcctcctcttcccggcc

SEQ ID NO: 187990 - DNA, 198 bp, Homo sapiens
agccagccgcggcttaggcggggcggaacggtccactgcttcgcggcgaggggaggagtcgggaagagccgggcgaggcggagggatccctctggaatgtttccgtcgggtccacccgaagcggaagacgcggattggctgcgagcaccgagaggcagccgctgattggccggccgcgggcgtcggccccgcccccca

SEQ ID NO: 187991 - DNA, 323 bp, Homo sapiens
  misc_feature (26)..(26): n is a, c, g, or t
  misc_feature (64)..(64): n is a, c, g, or t
  misc_feature (93)..(93): n is a, c, g, or t
tagacaggctgatgctcctttctcancattcgaaggtctttctgcatctaacaatctcctgccnagtttctgtttctcccgttctgccccggntaatttaaactccggatgttccagacctctcatctctccctgtgcacacaaggccttttcacatctgtgggtcttagtacacccactgttgctgtcaagaatgtcctcctcctcctttttttttttttttttgagatggagtctcactttgttgcccaggctggagtacagtagcgcgatctcagctcactgcaacctctaccctgcatcagcctccctagtagctggga

SEQ ID NO: 187992 - DNA, 317 bp, Homo sapiens
ttttagatattgcaggtgttctttgtaagactttcattaaggtctttttctgtttctgtttctcttctaagattgccggtctgttcactcattatgactattaagtctttgaacttttttttttttttgagatagtctcacgctgttacccaggccggagtgcaatggcatgatctcagctcactgcaacctccacctcctgggttcaagtgattctcctgccttagcctctgaagtagctgggattacaggcacatgccaccacacctggctactttttgtgttattagtagagacggggtttcaccatgttggcc

SEQ ID NO: 187993 - DNA, 279 bp, Homo sapiens
tgggcctctgtttcctcccctgacaaatagggataataatgttactgctctattatccacaattatggttataagaaaatatatattttttttcaaataaaatactctaccaaagcctgaggtcaatcatgattctttgagccattcattttccaaagagaactttattgagcacataccatgtgctggaactcaaggtagttgttggcaccatagccataaagcaaggaaacacagaatggttgccctcatggggatcagagcctggcagggaaaaca

SEQ ID NO: 187994 - DNA, 229 bp, Homo sapiens
atgggtgtttgccaagaggggcccataccaggtgaatgcaagtgattggcccaaactcctcgtgttccagttgggaaaagtagcaagcttacaatgtggatccctcaaagtgttcacagtacatggaattctccctctctgagatgtcaagtttcctaactctggctgcatattaatgtaacctgggaagcttttaaaattttcgatgcctgggtccttattgacaaca

SEQ ID NO: 187995 - DNA, 561 bp, Homo sapiens
gttacataaccttaacctgctcggatgaatgttataaaagttattgggtaccagacattttggaaaacagctaaagaataaagtaacaccattaaagttcaaagtcttatttcatccatgttcctaacaagggatatgaactcatcattttttatggctgcatagtattccatggtgtatatgtgccacattttcttaatccagtctatcattggttggacatttgggttggttccaaagtctatgctattgtgaatagtgccgcaataaacatacgtggtgcatgtgtctttatagcagcatgatttatactcatttgggtatatacccagtaatgggatggctgggtcaaatggtaatttctagttctagatccctgaggaatcgccacactgacttccacaaatggttgaactagtttacagtcccaccaacagtgtaaaagtgttcctatttctccacatcctctccagcaactgttgtttcctgactttttaatgattgccattctaactggtgtgagatgatatctcaaagggggtttggattgctttctctgat

SEQ ID NO: 187996 - DNA, 380 bp, Homo sapiens
ccagttaataagtgtcagggctaaggtatgaacccacagggtccaactctaggacctgtactcttcggcaccatcctttcagtgaattaccagtagctgctatggactgaatgtttgtgtccaccccccaaccccaaattcatatgtttaaaccctaatccccagtgtgatgtgatttggagatgggactttggggaggtaattaggttatgagggtgaagccttcacaatgggattagtgcccttatgagaagagataacaagagagcttgcttcctttctctctgctctacaaatgtgaggacatggcaaggaaaccaggaagagggccattgacagaactgaaccagggtggctcgcacctctagcactttgggagg

SEQ ID NO: 187997 - DNA, 607 bp, Homo sapiens
tcaggaatgctattgatgctattgtattaaataactgtcatgccaaaggcacataatactataaagtttatttgcaatgttgagcagaaacatctatttcttttttatatcaaagcttattagaatgctctatcatctatggagtgtacagaatcatttccagatactcttgaaccaaaaaagaatctgagcctctcctaacaagtagttacaacaatgtagaaagattacatgggaatgttaaattggtaacacattttacctcaactctgtttccaaatatattttcagtaagttcaatgggcaggctaaaaggtaaaatctgtccctagaaggtatattatttttacaacaggatgagataatttaaaatgtattataataaatccaactcatgcattttaagcatctactcaattttcagtaatatgctagaaattttcagtaatatgctggaaactgctatgcagtttaaggataaatgttttactttattaattagctataggaaataatatacttacgcagtttttgtattttttaaaaatagtctaattccattttgttcaataagcattgatttactgtccaggtgctagtataggtt

SEQ ID NO: 187998 - DNA, 305 bp, Homo sapiens
acgttgacacttcaggttcctttattgtggaatttctttcttggcctatctctgtcgtttgtgacttgacatttttgaaccatacagatcagtgtttatttgaggcttccttatgattgaattaacatttgcattttgggcagggatacaacagaagtgatgtgtcccttatatcccaagattgccttatatagaagtcacatgatatcttcatgtgggttggttctggtattggaatataatgaaccagaatgctatgaacattcttatacaagtatttttatcaatatttttatatattttgg

SEQ ID NO: 187999 - DNA, 441 bp, Homo sapiens
agtctatgtttaattttgtacacagaagaaaatgtataaatagtgcatatggtttgtaaagtggagtaggggagattagggactctagcttgcacctcttgccctgttacacaaggactcatccttggttcccatgtcctcctcaatgccacctcctgggaggattaggtccaggtttcccaaggaaacgaccatccatggagagtgggtcaccagacatgcagacaacagatgcagaggccgaaggggtcctgatctgagaggtgagaacttgccccaaacaaggcttcaatgggttctgagaaccggcctgaggggaaggcagggagcggcggttctcagagggttctgcccaaaggctggtcccatccctacaaggaaacttacagcagggccacctgctgggccagagggctccctgggcgaggggcagtggtacag

SEQ ID NO: 188000 - DNA, 567 bp, Homo sapiens
aggagctgagaggccaaagaaagaggctgacaaatccagtcttgcagaaagaaatttcacagggacataaaaacaggagccatatctcaggtagccacaagaccgtggattcccatacctgacctccagaaagtattcttaatatatcaagcttttagcataaaacatgtgcagctgatcatgtcttcagactttcttgccaagacttgtgaccactggagaggctggataagcatctttatgaagggttatctatgctacaggcatttttaaagaacttactgtagaacaacttggtatgtggggcccaaatatccatcatcatggtggtttcacttcaagatggcctcactctggccatgcaacagggtgttttcctacagttgtgaggattacatgaaatgatgcgtttaaagtttctcacactatgcctggcacatagggatcagtcatgaaatggcagttactcttctaataatttgcctgagattatacagtcggtgtgttaacaatacctggagctgtgttgtgactttagatgaggcatgaactctccagtttggcaat

SEQ ID NO: 188001 - DNA, 221 bp, Homo sapiens
tggcaaaaaaaaaattcatgcaaataacaagagcaataatatccatccaacggcaagcctacaggaaagtaagcattcttctacactattggcaggaatataaattgaagcaacctttttgggagagcaattgcctggaatctatgttaatgtaaattgtacatacccacaatcacacccttagtaatacagtgttcagaaatactagcacttaagaaaat

SEQ ID NO: 188002 - DNA, 425 bp, Homo sapiens
tcaaagcaacatttctcagcagtgtggaatacttctaaagttgcattattgttgaatacatagagaacctatcttcagtaggcaaggctattccttcatacagaaaaaatatataaagaccatctgacacactgttgatggacacttttaagtgtaagaaattaattaagataatatttggctgtaatactttgcatttgaaattttgtagacaattcattttcaagaggatgtgatatttttgggagattacctatactgaacaatagtggatgttagaattattttgcaaatttaactttataatatcatattctataaaagttctgcatattaattataggaattggtttttctaatttgatcatttaagcgtagaaagatttgtttggaaattgtgaaatgtctttatactatattttgtg

SEQ ID NO: 188003 - DNA, 831 bp, Homo sapiens
ggagtaatgaaatctgacttacagtttagagtatcacgctggctagtgggatggaaatagtctgtcgggagacaagggaggaagcaggaaggtgagttcacaggccagtggtagctcagaccagggtgaaagtggtggagatggtcagagtcaggttcgggacatatttaaggcaaaaccaacaggatttattgattaaatggatgtgaagtgtgagagaaagggagaagtcagggacgacgagaattttaggggccttggcaagcggaaggatgaaatcatcatgaactgggatgggaaagactttgggaggtacagggatgggatgggggttcattctgttttggacacgttaaactaggaagccttttagacagcaggtgtggtgagcaggcagcagaatatccaaggctgaagttgcagagaatgggctgaaattataaatgtgggaggagtcaccagcatatataatactacataattctatgtatgatcatgtgtaatttgcatgactatgtgtttactgtctgccccctacaagactgtaagctccatgtggccaaggaccacgtctgttcacagccagcagggtgcttggcactcagtacatacttactgagcaaatggagaagttgcccaattactccctcaagaatagccacacagcccacacaagaagcagactctcttgcaaccacagtgccaagcccaaccagccccaaacagggccctgggtctgtccaccccgagcttgagattccagaacgtaagtggatatgcctggcacatcacagagtcagatatttgggtttcagccctgccacattctca

SEQ ID NO: 188004 - DNA, 278 bp, Homo sapiens
tacctgccttctacccacaaggtgctccctaagcagcactagaggcctcaattttcctgaccagctcaaagataaacggacagaataactcccactgctcaagcatgggctgcacacactattgtagagaaaccggataagtagttgaggccaacttcagcagccataaagcacacagacagcaggtatccttgatatgaggacaacaacattttaccttggggatatcgctccaaaaacccatttgccagtcataataagaaaaaacagcaaattcc

SEQ ID NO: 188005 - DNA, 509 bp, Homo sapiens
cggcatcttcctcatccccatgtccccagcccatccggtatggtgcctggcacggcagccaccatcagtagccataatagctactggttagcacacactcgctgctgagctataagcagaattatagctctttaatcctcaaaatatccctcaaaataggagggaagtagatgtatcagctccacttgtttactgagtgaataaactaatggaagagaatggcctttcggacatttgagttctctaacactgctgggaaagttttaataaaccagggcttgccactcatggtagaggagcatatcgaggtgtggagcatgagctggggtctgcctaagtgggttcgaatcctggctctgccatcttttagctgtgtgactctgggtgggtttactgacattctctgagcctcagtttccttgtctcacaagaccttggtgaaaattaaacaaattcatgtgcaaaagtctcaaacacacagctgccatctgggggatgggacgggatct

SEQ ID NO: 188006 - DNA, 523 bp, Homo sapiens
tactaaatggctgtacctagatgtatgttacctaaatggctgtacctaaatggctgttacctaaatggctgttacctaaatggctgttacctaaatggctgttacctaaatggctgttacctaaatggctgtttattatataatcagtgctactataatactctttgaaaaagcaaatttgtccaatgcaactgatgtattgggaacaatttatagtaacacaaattttgcatttgttaatgtgcaattttgttcacaagaaacactagataaacacaggaaactatacctcactgaacagggctgggtaggaatacataaaacacatacatgcacacatcttaaacatctaccagccacctagatcaccacatgttatggaccacattcatctggttacaattttccatctgatttcagatgatcttcttccactacttcataactcacaagctgcaacccttctcatgcccatttctataagcaaacttcggggttttacagagtaaagtaccatatttat

SEQ ID NO: 188007 - DNA, 401 bp, Homo sapiens
aggaaacatattgctctcagtctctactgcaactttattctgtttacaaaattacctgtgaccaacaaatgggaaaagccatggtctttaaaagaaaaaatatgcaattccatttccactatttattcttgttagttcactgactgaaactgaaatgtggtttattacaatggatgaaaatttggaaagaaacaattaatttgcataatcaagcaatctgcattatattgcataaaagacaataacaaagtgaattatgtacaaggctagacttcatgctttgacaaacaaaatgtagcagaatagtttctttaagtggaacttctggacaaaatttccatatgagatataggtagcatggatgaaatagagatgttaagacattttagtttttttgtttt

SEQ ID NO: 188008 - DNA, 532 bp, Homo sapiens
taagcactgaacaaatcctccttaatatcgtccacttatttctatacctcttagtcgtacagcatttccctgtttagttgtattagtttatacatccttggtattactgttattgataaatcttaacattgaagagctctctttcttagactattatcacttaaaatttgagcacatttagctttcacgacctctaatattggtatgaaataaacctagcatttaagctaaagacacagtggaatgtctaaaagatgctgtcagttacttattttcttgtttcataaacattggatatccctcaatttatattccaagatagccctcaaatatgatttaatacactttttgttgagtgttctgttaaattttcacctcttgtggcatttattatttatccttttattatagttatcctgaacattgtcttcgctcccctatttcactagaagcttttcatggtatttattatgtcctattcagtaaatattttcctcaaaaatttctataaaaattattttaaaataaatta

SEQ ID NO: 188009 - DNA, 757 bp, Homo sapiens
cctgccaatttttgttgttgttgttttttgtagagacaggatttcacatgttgctcacgctggtctcaaactcaagcggtttgcctgcctctgccgcccaaagtgctgagattataggcgtgaaccgccgcccccagcctcaggctttttttaaaaatacaaatggttgcatagtgtactggattttttagtccttattttacaacccataggagtactcatagagctgcctcattcttttgaagcagaaataaatatccttatacatatttatttatgcatatatgtaagtatatcaatgagataaatttctcgaagaattactaagtcaaaaggaaggtgtatttaaaactgatagatactgtatatcaccattagaaataaggaaaactcacaccatttatcttatttttctctcaccttctatatccaatccatttgcaaatcctgttgactctaactccaaaataaattcaggacttgaccacttctactctgattcaacccaccttctcttatcaggattatatttcagtagccttttaacggtctccttgcatcagctattgccccttcattattaggagccagagtaatattttcaaagcatatatcagcccttggctccagatcctttcagagcaaaagccgaagtctttgtggtgtcttaaaaagcctgatcagcacctctccttttccccaaaccatctctctgcccccctttgtgatcacatttgctactgttgactcctctgga

SEQ ID NO: 188010 - DNA, 505 bp, Homo sapiens
cccacccccaagaggaagtagaaagcatgaaccttgataaatatagccttgagaatgatttattaggaatgaaaactttctttaaataagtaagtaaataaggttacagttatctaaatatcataggtctaacagagtgtaagctcttcgaagggaactacttttatttgtatgtgcatagcgtgaaagtgtggaataaatcaatgaatgcatcactaataatacaggattttagctagcgtttttcctttttcctttaatttatgtttagggaaaaaaaaacctacaccttcaaactaaataggtatgattttacctttagagtgatagcagctgagatgtttttgtcctaataagcaccatccacataaaaagtgaatggcaaatttcagccctactcagaatatttcagcagaacattaggacaaatggattttcttagatccacgtatggaagctctcagattatgaattatttggaacatcagaaacttggcaacagttt

SEQ ID NO: 188011 - DNA, 398 bp, Homo sapiens
atggcgttcccctgtgtgcatgtgggtattccttcttttaagacaccagtcatattgggtcaggatacatcctaatgaccttattttaacttggttatttctgttaaaaaccctatctccagctggatacagtggcctacacctataatcccagcactttggaaggccaaggcaggcagatcctttgaaccaaggagtaggagaccagcctgggcaacatagtgagaccctcctctccataaaaaatttttcaaaattaaaaaaaaagaaggcctgaagctgacatagctgagaaagtttgttttaactcactaccattgaataaaaacttaatagttttatcaagatataatttacatactatgaaattcacctattttgtgtacaatttaatgatt

SEQ ID NO: 188012 - DNA, 367 bp, Homo sapiens
agtacgagactggatgttcatgtcttaagccttccagtggagcttctgatgtaaatttctcttaaaccactgttttcagtccgtgaagaaaatgtgtatgtatgtggagtcatcaatttttttcaggaatttaaattcctgaattttaattttaaaaggatttacactgttttctgaccactgtttgcttgtcctactgaagaacagaagcaaacatccagtcccttattccatagataatagttccatagtagcctctgtattgttaaagagctgcataggtaattctagaattattctagttgatctaatatgaaaggagaattggtatagatttgtccttaaattaactgtgtctgcttctaga

SEQ ID NO: 188013 - DNA, 358 bp, Homo sapiens
ctgtgtctttgagggtgtttctggaagagattgacatttgaatcagtaaactgagtgaagcagattgccctcccgagtgtgggtgggcctcatccaacccatggacggcttgaataagatgatgggttaagaaaggtttctgctccactgtctttgagctgggacatcagtcttctgccttaagccttggacttggtcttgaactatattcgactctcctaggtatagagcttactcagagtagaacttgggcttctctgcgtgcgtgcatgcgtgtgtgtgtgtgtgtgtgtgtgtgggtgtgtgtatgtatcctcacgccacagtcttatagacatgtaacagaaacaacagccag

SEQ ID NO: 188014 - DNA, 621 bp, Homo sapiens
ggctctggctagagggagtggcagtgggtggatatggtgagcggcacttccagatccccgaccgaccctcaggcctaccttggccctcgcagaccagacagcccgtgggggctgctggcgtttgcagcgagggagagactggccactgacgcttcccgtttttggtgggtttccacctccctgagatgctccaaccatgtctttctggttctctttccagaggcactgggaaagggacagcaaagcagagtgggcagctgagaccctcacatcctcattaggaggagggagaccacagctcgatgaggcagcagagggatgaagggggaacccagccagtgacaggtctggttgggatgcccaactccacctcctgcccccacagatagaccactactgtgtccactgccccggcctagtccaagccactaccgttctgtcctgggatttctgggactgccctcatctgtgatgggggtctctgtgtccagctctgccgctctcctgctccctccctctagtctccctccagaactccctccagtcagttctccatgttttagctggagctgcctttataacatgcgaatcggttacctctctgtacttaaaacccttcca

SEQ ID NO: 188015 - DNA, 184 bp, Homo sapiens
tagggtaagtatatgtctggcttccaaagcagttctttaacaacaaggaatgaacattatttatattcccacagttcctaacaaatgtctttcatatagcaaagagctaaatgaacacttgttgatgaattaatatagataaaagaaaaagaatggagttctaattataattattggtttggga

SEQ ID NO: 188016 - DNA, 470 bp, Homo sapiens
gtacaaaagcacgtgtgtgaggggagcactataggaaaaactatggaaggctataaggtgatttgtgatcaatggttgtatcagagaagtggtggcaaagatgaggagactgttatttggatacttctttattgtctggattttcacaataagcatgtataacttttgaaattcaaatgagtgaaaccaaaataaaaatctaccagctaaatttgttaacaaagaatgggtattgcttttaaaacacaaaaaatcaaattatgtacttttttaaaatgtaagataaaacaccctaggattatgctacagtttgtgactactggatcctgaaaatggaacagttaatgatcaaatatacttgacagagatcttggtggagaaagaaatttggattccattaatacatactgagcaccaccatcaggtattagacactgtattaagcagctatgcagtaacttaggacttag

SEQ ID NO: 188017 - DNA, 343 bp, Homo sapiens
gaacatttttaggctgcacacagaactcaggcagatgagcaatttgtttctgacacttaaattacctgaataggtagggaagaagtggtactgacagtagtttcaggaccaaagaatgtatttccctttctattaagaagttcaggcaaactataagcagagagatgatagcacccaactactctggagctctacctggcaagtctttgggataaatcaaatccattcttttttttttttctttgagacggagtcttgctctgtcacccaggctggagtgcagcggcgtgatctcattgcaacctccacctcctgggttcacgcgattctcctgcctcagcct

SEQ ID NO: 188018 - DNA, 320 bp, Homo sapiens
gacggatacacgtgggtacacatgtgtaattactgtcacagagtgacatgtacattcatgaacagaatgtgttaggcagaaatgtttcactagcatcctgaagaaacaaaggaaaatcactaaatgcaagaaaataattgctttatcaatttttgatcagcagtctcaacttccaaaaaagcatgaactatattatattcccactattatacattgtatcttaagaacagctccaaatcaaattaagcatcccctgaattgagatagaaagacagcagttacaatcaatggtgatgagtatggaaaaagggttttgtttt

SEQ ID NO: 188019 - DNA, 375 bp, Homo sapiens
agaatagtggaagagtgaatgtgtgcctatggttaattttgagggtttgttttgaaatcttgttccttaatgtatcttatttttgtttacctgccaatggatagaaaatgcttgtgaccacgtgaattttcacccacttgaatagattactttataatttcatctattaccctgaagacagaattcaatgtcattcttacctttatattgtcttctcactcaggttcctcccattaaacagttctagattttaagcataatgctctatatgtttttacagtgtgttaattattactcaggtgtcagtatagcaaatgggcttttgatcatcattgtatgcatgatgattctgtacggtggtatctattatttctt

SEQ ID NO: 188020 - DNA, 410 bp, Homo sapiens
tctctgcagatttattctcatggggtgcattttagaaagagagagagcatgagagagagagaaataatgtttcagaacaaggaacttttcacttttgagataaaccacagcatagttcactctccagtgtaactgagtctatgacactgtttgacctgctatttgcatatgtctgaagagtaaaaccaggttccttctagtatcccttctgaatgatttaggaattgacagactacaatattctgtaaagtaggtatttatttcatcaacctgctttaattgtaccatagcagcccaagaattacaggtgatagttattaaataattaaaaaataaatttatggagtatctgcgatatacaggtcactgttttggagactgtaggacaagaaatgtgacatgttcttccc

SEQ ID NO: 188021 - DNA, 430 bp, Homo sapiens
gaatgtgcagctagccccgcttaattgatctaagcagccagggtcggcaggggagctttcacgtacacagcctctattcctggcttgcaggactgtttacctaaggggcaaagaagtccacctgcgaaagacaccatgttgctactacagccttagcaacagcagtagcccggttttcattgttgttgtttacagtcatgagagccatactcctttaagaaaacaccaaactcctttccctcattcctggccccaatcagtaatcaccaagactgtcagctgcctgcagttatcgggaagagcagcctggggaaagttataggagcacagatggacagttgctttctgcatgcaagtggccagctaggatccggggggcatcaagccatgatttttatttctgtgctggatgcattagcagctgttgtaa

SEQ ID NO: 188022 - DNA, 264 bp, Homo sapiens
atgaaggcctttccacattcattacaagcaaagggtttttctccagcatgaattctcaggtgccgtcgaaggcttgaattagttccaaatgtctttccacattctttacattcaaagggtttttctccactatgaactctcatatgctggatgagatgtgagttctgattaaaggctttcccacattctttacatgtatgaggcttttctcccacagaacttctctgtgttttgttagattctaaaatctctaggaagttttgg

SEQ ID NO: 188023 - DNA, 284 bp, Homo sapiens
acaggagcactgtgtgtgtgtgtgtgtgtgtgtgtgtgtgtgtgtgtgtaattacacaagtaatgcatgaatagattgtcattctgaaaataccagtggtacatgagtagagtgaaaaatgaaagttttccttcactactctgatccctttccattcctctgcctagaggaaccttgtgaacagttaattatgcaaatgtatttgtttctacttaaatcatactgtgcatattctgcaccttgattttttgggtcatctaacagatctgtccaggtggtacatg

SEQ ID NO: 188024 - DNA, 383 bp, Homo sapiens
ctagttcttgaaggtgatgtgattatttgagtcatcttttattgttactatcaggaactacaataggattttggagaaattatggagagaaatttggccccaagaaaacatgggtttgtattagtttcctatggatgccgtaacaaattatcacaaacctagcggcttaaaacagtacctagttgttatctcacaggaagattttcttttttttttttttttttgttatactttaagttttagggtacatgtgcacaatgtgcaggttagttacatatgtatacatgtgccatgctggtgtgctgcacccattaacttttcatttagccttaggtatatctcctaatgctatccctccctcctccccgcaccccacaacagtc

SEQ ID NO: 188025 - DNA, 572 bp, Homo sapiens
acctcctaccccacggattctctggatttgttctgtaaatatttatataaaaatatattctagggcagagttgaatcaccctgagtaaagagtgctgtgggcaaggcatgacctgaactagcgtcacctaatactctcagcttctagacgggaaagtagtccacacctcaggaccaagtgtaactccatttctctcggcctctcagattagtgcttcctaaccagcagccacacttaagctcagctctgggatggacatctccagcactcaaactctctctgcacagacctgcccacaaaaatgcctacacccaagttccaccctgcccccgcttcggtttccatgaccccttactaggagtcacaaacttaccaaggctagcccccaggagtgttttgctgggccaataagctatttttaaatgactgattttttggccgggtgcggaggctcacgcctgtaatcccagcactttgggaggccaaggtgggcagatcacctgaggtcaggtgatccgcctgcctcggcctctaaaagtgctgcatacaggcataagccactgtgcctgccc

SEQ ID NO: 188026 - DNA, 440 bp, Homo sapiens
tgggttcaaacgactcacttgccttagcctcctaaagttctgggattacaggcgtgagccagcatgcttggccaaaatttaccatcttaaccatttttaagtgtatagtttagtatgttaagtatattaatactattgtgcaaacaatctccagagcttttcatactgcaaaactgaaactatacctgttttacaattccctatcactccctcctttatccccaggcaactacgatcctattttctcttttatgagttgaactattctagatacctcaaataagtggttgtccttttgtgactgtcttgtttcacttagcataatgtcttcaaggttcatccatgtcgtagcatgtcagaagttatttcattttaaaggctgaataatattacactgtatatgtgccacattgtgtttatccattcatctattgatggac

SEQ ID NO: 188027 - DNA, 501 bp, Homo sapiens
ttactgagcaggttgccacaaaaggtaactggggctcaatctcactgggcccttcagttattccagctgaggggtggtgaagctgtggtatttatccaccaactccctttcttcatggctgttttaaaatgcactcaagattttcattagatatggcaagccggcctatgtcattcttattctttaaaaatatattcatttgggttctgcttgaaggagagcctgagtcaaggatttgggtgcatgcatttttttagaagatgattccaggaagcaaggtaagagggtgagaagtgagatagggaagggaagaaagtcaatagatggtacattaatgagcaggttgccacaaaaggtaactggggctcaatctcactgggcccttcagttattccagctgaggggtggtgaagctgtggtatttatccaccaactccctttcttcatggctgttttaaaatgcactcaagattttcattagatatggcaagacggccacag

SEQ ID NO: 188028 - DNA, 104 bp, Homo sapiens
ggctgacctctgaggattcacttttttaaccagaaccacaagagtttaaaatgtgctgacctcttctgtaatgagtgccagtaagtagaatgctacttaatggg

SEQ ID NO: 188029 - DNA, 194 bp, Homo sapiens
cccacccaaatgacccccaattacaaggatggagaagggacctgaatgaacccccaccttctgcctcctaagctaaagtacctatcatccaagtaggacagggtgtgcctcccccaggagaaaggatactgccgggggctgggagacccccaaccccaaacccctaagagcggggctgttgttcgagatccccc

SEQ ID NO: 188030 - DNA, 380 bp, Homo sapiens
tcccgggatcaagggatctcccacctcagcctccttagtagctgggactacagacacccaccaccgcgcctggctgatttttaaaactttgtatagatggggtctcactatgttgcccaggttggtcttgaactcttgtgctccagggatcctcctgccttggtctcccaaagtgttggaattacaggcctgagccaccacaccgaacatagcctattaatgtcagcctatttctctatttatgaattttctgaagtgttatttttatattcagatttatagaagcttttgtcttttatgaccttgacacttttaaagggtactctcagctattttgtagaatgtccctcacactggggactctgaccttatgactggac

SEQ ID NO: 188031 - DNA, 400 bp, Homo sapiens
cttgtgtcccgccgtgggatctgttcgaagggggtagtccccagcagttgtcctgacctgaatatgtttctatttcctgccttcacagaccctgaagcaggtgacaggagtccctacaacacgttctgtccttcaccggaaaggcatctgactagcatgcctactcaaaagtcctccaccttgcagaatctgcatggagtccttggctatgctagcagagtctgaaaatgatttcctatgctcgagcaggggttggcattgctaaactgctgagggacagagtgaaacactcatttcctgtgttctgttgacctgcgtccacagtgtcccctctgggtgccccccacatgttatgtcttcctctattcgcaccttctcaccgtttatcattatctagttt

SEQ ID NO: 188032 - DNA, 287 bp, Homo sapiens
gtagggctgtcggtctagcacccataaaccaaaatgaggcagggattggggcttgccctatgatgctctgatgaccaaagcagatgcgtagaggcaagcagcatggtattgggcaagaggactggactgggagtccagagatgctgcttcaccctgggcctttagacacgtctctttccctcccagagcctcagcatcccttctatcaaatgatgacattctgcctttttcccagggcggttgtggggatcgagggagacagtggctatagggatgctgtgttaact

SEQ ID NO: 188033 - DNA, 242 bp, Homo sapiens
tgtctcattggaatcatggctaggactgattttataacatgctcacgcaatctggttcataggaactcacaagctgtcccccagaaacccaatgctgatggagaaggcaggagaaccacttccattattgcaggcaggagtcataaattccagtccctgctcagtcaccaacttgctgtggaagaccttgtgaaagtcatttaattcccctagaccttaaccgttgcctctctaagatgagg

SEQ ID NO: 188034 - DNA, 275 bp, Homo sapiens
ttcacagtctaatgggaggggcagaccaggaacagctgactaccatgcatggggagagctctgataaacctgcgcactgttgcggaggcacaagtgagggtaccacatccgccttgtgttgcgggggcggttagggaaggctttgcagagtcctgagaaaatactaggcttgccagttggagaacgggaggcagggcattccaagttgaagaaacaccacatacaaaggcagagtcctgaaaacataaggtatgtccacaattagtattagtttg

SEQ ID NO: 188035 - DNA, 359 bp, Homo sapiens
tctgtttgtgaccattgttcacttttgttgagtcttaaaaagttgttttgggatctttttttaatgttaagaaatcagccctttgtgatatgtgttgcaagtatttctccccagtttgttgtactattctggttgtttctaccagatagaaatataaatacctatttgtttatccattttcttacttattttttgtagtatgatttaaagaatttttttttaatagtttctaggtttgtgttatagttaggccaaactgagattaatttaagaaaaaaagattccttcatgattttttctagtttttttaaaactggcatattttaatatttaatcttgactgtaaaatctggattttg

SEQ ID NO: 188036 - DNA, 364 bp, Homo sapiens
tgaactgcctggtcagggcaacatgcggtacaagcctaaaaggagcgcttttcagccctgaccacctgcgccctcctgagcgctggggagaacaaaacgcaatccctgcctttgaaatctgcatcctccaggagaatggcaggcagcgcagagtggagggagaaaattctgcttctgactaacatttttggtagtgatgaaatttttggaccctctgctaaggcttaatgtttttaaaagctaatcctgggaaaatagtcttgatttctaaggtagtacttaacctctttatttcccttgtgttggttcttgttttccaacttcagagaaggctttataggatcctaatagggacacagttcca

SEQ ID NO: 188037 - DNA, 550 bp, Homo sapiens
tggttggccccttgctgtcagccactcttcacacattcatctaacaaaatttactgagtgcctgcaatggaagaacacaagtgctaggttctagaaataaaattaaaaattcctttctttgacatgcaatagcagttatcatttctgagcacttctacatggagtatttcaggagggctcattgtatcctcacaataaacttatgacagaagcattattgataactccactttatagatgagaaaactgaaacacaggttaatacatggcccaagtcatataactagtaagtgactgagccaaatgtcattggttctaaatgattatgcctctgaaataattacagtgaaaagttcttaaagacattaataaaatactgaacaggaagatcttagctttgctgcagtttctaggatgaagggctacttgagctccaagaagctttccacccctaccccatgccgatgccatgccccatctggagcactcatcacatagtctcagccaagtcatttccatctcaagcattgtgcaaaagacaaacactcac

SEQ ID NO: 188038 - DNA, 280 bp, Homo sapiens
aggttgcagtgagccgagatcgtgccactgcatagcgacagagcgagactccaactcaattaaaaagaaaaaaaagaaactgcatgaaaaaaggctgagaggaagtatgctgaaggttaagagtaaacacattcactgggctagaagcttcaagaagggtgactaccacacctctagttcctaaagggcagtacacaaaatgtaactgaatttcttgatgatgtgattatgggtaatattttcttccttagacgttaccttagcatcttagatgaaaaaa

SEQ ID NO: 188039 - DNA, 709 bp, Homo sapiens
gttctagagaagttataatcatgttctctggagagagtaatatttaccacacagcagaacacttcagtcagactttgtttccctctaacattgtgtaggcaaaagactttggtacctcaactcgagctttttcccttttcatctggttgtcctagtagagtgtcaacacaggcaggaatagattaaaatgaagggacactatactgttattcaccaacacccctggaggctgtggccctgggttgagtaagacggcttggctttctcttcttaatgtttgagaaatctcctgataacttgcttagtatccaaactgactaaacccagcatactttaaagatgagagaataatgctctttttggaaaagagactgccaatttgaatgaaagtcaagggcttcagacaaactgcaatctcaaagccctctggacctctccttgcttttaatgaaagtttaaaatgatcttgtaagattctcgtaaaaactgctaaacacaaacgtacttctgaattttggtaatcaaaaatcatgagtgtataaagctgtaccttgcttggaaagataaaataacaaaaccctgtgaaaaccacattatatttgactttggctgacagtaaatcacttctaatgttcaatcttaaaactgatggggaaatctctcaaaacataaatgaataattattacaaatatgaagtgaaatctctac

SEQ ID NO: 188040 - DNA, 527 bp, Homo sapiens
tttcagtaaaatgtctctcacttttggtagtttcaatggactagaattgatttatgttgaattgtttttcttttgttattcacagaagccaaaagtaagaaaaacagttccctctataaactgagctgttatttcattcctgcaacaaatatttattgagtgttcacaatattaagccaaagcaatgtacaaggtatacatagtccctaccctctggaacttacattctagttaggagaaacaggcaataaagcacataaacaatgtataagtaaatttcagacagtggtaaatgctataaggaaactaaaatggggtaaagagttagacaatatgggattacatgaaagattgctgctttgagactaggataatcagggaattcctctctgaggaggtgacattttggctgaggtctgaatgatgggaaagagatagccatgtgaagttctggctaggtgctttcacataaatcttttcacttaatcctcacctcaccatgaactggatgatgttatctccattta

SEQ ID NO: 188041 - DNA, 237 bp, Homo sapiens
acagtctctaaaggtataagacaagggtgacacaaacactctgacatgactccaaacctagctacttggtacaggcaaaatctcttcagagagcagagctgatctgattgaaatgtatggtgtggtggcccagaggtaccctgggctccacagagcacagtttgaaagggccccggtttaggaaaccagcctaggaaaactgcaacttctggctcagaccaaagggtagaaatggag

SEQ ID NO: 188042 - DNA, 580 bp, Homo sapiens
tcctatagtcccagctactcgggaggctgaggcaggagaatcgtttgaacccgggggcagaggttgcagtgagccaagatcgcgccactgcaccccagcctggcgacagagcaagactctgtctcaaaagaaaaaaaattaagttcaacaaatgctagctgttatgagtactgttgaatgtgctacagagaaccattccattagcccagaagggcttcctcgctccacaaagtgactcaagtttctctctcccaatctctctctctctctctcaatcaaatatttgttaagcttagtctaggtagcaggagagatctggattgctaacaatatctgcctccgtggcctgtttgctttggttaaatcaaattaggcgatctgtgaggggatggtaaactgcacagatgacaggaattgtttccctgagccaggccctgtcctcagggagctcatagacaagtcgaagctttcacaggtagccactggcagaaaaagcatacgggtaagtctcgcaagaatggtattggatgagtattacagaaattcaaggaagagaatggcacacgcagtagatacttat

SEQ ID NO: 188043 - DNA, 388 bp, Homo sapiens
aatgtaggggtctgcattggttagttttctgtgtcaacttggccagcacgtagtacccagttattaaattacacacaaatctagtattgctgtgaaggtatttttgtatatgtggttaggaaattatcatcagtaatttggagctaactcatccaatcagttgaaaggccagaagggcaaaacaactttctctgaggaataataaattctacctatgggatgaaacttcagcttctgccccagaatttccagcttgccagccttccctacagatttcaaactagctaatctctacaattccataagccaattccttgaaataaacatatttatcatatctatctttctgcctagatctattctaattccaggagacccaaaatgttat

SEQ ID NO: 188044 - DNA, 463 bp, Homo sapiens
cactttggctgccgggtgaatcatgctttagagaaagataagattgatgattgaggcctggaattttctttgtggaagacaatttcttttattttcttttttttttaagagacaggacctagctctgttgcccaggctgaagtgcagtgcacaatcatggcgcagtacagcctcaacctcctggggtcaggcaatcctctcacctcagcctcctgggtagctgggactacaggtatgagctaccaccttggctaattgttctattttttgtagagatggggtcttgctctgttgcccaggctggtctcgaactcctaggttcaaggaatcctcctatctcagcctcccaaagtgctgggattacaggtgtgaactgctgagctcggcctcgactttaatagatatagggctattaggattttctatttcttcttcgcgctttgcagttggggtaccgagctcg

SEQ ID NO: 188045 - DNA, 421 bp, Homo sapiens
agcgtgtctccttagtgacaaaacttctctctcctcagaaatcatctaccactgatttaggatgagatattaaacattctcttcagtcctttcacctctaagacaaagggtctaagggatgatggtccagagcagtggtccccaacctttttgaaaccggggaccagttgcaaaagaagacaatttttccacaaatggcaggtcggggccagggagggtggtggttttgggatgaaactgttccacctcagatgacctggcatttgattctcataaggagcatgcaacctagattcctcgcatgtgcagttcacaatagggtttgtgcttccctgagaatctaatgctgtggctgatctgacagaaggtggagagctcaggcagtgatgcttgcttgcctgctgctcacctcctgctgtgc

SEQ ID NO: 188046 - DNA, 449 bp, Homo sapiens
gtgcctccatacatttttacttttagaacagtaattcataagtgacaactgatatagcttatttccccgtgttccacaatgcgaagcaaagcaacattctctattttcatataaaggaaaaatgagaaaccaaagtaaaggtggagttgaggaaacttgggaattattgggaaaaataacgaacaaaaaattagtttacatattaatcagtgtttactaacaagtttccttaaactccacgccagcatttgcctgcaggtgttaaatatttgctaaatgaagacataaaccatatacacttggtgctctgcatctgtgattcaaccaaccccagatggaaaatactttggaggagcacatacagtagctcaccctgtagtcccagctacttaggaggctgaggcgggaggttctcttgaacccaggaattcaaggctgcaatgagctat

SEQ ID NO: 188047 - DNA, 157 bp, Homo sapiens
cactttgaaatgcttttttctttctcagatttcaggatttctttcttgccttagagtgggatgttcacttaaccctttttggggtctgtttttctctctaactttgggcctttttcacatttctgtgtttcttttttctctttttgagacggagtct

SEQ ID NO: 188048 - DNA, 357 bp, Homo sapiens
tactagaggacccggtcactgcgacagtatgacgttaagtgagaactgtattaaaaatatatgtgatcaagtagggtttgtcccaagaacaaaacaatctttctgtgagtcaatgtattaaaagactaaaggaaaaaccattgcatttgaaaaaggtttaacgcctattgtaaaacttaatgcattaaaattagaaggaaatgattaacttgactgaggttacaaataggttaagtggttgagtttttagtgttttaagtcgattagtgattaattattggggagagataatcctggcacaacaaaagaagccctgggtatcaggaaacggatttcagcctcttctgggtttatata

SEQ ID NO: 188049 - DNA, 225 bp, Homo sapiens
acccgtatcatctcttgctgcctccagacccattactgaattcagattcctgtatgtcccaggaagtaaagtcaaacctatgaggagaaagcacacacacacaaatgataagatttagctaatttatactggcagaaacctccataatatgggtgacagagtgagaccatgtctcaaaaaaaaaaaaaaaaaaaaaaaagaaaaagaaaaaaagaaacctccata

SEQ ID NO: 188050 - DNA, 663 bp, Homo sapiens
ctctgttacatactactacagtattttagttttcctaataaacgattacaaggagaaataatatctaatcttctcacaagcagttaactaaacaactctacaatttgaagctaaagtaagtccgttctgtggaaatgggaacaaaataaagcttactcagatcagtcaagaaaagttatacaattcttctccgcttctgaagtaatcaactgcattactaaaagacaaactttgaaattcaaattatatagagacttaattaaggagagagaaactcaaatcatttatgatcacatgacttgtatccaaatctgcacacttcattttggacttttctgaacccactctatgaaaaatacacctgaatatacaacactagggggaatggttaaattatgttactttggaacaatggaatactatacaacacaatcttggaagatgatacagctctcaatgtagaaattgagaaaggtctattatacactgctgaagaaaaactataagactgctgtaacaggccaagtgcagtggctcacactgcactttgggaggcaaaggcaggtggatcacttgaggtcaggagttcgagaccagtctggctaacatgatgaatccccgtctctactaaaaatacaaaaactagccgggtgtggtggtgtg

SEQ ID NO: 188051 - DNA, 334 bp, Homo sapiens
cactgaggtgtaaatgggaggtgaggagaggaaggcgctaaacacagattcttcttccaagagagacaggcaggcggtgggaccaggggctgagactgcactgctcaccagcttagccaagtgggtcgccggcagcttccatcactccggtgcccctttccctgtctgtaagtggatttgatggcccctgccttctagagtagctgggaagattgcatggccacacacttggggagagcccccagcctgtgacatggcacacgtgcaggtctcacaaggtggagagggctgcaggtggaggcagggtttgtaagttgtgaaagacacaggtgtg

SEQ ID NO: 188052 - DNA, 583 bp, Homo sapiens
tatagtgatccccaactgggctaaaacaacatcgttataattctctgtcttgtgatggaattctctggccctagccttttagaaagttaggggagagctataaatatgtaggaggaagagaagatattttgaggtgtgtggtttgggtgtgtgttaaaaaggaaaactagagtactgttatgttattacccatgtggcgttttgaccacaggattattagtctgacaggttgtcttggaatcagatttggtacaagactgcatagtctatgtaactgaacctgggaacagttcagtttaggtttggtgctttaatagcattagatgagaaatgtagattactgaatacttttgggtcataatgtaaagttcagcaccagatcgttatctttccctggtaaatccacttccttgcactggattctgtctcagggcagctggcactataagctgtgcaaaccagaacctagaggtcagcctggatccttcccttgcccttcatatcacataaatcactgagctttttttacttccttatgtccaatctgacttctcttttctatcccagcttgcctgtagcctcc

SEQ ID NO: 188053 - DNA, 258 bp, Homo sapiens
gctgcttgcttccagactttgtgctgtccagtaattatgtcttccactacccatcttgtgagcagagtaaatgtcctaggtaataccactatcaggcctgtaggagatactcagtggagcctctgcccttctttttcttacttgagaacttgtaatggtgttagggaacagttgtaggggcagaaaacaactctgaaagtggtagaaggtcctgatcttggtggttactcttgcattactgtgttaggtcaagcagtg

SEQ ID NO: 188054 - DNA, 575 bp, Homo sapiens
ctgggattatggtgtgagtcattgcgcctggtctcattgtgttcttttatcgtctgtgccagcttctaagtttgcatggcattgtgttttgcttgagatgaaagataatattctatagggaaataaatctctggttatttctaggtttgaataatcataattccttattctgtagctgttcatatcttacaaggcacttttgtcttttctcttgaacctcttaactttgaggtaggtaggatagatgtgtcggaggaaatacatggtaagtttctttttattttttttgagacggagttttgcgcttgtcacccaggctggagtgcagtgatcttggctcactgcagcctccttctttttcttccgggttcaagtgattctcctccctcagcctctggagtagctgggattacaggtgccagccaccacgccctggtaatttttgtatttttagtagagacgtggtttcaccatgttggccaggctggtctggaattcctgacctcaggtgatccacccacctgggcttcctaaagtgttgggattacatgcgtgagccaccgtgcttggccagt

SEQ ID NO: 188055 - DNA, 327 bp, Homo sapiens
tggtgtgtgcctatagtcttagctactcaggagacaaatgggaggatatcttgagaccaggagttcaagactaccttgggcaagatggctggacccttgtctctaaaattattttaaaaaattagccaggcatggaatatgactgtagtcctagctaacttaagaggctgaggtggagggtctcttgagcccagaagttcaaggctgcagtgaattatggtcatgccactattctctagcctcagtgacagagtgagacccataccaaaaagcaaaagacaaaatactttatgacctagaaactgtttgttggtatatgatgtggaa

SEQ ID NO: 188056 - DNA, 514 bp, Homo sapiens
aggtctaaaaagatgatgctggaactgtaatttgaacctggaatatttatctgctttcccatctaaaaaacactttattattcttttcatgctttggcatgatgagtatgcaatgaatataaataaaaggtcctggtagagtgatatacatagtacttgaaatgctgtctagtgtgtcagcgcaattagtagtgcactcagcagcagtgagaagagatgagagtagcacatataagctctattgaaactattaaactttgcctttgcagcacacaaacagccacagataacataaaagaatgaccatggctatgttacaatcaaactttatttttagaccttgatgcaaatgccaaggaaatttccatattttgtaatccacttaactatgcaattgagtttccattaaccttcaattggaattgattaatctgcagtgtaatgacatgctaaaaggcaaacatcaagaaaataatcaaatataattttataaataccttgtgctctataaagt

SEQ ID NO: 188057 - DNA, 205 bp, Homo sapiens
agaaaccaacgctgaacttcggtcggggatgggagggctatttagagtgcaggtaaggaaaacaaacataatgtgctttacaggactaatcataattcatcattatcatgtacttatcatatatagaaaggactgccctaggcattgaagttttggcaataaccagattgcccttgtttttgaagcgcttacaatgtagtgagag

SEQ ID NO: 188058 - DNA, 348 bp, Homo sapiens
ggctactggatttagcaacaaggaggtccctaataactttgacaagagcagttttactggactggtagggggtctgcctgatttgagtggtcttaagagggaatgaaaggagacgaactgcaaatgttggtacatacaatctttgaggagctctttcataaaggggaccagaggaatggcgtggtagctacagagacaggtgggatcaaagtaaagttttgctagaagaaaaacaatagcatgtttgtaagcggatccactaaaggggaaatcatagggatgcagaagagagaagggaggtgactttgagtaagtaaaggaggatgggtacaatgtacacggttaggg

SEQ ID NO: 188059 - DNA, 258 bp, Homo sapiens
aaagtcaaggtaggaggttgaggagaggaatgaatatgaggaagacataaagggaaatggacaagagagctgcctgaggatatggggagggctgagccacgctgagggcctatttggtggcacactagtgtaatagtgtcaaaagcacaatgtgtctataatggagctggcagggctttaggttaccacaagaaaagtgcagtcttgctctgcatggttagagtcctcaaggaaagaggatttcctttctgtaccaca

SEQ ID NO: 188060 - DNA, 408 bp, Homo sapiens
ttattcctctttcctcaacagcatgacacatagagacatggattgcacacccacactggctgataatacctgtgtctatgccttgagatttcaccagctggaagacaaacttggtcaggaatacagtaaggatgtgctgacctgctggttttctctctcctttgagaccaggaggtacttactgatatgtattactgaccctcaaagacactgtgtcagaggaaagccgaggaggatcatatgacattcagtatttccccacagaaagtttccagtggtgtcagtatcacctttcctactcacactctgtgacagacaagtcataaataaaataataaattttatgaacatttaatggattaactcaaacctgagcttcagcagttgccataaagcttcttctctctc

SEQ ID NO: 188061 - DNA, 185 bp, Homo sapiens
tattgcctttgtgatttggtgattggaaatgcctgcattgtcgaatttaagcaacaggtttatttctataatagcctattcttacatgctgaaatgagagagaaggtgctatttgcaagcacatcacgttgagtagtcatttgatgtggacattttattaccaaaaataaaaagccaagttgtat

SEQ ID NO: 188062 - DNA, 629 bp, Homo sapiens
ggttgttataaggagaaaattcagtggccaggacaaccttcggccaactctaaagccctatatgaaacaccagttatttcaccaagtcacctgatgtaacatgaattcagtcttctctatgctttttgtgtatgagcaactgtaaaaagaaatttctggggtgtgtttgtgtgtgtgtgtgtgtgtgtgtgtgtgtgttaaataagagtgcctggtttttcataactaagactaagaaaatgaaaagtatatacagttgtccttcagtatctgagggagattggttcaggattccctcaggtagcaaaatctatggaagctgaagttcccagctattccaagactctctgggacagagctctcagaaggtggagtagactgccatctttgctgtatagtagccttagccattgttgccttcaggctttagagagtcaaggttgaccagggactggagtgaactgccagcaaagcactgttgcccttggaaaataggtcagactgctttgcgagtgggtcatgatccatttctccgcagagccaggtctaccaagtggagactcagcccctctgctgtgtgtcaggctgcaaatgtctgactccctggttgagtcccaagggggggacgc

SEQ ID NO: 188063 - DNA, 400 bp, Homo sapiens
tgtgtgaaatggcaaaactccattaacaatggagaagtgtttaaataaatcacggtataaagcaacagaatacaggtattttaagaaatcagaggagtatctacaatatggaaattagtccacagtatattaaggttaaaaaaaaatgcatcttgtgaaatgctacattacaaatgatcccttccccccaccacccccctgagacagagtcttgctctgtcacccaggctggagtgtggaggcacgatcttggctcactgcaacctctgcttcccgggctcaagtgattctcctgcctcagcctcttcagtagctaggactacagccatgcgccaccatgcctggctaacttttgtacttctagtagagacgaggtttcacatgttggccaggctggtct

SEQ ID NO: 188064 - DNA, 574 bp, Homo sapiens
tttcttttattctgagagctgtattctgtggatagggattttgtattttagtgctaacaatgtttttcagtacctaacaccatgagtattcaaaggtctgatgttatctttaatgtatgtaatgaacatacaatggtatatcttatgaatattacattcattttctattcctacaacgttttcagaggaaatatttttaccctgacctggattctatcgctatcctaataactgtggttcagaaaattgtctcacaggcagacagtttcctaatcacgttttactcaattattttatttctcaatatgataggctgtgaagtagtccactggaaaaggcatcatgctgagagtaagaaaagcttatttgttcactgctctatctccagcacctagaacaatgcctgacccagaacaggtgcatagtatttgctgagtgaattctaatcctacttctgggtaaaattaagtaaattaattagttcttgagggactctgtctagatgacccctaaacttccatggtaaggttttgtggtttttatcttggcttttctaaatgctctaaaaatagta

SEQ ID NO: 188065 - DNA, 404 bp, Homo sapiens
ggctggaattacagatgtgagccactgtgcccagcctgtcttctaaaaatttaacgccactttgaattaattaaaagcagaatgtagttagtgaaattatgttcatcacttaagaaccaaagaagaagaaaatttattttttgagcttgttcttgcactaggagagcttgtctgaacttcataattaaagacctttacccttcagttccttcatagagttcgagttttattttccaactgcaggaactattatgtaaaacctagttcgtatcggttggcctcattcttttttgtttcctgctgtgaagtctttgagctctatttctgccatttttgtttctgactatggcttgttaggggaagagttaaattatttagtcatacttccttatgccactgaaata

SEQ ID NO: 188066 - DNA, 402 bp, Homo sapiens
aaaggcaactgtaatattttctttccaacatttcctagatgaaaaaaacaacatactataaagggcttccagtgtttgtttacctaaatgttatggtggaagaattgtttgcagtcatttctttatgtagcttattatgaaagtaaaaagcaggaagttaagagaaatgattagaaatgattacttcaagtgataatgtattcagtattcatacttttgcagaatgctttaaattattgcactacatcactttttaatgtagagatcattgtgcatttacatggtttaaagatattaatttcacattttcccaattaaatacaaatacagtacctcactttattattagtcccgtgaggatgtagagaccatatcttgtttattattgtttctccaacacaa

SEQ ID NO: 188067 - DNA, 357 bp, Homo sapiens
agtaattggaaatacatggaaacatggttatagtaaagatgtttgtgggccaggtgtagtggtccatgcctgtaatccaagagctttgggagactagggtgggtgggtcgcatgagcccagttggagactagcctgggcaagatgacaaaccctgtctgtacacaaaataccaaaaaaattagccagacaaggtggcctgcaactatagtcccagctactcgaggggctgaggctggaggatcagttgagcccggaggatcaaggctgaagtgagctgtgcttgcaccactgtgctccagcctggagaacagaacaagagtctgtctcagataaatgaatgaatggataaatgatac

SEQ ID NO: 188068 - DNA, 260 bp, Homo sapiens
aaaaattagctagtcatggtgacacacacatgtagtcccagctacttgggaggttaaggtgggaggatcacttcagcctggaaggtcaaggctgcagtgagctgtgatcacaccattgtactccagcctggttgacagagcaagaccccatcacacacacgcgcacacacacacacacacacacacagaaaagctgagccagattcggttggacacagttacaaatcccccttgaaacaccccacccctcattcttgagc

SEQ ID NO: 188069 - DNA, 449 bp, Homo sapiens
gacatgaatttgaaatgcttgttaagttttctgggtgtagatgacaggtaggggctagatctacgggatgtggagttcgaggctgggctggaaggggcacggagagggtgcagcacactgactggactcagccaaggacacagccaaaggagacagacctggggaaggggccagggggccactaatggctgaggaacctttaaaggccgctgaaaagcagcagccaaagagggagaaaggaaaactaggagcgtgcagtcagacagccaagaggaagggtgtgtggggcagcggtgtcgaaagatacagggtgcccaaccgagatcaagaccgaaaggcactgctgggtttggctccctggaactcaccaggcaccttgattagagtgggacatcgcagggaaccagagtggagggagcccagaagtttggtgctgaaggggtaaacgg

SEQ ID NO: 188070 - DNA, 422 bp, Homo sapiens
gcattgatggggttcagatcccaagttcatcctgatactgaggggcaaaaccagtggactttgatttgcatttctctaaagatctgtggaggtcaatagggagaccgctcatgatgttgaatcctggcaagcaaacggagagaatctgacatgtgtcccagtcgtgattaacctgtgaactgtaactcggggaaacccagtagctgatggggttgcgtccttctttgggactcccgcagatgcctgaggcggcagtgctgctgaagtcctgccaggctccagctcctggtgaggtcagggattccgcatgcagcgtcacagctgccaacctctccaaagcagtaaaggccttcggacagtgcacagaaagtgctcccatccacaatgcttccttgcctggatggatggatggatggatggat

SEQ ID NO: 188071 - DNA, 503 bp, Homo sapiens
acgcacgtgataaagttttcttgaggtacgtagaacaacttccctattgtgaaggcctcatggatcacctattaagacaaaaggaacaaacaccgttacctcacatacatttatgattctgtcctatctcaattgtgtgtattttctattgcgattgccatttggtaaaatctctgctttctaaaattgaaaatgaaaggggaaaatacagctgggtttttctaacatttccccttccttctgacatacaattttcaaactcaagaaatagagattttggttaggcgcagtggctcaggcctgtaatcccagcactttgggacgctaaggcaggtggattacttgagttcaggggctctagaccatcctgggcaacatggtgaatccctgtctctacaaaaaaatacaaaaattaaccaggtgtggtggtgtacacctgtggtcccagctatcctggaggctgaaatggaaagatggctggagcccaggaggttgaggctgca

SEQ ID NO: 188072 - DNA, 1449 bp, Homo sapiens
attatagagaatgtttcctggcaattaagcagaaattatggatactatagagcaacctggaatatttaaggagaaaaaaggttcctaaatgacatgcagactgactaattgcaagtcaataacgagcttgtctacctgggatcaaagacttgataggtgtaaagaaaagctgtcctggcaatgctgtcagggagtgatggtgggtgctggttctccttcctgcagtctttttgaaggttgccttttaaatgtggaaaaataagaggaattgagccaagagttggggcatctggttgggtttgtgggtgacctagggcaagtcactgtcctgggcttcatttctctctccaagaagactggctggactggctgctctgaaccttcttctagcatgaaggaaccacatactgggggccaaagaagctgcccatcaaactggtgctagagagagagatgaggccaggagtgggctcgtggctcccttcactcactaggacccagcttctactggcataacagggtctcctattgggcaaatcacttcccccatcctgcttagagctgctgtgaccactgtaaccctaagtaggacttggtggaacgtagacatttgaaaagctcttgtatacgctagagattttcaaatgtatgcataatagttgcaaatttgttaaaaacaaaaacatttacaagttataaaagtaacatgtcatagatgtaacatagttgtaacataaagaagtgttagactctccctacccctttcctgtcccactgctgacagtttcgggaacacccctttcactcttctctgcttgtacaaacacatatatacatccttttcccttctaaccataatgggattttgctttatactttattttgcaacctgcttgttttcctttagaatatatcatatggtgggcatggtggcatgtaattccagcactttgggaggccaaggcaggaggattgcctgaggccagtcctggcaacatagcaagaccctgtttttacaaataatttaaaaattaatggtgcttggtgcctggcacctgtaatgccagcactttgggaggtcaaggtgggaggatcgcttgagcccaggagtttgtgaccagcctggtcaacataaggagacctcatctcaataaaaaagaaaaaagaaaaaaaaatatagctctctctccatgtcagtacatataaggtgtcatttctgttaatggctacttaaccttccatggtaagaagtactatcagggattcaactggtcctgtttgattgaagagtcagcctatttctgatgttttgctatcacagagtattttagcaagtatatatatgatgtaggtaaagaggcagataaacacatgcacactgagtaagagagagagagagagactgagattgctgcattctgtgagttttatttctgcgggtttagttta

SEQ ID NO: 188073 - DNA, 654 bp, Homo sapiens
agaagcacttttcagacctcaaaaggtgcttcctgagttctataattctgggacaggacagaaaagcccgtactggctctggccatgcacactggttcctcatggaggagcatgtctgtgacacactctgggtcttatcctccttcagaacctcagtgtcctataagtttgctcatccatgggctcatttcacttccactgagcctcaaccttgagtgtccagtgaacacaaggacatttagacaaggccggagctattttgttccaagatacacaaatcgatgatgaaacaggatttcattgacttggggttggtggaaggacatgagtttacactgtaggaagccagtttttgttatctgtttccctataaggaagcccaacttcaaagccttgagatctgacctgatgagaccagttataagaaaaagaaaggggtgtgtttccctttcccttcctaaggagtgggtagaagtctcatccctctgggttgttggaggttagagaatgtccagatgtctttggaaagtcagtcttgtctttccatttctccagtcgcctgatttattttctaaattggcatttcagcacaaatccaatatctgacagtttagactgtatgctttaaagttcagagaatcttctgtaatcaat

SEQ ID NO: 188074 - DNA, 322 bp, Homo sapiens
ctgagtcacgggcgcgcatgctcaactttggccagataaactttctaaattaactgagacctgtctcaaatttttggggttcacattttggtaaccacgaagggattctgaacgtggatgcccctgacctttgacaaatttcctatcagtgcttgttaacagcatgagctaactttatggctcaaaccaataggaccatttgctgaggtctgagagcacccccttcagagaatccctgatctcccaaaatttgctagggatctaaagtttattttgctgtacaactcccttttttttggagttttacttgcttccaacacaa

SEQ ID NO: 188075 - DNA, 522 bp, Homo sapiens
cagctcctagagtatccccgttgtcttcaagactaattagaacatgaagaattttgaggcccaagccaaatagaacattttgtttttagaacatgaggtatagaatgccacgtattagtgtggtagttttcctttgtgatttatgatacacgtaatgttctttcaattaaaaagtgcagttcatcatattaagtcattatcctacctacagcgtattggacaaatttcatatatacttttcaattagtaagaaaagcaagtattgcagcagtcacctatctgatacaggtccttacagttgaatcagctctgcccatctgtaaattatgtttgaggcttgaacttttccctgtacttccagttccattattacctacgtatagcacatatggtctgcagcagtcttctgagccattgaaaaattgaggatttgtttttaaatgaactatcaaagaatccttcctggaaggattgtgtatttgagttgctgtagctgtattttgtttgattttgttttcctta

SEQ ID NO: 188076 - DNA, 313 bp, Homo sapiens
aaactgcccaaggtcagacaaggtaccactgaaaagaaggaacaatcatcgaggctaatataggattgggaatcgtttgtgttctcagcagccagagtggaaaaccacataatttagagtagacttctgagaacagttttacttatgtaatagggtgaaattaattttcctgctctgctaacctgaaagcatcaaactatttcgaagaaacttaactgcatttcagaataaaacttgagtatttataagaatacaaaaatatccagcatacaaaaatgtaaaatttataatggcttggatctgaccaaatatt

SEQ ID NO: 188077 - DNA, 799 bp, Homo sapiens
aaaaaaaagagagaagaaagacaaatgaaaagtaagaaaaattagcagatcaggccacaaagtgcaacatctgactaacgcaactctggaagacagaaaacagagaccaggccataagaaccacgccaaggtgcgtgttcatgaaatctgagaagaagaagaaaaagacaactctacaaggtgttagaacaaaggacaaaaatgcagaacacccttgacggatgctagaaaacggggagccaaatctttcccattctgcaggaagtgttttccaacctgggatttgaggacagaataaagaagatcttgtcggatcgcagatatggtcaccatctatcaggaagcaatcggagaacatccccgcagcaaatgagaggttaaccaggaagaacaaagccatggcgtacacgagtcaggagatccaaagctggagagagatgggaggaagcccccgagatgatgaggaatgggagacccagctgggcagaataggggggccaagaagggctgtcaccaagaaagatgaaaccctacctcactgatggccttccatattttaagagatctatgttgctggaggagagtttaggcatacattaagtagtgtacaaagaatactaatatttacaaagtcatagctatggaaacactgtatatttgaaaattgattgagccaaaaagagaagtatgactatgcttttaaaaatgtatttatttgttattttctaagagacagactctcgctctgtcacccaggctggagtacaggggtgtggtcatagctcactgcatccttgac

SEQ ID NO: 188078 - DNA, 464 bp, Homo sapiens
tctgaagtttctcgtcctccatcaccctggcgtgtcttcaggaagagtcctcttaggtcagtttagccagaattccccttacccctcatgtttcttcctggtaattttctatccactgatccccaccctgctccttggctataaatctcctcttgcccatgctgtattcggagttgagcccaagctctctccccaactgcaagaccccattgcagtagtccctatacccatcatgatggccctgaataaaatctgtcttactatgctttaacaagtatcactgaatttttttcttctttaacagggctgattcaaactagctacctattttctaattgggaggttaaagaaaatttggtggtattaatgaattgttgtcagttttgttgtctgtgataatagaatgctgtttatcctttttgacatcctgatctgttagactaagggtttattaacctcagcac

SEQ ID NO: 188079 - DNA, 168 bp, Homo sapiens
caccgggtcccaggacttcagagacactaaaaatttctaaaaacctgcatctgttcccttgaaggtttgaaaaacagtaagattccattcggggacattttctcagtatcaatgacttctatcctcttagtttctgtttctctcaaaaaaaaaaaaaaaaaaaaaaaa

SEQ ID NO: 188080 - DNA, 703 bp, Homo sapiens
aatttggaagagtttaaaaacatatatttttttcattaattgggtattgttacatttctcctgtattttttcttatattttcttgtgtaactttagtgacaaattactgtagaggcatctgaatttaggactcttggaagggaaggggatggaggtaggagggatggtgccagtgaatgatgtctgtctgagagagatttatgtttatgaaaaaggaagtgagtggattcctaagattgtggttttaaggcctgaatattgctttaagagtgtttagaattgttggggccaggatgaaggttgagaactacaggtttgagatcttaagaaaagccaggaccagaaagatctgttctagttatttccagctacgggatgcagctgaatgtcatttgaaaacatttttctcgttttttagcatctttgactgaaggcgaaatcttcatgccttggagggaaattcctagtgccacagcataaaaggaccagcagcagcaagtgtgatataattactgatgcctttaaaagatatgcgagccctttgggtatatacccagtaatgggatggctgggtcaaatagtatttctagttctagatcactgaggaatcgccacactgacttccacaatggttgaactagtttacggtcccaccaacagtgtaaaagtgttcctatttctccacatcctctccataaagaca

SEQ ID NO: 188081 - DNA, 1416 bp, Homo sapiens
atggagacccaggcatggctgaggagcctctgtccatcagtccattgctttctctgtcccttttttcccttctggactctggaagacaagagagtcaaatccctcaggggcagggaactaaaggacagagaacgctgtggtgccctcaccctctagagcgacactatccaatgtggtagccactagctgcatgtggctattttaattttagttattttaaattaaataaacccagtttctcagcggtgctaaccacatttcaaatgctcaattgccttacagtctagtggctccccctattgggtggcacagatgtaaaatattttcatcatctcggaaggttgagttggaccacactgctcccaaatatcccctcctgcgcatcttaattacccataataagagatgatgggattttaaatgtaaacaattggcagttttggagacacaattggggcagtgatggcagccatgaccagacattttccagtgttttttttttttctaagacggaatctcactctgtcacccaggcttgagtacagtggcacagtctcggctcactgcaacctctgccaactgggtttaagtgattcttctgcctcagcctcctgagtagctgggactacaggcgcctgccaccacacttggctaattttttgtatttttagtagagatggtgttttaccatgttggccaggctggtctcaaactcctgacctcatgatctgcccaccttaacctcccaaagtgctgggattacaggtgtgagccaccgcacgcagccattttccagtgtttttaaatgtaaacccaatagtggacctcaggccctttcctctggcctccctctgcctcctcctgatggttcctgctggtctctccctggctgggaccctgggaggaggatccaggtcggactttctgcaagagatgcccgacctcttctgggctagttaggcaagggcagccctccttagccagactcagctgcccacagcctggctttgatgagccccatgtcccaagcctgggtcattatgacctctagctgttcatggatggagatgctgctctcagagaatttcctttccaccagcttctagagctggcaaggactgaccctagtgtcctgaccctagccctctggcccctgcagagaagggttctgggaggactaggggaaccaggggggatctgcttagttttcttgaacagtctcaggtgtggactccacatatctcatgtcctagccctctcccctggggcaggctgcaccattggcatgtagtaaagggcagggctgacaactctgttcaaatggtagtggctttctggagtcctgcgtgttcaacagtcatgacggcgctctctgcagccgccagaatgctctctgtgccggggggatcctctaca

SEQ ID NO: 188082 - DNA, 397 bp, Homo sapiens
gcttctagagctggcaaggactgaccctagtgtcctgaccctagccctctggcccctgcagagaagggttctgggaggactaggggaaccaggggggatctgcttagttttcttgaacagtctcaggtgtggactccacatatctcatgtcctagccctctcccctggggcaggctgcaccattggcatgtagtaaagggcagggctgacaactctgttcaaatggtagtggctttctggagtcctgtgttgagaaggattctgaggttgcatccaattttagcaggaaagagtgctgtgatcgttagctgcatcagacatgggcatggatgtaggctgtgccaacacgcatgcttcttcccagacactccttggaatcaagagaatcaatgaacca

SEQ ID NO: 188083 - DNA, 437 bp, Homo sapiens
gctttcaagtaaaagacagaattttgaaaaatgtgaggctgccacatgaacatgctgatttccactcagcttctgcagatgaaatagatgatgacagcaaatgtgattttttttggtattgtggaatgagaagtgtccacaactggaagacgagcacaactcagagacccagcattttccaaatgaccaacacacagtgctgcccaagcacagtgggtagcgagtccctcacagggccagaggagccggcctgcaggaccaccactgcctggcacgcttgggcggcgtcgcagaaggacacccacgctgccctcaaggttacaaacactcctccctttcccaatcgcctacctaggtgattccacatgttcttcctaaacaacgtaacatcgatagactgcagaggcagatgtgagagtgcagccatcttctattaa

SEQ ID NO: 188084 - DNA, 312 bp, Homo sapiens
tgaggctgaatgttggtttaccatcttacattttctacgtccattaaatcagccttctgggaatccacagtcctggcaattctgaactgccccaggaggagggaagccatctctctagggtgagataggtgagccatcaggtctggtggtgggagtccacagtcctggcacttctgaactgccccagtaggagcgagcccatctctccagggtgagatatgtgagccgtcaggtctggttgtgggagtccacagtcctgacacttctgaactgccccagtaggaggaaagccatctctccaaggtgagattt

SEQ ID NO: 188085 - DNA, 264 bp, Homo sapiens
ctccagatatgatatctgaactgaccgaataatcgcagaatgaaatgttccataaaggtgcgtgccttttgcttcctcctgtcctattcacactaattgggtgccatagttaattcccggtagtaacatacctggggctttataaattattatataaccacacggctgctcacagagtgagactgtctcaaaaagaaaaaaagactgtctagaaaaaggtaatctctagaatctgaagagggttaacaaaatgaggattaaggc

SEQ ID NO: 188086 - DNA, 481 bp, Homo sapiens
agatcacaccactgtactccagcctgggcaacagagtgagactgtctcaaaaagaaaaaaagactgtctagaaaaaggtaatctctagaatctgaagagggttaacaaaatgaggattaaggcaaaatacagttagtaataagataacaaggaatctgatcatggaaaaggggtccttgtaacttactgaggctgaatgttggtttaccatcttacattttctacgtccattaaatcagccttctgggaatccacagtcctggcaattctgaactgccccaggaggagggaagccatctctctagggtgagataggtgagccatcaggtctggtggtgggagtccacagtcctggcacttctgaactgccccagtaggagcgagcccatctctccagggtgagatatgtgagccgtcaggtctggttgtgggagtccacagtcctgacacttctgaactgccccagtaggaggaaagccat

SEQ ID NO: 188087 - DNA, 269 bp, Homo sapiens
ttctgggattacaggagtgagccactgtggcctgccattcccgtgagttttcacaaatgtatgtagtatgtcattgccaccacgatgaaggtcaagagcattccaacaccccataaaattgcctcaggcttctttgtagttaatccctcaccgtcaacttccagaatgtcatagagagaaaaaccacacaatatattgccttttgagtctggtgttcttcactcagcccagtggattctgagacttctgtctgttgtgtggatctgtga

SEQ ID NO: 188088 - DNA, 257 bp, Homo sapiens
tccttttaatttctaggataccatgggtccttttttctctttctatgcctcaagattgttcaagattcttcactttcctcctgcttttgacctacctcttggatattgtttctttgagattctgtcttgatcactttctcttcttgctcaatgagctctatctgggaaattgtcaacactctcaaggctttagtaaatatcatgttctctcaatgacttccaaatttctgtatgtagtgtggttctgccttcattga

SEQ ID NO: 188089 - DNA, 392 bp, Homo sapiens
tcctcttactctacctgccccctaaagatggtgttcctcagtctgacaaccttagttctcaaagctctctcttttactaacctgattttaaacacttcttaagtcactaaatataatcaaatcattctaacccacacctctcaactgaactccagatctattacccaaaagcttactggatatctggatgtctagtgattattatggtacttctgtgcacaatatctggcacaaagtaggacttaataaatatttgttgataaatatcccataggcacttcaaattcaatcgattcaaaactaaactaataacttgccctctcatgaatctgttgttttggtttgtcctactaccacccattcagtcttatggctcagtcagaaagttcatg

SEQ ID NO: 188090 - DNA, 515 bp, Homo sapiens
catctgtacatacaaatatgaaatcacagatcaaactgtagtctcctcctggaaaccactgccttcattgcagctaggtcccagtgatcacagctacgcttctcaggcaggaggaaaaagaggcctggtagcagaatacttgtttttaatgggaaggacagagaaaccacataaggtgttcagaaagtccaaatgaattagaacactggttcttcacttggtcttcaaactgttaatatttatcacctgaccacttctgtaactcccacatctgtgccaagcacaatccttattcattaagttatacaactggagacaggtcttggctcaaatgtccacccctcagagagtcctcattcactgcagagatgaggtggcttgttcaggaatctacttagagggtttatttttatttgagacagggtcttgctctgttgcccaggctgtatgtagtccaatagcacaatcaggtctcactgcagcctccaataaactcctgggctcaagtgatcctc

SEQ ID NO: 188091 - DNA, 253 bp, Homo sapiens
gataatacttagacacaggttagagggggaaccatgctgaaaataccatggcaactagagattcattcagtattttgtttatggattcagacatggatagtttaaactacacgaaaacaaaaatgattaccacaaaaaccagccaagtgatcacttctagggtagtgggagttgtgatcagggaacagcatgtaggtttccagctgcaaaccacacaatgcagctgcaaacacacaatgctgctgcaaacaca

SEQ ID NO: 188092 - DNA, 693 bp, Homo sapiens
atttgggaggctgaggcgaacggatcacctgaggtcagctgttcgagaccagcctggccaacatggtgaaaccccgtgtctaataaaaaacagaaaaattagctgggtgtggaggcgggtgcctgtaatcccaactactcgggaggctgaggcagaagaattgcttgaacccaggaggcggaggttgcagtgagccgagatggcgccattgcactccagtctgggcaacaagagggaaactctatctcaaaaaaacaaaaacaaaaacaaaaactgactgtagtgacggttgtacaactctgaatatatacaaaatcacttaactgtacatgtgaaatgggtgaattgcacagtatgtcaactacatttcaataaagttcttcccaagaaaatagggaactcggccgggcagagtggctcacagctgtaatcccagcactttgggaggccgaggtgggaggctgaggggggcagataacaaggtcaggagatctagactatcctagctaacacggtgaaaccctgtctctactaaaaatacaaaagcattaactgggcgttgtggcagaggcctgttgccccagctactctggaggctgaggcaggagaatggcgtgaacccaggaggcggcgcttgcagtgagccgagatcacgccactgcactccagcctgggcgacagagcgagactctg

SEQ ID NO: 188093 - DNA, 496 bp, Homo sapiens
ctgcaggtcttgaggcagatcctggaactgtcagtcaccaccaacacccctgtcccccaaatgcagctacacaccattttcacagaactgcacgtccaggtgtgcaacaaggccccggcccagcatcagtacagcagccagaatctgatggagatggtgcactgcttcgtagcccttgctcgctcctaccccaaggagctgatgaagttcttcttcagccagatggagacaaacaaggaggccgtccgcgtggggactctgaatctgattagggctatagtgagcgcagatgagcccaggatgagtatcagggccatctacctggctatccgggtagtcaagaacaccatctctgatacccggtccaaggtgaggatggctattctccacatcattgggcagttggctctctgtggctaccaggagagaatcaaaggctggggcctgaagtacctgtctgtgcagctgaccttatccacctacaaactggtgagtg

SEQ ID NO: 188094 - DNA, 440 bp, Homo sapiens
tcctgagagaaaattcaagactattttgcataaaatacatttatcacaaccaggcagaccaaaaatgacctttttgggtgggataaaggggatattttgcagacccaaagaaaataaattcttgagattttttcccagaaatccatgggaggaaggctgaagtatccttattcttatcagaaaacatatttgaattttattaccaatatctttaaccccattttgtagatgggaaatctttgaggctcaaagagcaaagaaggctaacatttgttgagcacttaataaatgaaactgtcaatattagtaattattatcgccatcatcattatctttatttaacctatagcacagccctgtgaggtgttatcactgccatttacagatatgtaaagcaagattcaggcagttcagataactagctaggattacacattgag

SEQ ID NO: 188095 - DNA, 320 bp, Homo sapiens
gaatgcacagtgcatgagtggcctgagggaggccccgattctgttgcctgcagctgcaatatcccttattcaaggctccaatctctcagcttacacagcaagctactgcacaaatatcactttccgtgttagcagagacatggaagaattggaaagcaacagctcacaactttggggctaccaaacgaaccaccacagtaggtgaattagaaaaaagtcttcttacatcttttttttttttttttttttttgggtttgtggacctttttcaacccccctcctggaaaaaccggtgtgggggtctcccgccccaaattcgg

SEQ ID NO: 188096 - DNA, 580 bp, Homo sapiens
acagagacagaagcaaggacaaagacagagacagaagcaaggacaaagacagagacagactgaatggggtggcccttgctctcctctatcttggaagacacacctcaggtcccaagagaccaccaggagccaagtatgccaagagtctgcctgcagcattggcaggaaggacgccagaggacaggggtcgcagagcatgagctttgggaggtgacggcatgatgaggcaacaaggagcctcctctggctgtggggctgcccagcctggcctgcctctgaaggccatgcccagcttgcccctacctccccatctcaccccttttagttttcagtttaggtctgcagaccgggttcaggccccagcatgccacctcttgtgccatcgctctccctgtggcctaagtccccagctctggaagtggatgatggtgagtacctcacctaccagggctgcattcacatgtcaggggtgggacataggcaaggctcctcccgcctatggacccccaatcttagctcttcccaacaccccaagaaacagtctgagcaaatcagctcttctcctccctcctccctttca

SEQ ID NO: 188097 - DNA, 397 bp, Homo sapiens
ctctgctctccatagcccaaatgacacttttgctggtgtagagtaactaagcttcactttctgttcccctaataagagactatgttagagaccaccagatccctccttgccacactgcagacccatatccctggaagcagctcagagttagaccgtctttggagcagccctacagtcttttcatcacttggaataggagaaagactgagaatctatagcaagtctatcaccttgaataaatgtattacaaaataggaataaactacacacacataatgcaggatttacacaacacctaacaggtacttttatgaattttggacagatgctgcctgagcaatgattcccaaacctattctggtgagctttaaaaaatatagatcctggctgggcgcag

SEQ ID NO: 188098 - DNA, 326 bp, Homo sapiens
gcctaaagctacaagatgtcaagttcatttggttaaggcaaggtcagtgctatggcttatcaaagtggcacaggttaactatgtcaaatgattagtgtggatcaccccagcacaagcctattttaattacaaactaggtaatgttgagagcagggtttgatgaaaggaggaggaaatataatcaaaatttgcaggcatgatgaaaccatgtttgccacactagccatgttacccaaagaatcaaggaacaactgacctgtaagaatgttttgaagttttaattgccacagagaagacaaatgtcacagtaagcataggccaactaa

SEQ ID NO: 188099 - DNA, 331 bp, Homo sapiens
taggccttacataccaaccctttctgtgaacgacttgctctttccattacatatcctgcaattttccacttcgacatctggaattttgtgcctcctcggtcacaaatttcacttacatgttttatgtcaaaatcagtcaccattcaagatatcttggtcacaatttatctccctccaatttatttcctagtctctcctgaaagaagttaactcctacagtaaaggccactggtgaaacaagtccctggaatcagatgaacatgggtttgaatccttcctttaaaatttctcgtgatatgaggctgggcaaaactctatctaaatcaaatgt

SEQ ID NO: 188100 - DNA, 382 bp, Homo sapiens
gaggagttctcatttgggagaaaggctcaccagtgaggcaggaagtgacctttggaaacatgcgagaaccaacgtgcatgggtcctcaccaacttactctcagcagcgaggcctgccaacaagaaggcataggctcaccagctgcacacggctaatgctcacccaagaacaacactgatataagacccagagactggaaatctgccactccacactccttccctcagagaaggtaagaaatgagaattttataccctctccagctctgaacatgcctcctagccatgcctcttcttcacaactgtgagatcaccgcaaacataattcagcacacagagcctgaatccttatttccagataacatgagcagaaacatgcagct

SEQ ID NO: 188101 - DNA, 304 bp, Homo sapiens
aaaattggaaaagggaatggagggttggagtgccaagtatgtgtgaggaagagtaagagagaaggacccaggccgggcatggtagctcacgcctgtaatcccagcactttggggggccaaggagggtggatcacctgaagtcaggatttcaagaccagcctggccaacatggcaaaatcccatctctactaaaaatacaaaaattagctgggcatggtggtgggcgcctgtagtcccagctacttgggaggctgaggcaggagaatgacttgaacccgggagacggaggttgcagtgagctgag

SEQ ID NO: 188102 - DNA, 512 bp, Homo sapiens
gagcagctactctaactgcatattcacaggccagtacccagaatccctctcttctcctctataatacaggaagaggacaataatatttgcaagttgtgccaagttaaatcaaaggacatcatcaacctgacaaactcctctataaacttccctggatccttcaaaaaccagccatatttctccttgaagaaagccaatttggacaaaggaaatggcacatatactctgattgttcccctatctctgccagctaactccagcaatggacacagattcaatttgaggggctgatagagagctccactcctggtggttctggttgggcttacttccttgggcagtggggatacaggctggagctagctaaataaaagggagggttttctgatgacattggggtgaaatcccacactggagaactggcaggacccctcgcagaactgggggactgagaagaccctggagagggcatgggccctccagggggtgccgccaggaagggagcatcgagg

SEQ ID NO: 188103 - DNA, 393 bp, Homo sapiens
ccaaaactatgtccactcaccaggaggaggagtgccctcccttcttttgcccctcttcactaggctattacatcctccccgagcccccatcacttccccactcaaaacattccagcaatctgcctggctgctttaagcactccagatcctgctgaggagcgcgattcaaacttcacacagttcagacagcacagaaaaccggtaaccgatcagaagctaaaaataatcagatagagtgtaaccagcactccctctttcctttccacagcagcaaccacaggatcctactagcacagatgcccggctggtctttcaaacagaatcctcaacgcccccctccaccaccaccaccacaagcctccaggggtcccagctacctgcattcctccgagg

SEQ ID NO: 188104 - DNA, 677 bp, Homo sapiens
atctccatcagtgacatttattttctgccccttaatgtttataaatggtaatatgttctttgtgctctgaattttttggtatgtataatgacattagtcttgcaacacaggtatttttctacttctcagtatattctatttgtttatatgatctcttattaattaggtacagctaagaaaagtgagcctataacaaacattactaagctgtgttttgttgtggttgagaaagaaatgagatgaataaaagggagaatatgaattgaagataagaaaaatatgaatatgcctgcatttaaaagccaggtggcctcacgttagtacaggcctggaagaaacaactggaatctacacatttcctttcacagatgaggagactgaggcttggaggggcttgtctattttctcagagagggcatatctggacccagaaccaacagaccagtgtcatttcatgtttctgaccctcagctcctggaccagaaggcagctacttttttaacagaagatttttttagtcctggctttgccactctgttttgcatttaaaatctaagttcatctcctaatttctcctcttttcacccctacaggacacctataagatctccaggactcggtcagcatttttcttttacattttcccccttgtattttcctgcttaaccacctgagga

SEQ ID NO: 188105 - DNA, 294 bp, Homo sapiens
gtacacatgagtgacagcctctatctagtgcctgagtatatgaacctttaatccatcaaggaacttctaacaccatcagaatatacacacccacgtgcatacaccttcctgcagccaccaggtttgaaaccagcagaatatatttttctaatctcacccagattttatggctataatgtggctactgacaagattctaaaattagcttttatttaaataaaccatgtaatttttttttagttttttttttttttttttttagtttttaaaactctctgccacggcaatctactg

SEQ ID NO: 188106 - DNA, 501 bp, Homo sapiens
taattccaacgagtttttaaaaaatgtttaaacactatggtgtatcaaaaagaaaaggaaaattgcaatagaaattactttgaaaataaataaagacactgcaaatgaaaaggtttgaaataaggtcaagtacacagaagaaaactcataaattacttatattatttttaaaaaaagaagaaacatgaagaaattaattaagttttcagcaaaagaaattagagtctgggcgtggtggctcacacctgtaatcccagaactttgggaggccaaggcgggcggatcacaaggtcaggagatcaagaccatcctagctaaaacagtgaaaccccatctctactaaaaatacaaaaaattagccaggcatggtggtgtgcgcctgtagtcccggctactcgggaggctgaggcaggggaattgcttgaacctgagaggcagaggttgcagtgagccaagatcgcaccactgcactccagcctggtgataaagtaagactgtctc

SEQ ID NO: 188107 - DNA, 435 bp, Homo sapiens
tttgaaaagatctacctgtttcttaggaaactgaatatacatataccctgtaaccaagctattacatttttaggtatttgcccaagagaaataaaaaaaatagtccacaaaaagacttgtacaaaaatgtctgtagaagctctatttataatagccctgaactgaaaacaatccaggtgtacatcggtaggaaaaactgtggcaaatttataaagtagtacaaactaatgttagataaaatagcatgaataaatcttgaaaatgctattttggtgaaagaagtataacacaaaagagacatactttatgattccaatttatgaagttagatccttgtaaaacaggcagaactaatctatgatcttgtattagtcagggttttccagagggacagaactaatagggggtgtgtgtgtgtgtgtgtgtgtgtgtgtg

SEQ ID NO: 188108 - DNA, 124 bp, Homo sapiens
gcccgtcctcaccctggggtctttttgcagtctcctagccccttctacatgctcctgtgatggcacttcttctctgtgtgctagttatttacctacctgtttgttgatgccagattgacctcct

SEQ ID NO: 188109 - DNA, 435 bp, Homo sapiens
aaagggattgcagaggacttgacagagtgtcccacttggaggttaggcgggcaggagacacagtttccagaattgcttcataatatcttcctgatcttcatggtcctgttgggcagaatgatgttcagtcttttcttcctgaatgccttgttctgagggtatgagggctttgaatgtagatgggacagtctcaccctcctacgggaggaaaagggctcttcccttatcacacagtatttatcaacttgattaaaagctatgatagcagtgcctgaagatgggacttgtttctgacttaatttaccctcctctctcccagttccactctttacctcagtatagaggactctgagatagccctgttttgagctgatctttttcttggaattcattttcaggttcctggaagatattttcacaaagaatcccccctga

SEQ ID NO: 188110 - DNA, 589 bp, Homo sapiens
tgctctttagccataaattattcttggatccaaacttaaattcatactttatttctaagttattgggtgactgtagcttttatcagacttttcctttgagcactcactgttaagtcccaaagctcccgtgtagtttctgtcattattcccttacaaagttatatctttacatgtgtgctctacagtttcatttgttcccctgcttttctccctgtacaacacatgtatacaggcataccttggagatgttccaggtttggttccagatcatgacaataaagcaagtcacacacattttttggtttttcagtgtatataagccaacaattttctgaaccttcagtgagtcgtaatcttttttttttctttttttttttggggacagagtctcgcactgttgcccaggctggagtgcagtggggcgatctcggctcactgcaagctccacctcccaggttcttgccattctcctgcctcagccatctctactaaaaatacaaaaattagccgggcatggtgttgatttccgggctccagcctcaggagagttatgggatcgacttcgcctgaccggttcccgacccttcac

SEQ ID NO: 188111 - DNA, 561 bp, Homo sapiens
gttttattccccagtgcaggatacagtccaggatccttcatgcatttgtagtaaataaaatacagttcatcttttttttttaacttttttttttttttaggtttgggggtacatgtgaaggtttgttacataggtaaacaacatgtcatgggggtttgttgcacatattatttcatcacccaggtattaagcccaatagccaatagttatcttttctgctcctctccctcctcccaccctcctgcgtcaggtagaccccagtgtctcttgtttccttctttgtgttcatgagttcttatcatttagctcccacttacaagtgagaacatgcggtatttggttttttgttcctgtattactgtgctaaggataatagcctccggctccatccatgttcctgcaaaagacatgatcttactcttttttatggctgcacaatattttatcgtgtatttgtaccctattttctttatccagtctgtcactgatgggcatttaggctgattccacgtctttgctattgtgaatagtgctgcagtgaacatttgtgtgcatgtgtct

SEQ ID NO: 188112 - DNA, 269 bp, Homo sapiens
tataaccaagttctgttctgttaaaaaaatcagcagccaaggcttccatgttactttcttcttgtacatcaacacaggccctttttgcagggaattctggtcttaaatatgctctccctccagttttttccatgtctttgaggaactccagtgcagcagaagcattcatgacttttgcagacgttacatctctcttgtacaaactggagctcaacgtgacttgccatgagaccaagtttgccaagcattgggtgaagtgcaggaaacaa

SEQ ID NO: 188113 - DNA, 678 bp, Homo sapiens
aacctcccataccattgatgctgtctagacccataccaccactttcctcccttgctcactccagtctagccaccataccctcctttgttgttcctctatcatgcatgacaaacttctgtctatgagtctttgcatttgtttttccttccttctgaaatgttcttaccccagattgttccaggtttgtttttttcttgacaggatcttgctctgtcacccaagctggagtacagtggtgtgatcacagctcactgcaacctcaaactcctgggctcaagtgatcctcccatctcagcctcccaaccagctgggattagaggtatgcaccacgcctggctaatttttttatatttttagtagagaagagacaaggtcatgctatgttgcccaggctggtctggaactcctggcctcaatgtgatcctctagcttccgcctcccaaaatgtttggatttcaggtgtaagccccatgtcaagcacacagtttctttacctctctcaggtgagctcaagtagattttttcagaaagacctctctttactatcagatataaaacggtgactcatcccatttccacaccctagcattccccatttcttccctgctttattttctctaaagcacttatcactttccaacgtacttcttgatgtatttattgagttgtttattgcct

SEQ ID NO: 188114 - DNA, 363 bp, Homo sapiens
taatggttctcaatgatcatgacagatgtggcaaaaagaatgagtagaatggatataaggaacaaagaagctccatttaccctgtaaaaggatgggtccctgggggctgaggttgtaattcttgtgtgggcaggattcttaatacaccaaagtaaagtaatttttaatgtctctatgaaaaaaaaagggaaggaaacatatgcatcttcacatagactgtgagccaaactgttatagtttcccaggaggcagggagcactgtcacatagcataggagaaaggcattgaaaacttcaataattccatttcttcagaaagacagcttaatttcccacatgagccattcctgaggtctttcttcca

SEQ ID NO: 188115 - DNA, 660 bp, Homo sapiens
ggggtttcgccatgttggtcaggctggtctcaaactcctgacctcaagtgatccgcccacctctgcctcccaaagtgctgggattacaggtgtgagccactgcacctggtctatttatttactttttgagacagagtctcattctgttgcccaggctggagtgcagtggcacaatctcggctcactgcaacctccgcctcccaggttcaagcagttctcctgcctcagcctcccgagtagctgagattacaggcatgcaccaccacacccagctaattgttgtatatgtagtagagacagggtttcaccatgttggccaggctgctctcgaactcctgacctcaagtggtccgcccacctcagcctcccaaagtgctgaaattatgggtgtgagccaccatggctggccaatactgtcaatttatataagtgacttgagcattcacagattttggtatttgcggggccctggacccagtcccccaaggatagtgaggcatggccgtaatcttttacctagtgtcctggttagcattttcaacttttaccttagtagttattgaaataaacagtatttcttcaaaattatgagagaattaatagcttaatagtagaataaattgtacttcatgacacatttcaatttgagaagtgttcaag

SEQ ID NO: 188116 - DNA, 529 bp, Homo sapiens
catagctgtgtatacagagatacttaatgcatgtgtagtagacatgtatcttatatgcatatctgaatgctttctgtggatgtaataatacttttgtatctaagcatcatatggttatttctcactacatacatagaatcacagagtttgaagagaacttaagtcatctagactatactctttttgttgttttttttctgtttttctggggagactgagtctgcactccagcctgggcaagagagcgagactccctcgaaaaaaaaaaaaaaacttgcttacttgtgtgacatattcaatctgtcacctcaggggagaacaaaactgtgttcaagttggcagatagagtggctgcattcaaagccagactagtattatgggggccacaagtgaacattgggattttttgacatgtttcaaacattagcagagattttaaaagagactgagccaggaccttttttctcccagctggcacatgatcacctatctcagccttcaaagagtttgagtattattttccagccac

SEQ ID NO: 188117 - DNA, 490 bp, Homo sapiens
agtagggcacaatcagcagatacttactgaatttttctataaaaggacaaccgaagtagttcccatttccatggggaatcatggagtggttctgccacattgctgagtggtcagcaataggccaagctccacactgcaatgctgtacattcattattgatgtgtgatgggctcatgagaatttattatataattctttcaattttgagtatatttgaaatcttccatgaaaaaatattaaagaaaacctaacttttggtgactgggattccccaaagagatccccatatggataactgcttcaagtttttattatcatcagacaactggagagggtaaaattatagttaagtgctgaagtcataaattcaacatggatcacttaagtctatgtatcagttcccatatactaacttcatcagacaactggagaggttaagattatagttaagtgcttaagtcataaattcaacatggatcacttaagtcta

SEQ ID NO: 188118 - DNA, 675 bp, Homo sapiens
ctacctcctaccagtgttgacagttttgcaaacaggagcctgctacaagtcattaccaagtagaaatggacctctcgcagtcatcgtgtgccctgggtggaagaaggcccaatttatttttgaattattgggagaatatagcatgtcctccaggcctcttcatcctgtgctattaacaattgggctccataaagaggaagccaaaaatacaaagcttccaaggggctgtgatgtgattgttacgaccccatacagcctgctgaggcttctcgcctgtcagagcctgctgttcctcaggctctgccacctgatcctggatgaggtagaggtgctattcttggaagccaatgaacagatgtttgctatattagataactttaaaaaaaatattgaagttgaagaaagggaatctgcaccacatcagattgttgcagttggagttcattggaacaaacatatagaacatctcatcaaagagttcatgaatgatccctacattgtgatcacagccatggaagaggctgctctctatggcaatgtccaacaggtagtacatctttgcctagaatgtgaaaaaacttcttctttactccaagctcttgattttattccaagtcaggcacaaaagaccttgatcttcacctgctctgtagctgaaacagaaatagtgtgtaa

SEQ ID NO: 188119 - DNA, 312 bp, Homo sapiens
ctctctctctgtgtaaaaggctcctcaaacacacactaagctactcattccagaatcatcacaatcttttcaatcaaaaagtgaacagctttgacattttaaaataagagactgttgctttcagaatttgattagactattctaatagcaggctagagtcattaaaattggcttttagagagacacttcacgtgcttagtaattggcacatcggagtgatgacagcctccaaatcaggcttccgagtaagtcagtctttatctagttgtctttaaaactggataaaggcatgtctacacaaaagccacctac

SEQ ID NO: 188120 - DNA, 462 bp, Homo sapiens
aatgactttccatccaattagaagcaattctatgttacatccttagctgtatcaccctttatcatctggcccttgttctctgtgtgacttcctttcttctttctcctccccatcacccactgtgctctggccacaacatcagctcttgggtcactgaaacacacaaagctccttcctcccttagaggctttgtgattcagctccttttgctgtttgcaaggccggctgcttcctgcaattcacatctcaacttagacgccacttcttctgaaaaatcttccccaactacccactgaaaagttgccgctcattcactgtccattatgtttaactctctcatggcacccatcactgagcaatgcttttcttgtgtccttgttgattttttctctcttccctttctaaggtctaagctccacaagagtagggatcttctccgtcgtggtcgccactgtgatttca

SEQ ID NO: 188121 - DNA, 379 bp, Homo sapiens
ctctttgctgagagctgttctgtcgctcaaaaaaattctcctcccatcttcacccttcaattgtcagcatttcctcattcttcttggatgcaggacaagagcttgagaactgccgaatgcagatacaagctataacacaggtgggctgagtgggcagggtgcctccagtgtcatgcccttgcgggtggtagggggcactgccggccatagatgtccccggctggcaaagtggctaagaaaaatcctgagtcaatatggtgaaggaatctacaacctggaattctggtttttttttttgagacagggtctctctctgttgcacaggttggagtgcagtagtgcaatcatggctcactgcagcctcaacctcctgggctca

SEQ ID NO: 188122 - DNA, 656 bp, Homo sapiens
ctaagatcaataccatctttctggtgaactttgtctccaagcactgcaaagcactgcatctaattcaaagattctatgtctttggtgaagaaggccagcattgttgacctaagtctgtagtatctgagttaggaacaagacctagtttcctcacgcctggatgtgaggtttatctttacatgagagcaagggacgtttatgtaatcctcattagtgcggatggctgttctgactccaacagccagtgcatcattgcaagaacagttgctttaatctctaaagaaaacaccaaataaaatgcatttttttaaatcaaggaaataaggttccgtcaatgcatattgtccaagtgacaaaggatttcagacagctacgtaattagcctctaatagcaatatacatgagaatgcaatttacttttcatcattcttgttcgggtcatgaattgaaatcacagtaggagcacaaggctgtcagggataaagcaaaggaagaaaacaggacttggctgctgggaatattcacacccagccaagaaaacatgccaaatgaggcttaaaatgaacttttcctgtgtgcatttcacaagttcagaccaagaggaaaaacaattcttcccctcccctacccccactttaatactttaaccattgggt

SEQ ID NO: 188123 - DNA, 663 bp, Homo sapiens
cgagctcttacccgtcctacatagcgttacttagaggagacagacaaactttggaagccatgtattgactattaaggaacttgtctttctcttagagatggtaccaattactggtagtgatatagggaggataagacctgtctctaggattgctgtgattattgtctacgtagaatggccttcacttcagaatcagttgtgaatgaaaagtacatttgtgtgctagaaataggaaaaaaccttgtcttttatagaaaacttttaaaatgcagttatgttatcaggtagattcaaacgtataatatacaagaaaataaaacaaatgaataagtgttgtttgccagagaagaagcagttctgatcaataatatgtagagtaatttgtaagagtttgaaggcttgcgaagcgcttttaagcttgagagtaatgtcaactcatttttaaatctaatcgcattttattttcttgattgtaggtatcaagagcactcctcgcattgaaaagggctggttactggatgttcttatgagtaggagaatctagaagtgtcagcatgggtgtttaacctatttgggcagtgtttttccttttccttgttctgactaaagcatttatctctgaggtggggaaatggcattttctgttgaacacaggtggccttt

SEQ ID NO: 188124 - DNA, 289 bp, Homo sapiens
aattgattatatcaaaggaaaaacaaacagtaagattttaaaacttaaagctttcaatagtatattttctgaattttcaagcgactaaattcatcccatttgacttggtggatactaggtgtctcatgaagacttttatcttaattccactctagctcatagatagactgctttcttctgtcaactttttccaggtgttgagcccaaaggatcagaaaaaagtggattaacatacttccctgtaccttttgcaaattacatgcaaagctcatattcaaatgattgttgg

SEQ ID NO: 188125 - DNA, 470 bp, Homo sapiens
atgcaactattgttactatacctgagtgtttgtgcttgcaaaaatgtgtatattattaatattattattgcctattttgtagtattaatataaggtggcctatcacgtgttctgccatgtttttatgtttcccaaataaatcccccttaaaaatgtaaataaatgtctttaaaatattttttaattattttgttccccagaattatatttttgagattttgatcttttaggattatgattttagggattttagactttagggattttgatgtttcagagtttcagcattcaggatttggtcttttaggattgtgtgtctcaggattatggcccgcacccctaacaaagaggggaaacctgagatgtttttccttgggactgataagagataagccttgattgatattgaacatatgtagggattgaatggtgcttttcattaaatcgctgccatttttcagtgggaaagt

SEQ ID NO: 188126 - DNA, 676 bp, Homo sapiens
tacttggaatagtgcttggacctatggtagtttcccagtaaaaatttgttgaataagtgaatgaactaatgaatgaatgaatgaatatactacttatggatcccagattaagaattctttcctattcagttatgtcctccttttaaaagaattttgatggtgtcagagggaggggctgtttcaaactcatctttttggtttgaatgcaataatgtctgtagcacatagtagatagtaaatattaatttcattccttttcactcagaaagaagtcaaaaacttagtagaaggtagtttttatgatgacagatctcttgagactcttctaagtaatgttttcacacataaggcatagacgtgaaaaatgataaatggatgtttttgcaatattggtatttagggcactttatacctggataaaatagtcatatttgttaaataaatttttttttctccttcctgtaacaaaggatacttcattaataatataggggatgttagtgggaaaataggtatgtaagttttatattttagatactttttcagaagctcatttcctgtattggagataaatctgaagattttattaggggtctttcctagcatacactgcagctatatttatcccactttgcttaatgatttttcttcctctaacaaagttatatatactctt

SEQ ID NO: 188127 - DNA, 766 bp, Homo sapiens
tgaaagagtgagacacatgaaaagagaattccagtcagagtaacagtatgtatgtaaaggcccaggggtatcaagacgtcgagcatgtttaaataaaacagtgaccactgcagtcaagcaatctgggcacaagagtaccagtttaagaggagactacagatgtaggtagggctgctgatcacagggcctttggaaggagtttggacataaatatatatacacatatgtatttatttaaagtcactgttggctaacacctgtttttttctggcttaataaatgtgttcctggcttatctgaagagaatgggcatgaaacttgtccagggcaatagtacataacatccaaagtaatcactagcagcaaggtcacaataatatgacctaggaaggtcagaatctgtcccagtgggacactacccatagggaagacaactttcacaccactcaggtggctttttcctccatctgtaattgcttctctcccacctacagtggaaactcacctcagttatcactaacaagccctatctttcccaatcagagaataattaggctgattaacaactgcttcctgtatcttaatttcctataagtgaaaatgagtgtgacctaacaaagtcagactctgcttacgcctgggtgtcttggctaaaatacaagtaaacacttctcaaagtgtaatcactttcccctgtcctctaaacatgtaagcttcattttgccaaagataactcaatgtatcacatttatagacaaaggaagta

SEQ ID NO: 188128 - DNA, 456 bp, Homo sapiens
aagcttgattgcctgccacaggtttggtctcactgaagtctctaagaactcagcactgaacacaaataattttcaggtaacatagagtgttgttcttggtgactaaaattgccatcctcccttttttctcctctctgtaagatacaattgagagagccctgaaatagaagccagaaaactgaagctctatacttctgtccaacatcctctgcatcattcattccttgtagattcagtgtcctcatctttaatctgaggttctgagaatgtatgcataaaagaagtgggaatgcttcatgaattgtataatactacttatatgtagtgtgatattattatttgtagaggcagaagacaccaaaaataaatgtcaacagagtatagaccactagccaactcagaaaaccctgactttgtctctaagaaagcctttctatatcttgggcaatcaagctt

SEQ ID NO: 188129 - DNA, 356 bp, Homo sapiens
ctgtaagggaacaaaagggatggggaaatatcaactctgactcaagccatgcagagccagaaataggcaaaagaagagagggtgcacactgccgtgtacctgtgtcctcttcctgggggctggtcactccccactgtacccactcttctagaaagaagtcaagggcagtaatgagaaatgacagcaggaggagaaagtgccaaagtccaatgaacaacaggtggtaatactgtcagttcaaatcaccatcccggaagctgagtggcgatggagctgaacctagatcagtactcaaactctattaaacctacagcactaattgctcggtgaagcccatgtgttccttctcacccact

SEQ ID NO: 188130 - DNA, 526 bp, Homo sapiens
gggtggggatcaaggatgatgagaaatttaatattggcatatagatgtgaagatacttaagtgcctcagcaataaaatcatttctgtagcttgccttgaatgactggactcctacagttcaacagatactcagtaaatatagcacaattactccaaaagtcatctatttcaacacaggattgaactacctctctaagcaacttggattgactcctatttggctattacagaagactttctaagagaaatgggatacttccccacccatcacaaaaaaagaattgtaactgcagggtaaatgattatgtaatggtttaaaataggaaatatttttaaagtttctaaggattgctttttaaatttggttaaatgtcttaaatgggaaatcgagtaaatatataaagagacaccataaagacattatctcaaattaacgctatgatatggtatgagagtgagtaaatgcatttgactattgttggactgctgtgcttttgattttaatttcccaggtacttatatttgc

SEQ ID NO: 188131 - DNA, 186 bp, Homo sapiens
cctggtggggatcgcccttccccagcaacacgagagactcagggaacactcgctcagcaacgccgtttgccaaaggctgcaaaagcgacgtcagcgaggctggcagagctgcggaaagagagagctggggccgggtggggtcagtccactttgctggctctgccggaggacaggagcctgccattg

SEQ ID NO: 188132 - DNA, 785 bp, Homo sapiens
tcttccactaatcaagcctactgcatggtatgactccacatttgcagacgtgatcagagtgttcctcatgccccctcctctgcctgtttcctctgtctatgatggaacagccttacttctcccttcatgtgcccaactctcttaccctcctaacctcaggctacctgtttttttggcatacagtggcatccctggcacctagcacctctggtacagctcaggtgctccataaatatttgatgacagagtaaatggactgtgttgtattattgtccaccctggtggttctccacactgactaaacatcagaaacagagatctccaggtcctactcccctgcctttggcatttgagtttgtaggaacaggcctatacattcctactgtaaaattccgccacaggtcatgctcatgtgagaaacacaagtctctcctccgtgagttccttgaggaggcagactatggtttctgccatttcattcccattctgattctggcagaaattagatatacaagaaatatttgtgaataagagaatttaactctagagaaaagtaataaataataaatgagaggaaaatgccctttcttctgtttgcagatctaaaaccttggacctttaaagactaattcacattacccataccagtttgttacataagtgaattgtagtgccaacaccgattgttaattcgagtctggtctatcatgggggcaaccgcttatgccgattacaatcggaaattggtcttagctcccaaggtttaagggtttaatggacaccct

SEQ ID NO: 188133 - DNA, 783 bp, Homo sapiens
caaagtgggaggcatcatactacctcacttcaaaatataatacaaagctagtgtcatcaaagcagcatggtattggtctaaaaatagacactggccaggcacagtggctcacacctgtaatcccagtgctctgagagactgtggcaggcggattgcttgaggctaggagttcgagtccagcctgggcaacacgatgagaccccatcattacaaaaggttaaaaaaaaaattagctgggcatggtggcacatgcctatagtcctagctacttgagacacgaggatcacttaagcccaggagttagaggctgcagtgagctgtgatggcaccactgcactcctgcctgggtggacagagcaagaccctgtccatagaaacaaaaacaaaaatgaaatacacatagaccaataaaagagaatagataatctacaaataaatccatatatttatagccaactgatttttgacaaaggcactaaaaacataccttagggtaaggacagaatcttcaataaatggtattagaaaaagtgaattccaaaatgagtaagaatgaagttagatgtttgtttctcatactatacaaaaataaactcaaaatagattaaagacttaaacatgagttccacaattataaaacaacttgaagaaacacaggagaaatgctttaggacactggcctaaactagccatattttatggctaagacttcaaaatcacaagcaacaaaagcaaaaatacacacatgagactacattaaactaaaaactaaaaagcttctgt

SEQ ID NO: 188134 - DNA, 146 bp, Homo sapiens
atgccaaatgatgaaaagaaatgtgatctaaaatcagaggagcaactcatacacccaggaatcaatgtcaaagaaggtagtaaatgctactgcatgtttttcatgcaagacatcagaaggatttataccattatactgcaagtatt

SEQ ID NO: 188135 - DNA, 473 bp, Homo sapiens
gtgaaatcttgcctttaataaggccatactaagttttctacaaatacctgttgaatggcagtctcctacatttctatgtgctaaagtagaactaccattacctttagttagaaggaaataagcatttggaattctctaggacattaggaaatacgattaaattaggaggtatcagaacagattcaataattcaaattttaagaaatctacttgaaagcccaatatatcactttgtcatttatcacttctcaaagagcctttcaatagcattagttaagtgttacatggaaaaataagttttttttttgtggcaatacatttgaaaaatgctgttacttaaagttaaggaggtttctttatttctggactttaatatgcactgttaatctttgggtagcagcagcagatgcaatatttctcaaatttagttgggcatgatcctatttatccataagcatcttgaggtaggaagc

SEQ ID NO: 188136 - DNA, 331 bp, Homo sapiens
aaggactaccatcccctgtaacttgcaagtgttttgtcacggcagtgaccagttccattccttagggaatgcggttattatattttatacattgggttgccagcagtggagaatttcagaggcttcaacttggtcctgctataataatgtcccttactctacagttcacgaagaatgtgaaagtcctgccagctgccatacgtatccagttcaattacacgttcaggaagaggtagtaactacaaactgattagatccaccttgggatggacatgagacaaaactctaggtagcatctgaccttcaaaacctccccctgcaggctggatgt

SEQ ID NO: 188137 - DNA, 499 bp, Homo sapiens
ggtgatttataaatgtttgttatattacttgtaacttgaccattgtcttcctggctcatagggtgtgcggaggaattaaaacatagaggctgtcagaaacctcctttcctcaacataaagtcattgcaaggttattgagacaccccaacaaatagaggggcttctcaaggctaagttcacatccttctgttcatgaacgtctcagtgaaaagtaattttctttgttacttcctgtgcaatttatttttagtgctttgttcagagaagatgaagtgtctcaagtcacttcagtattccagcaaaattaatggattttaaattgtactttatgttttttgtattcatagatatatttttattcttttgaaacctgtacaatcttgcatctcttgcagttattaatggaaattccatctctcctaatgtttattcatcatgttccctcaatccaaagttcctcttcagttatggattaactcctcatacagaaatattttta

SEQ ID NO: 188138 - DNA, 544 bp, Homo sapiens
acacggacttgtgtcctgcacttctcctatttatgggggtttagtattgattgatagcggtgtggtcgggtgtgttattattctgaagtttgggggaggttatatgggtttaatagtttttttaatcaagtctcactctgtcacccaggttggggtgcggtggtgaaatctcggctcactgcaaccttcacctcccagattcaagtggatcctttcacctcaggttcccaacgtgctgagattacaggtgtgagccacttggtctgacctcttttattttacatgatagtcaatcctaatgggtgcgaagtcgtatctcattgtggttttcatttggatttccctaattagtggtgtttcatatcttttcatgtgcttattggccatttgtatgtcttccttggagaaatgtcttttcaagtcttctgcccaatttttaattggcttgtttgttttgtgttgttgagttttaggaggtctttatgtgtttagatattaatccatcaacagatataagatttgctgtattttctcccattttatg

SEQ ID NO: 188139 - DNA, 455 bp, Homo sapiens
tatttgttaagctattcagatgaactctgatctcaagaaatgatccaggatgaaacaatatttcagaaaggaatgagcttagaatcagagaaaatggaggcttcagatatagatttttaagatcagttgatctctgaattgaataattttaaaaagagaagcatcttgggtatataaaaaatgggttgacaactcaaaatacttcagcaatcaataggaaaagattatttagcaatgaagtgaaggctgtcaggtgactgccacctctgtccttccagctctcaagattacatgcacagtttcaacaagtgactgaaccctccgatcctcactgcaggggctgctgggtgcctctcaggcatccattcacctccatccattgtggcatccagcctctaagacagtgcccaacaactcctgccatctggcactcatccctggcctttcgtcccccg

SEQ ID NO: 188140 - DNA, 606 bp, Homo sapiens
agacttttcaccaattgatgccactatcaatacaatagaagaggattaaaaaccacagtaaagcctttctaattttagtttctctgtgacgtgattgagatttttaagatatttatccttcttaaggatgcatatgtgaagatttaggagcatataataagctaagcagttgttaattcctaggtgacctcaaacataggctttatattattccaggtgcttcatgtaccaccattatttttcttctgtaattataccttcctctttggatagccactctgttcccctgctttatttttagatctctgtggatgccatataagttgctttccgtcattggtttcaagatcagcattaattataggatccattgccttggcaatgacagtgtcaagacaaaaaggtaattgtggttttcgcagtgaggtgatagtcaaaccgtgaatcaggagaacttttgaaagtcttagtcttagaacttttgaaggtcttagtacagtattctcttttagcaccaaatctggagcaactctactctttgcttggagatattgctattttccttgatttgtacttttgtttctttctttcttttttttttttttt

SEQ ID NO: 188141 - DNA, 218 bp, Homo sapiens
tgaagttttttgcacctaccaccagtggggaaagtggcagctcacagcaagtctttggggtcctagttgttcccttctcctccctcccctgccgtggccaccatgtgcctgtgtagcaggaagctgtgggatctgcagactcagctctatcaggcttcccagaattgaggggcatggggtgttctaggggacatttcctggtcacatggcctagcaga

SEQ ID NO: 188142 - DNA, 271 bp, Homo sapiens
ctgccatcaccaaagtgaattttccactctcctttcatactttaagcattgcacactccagagttattgcacctggctggccacgctctagctggtaggaaggctgaggaatgccagtatctggcccatgtggccctgcctcttgccaagacccgtatggtgaagcgttcctcaaatgtaagaaatgggttcagctggaaagcaaacacatgttcactgcaaacttccagtctactgggaagtatttgccaaagatggaaaccttccttag

SEQ ID NO: 188143 - DNA, 125 bp, Homo sapiens
ctaccctaccttcactagacagagcagggcgagagttccatggtccccaataggtagggactaggcctcaaggcagcatgaagtagttacagaaaaagaacattggtccctctgcctcccataaa

SEQ ID NO: 188144 - DNA, 288 bp, Homo sapiens
ctcatagcactgaaaacatacacagtgcttaggtgtaaatatttgtaaagttaaagtggattccagccacactagaatccaagttgaattcaaatttactcctatgctgggggctgtggctcatgattgtaatcccagcatttcgggaggtccaggcaggaggattacttgagatcaggagatagaaaccagtctgggcaacataacgagacccatctctacacacacacacacacataaaattagccacgtgcgttagcgtgcacctataatcctagctactcagga

SEQ ID NO: 188145 - DNA, 370 bp, Homo sapiens
cagaatcaaatatcagtttctttactgattggctatttcttccctgcttgaatgcagttaagctcttttggcccctaagatgcacaatttcattttccaatccatttaataatgattgtattattttcagcaaagggaagaagagaactaaccttgtgctatcatgaacatgacagacactgtgaagatagattctcttaaatccgagggaaccagcttcatttaacagatgaagacattgaggcttgggagattaagccaccttgcccaaggctaaacaattagtaaatcatggagttgggattcagactgatctttctgacccaaaacaccatgtcctttgtaccttccttaaaatgtcacattctac

SEQ ID NO: 188146 - DNA, 425 bp, Homo sapiens
taactggaactagaggcatgcaccaccacacctggcttagattttatttttaaagcaattttaggttcatagagttcgcatatcctccttctcccttatagctagtttctcttatcagtaatacttttaattagtacggtggatttattattgatgaaccagtattgatatattattattaactgaagtccatagtttacattggggtttcatttttgtgttgtacaggtctatgggttttgacaaatgtatagtgtcatgtgtccatgattaccatattgtacaaaatagtttcactatcctaaaaatcccctttgcctattcattccttatcccatccctcgacccctggtaacaccactgatctccactgtctctctagttttaccttttctagaatgtcatgtagttggaatcatacaata

SEQ ID NO: 188147 - DNA, 452 bp, Homo sapiens
aagggctgagggagagtacccaaggaaggacaaacttggaaggggatcccctcccaatgactggagtttggacttcagtggagaaggtttagctcagcccaccagatagcagagaagtttgctagtttgcaggtgctgagcaagccagaagcaactctccagagtgcaggtggggtgtacattcaagccacagctggtgtcatgacatgcagaaggagagagagaatccagtagaaaccttctgtgctgcaagtgaggcacacacgtgggccttcagagggaattggggccagggtgagcagatggccttcaaagctctggtttccatgttgagagggcctcgggagagttatccccaggccaggctaaggcttcaggtcaccaaggacccacaccttctgggagtgtggctagacaggtcttcagtggatgacctctctgcctccccaaca

SEQ ID NO: 188148 - DNA, 306 bp, Homo sapiens
ttggatcaccaaaaaacagcgcatgcttttgagttgttttattctaagaaaatactctactttcatttagctgcttttgtaaaacttcattagagataaagaacacaggctctgtaatgaaaagacccaaattcaggtcctgtttcactactttttaaaaagctatattgcacagaaatcattatggagtgtagtgggtagacaaaaacagattagcagatagataaacatataaaactgcattttgtatttatcttacccaaacttgttttctgtagtactccccatgttggtatataggcaact

SEQ ID NO: 188149 - DNA, 406 bp, Homo sapiens
cttaaaacaacatacatttgttctcttagagttctggaggtcagaactccaaaaccaatttcactgggctgaaaccagtgagtcagcagggctgcttctgctccggaggctctcaggaagaatccgtttccttgccttttccagcatctagagctgtattcactggctcatggccacttcctccatattcaaagccagtggcatagcatcctctctctatgactctgtttccctctgcttctatcacatgaccttcctctcttttatctgtaatctccttcttatgaggacacttgtgattgcatttacagcccacccagctaattaagcataatatccccatcacaagatccttaaattagtcatatctgcaaagtattacatgcataaggtaacattcacaggt

SEQ ID NO: 188150 - DNA, 227 bp, Homo sapiens
atatattcttccatcacctcaaaacaatatcaactcattcacaaactcatttgatggtgaaatattttcacatcagtgaattactcgatgtctatgccctatacagttacagagaactggccctccttaaaatgttccaaatcttgagaaaattcttctctctcccttcccacaaatctcattaaataaaatagcgatattttcaggttgccagcacacatatctct

SEQ ID NO: 188151 - DNA, 480 bp, Homo sapiens
ctattcagctatcttggaacaataaaaacacaaaggtttacttttgagcactcattttaatcttgttttcactatgggaggaaagggtctaggagcaaatgtaaactccaagttttgctaataattgataaggccgtaagttctgtttacaagggccaaccaagagggccacagtgtccctgaaaaaatggaaacattccaaagctggtttcctgagagattcatcttaaagtacataggactggctacttctcaagatagagcattcagacttttctgttgaccgaattgttgtttaactaggaccaattaattttgcagttttactcgtgccagcttttactttgcttgccaataactaattgcattgttttcttatttttgtttttaacaccaacagtcagttttttgtatttaaaaaagccactttgggatactgaagttttaagccaagactatttagttgattggctcggtaag

SEQ ID NO: 188152 - DNA, 407 bp, Homo sapiens
gggcgacctcttaaccacctcctgccgtgagcctcattccttccctccctttgtaactgggttcccgctatttgtcacgtcctcctgtaaccgcacatactggcgaaagcactgcccgggttatcagggtgccccagattgcagactgagatgctggcctgagattgtaatccaaccttgcattgtaaaacgggcagagaccagagccctgctttgagatcattcggtggagacttcctttgaggaagaaaatgtgtgtgtgtgtgtgtatgtgtgtgtgtgtacatgactgcacatgtcgcactggagccctcagcacctgctgcaaagacacctgatgagcgcccaggctccacggactcctcgcgactgataggcacgttcaagaccaggctgacccaacaggc

SEQ ID NO: 188153 - DNA, 467 bp, Homo sapiens
agggcctctttttagaacattccattttcccattagcgcaagcctctgaggcacctttgtgctactctctttagaaaagagaatattacaaaaacacgttctaattattgttggcctttcattactttagagcttctgcacagcctagaaatgaacatccttgcctcagaattttgtccttattttttttttcttttgggagatgtgtcatccctacagggctatttatgaagcccaagctggcagaatttgtctaatgtgcgtaatgtagaagaggccaacaccataatgaaaggagcacctctgagctcatttgcattcccccagctggttgggaaacaaaagcccactccgtgctacacttcatggttcacttattgtggttcatttcctccaaatcgagtggtaggttaaaaagaaaagaaagtcaagtcttttctgcagtgtcctctgcccggcattcacag

SEQ ID NO: 188154 - DNA, 370 bp, Homo sapiens
tccagaggattccgcgtaatccgtaccacatacaaaagatgaaatatctctatagggagtagctggacacaaagcaattgattagtgagcttttcactttaaccttcactaaaatcaaaaacctcacaaaaaaacatcccagagctgcctctcaatcctgccaattctctccaggtttgaggtacaaaggtatgtggaacaggactttctgaacagacgggagttaggtagcgtggcgcatgctaggaaaacaatacgtacgtagtaaaggtcacatgtgccttccgataaaagatttttgttttgacaactgggtttttgaaagtggcttaagccagcctgggcaacatggcaaaaccctgtctctaca

SEQ ID NO: 188155 - DNA, 284 bp, Homo sapiens
ggattaggacagaaatcacatctaggacatctcaggccctttccacctgggacctgagacctcaaatctcttggcaggagatgagtgggtctacacagcccgattttgaggtaggtgtggctagcctcatttatgcgatgggaaaactgtggtccgggaaccaggggttttcaaattatgctttttgcccagggctggatgtaggatgtctgggggagaggcttgactgagatctgggtacactgagcctccactttaggaggtaacctagagactacacctac

SEQ ID NO: 188156 - DNA, 459 bp, Homo sapiens
cactttcccatctcccgggctttgcttctcacctgcccctcatctggagggctctcccttcccacatccttcttgcagaatccaatccagccccaaaggcccatctcagtgggttctctgccatcgaatcctccctttatcactccaaccaaaagggatttcttcctcaaaatgagatcagccctctgtggtaggcagaacaatggtctcccaaagatgaccacaccctagtcccccaaacctgtgaagatgttaccttacacagaaaaggaaacttgcaaatatgattaagttaacgatcttgagatggggagattatcctagattagccagatgggcccaatgtaaccacaagtgtcagaggcatttgaaccagagcaactccatcttgaataggggttgcataaaataaggctgagatctgctgggctgcattcccagtaagttaggcattctaag

SEQ ID NO: 188157 - DNA, 696 bp, Homo sapiens
caggcaggaatgaactgttgggggacccagcgagttcccagggcctttctgctgcttcttctacccctgtatttcaccgggctctctaaatgactcatctcaggcctttgtgtccttacctggacttctaccaatgctaatggctttccaaccacctcccctcacctgggaagatactgtcagtctgacatacattatgcatctgtctatccagaattcctcacactgctgatttctgaagagcattccaacttcagtggatctttttcatctctgcgtcttgaccatctcaacctggcccttctgacaactccagtgagaagaaggcagaaattaagaacagaatatatattttttggtctcagtcatgctcaggatggcgcaagatgagaaacagcctggaatttcccatccttgacaatctttaccatatcctgcccttcttgggcattaagatagagttaagagataggaaaaaccaagaaaagcaaaagagtcaaccaataagaagagtataaaaggacaaatatgtcaatagtttatgttatggagtttgaattctcacttctccactttccagtaatatgacattgggcaattacataaattcaattagcttcagtctcctcttccttaaaatgtggataacaaaagggttgactccatagggttgttatgactcaacacataacataa

SEQ ID NO: 188158 - DNA, 546 bp, Homo sapiens
tgagtgggtgaaaaacaagcggtcttaaaaagaaaggaggtgagcccggggagataaggtcgcattcagtgccagtgcttggtcagccatgaccctgcaccatgcgagtgacattgggactggagcaaagggacacagcagagtggcccctggtgcccaggacccggcagagctctcggactggttgcaagccagcaatagtggctatgcccgtgtgggagacgcagcttgccttagacttcagcgggaaccaccatgtccggcacagccatttccatccttcccaggggtgcttacgtgatcctggcagtctcagtcaaacttccaaactcagcagggaatgtgtgtgcttgtcctccaatctcaacaccctgggatgcagtgtcaggtgcaggtcagagacagcagtggagacccgattcccagccctgggctggggcccccacaaggcctccagcatctccccatggcccagtttcctcatctgcaggacaggctctcttgagaatttggggggatgatagacccaaaagcattctggagcca

SEQ ID NO: 188159 - DNA, 332 bp, Homo sapiens
aacaagggctggatgaatcaccagttatctcaactgaaaaaaatcagtgacataattcctattaactgagatggctcaaaattctaagctccaaaaaaatgtctgtcactctggaaggatgtgtacccttgggtcatttgtgttctgggtgtggcaggcccaaaagcatttaactgggtataaactcaattaagggagggccttcatttaacaccttacagttggaattttactgagtacaaagagttggtaccacctgctgaaatgggtggcaagtggtgtctattgagaattgtaagcaaccacaaacatcatgaattagcttgtacaac

SEQ ID NO: 188160 - DNA, 726 bp, Homo sapiens
atttccttgatgaataaccaatgcttagcatgttctgcctaaaaggaatttgttttcaaattcattttcccttaaaatcaaatactgaaccctctaattagaaataagcttttgttctctgactgtgtgttgtttcacaatgatctattcactgttttattcagaacacagacaacatatatggtgcttgcctccctcacccccacgtgcctgccttgccaggggctggaatatatggacatagtaacatgctgtcatattcttgaagaaatttccgtctataaataagccactattacttagaagaagaagaatagaagggccccaggacagagtacctagctaggtggagaaattgaagaaggcatcacagaaaaggtgtcatttgtcctgtagggtggcaatgggctctccaggaagaggaaaaagagagtactagagctaggaatgcttgatgctcatgttccaagtgttttacataaattaactcatccgatcttcatggcaaccctatgagatagtaagtattatgatcacacgcattttaaaacagggaaattttagcaaggaaaagtggactaacgtgcctgaggtcaaaggtaacaagatgtggaagaacatggcatgttacatgaagggtgagaagcccaagtggtgggaaggggagctgctgagacagggctgggccaggtcatatgtggcactgtgcaccgtgtgaacaatctg

SEQ ID NO: 188161 - DNA, 230 bp, Homo sapiens
aagctggagtccagacacacgatcatggctcactgtggcctcaaccccctgggttcaagtgattcttcgcctcagccttccgactggctgggactacaaacgtgcaccaccacattctgctaatttttttttattattatttgtagagatggagtcttgctatgttgcacaggcaggtctcaaactcctgggctcatgcgatattcctgccttgggctcccaaagtcttg

SEQ ID NO: 188162 - DNA, 481 bp, Homo sapiens
cactgacctgaaagtgtgttaaattactgagattttgtggttgttacctcaacataacctattctatcctgtctatgaaatgcagatttgtagcacaataacattttagaatcctaagcagatacatacaaaaccatccttctacttcccaagggtatacacataaccagactaacaggtggaattataaaaccatataaatatcttagaatggttgagtgggtgactaaaacaaaagaaaatggggaaaaaaggaatgagcataaaggggaaaagaaaaggaaaagacataaaaaggtttattaaacccgttgtgcaaatattagaaatttcattcactcactgactcaacaaacatctatggacctattatgtgccagaactattttgggtgtacttacagagtggtgagtcaaaaaaaggcagtgcaggctgggcacagtggctcacgcctgtaatcccagcactttgggatcacgag

SEQ ID NO: 188163 - DNA, 404 bp, Homo sapiens
gattgtccatatggaaagtccaagaaatctacaagaaaaaaatctagaactattaaattcagcaaggttgcataacataaaacatagctccatacacataaaaaaaattgtatgtctatatgtcagcagtaatagcaaatacaacacaattaaaaatacaatactatttacagtcactcaaaaaatgaaatacttagatataaatataagaaaacatgtgcaggaatatatatttaaatctatacaacactaatgaaagaaaagaaatgtaaacacatgtagagatataacatgcccctgcactggaagacacaacgaggtaagatgtcaactgtcctaaagttgctatacatgtttaactcagcccctatcagaatccttgcaggattttttttttttttttt

SEQ ID NO: 188164 - DNA, 443 bp, Homo sapiens
gcagcatggaatgaatgaatgaatgagtttatttatttatttatttaaatgaccaagtcttgctttgttgcccaggctggagtgcaatgacgcgatctcggctcactgcaagttctgcctcccaggttcaatgcgattctcctgcctcagcttccctaataactgggactacaggtggctgccagtatgccctgctaatttttgtgtttttagtagaggtggggttttgccatgttggccaggctggtctcaaactcctgacctcaagtgatcagcccgccttggcctcccaaagtgctgggattacaggggtaagccaacattcctggcccagacatggaatttaaacctaaatattttgttggtagcatccccacttttaaccatgacattgtccttgttcggttccagggtttctgtagcgtggagctgggcacatctct

SEQ ID NO: 188165 - DNA, 351 bp, Homo sapiens
gagaatgttcgaggaaggcagtggcaggcaatagccatagagagtcacagaaggttaaagaggttgtggaaacagtcatttgtttttcaagcagttccggtggggtttgagaaagcagcagcactcaactgtgagcagacaaactcactttggaaacctatgcagccacttctaagtaaactaccaagagaattattattttatttaggttcctcatttcagtgacaatcttttaatcctttgaactgtatgctgaaaaggacattatagatcctcctgaaagataatttttagtgtccacggttccctcaatatgatgatttttttccttggtccctatctttcaccatt

SEQ ID NO: 188166 - DNA, 760 bp, Homo sapiens
accacagacagcccctgtcttgtggacccatagccatggctggctgcacatctgtacgctgggctcacccacgcgattcacctattctgataacaaagagattcattttgtaaaaaatgtcacatacaaatgccattcaaagccagtaacaggtatgttgactttgtggaaattcactaagctggatattgacgtgagcactttctgcatgtatgtgacactgaagcaaaaattcacggaatgaaatgagtgagacaggaccatttggaggccaaagaatcatgacaactaaatgcagtgaggcaaagaaataggaaaagaaatagtataaggacatgaccagagcaatgaacaagctctgaaaatgagctgtgggttagagaggagtgttatattagtgttatcagtgtgtgtataatagctttttggcttgtgtcttttacttactgtttgtgcaagagaatgtccttgttcctcagaaatacacaaggaggatttagagataaggtggtgtggtcgcaggtgtgtctccaatgtattttcagatggttcagaaaacagactacatatgtagctatatagagacaaaattatctatttatgtaaaatattgacatatttgggccaggcgcggtggctcaacgcctgtaatcccagcactttgggaggccaaggcgcacagatcatctgaggtcaggagttcgagaccagcctggccaacatggtgaaatcctgtctctactaaaaaaattaaaaaatt

SEQ ID NO: 188167 - DNA, 330 bp, Homo sapiens
tatgtataatgaaatttaatatttatcatttaatagttgatttagcaagaagttggggtttataaggtatatactttaaaaaaactgacacatagttaaccccagcagctatagaaccctttaatataataagatggagtactaagaacaaaaaataatttaaatttaattattaaaataatttagttttgtttttcatttgaaaaataagctaatgtgtaaggttagaaaagaaagttggaatgcaacttagagcatgtttataatgtgcacagaaaaagcttgagaatgataattttggtttaaatgtgctggttagttgatgttatg

SEQ ID NO: 188168 - DNA, 376 bp, Homo sapiens
ctggtgactctagtatacttgaaagttgctaagtcagtggatcttaaatattctcattacaaagaaaaggtatgtgtggggatggaaatgttaattagctcgatttcatcattgcacaatggatgcacacagcgaaacactaagtgatacaccatacatgtatacaatctttaaatttgtcaagcagaccttaataaagctggaaagcagagtatgaacctcagctgcaccttttaccaggttctgggccttgaggaagttaactcctctgtgcctagtttgctcatctaggaaatggggctgataagagcacatttgtcattgtgcaggttaaacgagataatccacatttgtatctgcagagcaagcattcaac

SEQ ID NO: 188169 - DNA, 163 bp, Homo sapiens
atggtcttgatctcctgaccttgtgatccacccgcctcggcctcccaaagtgctgggattacaggcgtgagctaccgcgcccggctaaattcttatgttgaagccctaaagccccaaagtgactgtatttcaagataggtcctttaagaaggcaattaaggtt

SEQ ID NO: 188170 - DNA, 329 bp, Homo sapiens
tgctgggattacaggcatgagccaccactcctggcctacctaccctgtgtctttaccctgtgtgtatctcaaaataaccatctcgaaattatccttacgccaaagaggcagatctgtggtggcttattctagtctcctacagtcatatttggggaagcatgtcctgaaccctgtcacactctgattttatatttgttatgccagtgatgaacctttacattttaactaaattgttgttaagcagtaattttaaaagcttaaaagtctttaagaagatgagggccagcctcatcttcttggttcctgggaattcccgttggttgtgaccg

SEQ ID NO: 188171 - DNA, 509 bp, Homo sapiens
cttacagccttgtaaaaaagtcactgggggcctgcttgaggcaatctgggtcccttggtctgccctgagtgccatcaacctgggttctggtcctgactctggcactcactagaaatatggctttgagagggggcctgctagatctttctgggaccactgtagatgaaagggaccctcggccagaaaagccgcctgcagaggctctcaagatctgcacacccatgttcacagccacactattcgcaatagctaagaggtggcagcagcccaggtgccctttggtggaggaataagtgtagaaacagggtgtgggctgtctatacaatgcaacactacttagctttacaaaggaaggaattctgacacatgctacgtacagcatggaggaaccttaagggcatactgctagtgacatagtcgcaaaaggacaaatactgtatgattccacttagataggtcgctagagcagtcacattcacatagacagaaaggagaagggtggctgccag

SEQ ID NO: 188172 - DNA, 448 bp, Homo sapiens
agatcccccttcatccaatgaaaagaaacaggcctttggagctgaggtctaggaaattattggtggggggaatgcaactgaaattgctaggagttgagtcaggcagctatgagcaagttcaatggtaggtataaaccatgctttcaaacaaaaaagttgaaataagaaaacaagagcccagatgctaaggacatggggaaattaagaaaacagttgaggtagagaaagaatttaaggagggctgaatgctataatagctgccattatttgactgcttattatgcaccgtggagagttctaaatgctttagctaatttaatcttcatgagacacctaagagataaatcctgctattattattcatattttggataggagattaaggcacagagaggtcgtacaaacaagtgagtgtcaggattcaaagaaggaggttttgctccagagg

SEQ ID NO: 188173 - DNA, 335 bp, Homo sapiens
ccagcctccagccacatggaacttgcagttctagagcggaccacgctctcttgcttccaggactccgcatggcctgtccccatcccatctatcttccaggtcttacacctagattttaccttccctgggaggccttctttaattctccctcaccccagttggggtgtacgtcacactgtcttaacaaccactgagacactgtccccaccacattgggctgtgaacgctgggagggcagagactcttcctcagtcacagggagaggctcaagaagtggttaagaggccgggcgcggtggctcaagcctgtaatcctagcactttgggaggccgaga

SEQ ID NO: 188174 - DNA, 138 bp, Homo sapiens
tcaggcacaatcaagataaatgatagaaatcttagtaaagccctctggagcctgactaaaggaggcagcaaacaactttggcacaaatgtgctaaaagatggattgaggaagatgtgagctcagtcagtgttagacag

SEQ ID NO: 188175 - DNA, 236 bp, Homo sapiens
atacatttaaaaattttagaagcagctggctaacttcaacaaatactcctgttgagcttgatagtgctctgattgctacagattaatgtggggagaggtatcgtgtattttatcaacaccctttgtttaatctttctgagcctgataggcctgttctgaattaatgctgtcgttgagtgataaaaattaagatagtttaccttactgttatgtctcgtgctcttttgaaataatta

SEQ ID NO: 188176 - DNA, 233 bp, Homo sapiens
gggagctgcgggcggggaccagagtgccatgtgctgtcctgtgacatgtgtgggacccaggcctcgctccccgacccccgggatccattctctcaggagctagagcctgggtctcaccacagcaagctgaggagaagagaaagagtcagttagaccagtcagggccgcgtcctgcgcacgtcagaaaggcttttactcttggggcagcctccccgcctccccggccgccctcc

SEQ ID NO: 188177 - DNA, 372 bp, Homo sapiens
atggaagtttatatacacttaagggagctacctgttcccttctcttgaaggatattaaactgtggtatttgctagagaatttgaattagcaggtgtatgtagattctgagccttttttgtgctcagctcaaagccttgaccatgctgaatacataacaaagtactgattgataatgtttaacccctaggggcaggctttcttttcgccctgagcaaaaaagatgcaatctttgtggatgggtgtttggggaattcctgcaatataccttagatgcagagtttcgggtggagttttgtttttatgtttgtttgttttgttttgttttgactttccattttccactttaactgtgatccattccaggggatttt

SEQ ID NO: 188178 - DNA, 121 bp, Homo sapiens
ttcctcttcctatctaatccttgctttttaagtccaggtgggagaaatctggttgtcctggatgttgaagaagttcactgttgtgatggtgtgtgacttcaacctatcatcaattccatgg

SEQ ID NO: 188179 - DNA, 422 bp, Homo sapiens
tcccggattcaagcaattctcctgcctcagcctcctgagtagctgggattacaggcacccgccaccatacccagctaattttttgtatttttactagagacaaggttttgccatgttggccaggcttgtctccaactcctgacttcaagctgtctgtctcggcctcccaaagtgctgtgattataggcgtgagccaccgcgcctggccagagttttttttttaagtagactctatttttaagaccagttttagattaatggcaaatttgagcagaaagtacagagagtttctacatacctcttggccctgcacatgcacagcctccaccacagcatcgtgcactggtgtgggcattgatttttatgagagtgaaaaagaggctaagaatgcaggccgactagggaaagaagaaggaagccca

SEQ ID NO: 188180 - DNA, 241 bp, Homo sapiens
ctggcagtataggcagcagggcaggctggggcatgctgatacccgcctctgtctgggaagtcgaaggaacagaacctgttcaggctggcggctcatttggatgaacagggagtgtgtgaccttgggcgttgagtcctctccactccctgggcctcagtctccccaacatcaaagaagaaggcaaatcacctttttttttttttttgagatagggtctcgctctgtaacccaggctacaatt

SEQ ID NO: 188181 - DNA, 490 bp, Homo sapiens
  misc_feature (69)..(69): n is a, c, g, or t
ggctgactctagaggattccaactacagcagctcaggcatgaaaaataatactactcgccagctcaggntatagatgcaaaaccaaagagtctgccctctagagactattactggaaacaatgttagggcaaaaagataaatgcttcgttttttaagacatgtgttatacattagttaacctctgccaggagagttgggttttttggtattgttttctgtgccgtctgccctctagagactattactggaaaatgtttaccgaagtattttgcactggcgatcattgtgtgagcctgagagggtatctggttgtgttgtgttctcttaccacctccaaaatatttgggattacgggtgtgagccactgcacccaacaaagaaaggtgtttatttgactcaaggttttggcggctgggaagtccaagtgcatggcggcagcttctggcaagggcttttttttatacaggaagtttttagattaagcaatta

SEQ ID NO: 188182 - DNA, 406 bp, Homo sapiens
cctccatggagcctggtatcctttatacaatctttgtgctctaggatctcataagctagttgggaaacagtctgaacttaagaagaaacaaccacaacagtaaggcagttacggtgtgtacaaaaagagtaacacagcaaaggctttgcagaaaaggaactagcaaaaagaggattttatttagtcaagtatgcctgaaggtttgtgttggaaaatactaagtaagaggcaaaatattgggccaattggtctttattctatagtatgctggtccctccagatgctacatgaaaaaacaaggtgtagcaaaataactctgggaaacaatgcattctatcctttgatcctttaggttcacaatgtacattagcttactgaaggatcctagaagcctttcagtcaacag

SEQ ID NO: 188183 - DNA, 449 bp, Homo sapiens
agatttcaacatgagacttggtagggccaaagaaaccaaatccaaaccaaagcagatggagatgactatgtcagagacacctcaatctttgaaggaggatatgtgcttctttgcatgtgtccatgaggtttgtgatgggtgggactgaggagatagtaacttgaactgaaaaactaccagaactttatttttttcctcctgcaaattgacttcattttttccctaattctccatcacatagctggcagaaggtcaccaactcacacctctcaagttttcaactttttcactcaaaaaccaggtcagactgactaactcctaattctaaatttttcagaagaattaatttgacaggcttattttgtttcagatgtcccttttaaattcaattacccgtgtctgagaggagcccaaatctgagagcagagaaggaggtgacaggtacttca

SEQ ID NO: 188184 - DNA, 463 bp, Homo sapiens
aatgaataaagtttgaatctgtaggacttgttcatgcagtgttggcaggggtgagggatgaggtgcagagcccatgggtgaggaagaaaggaagaaaggctgccagatgttgcattcgctaagtaggaaatacagaaaaggcatcaggtttggagagtgtagcagatgcttttgggtcacatgtgccctctgaggtgaggataaattaattgccttttgtatcctccatcacagtggtccccaacctttttggcaccagggacccattttgtggaagaaagtttttctgggggctgatggggggaatggtttcaggatgaaactgctccacctcagatcatcaggtattagttagattctcataaggagcatgcaaactagatctctcgcatttgcagttcacaatagcatttgtgcccctatgagaatctaatgccacagctgatctgacaggaggcggagc

SEQ ID NO: 188185 - DNA, 254 bp, Homo sapiens
ggcttcccagactccagtggcttcagactctcggccagcccaggctctacacagatgacgccttccgtggtagggcttggaccatagctgagcgctcggctgagcactttattttacttgatgctcgtaaccgctaccctctgagataggttttattggcccggttttaggcacctggggttgcaaaaggcccaaggtcacaaatgaataagaggcaagatgaagtgcaaataaatgattccaagacccttgtt

SEQ ID NO: 188186 - DNA, 657 bp, Homo sapiens
agggtaaaagggagggagggggatgggcaactggatggaagaatggatgctcagcttacagactatctggaggatggatggatggatggatggatggatggacaaaccgatgggagaacaggtagatggacagaagaacagatagatattcaaatgcacgaaccatatgagcaacagtgatatttggtaaagtacacaaaagaccaagacaggtgctacttctagagaagtagacagaaggatcaagagtgtgagttctggaggcatgtaggctcctgctcaaatcatggatctctgcttactagctagagaagtctctttacctgagctgcagcttcctcactggtaaagtggccataatagtagctactgcatagggttgttgagaaaattaaatgtacatgcaaagcccagagcttattaagtattcaaaaaatggaagccattattatcttttaaattgcaagtgctcaatatttgttggatgggtgaatggatgagtggatggatggatggatggatggatggatggatggatggatggatatacagacagatgaggcacctgtgatattgcattctacatcatttaagtctctctgagcttcacacaggttttctgatcaacaaaatgagaatcttaaggacaataatact

SEQ ID NO: 188187 - DNA, 344 bp, Homo sapiens
tagatatatatagtattatgatgacactaggtggaaataaaaaaaagttttctatttttgaagaagcactgttctttttctgtcctttctttcccctatgattcatatctctggctttacaatgctagctaaaagataaacagtatgccacttgctcaggttccttaagtgttcatctcctccaggtctgccatgcctttaaggaaatgagagagaaagaaaggaatatatcacttcccttattagatatatgacagcattaaagccagtgatgggatagagtttgaaatctcataagattatctaaaactgagcagaactcccatacagaggtactagaggtg

SEQ ID NO: 188188 - DNA, 350 bp, Homo sapiens
acactgtcttcttcccatttatgaaatctcggctctgtccgggtggtttctctggacttttgttattacagattaaaaatgaggtttagaaaggtgaaaattgatccagaaagtactgattgagaatctttgggggtatccaggattaggctggacaccaggatagtttttagttttgatttttagaattccgctaacaacaaaaatccatcatgtatacttttgtccatctgcagaaaaaggtaagacagaaaggtgcccaaagctcatgctaagccgatgggacttcttcaattgcctggatgctttcagaatcaaagtttgtatttaagaaatggtgctggtctgta

SEQ ID NO: 188189 - DNA, 168 bp, Homo sapiens
acataatatcacctttgtggggttcttgctgaaaatacagaatctaattttgaagaaatgggcttatatatccagaaggtgggttgttttgcgagacagttatccacactcttcaaaagattcaatattacaaagaatggagagaggcagcagaactgctttaggctg

SEQ ID NO: 188190 - DNA, 724 bp, Homo sapiens
agctacttgggaggctgaggcaggagaatcgcttgaaccctggaggtggaggttgcagtgagccaagatcatgccattgcattccagcctgggcaacagagtgagattcctctcaaaaaaaaaaaaaaaaaaagaaagaaagaaagaaagagaaaaaaaaagtgtactgctgaaaaactaactttaaagtttgaaatgctattattcagtaccaggtattatgttcaaaccaatgtgggggcttccgtataaggggctacacatcattgggcagatttgattagctgtgacaattgtttagagtccttaaagaaggctttaagcacagtctaggagtgtactatgtgatacggtttggatatttgtcgccacccaaatcttatgttgaattataatccccagtgctagaggtgggcctggtgggaggtgaattgatcatgggggcgatttcttatggcttaacaccacatactcttgctgttgtcattgtgataatgagttcttgtgagatctggtcatttataagtgtgtggcacctcaaccttctctctcttcctcctgctccctctttgccttccaccatgagtaaaagctccctgaggcctccccagaagcagatgctgccatgcttcctgtagtctgtggaactgtgagccaattaaacctcttttctttataaattactcaatctcaggtatttctttacagcaacacaagaatggca

SEQ ID NO: 188191 - DNA, 318 bp, Homo sapiens
agagctgggatgtattaatccaagtgatggaaatgaagatgggactgactcctatattaaacaaaatgatctctcatttaggcagccaggaaaaacaatctcctcatgaagattgattcacattttgttttgtttttagggtacctgtcaaatgaaaaatctgattcgtgtcaagatgtcccaaaaaaggccatagcaattttcaaattggccctagtgaaattgtgtccgttagggacaagtacatacgctaacattataatgagaaaacatgaaggaaacaggtgtttgtcctggaagaaatgcagttttagatag

SEQ ID NO: 188192 - DNA, 462 bp, Homo sapiens
cagttatatccaggtgattgatggtgttattgagttcaactatatctttactgattttttgcctgctgaatctgcccatttctgatagagaggtattcaagtctccagctatgatagtggattcatttctttcttttctgtctttttttttttttttttttggcctcgattatttggatgctctgttgtaaggtcaaccgggccaggttagacctataccccaggtagtaagttttttaatcccatttagaattacaagagcacaatctccacatttatctatggatcctccgtaagttaaaacccttgaggggtacagcatcactcggatccggtgcccaagggcctaagcagaaagatggctccgaatttgggcacaaacaatgtgccatgtgtcccagggccccgagttattttcccccagattactcgggggggaccctcataagtcgaccgtgcagg

SEQ ID NO: 188193 - DNA, 423 bp, Homo sapiens
gctcaagtgatcctcctgcctcagcctcccgagtagctgggagtacaggcttgtgccaccaaggccagctggataagagcttttaattgaaccaagttacaagacattaacaatagaaactgacacctaccataagggtatactagattccttgaataaacaagggaccatactacaggattaacaagagagacagtggcttctgggctggatacaggctttctggattacctgcatataatgattgggcataaggtgattaatttggcacaaatttatgtgccagtacaagagattctatgtgaaaagttatttatccatcgccacctgtgattaatcatttaattcagtgaaacaaatattatttgttatattcaaggcaatgtggtaaatgggatacaaaggttatagattggcaaaatc

SEQ ID NO: 188194 - DNA, 230 bp, Homo sapiens
gggaaggataggaggaggtatacattgatccaagggcattctcctacgtaagcacaatacagttatcacactcagaaaatttaacattaatgcagcattaccatctagtatgcagttcacattcaaatatcccagtgtcttgaaatttgctgagagtagatcttaattgtcttcacactccccatctcacactctccctctcatggtaactgtgtggtgaaggattggtt

SEQ ID NO: 188195 - DNA, 523 bp, Homo sapiens
aggaatctcaagacattggcttgtccaaagtcacatagtaggtgatagggccaatactcagatcacatctgagcttgtctcacgaggctaagttcatctaccccttctgaagacatcctgcatgcttagggactatattagactagactttgattcacaaatattagaagactggtcctgctgctggaggcctcagatgggataggattatgtagctaaaagcttctacaagggctgtggggagtggtgaaatatcaccttatctttagtatttcaacttgagaataagggcaatattgcctggcactccaataccagcacctggctctgacactttcactactatgtatgttgtgggcaagcaacctaagaatgggaagtggggaggacagaaataaaacaacgttactgggcaatagctattactccattacaaaagatgatttgggttttcaggatggtcgcttgctgaagtttaaacgaaaaaagaaaaatgaggctggactcagctcactgatgactg

SEQ ID NO: 188196 - DNA, 206 bp, Homo sapiens
accccagcaaatccccattcgggcttgatacacattcagaacatttctttcagagctctggtggggccagagtgctaccaccaatttttatgaacttaaattttcaggtcctagatctaatggtatctagcagttcctttcttagaccttcagttcttactgaaccctttaatccagggctattgtttacctttccttagatcatt

SEQ ID NO: 188197 - DNA, 302 bp, Homo sapiens
ccaaggggccatattttggagcagcctgtcctgaactccaacagcaaaggtagaacagggcagagtgatagcctggtcaggaagtgaatgaatgggactcacagccacactgattgtctctagtgacaccaagagctcaggtgaggctaaatcagccaggaacccccaggggcccaaagaggatggtcaggagtaggaggaagacatcacaagtcatagaaaagagataggagggccgttttctctgcatatgccagttataacagttgaatttgcactccccagtactcctagagactcta

SEQ ID NO: 188198 - DNA, 365 bp, Homo sapiens
aaagagatcctgcaagatcgcaaaaagttagaagtaaacagttctatgcatttcactgtgaccagcaattctgaaaaatccatctgataatttaaatttattgttggaactgactcctcctatctagctgtaattttgtaccctttaacaaatctctccccatcaccccttctccctacccttcctgacctctggtatcctctgttctagttcttacttctatgagatccagttttgggttttttttttttaaggtagttctagtgttctatagcaggggtccccaacccctgggctgcagaccagtgctggtccatggcctattaggaactgggccgcacagcaggaggtgagtagcggcgagt

SEQ ID NO: 188199 - DNA, 501 bp, Homo sapiens
tgccgattgagtatattgtcagtttcatgaaagcaaagaatgtccagttctattgtaccagtcagtctagtggcaggagacagatttgaaagatattgaatgaagggacttttcatagtgctgtgggaaactaaggaattatcaggaatgttgaaatttccacaaactagcaacataggaaagcaatagcatcaataggtctgaacaagcatgtgtagaagtggcttctaagggtgttaggagagaattaactgtgaaattgaattaggcaaactgtaaaggagaattaactgtaaaattgaattaggcaaaatttaccttatcctcacagataaaatacatcgcacattttttctttttaatgttttagttcacagacttcttgatgcaaagacacagaggaccctatttgccaaaacataaataaacacatacttgcctctctactttcagatgtatgatcattaatatctcacacaacaaactttcttcagttatctc

SEQ ID NO: 188200 - DNA, 429 bp, Homo sapiens
tagaatcgccacgacaaggagcaacaggaattatcttgttagagacaggggaggtgggtggggttagtgccccagtgccgggcattaatacagccaaggaagggtgtcacagacaggccgagtaggagggacagggagagcctggcagccttcttaccaagaggaaaagaggaaagacctgtttatctgggccttggaggcagggatggttaactgcaaagcaggaaaaggcggctcggggctggaacgttactccctctgctcatgatccagggagaagttttgggcccccttctctctgctgctgatggccgataacttgataactcggctggctggggccaagaagatcccaagacctcgatctgccaggagtggccagacacgtgaaaaagcagctccttctgcgtggcccaaacccattttgca

SEQ ID NO: 188201 - DNA, 812 bp, Homo sapiens
ggctagagtgcagtggctcgatctcggctcactgcaacctccacctcctgggttcaagtgattctcctgcctcggcttccggagtagctggaattacaggtgcgcaccaccatgcccggctaattttttttttatttatttttagtagagatggggtttcaccatgttggtcaggctggtatccaactcctgacctcaagtgatctgcccgcctcggcctcccaaagtgctgagattacaggcgtgagccaccatgcctggcctaggtgggtttttaaccatagggacagtccaataatgtctagtttgactttaagattaagccttttaacttcagtaatgaaggaaggggtgtaaaatagcattaagccggcaagttaggtcatgtaacttggctaatcacattagacttgatgtttaaagagagaaggagagtgtgtagagcaggaattatgaaatttataatcagctttagagtaggctgagatttccttggatgtcaataattatgagtaaacaagaattctgtcatcccacatgtaagtaagcagttacaagactgcttacttatctgtcttggacattgatagaaagcacatgattgggaaggggcagttccttgactgagggaaggaattgtgtctggttcacttttctatcaccaacatagtagatgctcaacaaatacttgttggatagaggtccactcttgtactcaaataaattatatttgaatattactatagttcttatgcacaaactgatgtcaataactcctgtaattgttgtgtatgtgtgtgtgtcagggggag

SEQ ID NO: 188202 - DNA, 197 bp, Homo sapiens
atccccaaatggaataccatatttaagtgtctgttcccttccacgcttcttttcattttgataaaaatacagtatttcgtttctatttgtaaatgttcagtatttattcaacaaacaggagtgttgtatttcaggcactgtgccagtgcttgagttaaaacaaagggcaggctcttaacacctgcctgaaggggctt

SEQ ID NO: 188203 - DNA, 377 bp, Homo sapiens
ctgagacagttccccagtctttctttgtagacaagaattttaaagcagctactataactatgctcaaggattaaagagtaaaatagtctcttaataaatgaataggaaatttcagcaaagaaacagaaaccataaaagaacacaaattctggaccaaaaattacaataaccaaaataagaacattcactggatacaaaataaagatgacaggaagagtcagtaaacttagaatagatactattcaatctgaacaacacagagggaaaaaataagaaaactgaagagtactgtgtattacaacatcaaaggtctaaacctacatgtaataggtataattggaattctataatcagaactaagagagaatggggcagag

SEQ ID NO: 188204 - DNA, 695 bp, Homo sapiens
cacccacaaaaactagaaaggatgaaggagggaaatttcaatcaataaaatacatggcttgaaattctgtgaatcaggagattttccagaaaatgttgtttgaagttggactagagttaatccttccagctgcttttgttacaagataagttgttgaatcatgtaatgtgacaatggctgtgcaaacagcaactaaaattttggataggatgtaaacagccaaccgcaacacggacaaactaccagcacaattgttttagtccttggaatagaccacaaagccagggacccagaactaaacccagaccattaaaacatcccaatgtattgctgggtctgtttcaaagagctggatggctttttcttttagcttagtcatggttatttacttgactgtatttatgaggtgtagaaagaaccattttgctatagcataagcactcgctcgggaattccttaaaaggaaatcaaggataataccaaacttggctgatggattttaaatggtttgttgagtctttaaagcagaagtgatgttcacataagaaacagtatcctagaagagcacagccccattggtaatataagtagccttcattttaacaggagtgagtcaatcattggtaccttaagttggtcagattttctaagtagagcgaaataatttctgcaaagcaggctggagtgtttctgaa

SEQ ID NO: 188205 - DNA, 711 bp, Homo sapiens
gcattccagagagagaaagggtgaggagaatgtgcaaagaattcagggcatgcctggagtgtctgaggaacagtaaggaggcaactgcagccagatcagagtatgtgagagaaagagcagcaggtgatggggtccatcagaagtaatggggaccaggtcatgtacacacagagctgtaggccactgtggttcccagtgagggggtcaagtggagatcagaaatctaagtcagaggagagggaagggagtctggcttgaccaactgatggaaaactggagaagaatcaggagtgtgggcaaaggcaaaagaggagaggatgaaaagctcagaatccagacctgaggaaagcagagacaagaaaatcagtggcaagcactgccctgtcagcggctcatggtgctgccatcaaagtattcatgatccactcttcttccatcattcatccaaccatccaatcatccattcatttatccacccatctctcctttcatccatcccctttccttccctccttttattctcctatccatctatccctccatcctccttagctctctccctccatgcatctctccatccatccatccatccatcatccatccatccatctattcacctatttacctaaacctccattcatctgtccctgatccttcccttcattctttcctccatcccttcctccatcccttcatccatctctttatcca

SEQ ID NO: 188206 - DNA, 414 bp, Homo sapiens
cagtcaaagggtattgactattaggacaggaaaaaatcccactaaagaatacagtaatagtggttattgggaacagccactatctctcaggctctaggagagtacccaaggagggaataactgagtagaacttccccctacccaccctccaccctactaagcctgaaagtaggcgctcattggaaataatatggctgtggtccacttaatgatccagaaatttaaggtgtcacacactgggctgctgaggaaaccatcagctgtgttttcagtaaaacttgctaggaagccattccactgacatgccagtggtactccatagaaagacacatactagggaactggccaaatttactgaagattatgtaacatggccttcttgcacaccactggtcagaaagtcactcactggcc

SEQ ID NO: 188207 - DNA, 684 bp, Homo sapiens
gtaatttgtaaaatattttacctttttttccccctgccctctccagaaatgttacagaaaaagattgagtacatttctgccatgatgcagagaaagaaactggtccattattactcattgtgtaacaccataagaaggttcaaaggagctcataccttctgtatgttgatgccaggaactgtgtataatgaactggccttctatagttaggattggtacataccgctcattcagcaaatgagtattacagtgatattcaacatgtgtccattgactacagcatcagaagcactaagtgctattaaaatgcagattctaggcctcatcctactcctgctgaatccaggtatctcaggagggaattcatgagactgcatttcaaataaataccccatgtgattcttgtgcatgctgaaggttgagaaccactgatttattaagtatcttgtgtgttcattatgctttatcccctctaatcctcttgtctaggactccttaaatttgagatttagtatttccctttaatataaacattaaaattgagattagtgtaaatttgtaaagagactatttagctaatctggaggaaaaagagtaaaaagcactgaatttagcagcaatagaccttccacttggctgctgtagtaggtaaacatttgcaaccacgtgtttggatttaacaaa

SEQ ID NO: 188208 - DNA, 460 bp, Homo sapiens
tgaatatatattccaattagtagccattacaagccggttttttggaaacagtgcgaaggcagtttctaagttgtttaccaagaattgacattaaaattattggtaaattgattgggtattgattggctatatatatttgttttacatattttatgaaaaacgaaataatggttgagacagctagtcagaaacaaaatgtctttaaacaattgcccctgtgcacagatgtggggtaagattgaagtctcatactctcatctttctgggcttgataaattgtgcagaactcaaagagcggagactgctctgagctacttttctcaccgccttgctcaggacacataaaccccttaggtgggcagatcacctaaggtcaggagtttaaaaccagactggcaaagatggtaaaaccctgtctctactaaaaataaaaaaaggccgggcacagtggctcatgcct

SEQ ID NO: 188209 - DNA, 469 bp, Homo sapiens
tggattactcaagttgctgttgcatagagaacatttatcatacttcagtcactctagcccttgccagataggactagtttccaaatccacatgtgaattttgggttggaattttgaattcatctatattttccctccaccttcaaattccatttctgatggaaatgagatgagtaaatctaacaaggctcttgtaacagacatccacatgattgttttcagaaatctagttttcgagcctctttcttccaacagtaccatcattgctcagaatgtcttgggggcctcttgaatctgtactcaggtactgaagagcatctctggtggccaatcatcttttggagcttgtatttgtctttgggtgggagaaatgattaacatgttttttagagacaagattgggaaaaaaggggtgggtaattgtcaagttgaaggatactaaaggtctctattgaggtgactataaagag

SEQ ID NO: 188210 - DNA, 306 bp, Homo sapiens
tccacttaacaaaattgtggtaaaacaggtgaagcagtaaggacgccatcttccatcctctgcatccaggccaaggaagacacactgagttaaaaaatcacgtatggctgagggcagagccatccttaaagaagctgtcctctccagagaaggtagtgagacatttctaagtggggcagcgatcagctcctcttttcaacataaaaacgtaaagaggctcctggaggagcctttctcctctttctttggtaagtgtgaaaaaatcagcagattaggtctttcccttccacaaccctttcatcctcg

SEQ ID NO: 188211 - DNA, 168 bp, Homo sapiens
ggggaggactcatccccctatgcatcatctaccccccgatagctgacacagtactgttcacaaggttacttactggttttttgtttttttttttttgagacagtttcacgctgtggcccaggctggaatgtagggatgtgatcacggctcactgcaacctccacctcc

SEQ ID NO: 188212 - DNA, 275 bp, Homo sapiens
atttctcttaaatcttgttcttcttgggccttacatatgggagccagtgttttgtttcactccaatgaaatatgccattaacacaaacttttttaaaattttaaggtccacgccgggcgcgctggctcacgcctgtaatcccagcactttgagaggccaaggtgagcagatcacaaggtcaggagttcgagaccaacctggccactatggtgaaaccctgtctctactaaaaacacaaaaactagccgggcatggtggcaggcacctgtagtccc

SEQ ID NO: 188213 - DNA, 176 bp, Homo sapiens
tttgtaaaaccaaaatttgggagagaatgcgaggagaaattaaaaagatcactgatattacctaaatgaccctattacttaaaatgaccttttgaagtaagaggaaatgaaacaagttacactgagttcctccactgatgatatggggaggatgacacctttcctgcctgccgtat

SEQ ID NO: 188214 - DNA, 319 bp, Homo sapiens
ctcaccacagacagaggctaatatccccaacatgtaaagttctctacaaatcaataataaaccaatgactttcttgctcccgcctatggactaaagaaatgcataaacaactcacagcaaaagtgatatgtgacccttttttctttgagacggagtcgtgctctgttgcccaggttggaccgagtgcagtggcgtgatctctgttcactgcaaactccacctcccagattcaagctattctcctgcctgatttaattttttgagtaaatgtttgcatgggttaaaaaattgaagccaggaaaagcaccacgtgtacttg

SEQ ID NO: 188215 - DNA, 495 bp, Homo sapiens
cccacctcagcctaccgagcagctgggactacaggcgtgcaccaccatgcctggctactttttataaaaaaattttttgtagagatggggtctcactgtgttgcccaggccgatctcgaactcctgggctcaagacatcttcctgccttggcctcccaaagtgttaggattactgctgtgagccaccacactgggcccaaataccaaattctaaatagaattggaaattgtgttattgaggatttagtgattactcttccctatgtcttgttaagtaattcttctcaagttgtttgcctttttccctctgtttctctcaccagttatacagtggggttttccagaggctctatgacgcgacagcatcatcactctggtggttaatggaatgtgtgtttgtgtatttctgagttctctagagttttgtaagttggtaggtattggtagaattggaaaatttttaacatttaaattttaaaaaattccttttttttc

SEQ ID NO: 188216 - DNA, 275 bp, Homo sapiens
tagaatttgatggcactgtaggaatcttaatccagaccagcgattttcagtccccagactaaaaccaagcccttacctgagggcagtgcgatgagaaacctaagaaaatgaagtgaatgttgtattaaatataaagctaaatttattcagttgatttctgcatcattctgttattttcttttcttgaatttttcaggtttttttttttagtgtcctccacctaccccagaaatcagtcttcctgatctcagcctcccacctcccaccattctgtc

SEQ ID NO: 188217 - DNA, 662 bp, Homo sapiens
ctgccttccagcttcaagcgattctcatgcctcagcctcctgagtagctgggactacaggctcctaccaccacagttggctattttttattgttttgtatttttagtagagatggggtttcactatgttggccaggctggtcttgaactcctgacctcaagtgatccacctgccttggcctcccaaaatgctgggattacaggcgtgagtcactgtgccaggcctttggctactttttgaagtggatattttcagtgggtgagatggtagattataaatagcttaatccagaaattaaaagtcacctaaatgttagcaacacctaatatggaatttatgaatagcccaaagcagcctttgcagccactttaagctaactttaaataaaatgatacctttatgcaacttcttcattatcaaataaaatatttatatttgggaagtaaggcatacaataaaaaataaataaatggagctttcacctttggaaaacaggcacgataatttcctgaggactcgctgaatctgaagttggattctctggagattttggacttgtcaactggctgccttcagtttctcctatgaaaatgaggacagtagtaatgcccagtgagaaaaggagggtcagaaatgaataatataatgtaataaatgtgata

SEQ ID NO: 188218 - DNA, 378 bp, Homo sapiens
tggctttcgattgttcccccttatctcactctgtctttccttgagtccatcatctggtcaacatttactgagctgaagctccctggagcttactcactgagcctagtagagtgcggtcgacattcccatggaggagataaacctgcgctagggactgtggtagctcagaggggcatgtacatcagacggaggcattctgggactgagtttggtacacctggggtctgatctccttatgcagaacatctaccctgcagtctgcatgactgtggtcaagtcacttttctaaacaaaaatctgtagcctacaggctcccagatgctagcctggagactgattcactaggttggggtcccagaacttgtatcctgctcaagt

SEQ ID NO: 188219 - DNA, 461 bp, Homo sapiens
cttaaaggctggtgacccaactcacacagaaggggatgggccatgcatccaagtgaggcatgcaccttccctcgggaagcagaaatcctaagtaggtgacaaccacttgctgagtggccggagcacaccctgatggaagtctcagggtcagattgcaccctgcctccctgcattgcatcaagcagggcagcacacctgcactccagcttctagtgtgtaccaactcagtggaaaacacgtcactgtcggttttgttccaaaaagattttgtttgccattaaaaaaaaaaagttaattaacgtagtagaaaccaaaggactgcctgggggtagggagcaagtcagccatcaccagaggtatttaaataccagctagacaatcacgtcactgtcggtttggtcccaaaaagatttggtttgccattaaaaaaaaacaaggttaatatagtcaggtctaccggg

SEQ ID NO: 188220 - DNA, 425 bp, Homo sapiens
tctttcccctgacgcctggcaaccaccatttgactttctatctcatgattttcactattctaagtacttcatgtaagtggaatcatacggtatttgtccttttgggactggcttatttcctgtaacataatagacatgtaatactttcttaaaagttatgaggtgaatatgaaaccgtatgagtaaactctgactttgttaccttaaaattcattgatggatctaatactttggatggatcttttatccatgtatgattttataacatcctgcactggttatttggaaaatattgattctttgagttatacccatcttctaaatattggtacattttattttacaatatgaaaagaattcattgatattaccactgaactcgtcagaaaagtccctaattattgagaatctgtcaggataaagga

SEQ ID NO: 188221 - DNA, 581 bp, Homo sapiens
cctaggtcagtcagctcctggaaaccccccttctgtttccttctccaccctcactcctcattcagtctctcccaggtccatgtgcaaaactgggaagaaactggaatttctgtagatgtaagggagagggtgcattggtcagagtccagctgcagagagcagaatacattctagccagtttaaaggagaaagggattaaggggtattcagtgacttaccaaattactggggaggttgtttataggaccagctagcaaaggcatactacaaaacagcgacaccaaggcagccacagaatctcccataaacatgatgctactcacaaaatttgaaagctcctgcaaaagctgcgtggtctagaaataccccatccgagccacaatcaggaaggcagtagaaatgggatacacagacaacaacatgaccaggtgatatgccatgataaggaagtccctgctatttggcagcttcagaattttgacatatctgctacaatccacacttgtaaaatagatggctgaggcctgggtactgagactatactaattctgccgtagtggtgtttgcctccagaaataaca

SEQ ID NO: 188222 - DNA, 483 bp, Homo sapiens
atgttggtctaggctggtctcaaactcctgggctcaggcgatccacctgcctcagcctcccaaaatgctgggattacaggcgtgagccaccgcgcccagcctgtttgcatcattttaagggacacgaattatgtctttctggggttaattaagaggagctgccttgtgggactataaaaacgtagacatagaagaagcttctaagcatcagtttaatctcctcattggagaagatgagaaaacatggacagaggggtgaccttggcttgccccaaatcacacagcaaaggggttgaagagctgggatcagacatgtcctgggtctctttcccttaagggtcgtgtaactcagagacctttgtgcttcaacttctaaccaaaaggtgaccgaaaacaggggtctgttgtctcatttgatttcttgttggcctctaataatttccacccgatcttaccacatttggcaatcaagcttgggtacct

SEQ ID NO: 188223 - DNA, 302 bp, Homo sapiens
tcagccttagggcttcagagtgtctgaggtgaccaggggctgaagtgaacccccagcacagcacagctgctctataaaaacgtggccagactttttttttaaagcaagtccctgtgcttgttcctcctgactaggtaagactcctcaacttgcctccagccacatcttataggtgtggtcagattggcaacaggttcgtacctcagtggtacagagctcccagagaaaggggcaggctatcatcttccctggaaaatatgaggcaattagggactggagggacccccagcataccacagcag

SEQ ID NO: 188224 - DNA, 746 bp, Homo sapiens
tagatgagtgaacctcagcgtgactataccttaggatgtatggagagatcactgcattgggaaaggcgattggaaaaggagatgggggctagaactttttaagggttttagatgctatttaataaatcatatgtagttactgacaaattatgaggaaggtggcgattttcaacttgtaatttaggatgaatattttggtagaaagtgcattagagaagatgcagtagcaccatttataggtccattgcaataacccacctgtccatttaagtatatattcattagatatctactgtgtgctaggcccaattttagactatagaggcacaggaatgagcaaaataggaaaacaaagtttcctgactcgtggggctcatgctcttgtggagaagacagagagtgaatagcataaataaatgaactatgtttattttagtgataactgataaagagaaggaataaaacagggaaagggggtatggaggtgagggagaagggttaatttctgtacattttgcaatatatattcaaggtaattaaggaaggcctcttggagaaagaacttgagggaagacctgaaggaaggaggctttaggcagggtctctaaacatctggggtaagcctgggtcaagcagaggagacagatagggccaaggctctgatgctgggtgagcctgggatgctcacaagttgactagtgagttgggcagtgtgggcagaagagggaaaaggagagaaacaaagc

SEQ ID NO: 188225 - DNA, 334 bp, Homo sapiens
tgagttctgccactcagcaattttcctaaataaccacctttgtcacattgctcctacgctaaaaacagtatatcaagttgtaacttctatgttcaatgcccaggttttcctattagaacccatctcacttatctaatctcattttcctcattcttcccaaactctggtgttcctatgtacttttcttgtcatgctgttccccttagcatgctactcttcttacaactgcctgcctacacaagtttatgtctactttggggttttttttttttttggacacagattgaagcggtggaccaaccatgtgtggggttcctctaaattcaaccgtgaa

SEQ ID NO: 188226 - DNA, 352 bp, Homo sapiens
ggagacaaatggtgtaaaggtcattattgggtcaaatgagataattgggacggtagattacacaagtcaatgtatcaaatgctaaatttaccaaaattgaaaattttgctgtgattctgtaagagaatattactattcttgtgaaatatttagcagtatagggtcataatgtatgttccacataaaagaacaaaagacaagactagtaagacatactatgatacagaaagcatgggcttggcttttcttttactgacagtgcacaagcctattttctacgggtaaagcacattttgagttgaattaataaattccgctaagaaaatgcaaacatttaaaatacaattttagt

SEQ ID NO: 188227 - DNA, 294 bp, Homo sapiens
acttctatatgtgtgtgtatacacacacagatagattgaccaatagatagatagataggtttagaaagttctaaattaccacaacccttagaatttcaggcaattttttcttccaaagacataaatattattttttcataacacctgctgacagagggatagctagctggattagagttcacttccttctattgaggtggcatttctgaggatgtgttgcatctctgtgaatgagctcctttaattctcacaacattcctaatcgcatgcctaatcatctaagccaagaaagcc

SEQ ID NO: 188228 - DNA, 316 bp, Homo sapiens
gggtcactttcccagctttttccctaatgctggacatgaggttgtttctcacatgttggtttgtaggggcaaacagagccactgtgtgtgtttcttttctggctccagtcaacttccctgtcgaagaccgattcatctcccagcccaactcttcccgtgctctgcttccgccaacctgggcatttagagggaggctccttcctgccatctctgagcatcgttcggggctagtgggcttgaaggggctgcctgtgtactggggacggggactgatgaccatggcctctgggtgtgtggccatagagtctagcctgcg

SEQ ID NO: 188229 - DNA, 682 bp, Homo sapiens
aataaagatggtaatatatatgttctctatttatctgttaatgtggtaaatatgttaccttaataggtatctttaaatttacctgtcttacattcctggattaaatcttatttggtcatatttttaactattcagctggatttatcaagattttatttggaaaatttgtacctatatttataaataaggttctgtagttttttcctgatgtcttttttcattttttggtatcagagttattctgtccccatttttcctaaatataaagcttgatgttctactctttattgattttacattctctctgagtaatatctggtcttaccacttcaattatatgtctccttataccattttatcacctaatattctgtcagaggaccctatgtaggcagctatggttgatatttcaaatgttttcagaagacacagaagaaggagaaagaagaaatatgtggataaaaccagtgttttctattcataacttatgtaacatatatagctgactatgtttatggtgtctatcataaaaatgtataaagatagtcttttgatatattaagttgtatattctgagaaagtccttttttgtgtatgtgtatatttatgtatatatgtagtctgtatatgttttcaatacccatagcccttttcccactgaactggacggaaccttattgcc

SEQ ID NO: 188230 - DNA, 272 bp, Homo sapiens
atcaggatcttacactgctcactgagctcaccatagcctaatgaaaacaaccgaaaccaaatatttcaagttcagaatatgagaacaaagaagaactagtaaaaattatgtattatgaaatgttctcttctattagaatgaaatattataaccaatggcctttccacaaagtcagtacacataagcaaaaaactttagctgctagctatagatattaaactatacaaactcagtactgtttctgtttagacaatgaattgtgcccatcctgc

SEQ ID NO: 188231 - DNA, 195 bp, Homo sapiens
tctcttacagacagatggaggactgccagacagatgtaggtgtattttggtcacctgcccttagagaggcatttatgatggatttattcgtcctttctttcaacaagtaattgaagatctactactctgtgctgtgtaccattcaaattcaaccagaaataaataaaaccctgcccttcctttcattgcctctca

SEQ ID NO: 188232 - DNA, 367 bp, Homo sapiens
tcacatttctggccactgagaccctttctctgagcttgagacttaaatatcagctgtgtccttgacatcacacctgggccccagctgggtggcccctctgtccctggctcaggttagacccctgggccactctgactcccctcccttcctccctgtggctgcttgagcaccaggttgtattggttcatgtaccttgtacgacccttgccatcagagccctggccccagccaccatcgccccgcctgggtttccttctgcactttccactttgggtatccacccatttcccccagttctttgaccagtgcagccagcagggaattttatttcacgtctaatcagacagcatctctttagtgtctttct

SEQ ID NO: 188233 - DNA, 520 bp, Homo sapiens
agtacaatgaacatttattgctttgctcttcattcccaagctgcttcaccccaatcccatatccatagtaatttttgttatattcaggccttcagctgattgggagggcattacagagggcagatcacgttaaggacggcaaactcctttactcaatcgaccaatttaagtgttaatgtcatctcaaaatgcccttgcaggaagactctgaatgttttaccaaatatctgggcatcccatggcccagtcaagttgacaaaataaaattaaccatcacagactcctttgttgatcttgctcatgtaacttcacccaaattgtttttatccctgtgttctttgacctgggattgagaataacacatccaaccccctgctttgatgttagtgtgcaagatgacatcattttagggaattcattgtatctattagtaagattgttcaatagaaaagtagtacttttttcattatcagcttacaaagatgaaaataaaaaaataaaataaattttatctcaatga

SEQ ID NO: 188234 - DNA, 281 bp, Homo sapiens
aacatggagaaaatcatgctcatagcagatactttaaaaaatacagctcaactgtgtcttctacatgggccaacatcattatcttagcagttctgagaagaggatgaatattggtccagacagcttttattattatttggtgctccctctctggtcaaaatcctacaggttgtagctaggcccaagaatcaagtttcatgcagctttgcagacaaatttgactctgacagccaatcctcaaatcctagtgcataccaagctctggctttcacggtgggctg

SEQ ID NO: 188235 - DNA, 432 bp, Homo sapiens
cattctgtgtcacagggcaaaccaccaaatgatgctggctcataggccatctactttttctgataacactaccttaactccttcgttttctaaaattcaatgaatatttattagaaatcagtaagtattcactgaaaattataaaatcacatgccatatgaaataacatatatctatgcctttaaagatggcaggtcacattggaaagcatggccatttcctcaaatactaatttttaagttatatatttttaaattttgaattgacacataataattatacatatttacagggtacacggtgagttttgatacatacatagtgatcaaatcacaataatgagattattcactacctcaaatatttaccatttgcttgtgttgggaacattcaaaatcttctctcctagctatttgaaaatccgtagtaaat

SEQ ID NO: 188236 - DNA, 111 bp, Homo sapiens
tgtccaactcatggctcttgccccaacccttactccaatgcttgggccacatttgggtctctctaaatacttatggagtatttagagagctattttgagagctacttagag

SEQ ID NO: 188237 - DNA, 2489 bp, Homo sapiens
gtgggcaggcgaggagcgggaagaccatctctgcaagtgcagcatagcctcggcctaggacagcgggagtgcgtggccaaagctgtgagcagaggcacaggtggtggcagacagtagaggcgccccatggggaacatactgacctgtcgtgtgcaccctagcgtcagcctcgagtttgaccagcagcaggggtcggtgtgtccctctgaatctgagatctatgaggcaggagctggggacaggatggcaggagcgcccatggctgctgctgtacagcctgctgaggtgactgttgaagttggtgaggacctccacatgcaccacgttcgtgaccgggagatgcctgaagctttggagtttaacctttctgccaatccagaggcaagcacaatattccagaggaactctcaaacagatgctttggagtttaacccttctgccaatccagaggcaagcacaatattccagaggaactctcaaacagatgttgtagaaataagaagaagcaactgtacaaaccatgtatctactgtgcgtttcagtcaacaatacagcttgtgttcgacaatattccttgatgacagcacagccatccagcattatcttacaatgacaataatatctgtgaccttggagatacctcatcatatcacacaaagagatgcagatagatctttgagcatacctgatgaacagttacactcatttgcagtttccaccgtgcacattatgaagaaaagaaatggaggtgggagtttaaataactattcctcctccattccatcgactcccagcaccagccaggaggaccctcagttcagtgttcctcccactgccaacacacccacccccgtttgcaagcggtccatgcgctggtccaacctgtttacatctgagaaagggagtgacccagacaaagagaggaaagccccggagaatcatgctgacaccatcgggagcggcagagccatccccattaaacagggcatgctcttaaagcgaagtgggaaatggctgaagacatggaaaaagaaatacgtcaccctgtgttccaatggcgtgctcacctattattcaagcttaggtgattatatgaagaatattcataaaaaagagattgaccttcagacatctaccatcaaagtcccaggaaagtggccatccctagccacatcggcctgcacacccatctccagctctaaaagcaatggcctatccaaggacatggacaccgggctgggtgactccatatgcttcagccccagtatctccagcaccaccagccccaagctcaacccgcccccctctcctcatgctaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcgagagcagtaaaagcaagtcccagctgaccagccagagcaaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagtcttggcacccgcctttcccgtgtgcgatctctggagctggatgactggccagttgagctcaggaaggttatgtcatctattggcaatgacctagccaacagcatctgggaagggagcagccaggggcagacaaaaccctcagaaaagtccacgagggaagagaaggaacggtggatccgttccaaatatgaggagaagctctttctggccccactaccctgcactgagctgtccctgggccagcagctgctgcgggccaccgctgatgaggacctgcagacagccatcctgctgctggcacatggctcccgtgaggaggtgaacgagacctgtggggagggagacggctgcacggcgctccatctggcctgccgcaaggggaatgtggtcctggcgcagctcctgatctggtacggggtggacgtcatggcccgagatgcccacgggaacacagcgctgacctacgcccggcaggcctccagccaggagtgcatcaacgtgcttctgcagtacggctgccccgacgagtgcgtgtagtatctgttttatttgactgcagtctccttggtgcaaaaacaaaatgggaaaaataaggataactcagaatttcaaaaggaaatcacaaattcagctaataatagcattttcagtacttttcgtaaactaagtaaatacacaaaatgttgatttttctgaccataagacgtattttatgtccttttgccaaggtggatttgttagtctcaggccctcctggccacattgcccaagtcacacaggcttctgtattatgtatttagataaaatgtgtgaaaatatatttgaaataaagttcataa

SEQ ID NO: 188238 - DNA, 344 bp, Homo sapiens
atcaaagtagagatagtgaaatagcctaaatgcagcagtcgaataaacgagttgataaatttttatcaatgattacatctttttttcttttcttcctctatgcatatagctttggagtttaacccttctgccaatccagaggcaagcacaatattccagaggaactctcaaacagatgttgtagaaataagaagaagcaactgtacaaaccatgtaagtaaacactcaaatagttaagaaattgatagtttgacataaaaggatgtctctcttgatttctttaaattacaatgtggacctggtggtggtagcatggacctctttttgtggattttctaaatctc

SEQ ID NO: 188239 - DNA, 2420 bp, Homo sapiens
gtgggcaggcgaggagcgggaagaccatctctgcaagtgcagcatagcctcggcctaggacagcgggagtgcgtggccaaagctgtgagcagaggcacaggtggtggcagacagtagaggcgccccatggggaacatactgacctgtcgtgtgcaccctagcgtcagcctcgagtttgaccagcagcaggggtcggtgtgtccctctgaatctgagatctatgaggcaggagctggggacaggatggcaggagcgcccatggctgctgctgtacagcctgctgaggtgactgttgaagttggtgaggacctccacatgcaccacgttcgtgaccgggagatgcctgaagctttggagtttaacccttctgccaatccagaggcaagcacaatattccagaggaactctcaaacagatgttgtagaaataagaagaagcaactgtacaaaccatgtatctactgtgcgtttcagtcaacaatacagcttgtgttcgacaatattccttgatgacagcacagccatccagcattatcttacaatgacaataatatctgtgaccttggagatacctcatcatatcacacaaagagatgcagatagatctttgagcatacctgatgaacagttacactcatttgcagtttccaccgtgcacattatgaagaaaagaaatggaggtgggagtttaaataactattcctcctccattccatcgactcccagcaccagccaggaggaccctcagttcagtgttcctcccactgccaacacacccacccccgtttgcaagcggtccatgcgctggtccaacctgtttacatctgagaaagggagtgacccagacaaagagaggaaagccccggagaatcatgctgacaccatcgggagcggcagagccatccccattaaacagggcatgctcttaaagcgaagtgggaaatggctgaagacatggaaaaagaaatacgtcaccctgtgttccaatggcgtgctcacctattattcaagcttaggtgattatatgaagaatattcataaaaaagagattgaccttcagacatctaccatcaaagtcccaggaaagtggccatccctagccacatcggcctgcacacccatctccagctctaaaagcaatggcctatccaaggacatggacaccgggctgggtgactccatatgcttcagccccagtatctccagcaccaccagccccaagctcaacccgcccccctctcctcatgctaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcgagagcagtaaaagcaagtcccagctgaccagccagagcaaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagtcttggcacccgcctttcccgtgtgcgatctctggagctggatgactggccagttgagctcaggaaggttatgtcatctattggcaatgacctagccaacagcatctgggaagggagcagccaggggcagacaaaaccctcagaaaagtccacgagggaagagaaggaacggtggatccgttccaaatatgaggagaagctctttctggccccactaccctgcactgagctgtccctgggccagcagctgctgcgggccaccgctgatgaggacctgcagacagccatcctgctgctggcacatggctcccgtgaggaggtgaacgagacctgtggggagggagacggctgcacggcgctccatctggcctgccgcaaggggaatgtggtcctggcgcagctcctgatctggtacggggtggacgtcatggcccgagatgcccacgggaacacagcgctgacctacgcccggcaggcctccagccaggagtgcatcaacgtgcttctgcagtacggctgccccgacgagtgcgtgtagtatctgttttatttgactgcagtctccttggtgcaaaaacaaaatgggaaaaataaggataactcagaatttcaaaaggaaatcacaaattcagctaataatagcattttcagtacttttcgtaaactaagtaaatacacaaaatgttgatttttctgaccataagacgtattttatgtccttttgccaaggtggatttgttagtctcaggccctcctggccacattgcccaagtcacacaggcttctgtattatgtatttagataaaatgtgtgaaaatatatttgaaataaagttcataa

SEQ ID NO: 188240 - DNA, 405 bp, Homo sapiens
taattccctccattcgtgtttcatccatttcgttttgaatgctttcccttggaggacaattccatagtctaatagatacagatacttgagagcttctttaagacattcagtctatttataaaaaaaaaaaatgctcctccagttgctgtataattgttcttccttgtattatcctaaaggaagtggtggggggcggaatgtatgcaatgggaaatcgagttcaacaacatttctctcttgggtgctacagatttcatctttcataaacttatgctttgctcacagaaaatgattaccaagggaagggaatgaattcactgcttttccagagctgaacgagttctacctataacaggtgctcacagagaataacacagtcccaagtcgaaatagtccctaaatgta

SEQ ID NO: 188241 - DNA, 297 bp, Homo sapiens
atagcgacaccgtaccacgggggagcccgagaaacaacgggaagagggcaaagtgaagcagccacaggaagaggactggacgcccccagacccgggcctcctgagctacattgacaagctgtgttcccagaaagacttcgtcaccaaggtgggctggcctggagtgctggggtctgctggattccaggggctggcactcccaggtccttggaattaagctctgttctttagctactcagcagtgtgtgtatttccatggatttgagtgtctgtgtatgtgattgtgtgtgtctgtgt

SEQ ID NO: 188242 - DNA, 434 bp, Homo sapiens
tagccgggactacaggaatgcaccaccacgcacagctacttttttattttttgtagagatgggggtcttgctgtgttgcccaggctggtctagaactcctggcctcaagcagtcatcccgctttgacctcccaaagtgctggagttacctttgctagccaccatgcttttggctggggtgttttagaagcagaaatcagcatgttactctcctgcttaagacttgcagtagctgcccatcagccttcctataaagtccaagctcctcaccatgacctgaaagggtccagtgtgaactacccacctttggaacatatctagttccttccatgctggcaagattgacttcttttccaggctcatacctaccaagcttgctcctgcctcagggtctttgtacaagttcctctgcctagaacatgctttctcaatttt

SEQ ID NO: 188243 - DNA, 502 bp, Homo sapiens
ctgccaatttgcttggtgtagcagagtctttctgtaggttttttcaaatgaaaacattgcaagaatatcaaagagagcagtgtttgcgttagtgattataaactgcagcatggtgctgacattgataactgaaagtcaactaatgagaatttgagacttctgaagtacacttagttgctagtgtctcccttttggtgtcactggaaagtttagaaagcatggttttgtttttgctcaggtttctctttctgtgatgcagagactctcagctgttcctcctctatgtctacattatgtctgaaggaaagaatataacaaaacttgaaatactgctgtttttctacaatgtttgtaaatatttatcttgctgcttttctaggttaggtctacctggccaggtagatctaacagcaaaatttgaatttgagtggagcaacagaaaacataaaacaatacaccatcctcagaaaacccttaatcacactccatttttgtgcactaa

SEQ ID NO: 188244 - DNA, 310 bp, Homo sapiens
aaaagtaccctggagttagtagactgttttgttgagagttcacttacattacttaaataatggaaatgcttttgaaggattgacaaagatgtaaagaaggcagtaaccatagtttttgtaaaatagctacatgattaagagctcaagagagaacaagaacctcatgatagcaatgtctagtagacaccagaatgaagtttagcacttggaagcttgacggggatccatggcagagtttgtgaatcactgttctactagtctactgctgagtaactttactcagtttgcctcttttctccatatgtgattt

SEQ ID NO: 188245 - DNA, 1026 bp, Homo sapiens
ccaaagatatgatgagaaaagacaggcaggctcatgtttgtgtagtctaatgggagctccttcaaggagcctggaaacacaggcctctccctccgtgcccagtgaggaagaactttacctgccaggatgtgagcgcggagggcagcacacacaactccagcaccagggtttgctcaggataactgtgccaggactgagcctgggcaaggtgccaccgaactgctcccttctctcacagagacatcctgctcctcactgccaccatctcagaacaacccccgttccacctcccaggctcctctggctggctctggccatgttcttgcaggatccacatagacacacacaggggcctggtgaggagctcagtccggcaaatgatcagcctcatgaggtcggctcagatctgatcctgggacgcccaagtgctccaaggccctggtggctccccgagcccatggcaacagcacttacctgggaactccgggccccttctctgcaagacttcagatgtgtccaccacctgtgtaagtcccctctctcaggcccctcagggctgctgcctcctcggcctcccagcctggctcaggggcaaccactcgctggcaggtaaagctgtgccctgagctctccactggcctctgatcagaccaggtggacacccctcgggcctgagccctgggccatggccaatatcatcggatctgacgagtgattctctgagaggaagatggcctgattccacccctcccagctcctctgtgctctgtccacgtaagcctagatttccttgtgtgtaacatggtccacaactaacgtcctctccatgcctgtcttgagagttgtgggctccatatgaggtgacaggaggaacaacacttcccaaacggtgagaaacagcctttgggagctgggtggggttttggcgtcaggtgagacgaggctgactcggatgcccccttccggcatccacacggaagccacctcactgagtctgactcggacacacttactgcctggtaaata

SEQ ID NO: 188246 - DNA, 404 bp, Homo sapiens
ttatgagagctgaaacaagaaagcctatgttggcctcagctgggaatgtgtgcattgggcaattcaaatttttcattgcgctatgcgtgtctgtgaatgaccatacaaatggtgatacaaatactgattttggggttataaataatttttttttttttttttgaaacagaacctcactcttgtgcccaggctggctggagtgcaggggcataatctcggctcaccgtgcagtctcagcctccgtgggttcaggctatctccgtgcctcagcctcctcagtagcggggactacaggcgcccatcaccacgccgggctaatttttccgtgcattttagaaaagagtgggtttcaccatgttaagccaggatgtgtctcgatctccgtgacctcgtgatccgccgtg

SEQ ID NO: 188247 - DNA, 196 bp, Homo sapiens
ttatagatttaacccttaggagggaatctctcctacattttagcatcggagacctagattaaaggctgaggagagaagattaaatgtggccaagagagagaagcttttctttctcattccgtctggtacagccaaaggggtaaggaagacgcgggcttctcttacgatagattgtgaggctgcagtttctatggtg

SEQ ID NO: 188248 - DNA, 494 bp, Homo sapiens
gccggtgctgacataatgacatagctgtggagcccatggaaagagagaacctgcatctgctccagaggcagcctgggaagactctcattctcctgcaaggtcgtcaagcaaaggggaagttaggagcttggtgagaggccagggggctgctatgaaaaggaataagcatttgctaagtaatcccgaagagacaagttgaaaggaacggggcttagtagcctggataacagctattaagtatacagaagggactgggctgggcaagttttgtcctgggtggtgaggacgcaggtatcatgaaacacaggacccacagagatcatggcttcagaggcaaagcactatgtggtttctaagcactctgtgtaggtttctaaagagatttggtctgtcaaactttggaatgtgtgtccaaaggaaattacaagtgaccttttcctacctccctcccccaaatcaaggatgatcagagataattcagtttagtgtgataa

SEQ ID NO: 188249 - DNA, 293 bp, Homo sapiens
caggcttgtgctcaatgtttactttctcagttgaggtcagtgttattgaactgagatagtatctaattttaactgtgcttgaaaggttatactcttcaaattatatttaaatttcttgattgttttcataagacaatgatacttaatatttaatttaattagtttatattttttgaggcagtcttactctgtcacccaggctagagtgcagtagtgtgaccttggctcattgcagcctctgcctcttgggttcaagagattctcccatcagcatagctaggattacaggtgca

SEQ ID NO: 188250 - DNA, 585 bp, Homo sapiens
actttgctttgttttcattacgcatgatttgttgccctggaaatacgagagaatctcagacagagtaagtttccttcctctgcccatctgctgggggaatctacagtgctatgaggccaaccttgaaaactttgtgtgttacagcctgaatttactttacatacagtcatttcaggggcatgtgtgatcactctgtgcttcataagattaatgagtcaggcaggatggtacttggagaattcccgtgtggtgagtgagttcacacagcagtgacttgggatccagtggactctctgtttcaaaatctctactcatagaaacaatttctttagttcatccacacctcttcttgtaacacatacaagtcctaatttcatgacagagttgaggcaccacatctctgtgccaatgtagtaactatttccctaaagtctttcaaatgaatgtatgagtgtcactttatcatgctgactaggattgtagagtatgtcaacctgattctgtaaaattggaaaattatccagcttttgaacacaggatgagtttcttaagacaatgtggaggcatgtgattagaagaattatt

SEQ ID NO: 188251 - DNA, 432 bp, Homo sapiens
  misc_feature (74)..(75): n is a, c, g, or t
acctcctaccccacgggggaatctggaaacatcaaagctggattagaacatctgccaccagctgaacaggccgnngccagactacagctggttcttgaagctgctgctgttcttctgatctccatcatccaagtgaaacagccatggagggattcttttctgaaaggagacttcactttggaaggggcaacatggcctggtgcggtggcttacacctgtaatcccagcactttgggaggccgagacaagcggatcacctgaggtcaggagttgacgaccagcctggccaacatggggaaaccccatctctactgaaaatacaaaaattagctgggcatggtggtgcatgcctgtaatcccagctactcgagaggctgaggcaggagaatcgcttgaacccaggaagcagaggttgcagtgagccaagatctt

SEQ ID NO: 188252 - DNA, 126 bp, Homo sapiens
tataaacaaacaaaaaagatctctgggaataaggctcaagtgccctgtatttcaaacaagtttcccagatgattattaggtatacttaacgcaagagcgtgaccctaaacccagtcttgaaactgt

SEQ ID NO: 188253 - DNA, 382 bp, Homo sapiens
aatttctggatttagcaaattaagtgaaatatataaattacatctgtcattaatgtagcagatcaaacttaaaaagcatacatggtagattggtgcagccattatggaaaatagtatggagggtcctaaagaaattaaaactaggattacctgtaacccaacaacctttcttctgggtgtatacacaaaggaaatgaaatcaccacctctaatagatgcattcctcatgttcactgcagcattattcattatggccaaagtatggaaacaaccttggtatccctcaactatcaaatggattaagaaactatggtgtataataaaaaatggaatattattcagccttaaaaaaaaaagaaggggatcttgtcatttgccacaa

SEQ ID NO: 188254 - DNA, 159 bp, Homo sapiens
cacttctttgtcctgcattgtaattctggggccaggactcttcatttcccccttgctggttggcttcctgctagaatttgcaataggagctgctagaaagagatggaaattcaggaggagcgaagtagagatgtcctctgcactgttaccatcacctgg

SEQ ID NO: 188255 - DNA, 686 bp, Homo sapiens
ctgaagggagaagggcatcgggtcaggttattgaagacctagatatggatttatgcattcatttatgtaacaaacatttattgagaacctagtgtacttcaggtacttctccaggcacttggaatgcagcaatgaacaaaaaagacaaataaataatcctgccttcagccacatatcctggtgaaagaagaaagacaataaacaaactaataaaataataaaatatgttaggaggtgttatgaagaaaagcaaaacaggaaatgaggaaaggaaatgctaagtgagtggtagttaggattcttagtaggaatgtcactggaggtcaagttaacttgaaatcattcaccattgatgtttacttttgattcagccagatgagactccactcaaattgcactatcattcaacatcagtttctctatctaattcacgaggactcaatctgtgtttttcaagcctggctaaatcaagataatgccaacagagtggggtagtgccttagagtacttgaaaggtattatttcacctgatccccaaacctgtgaggaaggtagactagatattgttttcatttcgacaactggtgtcactgaaccacaggggtttaagttaataactcaaacttagtaagtgctaatactctattcagtggtaggatggtagtggtgcttgaggatgtatttcg

SEQ ID NO: 188256 - DNA, 536 bp, Homo sapiens
tatgctgggggaaagcaaggctatgtttctagttcacatcttgatgatagtatactctcaagtatcactttttgaagtataaatgtgccaggtaatttatttctttagtacaagtgtaaatgaaagggaatcataggtgtaatatttcggacttgagtaagacatttggttttgtccttggtgaggcccatgtctacgaacagaaaaattcaaagcattgataacccaactttacagtttatgcaatcttatgttggagtgtagaactaaggtaatagaatagttacatattaatcccaagacaagactatatagtgtcttaaggttttcctggcattcacaaatatttattaaatgtctgctctatgtaaggtagtgtacagttgagatacataaagtataagatgcaatccttcaaagtgctaatttttaacttgaaagctctgatgccggaaacactaaataacactatttggtacaggagccatatagaacatatcaatgtacaagaactgtcactgtacatgatcaatggt

SEQ ID NO: 188257 - DNA, 621 bp, Homo sapiens
gtttttcaacttgaactatttcataaaacatgaaatgttgcacttctgacattcatccaaagtagcaagctgcaatgtgcttttaaaaaattccacagtgtgttcgttttgatggggccaaccagaaaaactagggaaagagaagttcagaaagttagggagtcataagaatgcttggaatttctaacagattttactaaacattttctgtatcatgacatgttccagaaggccataaaagttagtttatacgaatataaactactttttgccttgctgataactgcaaataaataattcagatgaccacccaccaaaacaccaagacatttgggggtttatgtgtttcctacagaatattttccttataaatttcatggtcaaggagcacaagaatgaagtagtacctcattttattccatttttaaattctgcagcacctgtttcaatatttttgtatatcccaataatatcatttacagaataagataatgactaacctccttccttgatttgactttaaaggaagggatagaaggcattcttttatttacattttagtacagcaacacactgatttctccagtcaaaattacttaatctgtcacgttgctttcatgg

SEQ ID NO: 188258 - DNA, 374 bp, Homo sapiens
aaattaaaagtaataaactaataaaataaaagtgagtaaaagaagggggagaagttccaggagggctcctccagctacagcagccaaagcatattcaatccggacaagtttatcagacgggctgaatgtagtcagcgaaaagccgtaccgcgctccgccatctttacccgaagagccaaagcacaagttcagggaggtgtccactgtctctcaaatcaaccaccagactttagaggggcacaagattgttaacgcgcaaaggtggttgaggaattggaaaggttgactggggctgcaccttggaatttattttgtcttggataatatgtaacattaacagagagcagaagctgattaaagtatcttggtgccaa

SEQ ID NO: 188259 - DNA, 350 bp, Homo sapiens
agaacgacgtgcgtaagcgccaaacggccgaaactcaagggctcctccagctacagcagccaaagcatattcaatccggacaagtttatcagacgggctgaatgtagtcagcgaaaagccgtaccgcgctccgccatctttacccgaagagccaaagcacaagttcagggaggtgtccactgtctctcaaatcaaccaccagactttagaggggcacaagattgttaacgcgcaaaggtggttgaggaattggaaaggttgactggggctgcaccttggaatttattttgtcttggataatatgtaacattaacagagagcagaagctgattaaagtatcttggtgccaa

SEQ ID NO: 188260 - DNA, 519 bp, Homo sapiens
tctaagggagcttacattccagtggggaagatgaatattaaaacaaaaccaacctcaaaacacaaaactgtttttgaaaggaagactctaatattcaattagtgcctttctctcttgagaagtagattcttgcatgaattaatttatttcttctcagttttatttgaagatgttatacttttaaagaaagatttgaaaagaaaaagttcacccattattccattggcatcattcccttaatactacagttaatctgtttttcaatgttattttgtggtttccccgcccaggagcttctttgcaactttggttttcttctacttctactcaggttcagggaggtgtccactgtctctcaaatcaaccaccagactttagaggggcacaagattgttaacgcgcaaaggtggttgaggaattggaaaggttgactggggctgcaccttggaatttattttgtcttggataatatgtaacattaacagagagcagaagctgattaaagtatcttggtgccaa

SEQ ID NO: 188261 - DNA, 115 bp, Homo sapiens
cctccttaaaaagaataaatcccctccttcctctcttctcttacaaaatctcacactcttcaagatttctatgcctcaaatcttagggaattaaagtgaagagcgggctgatctt

SEQ ID NO: 188262 - DNA, 281 bp, Homo sapiens
tcaggggacactgtttggctttcacccggtcacaggtgtactaacacacatgactaacacaggatttttgtcttatgcacacagaactgcatgggagaaacaaaaccaccagcgagcagagaggccgaggcttggctctgctgtgagagcgtcaaggtccctgcagccctgagctgctgcagaacccacaggaaccaacttccagagcttgtttctggggtcctggtgcagggaccccacccactgtgctcagatggagcttgaagctctcagacctcagg

SEQ ID NO: 188263 - DNA, 409 bp, Homo sapiens
accaaaaaaacccagcagcactgaccacattgacacccaaattccccgactcccacggcaaccccactggggctgtgatattatccttgtgttttaatttaattttttagttttgtagaggtgggggtcttgctatgttgcccaggcaggtctcgaactcctgggctcaagcgatcctccctcctaggcctcccaaagtgcggggattacaggtgtaacccactgagcctggtcttttttttttttttttttttttgagacagtcacccaggctggagtgcagtggtatgacctcagctcactgcaacctccacctcctgggttcaagcaattctgcctcagcctcccgagtagctgggattacaagtgcacgccgccatgcctggctaacttttgtatttttagtaga

SEQ ID NO: 188264 - DNA, 174 bp, Homo sapiens
agatgtatgcaattacaattattggggttccctcagcattatgtaatgactcatccttcaatcatcacatagcacgaaatttacatcagtgtagttttctgttttcagaacctagaattccacaataagatttttttctcaggtgacagtaatatccaaggtacttcaacagaa

SEQ ID NO: 188265 - DNA, 591 bp, Homo sapiens
aagaaattatcaagtttactagtttgcaaattttagaaagttattggctaacactggtcttgagttatggtctggtgaccccgctctccatgaaaataatattagcttccacttactaaggcaggccctaaaatgcaatgcatcctgaatccttcactcaatcctatgaggcagattttggcaatttccctttttattcacgaagaaatcaagctcagattagttaaaaataaatctccccccaaatcgcatcactgtgtagtggcggaggtgggatgtaagccagttctgattggtttcaaagccccattctctttcccgaaaattctctctgggtttcttctttcatgcgcagtgcatatgtcttcacttaatttgtttccttatcttaagtctgcaataattccactgacttcctcaactctcctcttctctgcctcactcatttatctctgcttgaattcaaacgctgagctctccataaagctaaggagttctaggagtagatgataatatgtctcacctttaccaacaaacttaaatttcctacattgcatttatttttctgtagcaaccaaagctcagggaaga

SEQ ID NO: 188266 - DNA, 449 bp, Homo sapiens
cactagatcaaatctctaaataggaatcatttcccatggaaacctccaggaaggtacccatatgactgagaagggcacaggaagcaaagaaatgcttttaaatgtagccatgcacaaatcatgtgtctcctatacattccgagttgaaaagtaatttccaattttaaaaaaaatacacagaggtatgaattcatacatactcacacgtatatgtacacataaacacacacatatgtatgcatacgcacatatatgagatagaaatttctcctttaagtgccactctgtaggacctaagatatttctggattttgtttgtttatttttgttttacatctgtgagttggtatcaacttacctagcaaagtaaggggagaggcacagaaaaaaggcgcctttgcactttctggaaactagccacctttgactcaccttctgcctccagctcc

SEQ ID NO: 188267 - DNA, 364 bp, Homo sapiens
caagtttcccaaagacactgcgcaggcatcacttcctctaggaaaccctccctgacgaccagtgtcaactaagcgtccgtctccagtagcacagcaccctaggcttacttcaatttcttttgtggaatcaagatccccacagatgttcaacaggactcccatcacaaccgtatctttcctaggattttagatcagtgcatttatttctttcacctgcctaaaatgtctacaaaatattcaaatgcttacatccaaatactcaaatgtctgccgggcacagtggctcatgcctgtaatcctagcactttgggaggccaaggcaggtggttcacctgaggtcaggagttcaacaccagcctgacca

SEQ ID NO: 188268 - DNA, 553 bp, Homo sapiens
caccagctaatttttgtatttttagtagagacgaggttttgccatgttggccaggctggtctcgaactcctgacttcaagtgatccacctacctcagcctcccaaagtgctgggattacaagcgtgagccaccgcacccggccaactgtactttttctatgtttagatacacaaacaccattgcattacagttgcctacagtatttagtacagtaacatgctatacaagtttgtagccttggagaaataggccgtaccatatagcctaggtctgtagtaggctacatcatctaggtttgtgtaagtacactctatgacattcacacaacaaaatcgcctaacgattctcagaacatgcccctgtcattaagcaacgcatgactgtgttgatgcgatagttggacttgatggcttccctcctgccccgatagcccatgacttggtgatttctttctcctgactagatacctccatctgcgtatcttaccagcaacttaaactttgcagctctgaaatgaaactgacctgcttctctacccagctgtgccacctg

SEQ ID NO: 188269 - DNA, 502 bp, Homo sapiens
tcagccggtccttcaaacattcatcgctggttgggagcagaataagtattatgtttcttgttttcaagctctgattgttttcactatgtcacattgtttttcacttaccttaacccattgaccccgatctggcttcacttacagtgagacatagctgcccaaacttggagtgcagcttatgaccatataccaaaataatcaatgttttcaacactttgggtctaagatacagggatactgattaacctcaccaaacagtccaactttgtcattatttaatttctccttttcctgcttagagcttcccaggtgccactgtttaagatcaactggagggagtgtgaagatggggacctgaaatatggcctgtccctcacagaccgagacctcagactctgtgatgctgtttagtgctttgtgcttggaaataggattcttaggggttatgggtttaggtggtagttgcagtgtctggctgtgtggcctttcccctcttctgcca

SEQ ID NO: 188270 - DNA, 423 bp, Homo sapiens
ggccaccagaatgctaatagttgtccaaagtcaaacagctagagagtaatggaagcaggattcccaccctttcatagtgattccagagctcataatctcactgagcttgtgctgtgtggcctcactataaattataaaaacagccaccttaattaatgatggactatgcacctgaggacaggtttcacataatagggtccatgtatttattttgattagcacttatatggaaccttatccaaacactctggagtttccttagcaggacatgtgcagagaagctaaaggaaggctgtttgcttgtcctgttattccctggaattctctgctcctcatgttgttccctagcatctaatttccttgtgactgccttcccacaatcattgaatcaacagccatatttatccctttcatttaaataac

SEQ ID NO: 188271 - DNA, 295 bp, Homo sapiens
acctgcccccgtatgtcaggcatgtatctcatcgggtagactgaggctgacacacacaacagtgtaaatgactaatgacacatggagcactccatctataactatggaagaaatgataacacagtggcttgtaccctgaacatccttttggaaagactaaacaaagagggttattttgtgacttcaccatatacatggcctgaatggatggtaagactgttgaatggaaggttgggtagattagagtgtgctaccaaaggcaaaagggctctggccaggggcccaatactactgt

SEQ ID NO: 188272 - DNA, 382 bp, Homo sapiens
aatatgaacttgtgagagaattgggtttgaggggattttggatagagcaaaagaggattgtttgtttttaattagtatagcagttgtaacctttttcctctctcagattttccccaagaacgctgtcccgtggtgctcgcaccacttttataccctgaaaaacgggacattctaatggacaggatcctgcctgattccggaggggtagctaaaaccatgatggagagctctttggctgatttcatgcaagaagtaggctatggcttttgtgcaaggttggtagtaaaatgtgttaagcttctgattattcttgtgccaaacatgatgtaattctttaaaaaaagtctctaaaattccttaaagttatcatcttttcttctca

SEQ ID NO: 188273 - DNA, 465 bp, Homo sapiens
tgccccaagctggagggagctttcactttgttaaaacattcactttcagaggtgctggagagatagatcgtcaacctcgagtacagctctgaattggtgctggggttttctctttttgttcctgtctttgaatctcaaagtaaaacttttgggagcggctgcatctcttcagcaaactgcgtaactcggtgctccggcttaggaaatgggatctttctcttcgcagagaagtcacccgataaagactttcaggaccagaggtgccttccaaaaagggcacagttgagcccagatggtttgaaattgacgctctggtctctggggggtcctccctgaaagcgtggctttcagaaaacccgcttgtattttctatacgttctccactaaggtccagagtttccctaaccctgtccttggctctacttcttaattctcccacagcctggatcccttcttctctgctgg

SEQ ID NO: 188274 - DNA, 324 bp, Homo sapiens
tgagttcttgggagatctagtcatttaaaagtgtatagcacctggccctctctcgcttgctcctgcttttcactatgtgatgtgccttctccccctttgcctgctgtcatgattgggagcttcctgaaacctccccagaagcagatgccactatacttcctgtacagcctgcagaaccataagccacttaaacctcttttcttataaattacccagtctcaagtatttctttaaaacagtgcaagagcagactaataaaatagcgttttcttggtatgtgcagtaagaatgagttgtcactaagatggggaagactgttacagg

SEQ ID NO: 188275 - DNA, 338 bp, Homo sapiens
attgttaaaagcaggaaagaaaaggaggtgagtaactgggtagtggggaaaatgtatgaccttttatgatctcaattctgagtgtccatgaactttacttttgtactcagggagcagaagaaatcagaattgaatttgtcattggagcactctgtgaaatgcaaatagaaagcaaaaaaggcaatgacagagataaaagcataacaagccacattcactgcaattaaggcagaaggtgtttgcaccactttcctggatgctgagaaaatacattgtgatgaaggaagtgcccctacccctgcactcagcctcatttgacaaagacagagaagagcacg

SEQ ID NO: 188276 - DNA, 296 bp, Homo sapiens
gtgaaactccgtctcagaaaaaataaataaaaataaaaaataagatactttgataaaatagaacaatgagaaccagaacaggctctttgaaattacaagtaagattgttcaatgttatagatacaatgtttagtgagaaacagaatgcttgttgcctggtgctgcaaagaaatagcactcaaaacataaatttaattctctcagcaaggccgtttttactttctgcagaaagggtgctcatcacagatggaacaatggcaagagcacacctgaacaaaggagggaagcaattttta

SEQ ID NO: 188277 - DNA, 336 bp, Homo sapiens
cggctgtgaaaggttgatttcttgttaagtttaagaaatttagtgtgaaaagagccagatttaattgggcatgaggagtaatagcatctccctttgatttagtatcctgtttacgaagttgatctttgagtgttttattggctcgttcaaccaaggcctgttctccagagttatagggaatgcccgttgtgtgagtaattgcccatgtctgaggaaactttttaaaagcagcactagtgtaggcggggccgttatcagtttttagtttctcagaacagcccataaccgagaaacaggaaggcacatgtcgtttaccatgagctgtactttcgcccg

SEQ ID NO: 188278 - DNA, 162 bp, Homo sapiens
tcacaccactgcactccagcctgggtgacagagcaagaccctgtttcaaaaaagaaaaggagaaaaaatgagtagtctaattaagttaatcagtactagaaaatgaagtacttttatactttcaattttgaaacagggtcttgctctgtcacccaggctgga

SEQ ID NO: 188279 - DNA, 351 bp, Homo sapiens
taattcagcactcttcaccaattattcctaatctaggcatcaaagcaggcctgactgcctgcttgaatttcagcccctagaaccctccacatcattgggactgttagcctggacaaaaccaggacttcacataatcatcgaactgggattaggccaagcatatagggaggggcaaagtgacatgtaattgagctcctgaaagatcatgcatgcatgggaaagtcttcagatgtttctagaaataggtcatctgaaatgcatgtgacttggcagtttcgttgacgtaaaagatttcttctaaaaaaaagatctctcctaattaaatttactgatgtggtgtcacagagaaga

SEQ ID NO: 188280 - DNA, 303 bp, Homo sapiens
aatatgttctctgttctcctccagatcctacattgtacttaatcatgttttgttttcaagagagcaaaaggatgccaaattccaagtgagagaacagattgttagttatcaacctaagtacagactgagccactaacccaggtgaataaagagaaaaaaccaggactctcgggaactgatctgtttgtctgctgatcttgtatgctttaaaattactcagtgcatagccagctcttaaggcaaaggacagtcaataatgaaatcttagctagctattaatactggtgtccagaaggttgtata

SEQ ID NO: 188281 - DNA, 449 bp, Homo sapiens
atcggcttcaaatcttccataatcacaatgtaagctgtgtccattaaattctctgaggaatgcaagaggatacaacctaagacaaaaaaattaattgaatcctgatatttcattagtaaacagggtaattgatggataaatgtaatggtctcggtgggtggacagtagttatataagggctgatgcagcaagatacttaattatttaaaggcgtttgaaagaaattgaaacacaagagtgggtgtattcaactaaaataaaatcagagagccctaaaataaatccattttgcgggtaaaaaaatggcattagaggagattctgggtcaatcatccagctgtgaaagttgcatcttggaagcaggatccctgtaatgcaacgatacttgtttatcagtggtggtctttcagtggaaaagattttgaagaatggacccttccttttgtgta

SEQ ID NO: 188282 - DNA, 389 bp, Homo sapiens
caatgtagcatgcacggggtgggataaatatggaggggagatgagccaggcagcactgacattttgatgtggaggctaatgataagctctcaccatgtgctaagcaacttacagacattaacccttaccaccacctcatgaaacaagcaagctggagagcatcagagtgaagaggggccaatcaccatgctctcctgacttctttcagtggcagttttggcagcctgagaatccagggagatgtgtggtggaagactgaggaggcgaggcctagggaggttagtcaggacagagctgagatgactaagtgagatacggatggaaatgaaggggggctgggaggagtggggtgctaagagatggaggttacagagagggtgaaggatgtg

SEQ ID NO: 188283 - DNA, 701 bp, Homo sapiens
ccccgcttgcgcttgttctacagtagttaaaagtataatactttaaaatgaaaaaagctcgctgggcgtggtgcacacgtctgtagaccagcatttctggaggctaagacaggcagatcgctagagcccaggagttcaagaaccatcctggctaacactgtgaaaccctgtctctagtaaaaatacaaaaaattagccgggcgtagtggtgggctcctgtagtcccagccacctggaggctgaggcaggagaatggcatgaacctgggaggcggagcttgctgtgagccgagatcgcgccactgcactccagcctgggcgacagagtgagactccgtctcaaaaaaccaaaaaaaaaacaacaaaaaaattgcttttaaaaatagtgactttatagctcttccccaagcggcctgagatgatctgtgaaaatggttcattagtcacttgacccagaaatccccacaaaatcgtgcaaatccagaggttcaggtcttcttgatcactttaagaacgctcgtgaaactgcccaggccatcaagggtatgcatacgtgagaagtcaccaagtgtctgaaagacgtccctttatagaaacagtgtatgccattccgacttggcaggggtggagctggcaggtgtacctaggccaaacagtggggctggacacagggttggtgacccgaaaagagcgctgaatttt

SEQ ID NO: 188284 - DNA, 260 bp, Homo sapiens
gcatcttgatctgattgctgggggatactcaaacctttagctcaccttgcttctcccctccacctgagctgcagcctggaaaaggaggcacccacaggtctaaacatggccctgctttttttttcctgaaaattccaataacaaaagcaacgagagcctctcactaccaggccttctctcactttgctataaaattagttcacccctctttcttagagtgttgaggtccctgccctccccacctccctccccagaaacaa

SEQ ID NO: 188285 - DNA, 304 bp, Homo sapiens
aacagaaaaaaaaagagaccctcaaataaaaactgtcatatctgaaatgaaaaacttcactagatacactcagtggcaaactggataaagcagaagaaagtgtcaataatttccaaagaaattatccagagaggaaaatcaacaaaacagaaaatagaacacaacagaaaaaataaagacaaaaactgattctttgaaaaaggtcaacgaaatttctaactcttagcaaaaatgatcaagaacaaaagagaatatacaaattaccaataagaacaatgaaagaagggatatcaaaatgatccta

SEQ ID NO: 188286 - DNA, 432 bp, Homo sapiens
aattatgatctctttaaattcaggcaataatgtggaagtcctcatgagtggcaatgtcaggtgttataatattgtggtggaagctatgaaagcattccctatgagtgaaagaattcaagaagtgagttgctgtttgctccataggcttacattaggtaattttttcaatatcctggtattaaacgaagtccatgagtttgtggtgaaagctgtgcagcagtacccagagaatgcagcattgcagatctcagcgctcagctgtttggccctcctcactgagactattttcttaaatcaagatttagaggaaaagaatgagaatcaagagaatgatgatgagggggaagaagataaattgttttggctggaagcctgttacaaagcattaacgtggcatagaaagaacaagcacgtgcaggtaggactctcata

SEQ ID NO: 188287 - DNA, 201 bp, Homo sapiens
cgcaggggtttggggggagtgttggcaataccaagaagcttttttggggcggtttgtccctaacatatagtcagaagataatgttttatttactgctttgttgaagaaacaacttggtcactagtgaagggtaacatgcagtgtgttgtaaaatgttttttgctagtttctgatccttaaattgagcagcatattatactt

SEQ ID NO: 188288 - DNA, 188 bp, Homo sapiens
cctgacatcaagtgatctgcctgcctcagcctcccaaagtgttgagattgcaggtgtgagccactgcacccggcccatattttttaatttttaaaatagctcaaaagtggattgtgtctccactttatagatggatgccagtatttatataaaatttattaccatctacttcctaaaaggataagagg

SEQ ID NO: 188289 - DNA, 272 bp, Homo sapiens
acccgagtagctgggattataggcacatgccaccaagcctggctaatttttgtatttttagtagagacagggtttcaccatgttggccaggatgttctcgatctcctgaactcgcatccacccaccttggcctcccaaagcgctaggattacaggcatgagccaccgcgcctggccgaacagtgcctatcttgatacagctggcattatgctaaatatatcagctgaatttttacttgatcctcacaataaccctgtggttgctacaatttt

SEQ ID NO: 188290 - DNA, 405 bp, Homo sapiens
aaactatgccttaaataacatgaatctgtcgttgtagaacttattcaaattgttcttgagcctgtttctcttctcagacatttcaggtgtctgtcatttaacagtaagctcaagtaggtgccctgatgaaacaactgaaaatgctggaaaaccctgcacataaatgcatttgaaatgtattttagtaaagaatacttggagccccaaaacttaagcgaaagaggaaactcgaaagtgatagagttctgaagccaactttgagggcattggccaaacattcatctttggtgtttatgattcaagggacctgcaaaatggaacacacatctcagagcctaagatggaaagtctaagaagctccctaacccaatcccatgaagcagagagttcaaagggtaacattct

SEQ ID NO: 188291 - DNA, 278 bp, Homo sapiens
ggtttggctgtttgggatggggctgagttgggagccgggattatagcgattatatgagcgggcagtgtcaagtgtggtaaatccatggctcttgaccagcatgcagcagaatcagagtatttcaaaacacggatccctagacccccaaccccagggcttctattccgcatggtctgagcaggcagccggatgctgctggcctcccaactatccttgacaaccaccgatttaaaagaatgctttagaggtgggaggcactcaaaagtcacgaggtgcaa

SEQ ID NO: 188292 - DNA, 147 bp, Homo sapiens
gctactcatggaaagggttttttaataatggaaaaaaataaactgtcttgatgctcaagttcttgagctcaaattagcaaagcaggtggacagatcatatttttttctatagcataactccaggaggattctgagctgtctttgtta

SEQ ID NO: 188293 - DNA, 225 bp, Homo sapiens
ctcacaggcacacacatgctcgctacacacacactcttcatacacacaccctcacagagacatacacactcttcacacacgcgctctcacaaacacaccctcacaggcacacacatgcacttcacacacataccctcacaggcacaccccttcatggacacacgcacgttcagaggcgcacacacacccttgacacatacacaccctttcacacacaccctcaca

SEQ ID NO: 188294 - DNA, 561 bp, Homo sapiens
ttgaaattacctagagaataagtaagctccaagaagaacatacctatggctatcctatttttgaaggcaaaaatggagctacaaaattaaacaaaggatgtatttcatgtttgaatttgtagaaaaagtcttagaaaggtataatgaaaataaataaaattactaaataaaataactatgagatcctaagaattttgccaccatctttgggaataactaatgctgataaagtacaaactaatactttggtgccaattccaactccttgcacggtacaaagggggaaaagtatcttaatgcataagaaattatgagacagcacaaataaaaaccaatcttttatgcagaaagtttcaattaaagtgaaattcatattttaaattacgaaattataaccggaaaagtttgtaatgttttcaaaatggtcttcgctaaaccacctctatctagcctggaggctagagatggaacttaactatccacttaaattatatctatgtatttgtgcaaagttaaaactttaaatctaataaattattcgaatcaattaaaacaaagtca

SEQ ID NO: 188295 - DNA, 302 bp, Homo sapiens
gtaaccttcaggacaggaaatgtctgggagcaactggagaacagaaagtttagtgttcagtgaggtcagggctgggcagccatcctcatgtatgtatcagctgaagcagtgagagtggattctccaagacacagagtgtagatataaaacagcaagcaaatagcattgcttttagaaagtagccttttaatttgattggaaggattgcctgggaaggagcacatgtgaaatgtatggagtgatagaaatgttctataatgttaaagtgtgttacgggcatatgcatatgtcaaatcgcatga

SEQ ID NO: 188296 - DNA, 255 bp, Homo sapiens
ggctccctctggctgggagtcgtcaccagctctgcactggtgtttggttgtgtgagctcctagtgttcccaaaggagtgagcactcatttggagaactgagtcctcccatgatggcactgcttaaaatccaaacccagagtcaagtccagaggtcctcgacctgtgaggcaagtatggtttttacatttttaaaagttcatacaacaaaataaaacaaaacaaacagaccaaaaaaccaaggaagaacatgttaa

SEQ ID NO: 188297 - DNA, 721 bp, Homo sapiens
gcaggctgttgccaaagttaagttcccaggactcatggctgtctctgctccttccctctcaccccacaccccacactcagccagtcccgtggctcaaccaatacagccactgctcaccgccctcaatgccagcctcaggtcacgccacactgtctttcttgtggacaccacaggaatccaccccacacacacacttactcttctctccctccaccctcaccgtcttgttgtccattctccccacatcccccagactcatgccttaaaaatgtggatcaggtcatcccccggctcataacccccacagagcttccatcacatttacgatgaaattcgccctcctcacccctgctcaccgtgggacctcactccctcctccatttcctccttagcgcttctccaatgcccagtgagtcatttccttgttagtgtcttatccctgccggcatctaagccccatgagggttctgctgctttggcgctgtgtcaccagcccccagcacagtactgaccatggaacgactccacagctctctgggctcacattggatgatgacctctttcagcttcatctctattgtctcctttaaccctcagacacccctgtgatgtggttacttttactggccccatgcacaagtgagaaactgagtctggggcgggttacccagctgtgatgaatatctggtaaatgtttacttttagcattcgcgggtctatc

SEQ ID NO: 188298 - DNA, 590 bp, Homo sapiens
aagtgcttaaggatgtgctttagctcgagatctggaactcattacttttaaaaatactgttaaggacaaaattaagtagaagaaattcattctcttttgatgatagtatatggccttttgcatgctttagaaagattatcaagcactgtttatgactttgtgatatttcacaacacattttaggatttacatagggactagtaaatagcttatatcctatcagtattaccaaaggaatcaaagtacattaatttgaagaattaagatgaaagaagaaactttctagccaactgtaatatttttccagtattttttgttacatgtcttttaagcaagtgttatttgtggacattctgcgggaaataaccctattgatttctttagttcacttgctattcaacaataaataaatgaatgagtaaataaactcaggttactgagttcaccttaattaaaaggattatgtagcacaattcccttatttattactggtgtagtctcctggcctcaaaatgagacatctgtttattaccacagcccagtaggttctgttccagtgttgctgcctagatgttcttctcagtctcttt

SEQ ID NO: 188299 - DNA, 365 bp, Homo sapiens
aggatagacatacagatcaatgaaacagaatacagagtacagaaaaaaaccctatatatgtacaggcaaatgactttcaaacaaggatgccaagaccatgcaacagaaagaatagatttttctaaaaatgaagcttggacaactgaacagcctcatgcaaaagaatgaagttgtatcagccggcgcggtggctcacgcctgtaatcccagcaatcaagacagtgtagtactggcgtaaggatagacatacagatcaatgaaacagaatacagagtacagaaaaaaatccctatatatgtacaggcaaatgactttcaaacaaggatgccaagaccatgcaacagatagaatagatttttctaaaa

SEQ ID NO: 188300 - DNA, 464 bp, Homo sapiens
tgggattacaggcatgagccactgtgcccagccagggtccccctttctatagcaacccaacccccctgtatgggggagaaccaactgttttctctgtacacaagctcaacgcagaacacttatgtgaccaaatgtaggggtttttcccacaccaagcagttctctgcagacaccagctgggtgtcctacaatttcaactcagttttgacattgtctacctggagttagcatcagatcccactgttaagggctcagctccagaagactgcccctaacgtcaggtgtcagtagcaagtccaggttatctattggccgtaaattggaggttcctacagccccctccttgagtttgatcacttgctggaacggctcagagaactcaggaaaataacttactagctgactggtttttaatacaaagatacaactcaggaacagccatatggaggaggtgcacagaggaa

SEQ ID NO: 188301 - DNA, 830 bp, Homo sapiens
aggaaggcagaacagagactgtcaaagtaggtaaaaaggaaacctcaatatcagcttttaaaacgatatacacttatgaggtaaagatacaaacagattcaaactgaaaagatggacaaatatacaccatgcaaatctttgttatcaaaaactgcagccagtgtattaatggcagataagacagactacaagaaagacaagcatcaacagggataaagaaggatgttttatgcaataagtccatttgcttagaaaacctaataagcataagcatgtatgcacctaagaaaaataacaaaatacacaaagcaaaagttattgaattaaaaggataaatgcataaatccacaatttgacaattctaattcttatatctcagaaattaatagaaaaaaataactacgacaataaggctacaaggtattaataggagagattataaccagagcactgggagaaaaacagcaatatccaatatgcttacaatattggttgacaactcaaaagttcccaaaataatttttgacactaaaggtaaatagcctggaaaacctaaaagccagcataggaaggaagtggaaaatgaaatgctgattgaaaataaatctggaagtccaggcgcggtggcttatgcctgtaatcccagcactttgggagaccaaggtgggtggatcacctgaggtcgggagttcgagaaattctgtctgtaccaaaaatacaaaattagccaggtgtggcggcacatgcttgtaatcccagctactcggaggctatggcagaagaatcgcgtgaacctgagaggcagaggttgtggtgagccgagatcaccc

SEQ ID NO: 188302 - DNA, 164 bp, Homo sapiens
ccctctctggtttgccctggggtcgctgggtctcagcactcaaggagtctctccttggtgggaagggatttctctctcttctcctcggtctctgactctgtctttgtctctacctctgtgcttcctgcttctgccagcttgaaattctccagcatcagcttccc

SEQ ID NO: 188303 - DNA, 342 bp, Homo sapiens
cccatgaaactatgtgtctaggaactttctacgaacaggaagctactgctgttccctgttcaggttttaagtgtgcaggatgcaagctgtggcacttcccaggactctagacaagttttgctcattctttctgtgagaacaatggtcttgcatgacctggactgctggtttacctctgcagcctcaccaggtatcagcttgtgctttctacttcagcgatgaggaatgtctcccagcatcttgtgtgcttcgtggtcctggcctttggatatatctctgcctggaatgttcctccttcctcccctccccttcacataataaactccttctcctctttcacag

SEQ ID NO: 188304 - DNA, 697 bp, Homo sapiens
gagcaaggggaaagatgatggccggtgttggccggtgttggcagttgaagccatgtctggtttctggcatttctagctggttttactttcttctctgtgctcttctgtttcgtttgggaatctgtaaagcccagacacttctttacgtaaagcagaagccttatttatttgtgtggaggagtgtttagtcgatttgctgctgcccctggtctgagggtgagctctgtgtggggactgtggctttggacacaatcacggcagttcctgttccttctgctccaggacagctgctcaagtcacttatggtttttccaggagcacgagaaagggctgggggtaccgagccggccccgcatcactagctgtgttctgtttagcctgcatgtgtgatatcaaaaaacacattatatataagtacatttaagaatatacatttcaaagtacatcgttttttctttggagatagggtctcactctgttgcccaaatgggatgtggtggcacaatcatagctcactgcagccttaaactcctgggctcaagtgatcctcccgcctcagcctcctgagtaggcgggctgcaggcatgcactaccacacccggctaactttttttttttaaataaaggtggggtcttgctatgttgcctaggctggtgtcaagctcctgggctcaagcgatcttccaccgtgccctcc

SEQ ID NO: 188305 - DNA, 660 bp, Homo sapiens
cacaaatatgcctggggtcgggggagttactgctttttaaaagtagagacatcacttaagaccttattgataaagtaactttaaggaagtgaaggattaagctgtgtggatatctgaaaagacacatttcaagcagagggaaaagtgaatgccaaggccctgaggcaggaaggtacctaaaatatttgagaaactacaaaaaagttagcataactgggaacagagagctaataggggacagatcacaaaatcccttgtgaagactctggcttttattctaagtatgagggaaagccattgaaggtttatgagcagagaattacaagatctaatttatattttaaaaggatcatttgctttctatattgagaatagaagcaggaaaggctattgcagttaacagcataattcaataatccaaaaaagagattatgttggcttagttcaaggtgagagtggtgaaggtggtaaaaagagttgctttcaggagttgaaagcatacatacagaatacctaaagccctgtgtactgatgaggtcactaaggaagtcatgaaatcaatcatataaacttttcaattgtaaaatgttagcagaccaaagacaagtctaccaagaaaatcttggtattacacagaatggggagtcagaaggcatcaga

SEQ ID NO: 188306 - DNA, 533 bp, Homo sapiens
acatacataagcagtatctcttttttgtagcagagttttattatttcaaccaggttcatgtattttattatgtacctactaggaaggtatttaatacaatttgctaagaagtatggcaagctgggggtgaagaatcaaacaagtctggatttgaatccaaccttcactgtatacatgtggaactttgaacaaattacttaatctgactctcagattgcatttcttgaaaagaaagttattgtgacttttagaaaaactgtattaaagtgcttaataacaatttgcacttaagagatattcaagtaatgatagctattaatttctaagttgtcattattaggattgggggagttcctgactgtaattttcacaatttagaaggggaaataaatttacctaggttattgtgataaacaaatgactatgaaagtacggaggaggtaaagatgaaatctttaaacaagaaataagggaagattttctgtaaatttcacttaggctttgagggatgatttttaaaatttccaaggaaa

SEQ ID NO: 188307 - DNA, 579 bp, Homo sapiens
tcacctggcctggttggcgaagatgcttttcagatttttattgagccgtggccttgctgtagttgcggtcattccaaatggagactgatctgctcggcatatgtgagaactgttctctctgtgttcctgggtgagcaattcaagctttctgtgggaccagaaaccttaattattgaactacctttgctggttatctcatcactaaaattgttaatcgtttatctacactgtgggtgtttttcatgatttggcacacagcatagcaggcagcattgccaagatgtttttcatgttgcagaaaaactgtaacagatggaggtggtgattgtgaagcacttatttaaagtgttagtaatgaatcactatagcttgaaactgagtcagttatccatactaagggaagttgaagaacattctaatagcttctaataaaatacgtaatcaggcacctgaagagaactgactttgagtggctctcccattactgttaccctagccagggcccttagaatttattcttaggggctaaagtcttttaaaagcatgcatgcatgtgtgttttctcttttctaggaactt

SEQ ID NO: 188308 - DNA, 508 bp, Homo sapiens
tttatctgctgaccttccctccactattgttctatgaccctgccaaatccccctctgtgagaaacacccaagaatgatcaataaaaaaaagaggagggaatgctatcagcaaaacacaccagggtggaaaagcacaatgcatgttcagaaaatgccaagaaccttagtttgactagagactagcatgttaagagtgaagtatataaaaaggtcaaaaaggaggtttgagccagtttaaaagttgtagggaatatggggagttactaaaggtatctgaatagagaaatcacaagaatgaaagcaatgtttcaggaagaggcacctgacggtatgaatgacaggctggagagagggacactaattagtaggcctgagatgaaatgcagtaggaatgagaaactggtggtaggtgagatggaggaaataaaaatgataaaatgccgcaaaagatgagggataaggcctaaggacaagaagagaatctccagtttctattctgggtaacgaa

SEQ ID NO: 188309 - DNA, 130 bp, Homo sapiens
cacaggagggacagggggcacaggacggctctcacagcaaggacagggctcacacaggacggatggaggggtctagcaggtgtgtgtatgagggctgtgacagtcccacaacacaaactcactccacttg

SEQ ID NO: 188310 - DNA, 281 bp, Homo sapiens
ttaatggactcagtgtagctgtgagttgtattatctcaggagtataatcataaagataagttgaaaacagcattccaggagattgccaacactctattataaagtaaataaatacagatggggcactacactgaaaatgtggcatgaagttgccatccacggcagaggtcaacatttggacctgataaatgaagccaagtcatagataagaaaaaaatatctaggaccaaaagaacaaatatttaagagtggagccctcagaaaaagaaagaatcatccat

SEQ ID NO: 188311 - DNA, 340 bp, Homo sapiens
agggggacaccattgacatttcaatgaaaactgggagaagtgagattgatagaggatattgagaagagaagggggacctggtcaaacacgcctatctgaaaaggcaggcaaggggtggggtagagaaagcgaatgatggccacccgaaataaatcacccaccatccaggacttccccagagccctgtttccttaggggcaggaacattttaccacacactgagttccccacctgtgagggaaagggggactagagaatctgggaaggtcagcaatactgagacagggcacaatgaactggaaggaacacagactgaaaatcacaacatctggttctgatt

SEQ ID NO: 188312 - DNA, 382 bp, Homo sapiens
acagtaaaacctcatctcttaaaaaaaaagaaagaaatccatggtgctttcttatccttattttccctctgtggcattttttttttctaacccactcatttaatgttgccatactgtaaatgtaccattataaggtaccttaacccagttttttaacagaatccttacgttcataaaataacatttgaaatgttttcatatgaaccagttatacatagtgctattgtagatgattgtatatgaatatcttattgaatctcaaataattgtgaagtatgcatttcttttctataaatataccgctataagactgaataatagaatttaattttgacacattaaagtggaaaacaattatttaaccaaggcgctatataagatc

SEQ ID NO: 188313 - DNA, 327 bp, Homo sapiens
agctctttttaattggtgttttatgctttcacagtgatgtttaagtttggatttcttgtttatgctgcttagaattaattgggcttcattgacctgaaggctgatgtctttaacaattctgggagattctcaggcattattattgttgttactattattttttttgagatggagtcttgctctgttgccaggctgaagtgcagttgcgcagtcttgactcactgcaacctccgtctcacgggttcaagcaatttccttgcctcagcctctcgagtagatgggaccacaggtgtgcaccaccacacattattatttaagaaacattta

SEQ ID NO: 188314 - DNA, 1241 bp, Homo sapiens
tttattgatttttctcattataggtcatattttctggcctctttgcatgtctggtagttttttattggttgccagactttgtgaattttacctttttgggtgctggatatgtttggatttgcataaatattcttgagctttattctgggttacaggcaagttagttggaaacagtttggtcttctcaagctcttgtgaagctttgttagatggatccagagcggcctttagtctgtggctaattttgcactacaagtgagtaatacctttctgagtactctaatccaaagccccgtgaagatttccactctgtctggtggaaacaaactattcttacgccataagagctgtgagaattgttccatccgctgcttttagatggttgtttttccatcctcaggagtcccctcacatacatgcactgatcattgcttttgcctccctgaactcccagttcttttttttgtgtgtgtgtgtctttgtttttttctttttccgtggagaacggggatcttgctgtattgcccaggcaggtcttgaactcctgggctcaagctatcctcctgcctctgcctccctaagagctgggattacaggcatgagccaccgtgcctggctgaactccccagttctttatcctcaagtcagggagactgctaggctctgtctgcatttctcctttgccctgtggtctggaaattctccgatctataagttgaggcagttgtaggtctcaccttctttgtttcccctttctaagtaatcacagtccttactacctgaacacagtcatatagccaatgtccgaaaacccttgtttcatatattttgtccagtgttttagttatttcaggcaggaaggtaaatttggtctctttaactcactttggctagaacagcatattttgttttttttgtttcctggtttttttttttttttttttggagacaagagtcttgctctgttgcccaggctggagtgcagtggtgtgatctcagctcactgcaacctctgcctcccaggttcaagtcatcctcccacctcaacctcccgagcagctgggaccacaggcacgtgccaccacgcctggctaaattttgtatttttggtagagatggggtttcgccatgttggccaggctggtctcaaactcctggcctcaagtgatctgccctccttggcctcgcaaagtgctgggagtataggcatgagccaccactcctggccaggacagcatatt

SEQ ID NO: 188315 - DNA, 431 bp, Homo sapiens
tccacctgcgtccccctcccaaagtgttgggattacaggcatgagccactgtgcccggctttactctttattttgaaaagataactatagtaggcttttttgacttctaaggatggaaatggggaaatcatttggaacagtctttatgatagttaaagggagtaacgctaaggacatggtttagggcagtggaaatgaattagagggggcacattttagagagatttggtgaagcagctacttgggatgcataagggagagaagggaggcaaggataactaagtttttagttttaaagtacttgtcacatgtcttagagacttttagtaataggcagttggaaatgtgagttaggagattaggattgagtgagatgaatatagtgatttttgaaatgtttgaaataaggctttaaatctcaactctgacac

SEQ ID NO: 188316 - DNA, 444 bp, Homo sapiens
aaaagagatcctccctcccaagtagctgggactgcagatgtgtgccaccatgttcagctaacttttatgttttgtagagataaggcctcactattttgctattttgccgaggctggtcttgaactcctgggctccagtgatcctcctgccccagcctcccgatgtgctgggattataggagtgagccacctctcttgacctgagttaacttttgtgtatggtgtcaggtagagtccaactcccttctttgcccatgactatgcagttcaatggtcttccatgttgttcatgatggaaaaagcactgtgacacctggggctggcggcttggctctgggggccccagcagagccaggctgtctccctgggaaatgcctcggccaagatattctcctggaagtctgacagggagagggtggtgtcttggtctccctggtgcatcatt

SEQ ID NO: 188317 - DNA, 762 bp, Homo sapiens
accaccgcgaatgaagtttgcattttcctctgttcttgagcccagcttcttctcgtctcccaccccagcttcccggcattggaagaagggaccgtcctcttccttgtcttggccacccaaatcctggtatcgaaagggttgaacggaccggaagtgtgcagcagcgacgggtccccagctaatcgacgccggaagtagcaattactagacaagcattccgccgccggcttcgctatggcggcaattcccccagattcctggcagccacccaacgtttacttggagaccagcatgggaatcattgtgctggagctgtactggaagcatgctccaaagacctgtaagaactttgctgagttggctcgtcgaggttactacaatggcacaaaattccacagaattatcaaagacttcatgatccaaggaggtgacccaacagggacaggtcgaggtggtgcatctatctatggcaaacagtttgaagatgaacttcatccagacttgaaattcacgggggctggaaattctcgcaatggccaatggcggggcagataaccaatggcagccagttcttgtgacctcgccccaaccagggttgaggcaacacaccattttggcgaggtgtgtcaggccttggaaggtgatcgcgggatggtagaacaactccaggaccgcctgggacgacggaagatattaagctaacctcggtaaactgcaaccctgagaggcttgagaggccaggaacatctagaggacaaggcg

SEQ ID NO: 188318 - DNA, 567 bp, Homo sapiens
aggcaatatgaagtaccccacctggacaattgtgttaattatatatgcccaatattagagcacttacgctgcagtgaggtgggtgtctctcaccataccctagacttggaggtccctgataggtgttctgaaagaagatccctgtaaggttatagggaagtaaagccgcatcccaacatggtgcacagacagcagcctcctagcaacatctcttaaagcagatggtgttttcagacatattgaggaatgaggtgggttgggagcagttgcaacaagatagggaaaccttaagtcatctttgaggatactagtttgttgtgctattttttttcttcctaaatgatttggaagtgatttttctgtgcctgatgtagtcttttttttttttccctttctttgtatcctgtgttgggaaatggaaataattcaaaatctgtaaaaacactgggaaaatggaaattaaactttgggattctttactgcagaaaaatgatgatgggaaatgttcttcagtagagaggtagaaatcatttcagaccgcttctcctagccggggcccacaacatg

SEQ ID NO: 188319 - DNA, 399 bp, Homo sapiens
tggggacttgttatgatcgagggctgctaggcagagatgttggctgcttcctgggccctggcaagtcactttctctttctgagatgcctttaccccgtctagaaaatgagggacttggagtcatggattattaagggcccttgtgggattcagaaacactagatgtaaaatattcagccaatttgagcagtatggtctaggttgctctgggagggatcagaagccatcttaaagccagggtaaatggtgtgtttatgattagctcaggagcttcccagaaccctcagaggcggggctgtggaatcagcagggggactggccctcagaactgcagtctgaacatctagttctggaaggagcttgccttttacatatgaactgtgcactcacacaaggcac

SEQ ID NO: 188320 - DNA, 546 bp, Homo sapiens
gttcttttctttgaggccatgttaatggcagtcccttgatttggtctttgtactaggctgtttttaatgatcacattttatttgatgagaaacaattttattttctagttctgcatatcctaggttatgtatttcatttcagttccatttccatacccattgccttaattttgagcttgtctgtttcttacatttctcattttgacagaataagctgactgttattaagtacaatagataaggtacctaagagcctcgaaacatcaccaaataccatgaatgcattaggtatattttttgtcttccatgttactggaagcattaattatagcaactttttatctccaaatactgacaattaaaagaccctagtgaaaactttaaccaaacacttactgaccctacattgaaggccaccagccaaaaatcaccacccatacataagagccaaacatcactagacacttggtgaaatccttcaaatataaaaggggaaaaggaggggagaaaatccaaaggaaatagacaaacggagaataatggcaa

SEQ ID NO: 188321 - DNA, 769 bp, Homo sapiens
aaaaaattaataagacccccaattgtattgtgaaactacttattaactttttttccaagggaaaaaacagtttatctgagaacacagttggcactttaattatatgctttaaacacttccctacagatgccaggcagctatttattttctggatttttttccctaagtctctggttgtttgcacagatgagttttatttaaacatatgatgaaagtcagtaacactcaaagtttattttaagaatatttcctttacagcctctccttcatgtacacaagggggtctctatgtggttgggagggtggcaaaggttaccaaaattacctggggtcgctttttcaagctgtccatatccttcgctcttctctagatttagaagcacttaaataaatgtaaaacaccctacctcacctttaattcctgagactgaaaactataagtcagaattagttgggcagttacataacaatcatgaagaaacagaatagcaatcatagaatactagtagatttagaaggggtattagaggcaatcttgctcaactgttattttacagctaagactgcagaggcacagagagcttaaataactcaaatttggcaggactttaaccagaactgctgtctcctgactccacatttcattcttttccataagaccacacttgttgctctcttagttcatattagatagtgcaaataacaccaatatggaaactccagcgagccaagatggatatactttcgtgggtagaacgaaaaggagatt

SEQ ID NO: 188322 - DNA, 604 bp, Homo sapiens
gtttcatcaccgatgctgtgttccaatactgcctctgatcttgggaaacttgagcgcgcgggaatctgagggttgcttctagatcctcccggtccccctccggctgcccagagctggcgccccttctcctcgcgtcctgtcctgtcccgtgtggacgggacgtggcgagtgtcgctgagtccacactggtgtacagagcacttcggggccagcacgtggccacatgtccttagctgttgggctttgaaagtgtcccttgggtgtcaggcgagtggagggccggagagacgctgcggcgctgcttagcgggtcctcccagagagtgtgtccccttcccttggcctttctgcatcttctgagacgggtctgtgtccccctccccgccacctcctccctcttcctctccactgactgaaggtcatggccatgtccctgtcagggaccccgcctgtgtctcgggcacacagtgtctgtgcgggtccctgcttggccctcccacgtctaccctcggcccgcccgctccagccgctgcctcgttcgcctctcagtcccctcaggtcttctccatcctgcgctcctctcgctgtgtgccttgccttcctgg

SEQ ID NO: 188323 - DNA, 254 bp, Homo sapiens
aggcttcagatttaaggacagcttcactaactataaatctcagtaaaataattctaaagtcaaaacaaaggaagatattttcatatctaggtatctagtaactatattgattatcaagacttcttttcatagaattgactttgaattttcattaatacaactagaatatgtcatttcagttaaagaacagccaaacttgctttaagattgcctgatatggttagtcagatcaaaaggagacaccctgccgggtg

SEQ ID NO: 188324 - DNA, 615 bp, Homo sapiens
gtaaacacttcatggaaccttaactccctgttcctgaaatttagagacaggggcttcatttttagacagaaagtataaagatcagcagtactcctgtatccagtggttctcaagttctagtttacatatcattagcaaaatcacaaagcggtcttttcattcaagatacaaatagagtgatcagtatatcataatcaaaagtgacaagatagtgatttaaaaaacacctggcatttattgacaaaagaaaaggtaggattaagtctgctcaaacagtaaaggattagcattagtatttttttaaaaagaagaaacaacagtgcaggtctctatgctaaagtaataaggactgaagaagttttaagtttggaaaaaatggggatatgtattggtgaaacactttgtaatcatatagaatgattattttatcagcagctgttaagttgactttgaggaaattttgaattgaaatactttaggtgacaagtaaaggcaactgtgaaaagcaacatttgattttaggggacagggtacctgtgaaagaagactggttaggagtggaagtcaggcgtaaaggcactgaaatgtccgaggcagggacaatattcagtttct

SEQ ID NO: 188325 - DNA, 369 bp, Homo sapiens
tgcattcattcctcaatatatttactgcgtgaatatggatcagcagggatggtgtgagactgccacactcaagctgggcgtttgtgcaatccacatcaacacttccaatactctcaagcaaggccaataaatcataaagctcatgtgctcatgtgctactgaattcagcacttcaccatcggcaaaatcaatggagatgcttccagaattttcagttttacagcttcttgaacaaatcttttcccctagtccctctctttgtctgtctggctaaggttgaggcatggacactgggtttgcctcctctccatccaccttctccatccccttttgagaaatgaccacgtggttgaggtcgatcttgtagtc

SEQ ID NO: 188326 - DNA, 245 bp, Homo sapiens
tactgggattataggcatgagccactgcacctggccattgtttttacaatttgtattattttttattgttgttattgttactttttagtggatttttttcacatgttttctatccttggtgggttgaatctgcagatgtggaacctgaggatatggagggccaactgtatatatttttatcatctgctccttctaatagatgtaagctccatgaaggcaggaatctctgttttgttcattgatat

SEQ ID NO: 188327 - DNA, 202 bp, Homo sapiens
ggactgggacttgaggcaggataaaaccgagggtatacagatccagtcttctaccttccctaagtaaagaggctagaaatccattcaaatggattccttccagggatctggaccttcctgagatgcctaaaatccaggcattgttgattaatagctgtccataagaaacactgagagcagctttgaagagttcacccagggg

SEQ ID NO: 188328 - DNA, 251 bp, Homo sapiens
cctataaaacttccctccagctcctgcctcttagtagacagccccttctctgctgtgctgccagtatcgtatcttcgtgctttttctaatacgtacttcctctaaatacatctacgtactttctctaaatctgcctgtctttacctacaactgtcttggtaaatcctttactgcccatgacactggccccaaccagtggcacctgcaacattttggtggcccatctggggagtgcttggggactgcttggg

SEQ ID NO: 188329 - DNA, 520 bp, Homo sapiens
ccatcattctcagcaaactatcacatgggcagaaaaccaaacaccgtatgttctcattcacaggtgggaactgaacaatgagaacacttggacacagggcaggacacatcacacaccggggcctatcagggggcgggaggctggtggagggatggcattaggataaatacctaatgtaaatgatgagttgataggtgcagcaaaccaacatggcacatgtatacctatgtaacaaacctgcacaggtacacatgtgcacatgtaccctacaacttaaataataaaaaagaaaaagaaaatggcctccagctccacccaagttgctgcaaaatagattattttttttctttttatggctgagtagtattccatggtgtatatgccacattttctttacccacgcattggctgatgggcaatttggttggtttcatatctctccaattgtgaattgtgtgggagtgcaaatatctttacaaggtggtgatttcatctcctttgcacatataaccataagggg

SEQ ID NO: 188330 - DNA, 130 bp, Homo sapiens
cacagcatggtcgttggattcagttcaggaagattagttaatattgcagagttgtaaggaaatcaatgagggtaggtaatattattgtgtaggtaatgcagtatcacagagtttatatttttccctccct

SEQ ID NO: 188331 - DNA, 152 bp, Homo sapiens
gggatggctgggcggtgtcagaagcttcctgaggtttgtgggtgtctgctgcctgaggcacttgtcaaggagcagtcaccgcaggcaccacgagatcggctccgttgcagggacactgagcccagcatctacccatgagagacccctcactc

SEQ ID NO: 188332 - DNA, 307 bp, Homo sapiens
tgcccttcctttcatccttcaggacctcaggtcctaccctgatctttcttacctgagcttaagctcttccacctgccccaatcttctgtgccaggaaagatactttaacatacctggacctcattcttgacttctccgtgactcccatgccccacattcagccaatcaccaattattgcttcctgtcatcatcacctgatggtgatgtggaattcatcagcttcctcacgctgacccccacactccatcctctggttcttcactgcggcctccaaagcagccaggattgtcacaaaagtgttcatag

SEQ ID NO: 188333 - DNA, 627 bp, Homo sapiens
acgttgacacttcagatattaaatcttattgtctgctgataactgtctttggcagtttccagttattttcatttaatatttgtttttttttcttttactgtttctaagaagcctgcagtatgaattattttgcctgctttgcagatgaggaaacaagactcagcaaggctgagtcagttcccagtggtcgtgtagtaaattgcagagcttggtttgaaactgaagcttaacttcaaatcctttgtttctactgtagcatgctcgcagtgtgtgcccagaactggattaagtgcttttgatgtggcacttgagataaaccttgaaggaatggcagatcaaggaagagtggattttaagaagggtatttgtgtgagccaagatgcagagacaggagtgtgcttgaagagatgattgagatgctgagacaggagtgtgcttgaggaaatgatcttgactgaagtggagggagctttgtgaaggggaaatgaatgatagaggaaaggcagcacagttaaggattagattccaccatatggatttgggatattctttccctccctagttttgcctgtaggaataaaggtaatttgcacttttagtatactgaaataattaggattatgtaag

SEQ ID NO: 188334 - DNA, 357 bp, Homo sapiens
gacacacacagatacacagatacacagacacatacacatacatacacaggtacacatacagacacacacagacttacacacagacacacacagatacacagatacagacagacacacacacacagacacacacacacaggtacacacacagacacacacacagacacacacacagacacagacatacacacacacagatgcacacacggacacacacacaggtacacacacagacacatacacagacacaaacagacacacacagatacagacacacacaaacatacagatgcacacgcacacatagacacaaacagatgcacatatggacacacacacacacagacacagacagac

SEQ ID NO: 188335 - DNA, 163 bp, Homo sapiens
taaggcatcagcagggctgtgctccttccaagaggctctaggggagaacccttttctcacttctccagcctccagaggcacccccatgccttggctcctgccgccttccagatccccttcctctgacctcctctgtgcctccctcttccacatttaaggaccc

SEQ ID NO: 188336 - DNA, 378 bp, Homo sapiens
attgtatagaaatgctctgatttatgtgaattgatttgtatctgaaactttacagaagtcctttgtctgtgccaggagccttttggcagagtctttagggttttgtatgtatggattcacatcagcaaagagatatagtttgactatggctttcgtttttctatttggatgcctttttttttcttgcctgattgtcctggctaggactttcaatactgtgttgaataagactgaatgggctgcttggctgcattatgaaggagttactgtatctccctggattagcaataacagacctgggggtgcatgcagaccaacggcaaacctcaaagagtaaatatgctttaatttcttcagggagaaagtgaagtcctacca

SEQ ID NO: 188337 - DNA, 482 bp, Homo sapiens
aaacagaaagataaaaatctttgcagtgtgaatttggctaaaatttgttaatttacttgttcatacttcattctttcaatgggttttttattgttttgtgttggagataaaactcagaaatttactgaatatcagagtccttcttacctttctatcatccttcatcatccctttttgttttcaagatttgcatccaaagacagtagctaaaattctgaaataagctgataacaagagtggtatttgttcataaacttcacagctttccttttggaggaaatatatcatattcctccattaacccaggtttatatgtacccactagatttttgataatcacgtctaacttgctcgttcctatctctacttatttagctattttaatttttcccatctatcttttgtttcttccctgcctctgtttagattaattaagccttcctgccatggtttggactccattttatttccactattggtgt

SEQ ID NO: 188338 - DNA, 417 bp, Homo sapiens
aataaatattttttggaagcaagctaaaactaacctaaaccaacccaaaggaaaacataagccattccattcccttcctttgctccaaagttacacagcagcacttcttcaccatctaaaacaaacttgtccaacctgcagccaaggacggctttgaatgcagcccaacacaaatttgtacattttcttaaaacattatgagatttctgctgggcactgggctcacacctctaatcccagcacctcgggaggctgaggcggggggatcccttgagctcaggagttcaagactaggctggccaacatgctgaaacctcgtctctacaaaaaatacaaaaattagctgggtattgtggtgcacgcctgtagtcccagctacttgggtaactgaggcaggaggatcgcttgaacctggga

SEQ ID NO: 188339 - DNA, 292 bp, Homo sapiens
aataaatattttttggaagcaagctaaaactaacctaaaccaacccaaaggaaaacataagccattccattcccttcctttgctccaaagttacacagcagcacttcttcaccatctaaaacaaacttgtccaacctgcagccaaggacggctttgaatgcagcccaacacaaatttgtacattttcttaaaacattatgagatttctgctgggcactgggctcacactcctggcctcaagtgatcctcttggcctggcccattctttatggatcatgcaggtgggctacgt

SEQ ID NO: 188340 - DNA, 175 bp, Homo sapiens
cacactagattgtacaacttaatatagagctaaaaactcaacaggatgccattttagaagcatggacttcttcctgtatataatgccatattttcctggtattattctctatagtttgtagctgccttagctttttaaaatctttgtataatttctaactcctcatctgctctac

SEQ ID NO: 188341 - DNA, 162 bp, Homo sapiens
tacttcagtttctttagtagcattgtagatgtgctgccctttgttgtagcatgaaaaagaagactttttaattaataaaattctttgtccttcattctagatgagattgtacaacgtacattgaccctttccagcctgggagacagagcgagactctgtctc

SEQ ID NO: 188342 - DNA, 137 bp, Homo sapiens
ttgctctctcccagaaaaggactgtagcccttttctgctgtttttagaaccttctgctaccatatccaccacttccaccaccagatccataaccaccaccatagggactgcccgagcttcttccaccaaaactgccc

SEQ ID NO: 188343 - DNA, 452 bp, Homo sapiens
aaaagaaaaaaaaaacccttttggtttacttttcaaataaaacaagtttcccccaccttttttcctcatatatgtgatatgcctggagcttagtttaaactaagtgtaacttaacctgcctcttcctttgccaccatgtgttccacagtttttcctagttatgtggtgattgggtgggtctgtctgaccttggtttcactacactgttctgtaccgttaccaaagttccaggatcttgccccaccgtaaaggatttcctgttttcagtgtctcccccaccctgattcccaaagtagcttcttaatcttgtggctgtccttcggtctcaactgagatgtctcttggctaatatcctcttcttctgtattgttactgatgaggagaagctgactcttgacttcttggcaaagtgacttatactccatcacagtcctgttgtgtaaactgatttc

SEQ ID NO: 188344 - DNA, 289 bp, Homo sapiens
tgctctgttcatgcctgctgttcagatggagctctgccccgtattccagtaaatgctcgaaggcatgattgttaatctcttactgatgtcatgcttctgcgctttctattgaagactctcaaggcccttgtgacctggccgctgccgcactctagtatcccacatgcaggtgctcaacgagttgtgcttctccagcagtgtttggcccttaaggtgtcagtccacatccttggcttggccaattcctacctgccctttatatgtggctaattcttactgatccttccat

SEQ ID NO: 188345 - DNA, 428 bp, Homo sapiens
  misc_feature (70)..(70): n is a, c, g, or t
ttagaattggctcggaccctacttatattctaaaaacagatttctgacgaaataacgtacccattttaantcaaaatgtactttcaagcacagagccctaaaacaacttactattttcctcactctgagaaaaattacatctttactctcctaaactctaataacttttcagataatctgttgaaaaagagaccaccctctcaaaaatcaaagcaaagctgtgaattttaagccaactacaactacggatggaaggaggctgatgccctacacagccatttagggaattattttatatccctaactcacctaaggattgctgagaatggaaaaaaaaaaagttctttgagttctagttttatgaacttccaaaaagctgtcttcactttagtattctggtacttttatcaagttatatctgaaaagtt

SEQ ID NO: 188346 - DNA, 392 bp, Homo sapiens
tgaggggagcaggagctagaaggattttaggggaaagtgactgagagaggggcgccttgaagtaaaccaggattaagactgcaaactgtggtacagagcgagttaatgaagactgaagaaggttcaggatgggggcccagggaacctccgagcagggcctacaggtcatagtacagatacaggcagaattaagtttcagatttgggcccgcccctccaaagggcagtgcacctgaggagggcggggcacccaccagcagttgggcaagtttggcagcaataaaatcagctccacctctggttctgcagaggacaccaggctgaggcactgtgacattccccaccacacatcaggcaaggaagggtgcccgagggcttccactgacccccgca

SEQ ID NO: 188347 - DNA, 540 bp, Homo sapiens
cactgggattatagacatgaaccacctcatctggtttcaatcaacttttttgttcttacccataaatataaatggacagcacaggacaaccagacatttgagaaaaaccactagcaagagcaaccaaaattaaacatcaacaaacaagcaatataacaaaactcagaggaaataaatcactgatcgctaccaggaacagaagagattaaatgataaatcatggaataaggacaggatgctctaaaaaaggaatatttaaagctcttgaagattaaaaagtttaatagtcatacataaatgttatgaaaatttataacataaagcttaatgccattttccccagaaagtaaacaaacaaattaaagagacagaaattaggaggtaaaatataaggacatttgagaatcagtcaaaaagatacaacacctgaataatgggagcacgtcaaagcctactgagtgccaggctccttagtttacaaagaaaggctggcccagtacggtggctcacgcctataatcccagcacagtgggaggccaa

SEQ ID NO: 188348 - DNA, 627 bp, Homo sapiens
ggagggggcgctgggtgccccagcactgccagccacccgtgccacgctcaaattctcgccgggcctcagccgcctcccggcagcacagggctgaggacctgcagccagccatgcctgagcccccgccccgcggtgggctcccgcgcactgcccgagcatcccctacaggtgccaccccctgctctgcagagcccggtcctatcaaccacccaagggctgaggagtgcggtggcacagcgcgggactggcgggtagctccacccgcggacctggtgctggatccactaggtgaacccagctgggctcctcagtctggtggagacttggagaacttttatatctagctggaagattgtatatttaccagtcagcacagctgtgtctagctcagggattgtaaatgcaccaataagcactctgtgtctagctcaaggtttataaatgcaccaatcagcaccctgtgtctagctcaaggtttgtaaacacaccaatcagtgctctgtgtctagctaatctagtggggacttggagaacttttgtgtctagctaaaggattgtaaacgcaccagtcagcactctgtgtctagctcagggattgtaaatacaccaatcagcaccctgcgtcta

SEQ ID NO: 188349 - DNA, 400 bp, Homo sapiens
gaaaaatacttgttggcagatttactagacaaaaacaaccatgttaaagataaacaaagaactaaaggaagatgtagagaaacttaaaaaaaaattcataagcaaaatgaaaatattcataaagagatgcaaaatccagaaaaaaatttttgaagttgaaatgcacaatagaaatgaaaaatccactgagggaatcaaaggcagatttgaggatgcagaagaaagaatcagtgaacctgaagagaggacaatgaaaatgatcaagtctgagaaacaggaagaagactgtagaaaagtgagcagagccaggggacctatgggacaccatcaagctaagcaacacatacattgtgagagttccaaaaggagacaagaaaactcaaagagacccccattgata

SEQ ID NO: 188350 - DNA, 372 bp, Homo sapiens
aagaatgggatgcatgcagttcaagaaggtgttttcaagctaggtagaagtttttgattcaatatgttaataggaggcacatagcttgtcttcaccattaagggttcatagtcaaaatagtggtaatgcaaaactaatagaaattatgatagttttacaagcagtgagcaatatgcagtgtggttagaaagggagactatgaagaggtgtaggatttagcttgcagtcatggcagtgactgaggcagtaggtgagatttaagttggactttcttggcaattctatattacgtattgtaatgaattactcagaacatggtggtaaagctccgtagttacttgagagcagaattaattctcaatagtctggata

SEQ ID NO: 188351 - DNA, 735 bp, Homo sapiens
ttaggttgatacatttaagcatgacaaagggatattttgaaatatggaatatgaaatacagtcacattccacataaaaaatagtacatccatgtaaacttgtgtgctgcttcctacacaagaatatcttgtttctgcgtattttcctttcccatatgctttccttttgctttatggcaaaactagaaatattgatagacttgattttgccagtctatggacttcctatagaaggaatgagtaccccaaatcacttcctccacaaaacctttcactagcactattcttcctcttccctgtagccttgtgtgcttggctctgggcatgatgggtttgtactcatttgcttctttgtaggtcttctatcgcctttctccttatgagcctgtttcatattttaaaagataagggagggggagcacattttccatttttagctgtctactgtgactaagagtctgtggctggtaactaatttgtctggtaactgtctcttgacagttagatgcattttggtttaaatgccagtcttgcagagcttgagagaatgcatgctgctgtattcccaggtctaatttggtttcccagtcctaagccacacaaccccccagcgcctggccattgtggtgtcatactcatggtaggtactgagtacttgtgggattcacttgagtttaaaatataaaaaactgtagctgttattttggaaaacagaaataataactgtgtaatatat

SEQ ID NO: 188352 - DNA, 361 bp, Homo sapiens
gcaggattatttttagctgtcaatttttttaattaagaaaaaactagttcttaagtcttcttaattaaaaaatggtataatagggctcatcctagaaaacaatctactcagggtgttagatgttaaactgtccaagataatttactacaaagtatctaggaaacagagattttcctcaaataatcaattatccacaaccatggctttaatattagtccatgttccagtaacagatggaaaaggatcttctattcaacttttttgaaaccttgtcttataatcataaggcgaacagcctttaaaagaaaacgcttaagctacaaatggcctagataatacatgtggccttagattcccagtc

SEQ ID NO: 188353 - DNA, 295 bp, Homo sapiens
cggccaggcagatgcagtaagacttcagagagcccaggtctttagggcggaactgattgcttagtaaaccaccttcagccttgttttggggaaggctttctaaactgcatcaacttctctctgtgccttggaaatgagaagaagaatatgtccttgagtgggggggcattaattgagctctttttctgatcattaggacctttagccctagggtcacccggggcacggtcacccgtcccctagtgcctcagtgctcatacacacgtggtagaggacaggctgggcctctgccaac

SEQ ID NO: 188354 - DNA, 512 bp, Homo sapiens
agcctggtaatttgtcctagagcttttcattttggtgaattacataatggtatactcactagcttttatcttcatgtgatagaaacaactgtaaattttgcctaattctctcttcctagggtcatgttgtggcaggcttatggagttagactgctgaattaggtgaggtcagggaaggacaatgccattgaccacaaaattgagttgtggttgatgtattcacctgtaaattcacaagggtcacagggatcataacaaaaaaaatgccatggttttgttcagaaggctattctcaaattcatcaggatcctcttttcctttactattcatgaaaagatgactttaagatttcttgcttatatgcctattaggatgatggataaatatttattcattgataaggtgaatacaggagaaaatgaattttgatgaggtagggaagtatctctccaacttgccaagaaaagaagttaaacaatttctatcttatacattctttttgattctatgta

SEQ ID NO: 188355 - DNA, 186 bp, Homo sapiens
tctattgcattagaaggagagaacagatattgggaaataaccagcggtctccaccacagggaaaagataggacgcagggaacgccggggggacaggtgaaacagacaagtgatattaaccaggagttccctcccacctgagttaaactacgcatagtgttgaagttaatgttttcattttctccca

SEQ ID NO: 188356 - DNA, 650 bp, Homo sapiens
accctcaaaatattttctggatatattcacttatcgtcatctccatccctatcacctacagtccaaggtgccataatctccaaactgcaatgactttgtaactagtctcccaacttctactcttacctcccccttggactgattattcacatagtagcccatggagaactttgcaaaatgtgaataagaaagcactgtttccctactttaaactcttcaatggctagccattattcttgaataaaattcaagaataaaataaataaaattcttgaataaaattattgaataaaattcaaactccttgccatgatctaccaggtcctaaaggagctagcccataccaactgctccagcttcatctcatactattctccccttgctcactgatttggcacactgactctctctctccattcctgtaatgtgccaaactcccacagggcctctgcacatgcagctcattctgcctggaacactcttccactgagtcttcataaaagccactcattttttagatgtcacctcaaatgttatctcctcataggggtctccgttgaccatcctatttaacaaagtcttcattcagactctcacatccaagttactctatatcacatcattttgttcttctttttttccttcataac

SEQ ID NO: 188357 - DNA, 827 bp, Homo sapiens
gaagaatagagtgtactccagagctatttgaacaatcctattctagaaacagtgactagatgcttctagaagatccttccagctgaaaaatcaaaggctctccaaatctctcagttcctcactggcatttccaccgccattttctactctcacacttagaaaatctgctagagggaagaggaggtagaataaccccatgtccccaccacacacatcccttctgagcgaggaagacaaggaagagaaaggcagccgaatcaggactgcccctggagccctgaagaggatactctcaggaactccccacatgtggcccataaggagctgacatttgccatattgtgcccacataagggccctgcacagaagtgggcaaggaccagggagcctgagtgactcgaatcgtctcctgcctgcaccttgtgcattgccacacctcccctccaccctaggacctcagcagacacacccatgtgccagcaagcttctccatccctgtgggcttctctggctgccacgggcacatggcatgcatgatgaggccttgtctaaccacacccaagagcgaggacatgggcaaggaggatcgtttcctccctaactcctccccatcctcttcctgtctgaccgaccatgttcatcaacatttgtttatatagcccctgccctaccaggggtgagtgtgggaccacagagccgagggaagcccagcctttgcccttgaggatgtgtctctgtgggtgaagaagagagagaatgccccagtccctagtcctgggggccacgtggcctacacagttcatacgcctcatgcctctgctccacag

SEQ ID NO: 188358 - DNA, 577 bp, Homo sapiens
gacggggtttcaccgtgttggccaggatggtctcgatctcttgacctcgtgatccacctgcctcggcctcccaaagtgctgggattacaagcgtgagccactgcgcctggcgacaaagtattttatttgttttttgtttttttttttggtttttcatttgagacagagtcttgctctgtcacccaggctagagtgcagaggcgccatctcggatcaatgcaacctccacctccggggttcatgcaattctcagtagctgagattaaagacgtgcaccaccatgcccagctaattttttatatttttagtatttttattttttaatttttttattttttgagacacagtctcgctcttgttgcccaggatggagtgcaatggcgtgatctcggcacactgcaacctctgcctcctcctgggttcaagtgattctcctgcctcagcctcctgagtagctgcgactacaggcatgtgccaccatgcccggctgattttatatttttagtagagacgaggtttctccatgttggtcaggctggtctcaaactccgacctcaggtgattctcccaccttggc

SEQ ID NO: 188359 - DNA, 259 bp, Homo sapiens
ggcatgagaatcaagggagcggcagtattttatttttataagacagtataagaaataatgctcaggaagtgacaatggggaacaacatggtcctaatactgcttcctaacaccgagttatgtgagacaaatgaaacctgaacaacttgagagggcttaagtctatgacaatagcagaactaatgctgtgggttcctaacttccaaaccaaagctccatccaatatcaggtatactatagcttttttcttcaaattgatt

SEQ ID NO: 188360 - DNA, 394 bp, Homo sapiens
accaagctctacgcctagcaagcttgggtgagttggctccctttggtgcagaaatttgagttcaggaaatgtaaccatttccatagtacttttgcagttttgttttcttctacaccccttacaaagttccccctttggggaggtttcaatactgctgaggctgaactgtagggaagcaaaagtctcccagaggaaggttcgtgagagattgaaccctacaggtctgtattgtgatagcaacaaattaattacaactaatgagaaaaggaataggctaaactaagaccaaggatcaaagaattttctgattcctcctattttttcttgacaaaatttccttgtttatccttataattaatttacagaaataaatgaaaagagaacatatacataa

SEQ ID NO: 188361 - DNA, 274 bp, Homo sapiens
agtatggatattggggtgtgatcctactgcttgtctgtcccttgttcacctttgtttcctacacagaatctagcagtggcatccatctctgaggaaggaatgataatagatggcctagactaggtttcagagggtggcagtagctatgcaaggaactagaaatgttaaagtctgagtagaccccttggtgtgctccatgcattttgcgggtgtgatttgattgttcgaggtggtatgctctgtgagatctgtggtttgtttggttgttggaggt

SEQ ID NO: 188362 - DNA, 540 bp, Homo sapiens
caccgcaccgccgggaagcgacgcccacctgtttgctcagatattgccatttccaggccatgacacctgcaccctgaatgtgacacagcaaaacattgactctccactggcatcagacatacaggaattatgaaggatgaaaccatctcccccaggccttcaataagtgcaagtggattgctttgtaaacagaagtgcaaactcgttccgatagtggttccgcaccagtgctcggcagccgccctggcacagcgggcagtagagacagctgctgcacctgtcgcctaaggccgagagggccgggaggccgctcctggagggggcgcactgaccggtgatgcgctcctccagtctccagggcatctttagcttctcggcctctgggcttcccagcttgctgcacacctcgggcctgtacccactgctgtcagttgaaagcgtgcattctggaaagccacagtgggacatccctaatgcacacccttccttcttcaccttctccctggacacctttgctaagagatttggctaatttcttct

SEQ ID NO: 188363 - DNA, 1004 bp, Homo sapiens
gggagtctggaccacgcagactcagaacagcactactcacagcagggcctcttgctcgctctagctgctgggaggaaaacggcttgctaatctccacgcccagaaattcagacaagagcattctccttatctcatctgcacaggaagcaggtctaagtgtaatttcacaagcccctgactctgtgtagacacccagctctccagaaaaatgctttgaagacaaaggatacagcatacagtcccgtgtctcggctgagtcatcgcattccttaatagtgtcttctccccgggtttggtggcctgcttctggagtggtcagttctgctgccgacatgcccacccagctcgagatggccatggacaccatgattagaatcttccaccgctattctggcaaggcaaggaagagattcaagctcagcaagggggaactgaaactgctcctgcagcgagagctcacggaattcctctcgtgccaaaaggaaacccagttggttgataagatagtgcaggacctggatgccaataaggacaacgaagtggattttaatgaattcgtggtcatggtggcagctctgacagttgcttgtaatgattactttgtagaacaattgaagaagaaaggaaaataaaggaagttcgtgaatgctaatcaagggctaaataaagtggaaagcagcatccttgaaaatcatcgctctcaggacggggtctgcctggaatagcactgaatgtgtttagtagtgcctttggcttgggggctttggagaaagctgcttgagcccttcccatgctcataaattaggtaaggagcagtgaggaagtgtctacagcaacctcagccaatgtgatgtgcctctacagctgtatgaagtagattctctgattttatcttgaaatccacaacttccacaaaaaagaaaaatcttttaccatttctcattaaaaaagtaatataagtttattgtagggggaaataatcaaatgtaatctcattacccaga

SEQ ID NO: 188364 - DNA, 823 bp, Homo sapiens
gggagtctggaccacgcagactcagaacagcactactcacagcagggcctcttgctcgctctagctgctgggaggaaaacggcttgctaatctccacgcccagaaattcagacaagagcattctccttatctcatctgcacaggaagcaggtctaagtgtaatttcacaagcccctgactctgtgtagacacccagctctccagaaaaatgctttgaagacaaaggatacagcatacagtcccgtgtctcggctgagtcatcgcattccttaatagtgtcttctccccgggtttggtggcctgcttctggagtggtcagttctgctgccgacatgcccacccagctcgagatggccatggacaccatgattagaatcttccaccgctattctggcaaggcaaggaagagattcaagctcagcaagggggaactgaaactgctcctgcagcgagagctcacggaattcctctcgtgccaaaaggaaacccagttggttgataagatagtgcaggacctggatgccaataaggacaacgaagtggattttaatgaattcgtggtcatggtggcagctctgacagttgcttgtaatgattactttgtagaacaattgaagaagaaaggaaaataaaggtaagtaataagctcatctaaaggcagaaatatatccaaagttatgtacttaatgttcatttataccgttcagatctatagacccagtaatgtcatttatagctataatatccagtgcatatattaataattaattgctactattgaattatgtgccccttaaaatattgactttatgtagatattcta

SEQ ID NO: 188365 - DNA, 963 bp, Homo sapiens
ctcaaaagtgtccacccttctgaggtccgtccctcccactgagattcctcatgctgttgctaggaaaatgatagaacatttgaatctggttacataaaaagacaaaaactggagagtttaggaggaagcaacttagcctcctgtatgactgtagtcttggccccagggcagttcctggctcagacactctgggggtatcctcagtctaaggagggtgtctgcctgcccggttgacaggatgcctcttcttcacatacgtcttgtctttcagagtccatgaccaatgcctcacttacaaatatcttttctccttttgctcccacctttgtggatatttaccagttttttttctctaaaatcatccttactttttttttttctttttttttttttgaggtggggtctcactctgtctcccaggctggagtatagtggtgtgatctcagctctctgcaactgagttcaaatgatcctcctgcctcagctactcaggaggctgaggaaggagaattgcttgaacccaggaggcagaggttgcagtgagctgagatcctgtcactgcacttcagcctgggtgacagactaagactccgtctcaaaaaaaaaaaaaaattgtgacagaagctggtgtgaccaaggaactggatgtttgagatgactgaggggatgagttttgcttaggtcccgtgagataaagtagaaaacgtaaaaagacgtatttactcatttctgcttgccagtgtaatttcacaagcccctgactctgtgtagacacccagctctccagaaaaatgctttgaagacaaaggatacagcatacagtcccgtgtctcggctgagtcatcgcattccttaataggtaaataagcctaattaatgccttttcctataggtaacataatgtctgatggggttagggatgatgcctctgtaatctataccagatgtactcttatacacaaa

SEQ ID NO: 188366 - DNA, 825 bp, Homo sapiens
acctgaaaatgatgacaagggtaggtataggtagcagccacacgggctatatttccaggacctctacttcggggtagatcctgatcagtctaaggcagcagtgctaatcccattcctgttgccaataattggtttaagcatgagaacacgatccaagtctggacaacaaaatatgaaggctgattcaccaggggtgggatgctttgaagaacatgttacatgctcttcaacagagacataagaaagggacacgttccctttctcctctgaactttgtactcagtgtttgacatctagaattctggaagccatgttaagaacacagggaaagtgattctaaggaccaagcctacccactaaggatggcaaagcctaaacaacatggggtgtaccttaaagatggcagggtacaaaggtgctgcccagaggtgtcctaccctaggtgtgctatgtaaggcgataaactgcccttacgcttaggccaggagagtaagggggtcttttctagaggctaaaactgatccaaaaacaaatccttatactcattcatactcctggaaatgacttccatgggaatttaggagaaaaatcctactaatattgctagctatggtgtactcatacgtcaaagagaagcaacagtgttgttctgctgcccaggctgaagtacaggggcatgatctcggctcacttcaacctccacctcctgggttcaagcgtctctcctgcctcagcctcccaagtagctgggattacaggcgcccaccactacacccggctactttttgtatttttagtagagacgggtttcaccacgttggccag

SEQ ID NO: 188367 - DNA, 441 bp, Homo sapiens
atttccatccccacagttctagctcaacatttgttccaaatgttgctccacatacggtcatacacaaatacaggtttactaaacagatctttatcataaacagtgaatactgataatcacataaaatggttcacctcttgatactcttgtttggaccaaattctaagaatttcaacctgtaaaacaactaggcacattggctagagaaccaaaacagacaccccctcctttttctcctggactaattctgggtcctcaaatttctgaacagaattgcagatacgttaccaagaacagctggaaccctaagaggtgaggtgatattaaatgcaagcctagagtggcaggttaaacatggccgggtgctttggctcacgcctgtaatcccagcactttgggaggacaaggcaggcggatcacgaggtcaggagatcgagacca

SEQ ID NO: 188368 - DNA, 572 bp, Homo sapiens
aaggaaaggaggcaggaaacagacatctttaatgggccagaggctgatttaggctgttcagacattgttaagctgctcagcatctgaagttcaaagaggctgagaacaaaccggttaggaaatggcagaagggggttgggacctaggtgagcagcccgtcaggagcccctgggtggcttgcactcctagccccaagtgcaatatacaggtgaggcgcctgcagaattttcattaggctgagttcatttctggaagcagggaattggcatccacttaaccatccctaatgcctgccttttcatgtatgtctgcacttacttctggccttccccggatgcagtatgtgattcctggaaggggtctcctgtacgtcgtagttttgtcatcttcaggcaacccaggatgacatgatttctggaaatttccctgatttctttctgcttcactctccctcttttgctagaagggatcggcttaggcagccattgtggtgttcattcaacatgtccagtacagcctgttactgcagtttccaagttggagggtccgtgagtctactcccttttttgaac

SEQ ID NO: 188369 - DNA, 274 bp, Homo sapiens
aaggaaaggaggcaggaaacagacatctttaatgggccagaggctgatttaggctgttcagacattgttaagctgctcagcatctgaagttcaaagaggctgagaacaaaccggttaggaaatggcagaagggggttgggacctaggtgagcagcccgtcaggagcccctgggtggcttgcactcctagccccaagtgcaatatacaggtgaggcgcctgcagaattttcattaggctgagttcatttctgccatttcctaaccgttgtctaac

SEQ ID NO: 188370 - DNA, 220 bp, Homo sapiens
cttaccctagcataatcctgttgttctaggcaaccaactgcaaatttaatcgattttcaactttatttattaagcttctactgtgtgccaaatacctaatgatgggagagaagaaattaaagtcagcctgcttgccttcaaatagaccacagttgagtatgaaacacaaaaagtttaagtgtcaccccacagacttctaaaagatactaatatgtatcta

SEQ ID NO: 188371 - DNA, 252 bp, Homo sapiens
attcttcctctgtcgccaccctaatgcaagccaccattgcctcctgcttgagctactgcagtagccattaactggttttccacccccatactactacctgcttaccacccattttccacgctgcagacagaatgatcttttaaaatcccaaagattatgcccctcctctgcttaacaccatctgtggcttcccattgctctcagaataaaacctagactccttaccacaacgagcaaggctcctgccatctt

SEQ ID NO: 188372 - DNA, 399 bp, Homo sapiens
cttcaagtgactctcctgcctcatcctcccgagtagctgggatgagaagtacccaccaccacgcccagctaatttttgtattttttagtaaagacggagtttccacatgttggccaggctggtcttaaactcctgacttcaggtgatccgcctgcctaggcctcccaaagtgctgggattacaggcgttagccaccgctcctagccggtaccgctattaaaaaaaaaatgtaatagctcatttggaaataagggacattggtagctcttggcacctcctgatacctccttcaggaccaggacagaaataccagctttgtctggagttagggcagcaggttctttcacacctgcagggtcctaacgcatgctacgaattttcgaataagactgcagggat

SEQ ID NO: 188373 - DNA, 338 bp, Homo sapiens
gaagtgcgggagttcagagtaaaacagctaatgagctactcagttaaatattttccagatgacaaggtccaggatgtggctatgggacttagtggctgaaatggagtaaaggaaaacatcactggagaagaggaggtcaaggaaatgacagggcagagaatttcatggtagttcacaagacaatgacaaaacttgggataaaggtaaatgagagggaatgcctagaatgaggtcagcaggtaacagcagagaggatcagtggtctagccggaaagtatgaacctcaaagcagtttttaacagcagagcagagggatggtctagcaatggtccacagta

SEQ ID NO: 188374 - DNA, 373 bp, Homo sapiens
aggtaagtggggaggggcacagagcttccatgccctctgttgggcacactaccctcccaggacctccttgtgtttagcaacacagaagctctccaaaccctgctgtttgggtgtttatggaggcatgattgataaaatcactggccattggtagttaagtcaatctccagttccttttgcctcctggagttcagcaggtgaggctgaaagttccaagcctcaaaaaatgtggttggggccaggtgcggtggctcactcctgtaatcctagcagtttggaaggctgaggcacatggaccacttgaggtcaagagtttgagaccagcctgaccaacatggtgaaaccccgtttctactaaaaataacaacagtta

SEQ ID NO: 188375 - DNA, 427 bp, Homo sapiens
tatacaccgactaccagtcttacggctatttttgtatttttagtagagatggggtttcaccatgttagccaggctggtctccatctcctgacctcatgatctgcccacctcggcctcccaaagtgctgggattacaggcgtgagccaccgcacccggcccagtcaacaaatattttgtctcctgtacaccaggtattgttctaggcaccatggacttacattctagtagggagacaatattccaaatcaggatgtgggagagtcacatgacacacactgtgatggagccaagtaagtcaacgaagacaggtatgggtggtatcagccttataccacccaagatatggatgaattttcccctaagttcaaacctccttagtagcttaaaaatcagttattctctggataagtatggtggcagctgaag

SEQ ID NO: 188376 - DNA, 162 bp, Homo sapiens
aaacaaaacaaaacaaaaccacaaaaaagaaaccatgaaagattctaaagtaaacacccatgcacctaccacctagattccacagcaaccattttgctgtttgcttcaccacaaatccctctggccaccagcatcagccttgtcaagggttaccgagctcga

SEQ ID NO: 188377 - DNA, 429 bp, Homo sapiens
ttctgtttatggcagttgcaggggaagtttcaccatccgcccaccctgcccccgaccctcacccactctctggtttgggaatcacttctctaaattccctattattctaagtaccctttctacaggatttaccctcacgcagaaggtggtgggcattgaagaagccagagctccttacagatgactctccacggataacatgaaggggagggatacctcacaagtctcctgtaaatgggaggtggcaggtggaaagcagcaggcagaaacatggaagggggaactgggcttcctggtgccagaggagaaatcttgaagtggaacttcttggtagtagtagatttaggtacccttcatccacactacataatattccagaggtgttacattatttgatctctgagggctttggtagaggagggaaccctg

SEQ ID NO: 188378 - DNA, 269 bp, Homo sapiens
agagcctaggtggagatatggcttgatgactctggtgggcttccaaagcccctaagtataagtcaggtttggttggagattacctcagtgtctacctggagagtccattaatcgatttttaggggtaacttaccagcaagatatttaatctgagtctgatggaaatcatcacatgtactccatccctaggagtagagagggggctaattgctcatggtccatggcccacataacacttgccgtcagatgtaataacccaagattgggtc

SEQ ID NO: 188379 - DNA, 503 bp, Homo sapiens
agccccacttaacatggacaattccaaagtctgtgttcaagtatagccaaagcccctgccaaaaagcaaacatttgccctggctcagaagttcccaagtgaataccaaatgcttctagagaaacatttatttgagtgttagacatggaaataagaagtagaaataaatgttcatgatttcttagaaggctttgcctggaaatctttattcaaagagtcctgcgttggacaaaaacaaagataaatagatgggacttaattaagcaaaaaagcttctgcacagcaaaaagaaaaaaccagcagagtaaacagatagacaacccacagagtgggagaaaatcttcacaatctagcaatctatacattcgacaaaggactaatatccagaatctacaagaaactcaaatcagcaagaaaaacacaatcccatcaaaaagtgagctaaggacatgaatagacaattctcaaaagaagatatacaaatggtcaacaaacataagaaaa

SEQ ID NO: 188380 - DNA, 417 bp, Homo sapiens
aaagaaggtctgggtgtgggggtctaattttataggggatctgtgactaaaacactgtatggcttttctaactcagtttctacctggctaggggctcagttttctcactgaaaagtaatgatgctggacaaaatttctaaggccccttccagttaaaaaaatactggtttctttcttttttttttttttttggacactagagtcttgctcttcaagagattctcatgtctcagcctcccaaatagctgggattacaaccatgcaccaccatgcctagctaatttttgtatttttagtacagatggggtttcactatgttggccaggctggtcttgaacttctggccttaagtgatccgtccgcctcagcctcccagtgctgggattacaggcgtgagccaccatgcccagcctttgt

SEQ ID NO: 188381 - DNA, 195 bp, Homo sapiens
ttcaaatttcaaaacatatatgagttaaataattcaaatttcagttagaaaaagcatagcaaaaaattgcaaagtaaaataacttctaaatgaaatttcgatttagcaatcttttttagcaggtcacttctatcctcttctctctgataagttaacagctttattcatttgggtaaaagtgtggggaaattttaa

SEQ ID NO: 188382 - DNA, 880 bp, Homo sapiens
acctttgacatttggaagcatgtcagtattctacatattcaaaatggaagtaaaatcaacaaagatagggaaaatacctggaatggaatacaagcagtatttcaaatatataattgtatctcagatacatggcataaccacaccaaaaggggaaaaagaactaatccagataatttgagcacagtacttggccctgtatcttacattcttttagtaggtttctttttttctagttacatgagtgtagaaattctgaaaccctatttgtttttattacagaattcgacaaaattgagtaaatgtattgatggtgttgagagccagggtactcacagaagggagatgcaaatatagaataaggatggtgaagaaccttatgagtttggattaaaattggttgtaacaaaatgacttcagggtttctaacgaaacataatatctaaatgtaatacataatcctagactggaccctagaatgaagagaaaaagtatattataaatgatgttgttcgaacaattggcataatggcaatatgcactatagattttttaaaaattagataaaagtattgtatcaatgttacacttattgcatttgataattatattgtagttatataagcaaatattcttgttctcaggcaatacatgctgaggaattaagcaaaactttcagagaaagaataataaaatacattttgcaaaatgttaaaaaattggataaagaatattttttaaacatttctgtaggtttaaaattatttcaaaataataagtcaaaaagttatgtatcacattctgaattgttccttgttaccttgcttgtctgtatcattatgttgtaattttcccatgtttttcaacctttctaccctttcta

SEQ ID NO: 188383 - DNA, 535 bp, Homo sapiens
aataatccataacgcagaacagtcgaggggcaggcaagggcggggcagagagttaactggacttagcttaccagtgtttcccaaaatgtgggagtgcctcatggggtgcatgagatgatttaatctagcccacagatacagaattatatagtattcatctcccttaaataatgagaaagttattcccgtttgaattatctttcaaattgctaatatcggtatcagtgagaaagcctcagtttgatgccagtatactttcaccacctttcttacacacttatcttccttttaagctgagtgattactgactccaggctcagagccctcagaaagcaataacagctcatgaactttttttccactgtattcatttttattgtttccttctggttatggcaagtgacgttggttcccctctacggcaacggcataaatattcccttttaaataaatgtattacctaacaagatgtgtcaatttaataaaaagagagagtaaatatttcagttaccatacagctatacaaaaattgtgg

SEQ ID NO: 188384 - DNA, 410 bp, Homo sapiens
cttgtttactcagctaagaagtgaaacagttgatttacctatttctaaacttaagaggaaaaacaattatcttttaagtacagttatgcgccacataatgacgtaccccatgtatgatggtggtccaataagactataatgaagctgaaaaattactcttgcctggtgacatcttgataatgctgaccccatgtaggcctaggctaatgtgtgtgtgtcttagtttttttaaaaaaagtttaagaagtaaaaaaaattttgtttaatagtaaaaaaaggttatagaataggatataaagaaggtactttcgtgcagctgtaaaatgtttgtgttgttagcgaaacgttactacaaaagagtcaagtaaaaggccgggcatagtggctcacgcttgtggtcctagcacttt

SEQ ID NO: 188385 - DNA, 481 bp, Homo sapiens
ctagggcagccctgggaggtggtctcctctctgagcactccctgccccattagaccctgctgacccccgcagacaccctggctcgctctaataagacatctttggggctgccacccttcctggttaggaccaatttcccacagctgatcttagatcacagccctgggaaaaaacacttttcccctgggatgggggaaggtactgcacttcctgtcccccttgtgagcccagccacctgtccctttcagaaaggagaacagcctggtggttgaaggcagtccctggtgccgcaaggcatgagtttaaaacccagggcaccacttgagaatggcgtgaccttgagccggttactgtaattcgtcgaatcccagtccctgtcggatgcaaaatgagtcattcatgtaaggaccaaaagcagctgccaactataactgaaggaagccaagactgtgaggcatcctgggggcccagatactaccat

SEQ ID NO: 188386 - DNA, 345 bp, Homo sapiens
agataaggactaagagtatgtaggatgactaggacaagaacaaatggcatgtgatggtaaatgcagaatgtctttgtctttacaaaagtgcaatattgtctatacttagacgaagatgctgggatggagagtgggggctgcccggacagagctacaatcagggaattcaaggcctgccactgtcagtgacttacattgtttccttggagtttttcacaaataaattcaagtttatgttattatttaaaaaatcccaaggcatacaagtatttttggataaaataaatatatctgtgaatctattgagaataaaggtagcatgttaaaactcccatcaacattctg

SEQ ID NO: 188387 - DNA, 352 bp, Homo sapiens
ctttgttcttttcagtttcagagatcttttttatttaacttagaattatttcacttttgaatctcttaatttcagcatctgtatttatttcaaaccttttgggaataaagaggcaacttgttatgttggaaaggcttttggagcctgatagatctgagttttaatcctgtctttgccacttactaggtatttaatattcaggaatttatattatctttctaaaccttttttttttttttctgtaaaatgggaagttcttagtatggtacttggcttagatggctcccaataaaataatgcctgctaagattattattatcacacagaaagtttgtccttagtaccaaatcaa

SEQ ID NO: 188388 - DNA, 319 bp, Homo sapiens
gctcatacatagaaaaaaaatctgttaatagaaactgaggaaagctcagacattggacttaacagacaagactttaagtcaattattttcagaaaggtcaaagaactaaaggaaaccaggagaatgatgtctcaccaatattggtaaagagactggaattataaaaaggaaccaaatagaagttctggaattgagaagtacacaaataaaaaattcattggaagggttccagagcagacttaaaaaggaagaagacaaaaatcagcaaacttcaagataggtcaattgagattacccattctgaggtgcagaaagaaaa

SEQ ID NO: 188389 - DNA, 329 bp, Homo sapiens
agactgaccaagctggtaaatatataatgggaaccaggtatcttactatcagaagagagttacaaatccagttagggaaagaatgagaatgaaccccacggtgtcaaactggaactgaatgtaactgtggggcatcatgatgttcagtagacaggtaggaaagtagagacagataaaataaatagaaatacaaatctatgtacatacataccttccctagttttagtcactgagaaggcctggaagcagagatatcccaattataatgagcacacttagtgcccagatattggtttctaaatactattctccagtaataggaacctggg

SEQ ID NO: 188390 - DNA, 417 bp, Homo sapiens
cccagctacttcagaggctgaggcaggagaatggcttgaacccgggaggcggaggttgcagtgagccaagattctgggactacactccagccttggcaacaaagcaagactgtctaaaaaaaaaaaaagctaggttctaaattatttagtcttagaatctaacaagatattttcattttttaagattgttttcaagtaaaacttgctgtttctccctatccacttccaacaattgtctgatttatatgaggcaaacacatctcatataaatatgacctataatagcagataaattatttcttaaaaaaggaaagagtaaacatcttgcccctactacttctcagttctttccacacttcttaggaacaaatgtcaacagtaggctgggcaagtggctcacgcctgtaatcccaacac

SEQ ID NO: 188391 - DNA, 467 bp, Homo sapiens
cccagctacttcagaggctgaggcaggagaatggcttgaacccgggaggcggaggttgcagtgagccaagattctgggactacactccagccttggcaacaaagcaagactgtctaaaaaaaaaaaaagtccaagtctttcttaaatatagctttctaaaatgtagttttgagttaaagctaggttctaaattatttagtcttagaatctaacaagatattttcattttttaagattgttttcaagtaaaacttgctgtttctccctatccacttccaacaattgtctgatttatatgaggcaaacacatctcatataaatatgacctataatagcagataaattatttcttaaaaaaggaaagagtaaacatcttgcccctactacttctcagttctttccacacttcttaggaacaaatgtcaacagtaggctgggcaagtggctcacgcctgtaatcccaacac

SEQ ID NO: 188392 - DNA, 141 bp, Homo sapiens
tcactgacagtggtcagaggtctcggcaagaaaaatgaaggttctgggagttctgagagcaataggaccagagcctaagggagagataggggtaacaggtaagcaagattccagtctcaaagaagctgagacctaaataca

SEQ ID NO: 188393 - DNA, 399 bp, Homo sapiens
tgctggggcagcctggggctggcaggggaggccatgacgacaggatgagcacaggcctcaggggggtgaaagggatttgtctggaccatgcaaatgtgtgggagggcagagccgcctctggaagtggtgagcagccaggatgtggcttgcagacacggcctcagcagcctgcttggggggcccggccagaaggcccctggctctctgggagcctctcctccctctgtgggcttttgagggggtgccagggaaaagaggtcccatggggcatgagtggacggcagagcctcaaatgctagtttggggcagaatgagtgagctttgagctcaggggtcagggctgagcagaggcagcctggcctcaccctgtctgtggggaggcagaggcccacagcacag

SEQ ID NO: 188394 - DNA, 316 bp, Homo sapiens
taagctttttctcccaacaaagctgaaagaaaacccactttgtcacttctgagcggtgacagtccatggggagcctgtggtatgtaggatgggcattggcaaccataaatggattatgtttgtttgagattacatagtgtaccatttgaatctcctgaaaattgcttctggaacaaaatggggcttggataactcttgggctgatacatgtacttggtatgagacattttgaactcctcctgctgatagatgtcacgagcaacaccagagtggtaagtgttaaacaaggaataaagcaagtagttaatgggttgtg

SEQ ID NO: 188395 - DNA, 702 bp, Homo sapiens
cttggagaacattatgctaagtaaaataagccaggcacagaacgacaagcactgcatgatatgacttgtatgtggaatctaaaaaagttgaactcttagaaacaaagaatagaatagttgttgtcaggggatgggccagctggagacagtgggtagatgttgatcaaagggtacaaagtatcacttaggatgaataagttctggggatctattgtacagcatggtaactacagttaatagaaacatagacatgaaaattgagaagagagtagttctttggagatcttaaatgttctcaccacaaaaaatgacaagtatgataagtgaggttatgggtgtgttaattaggttgatttaattgtttacaagtatacacatgccaaacatcatattgtccaaggtaaatatatacaatttttatgtcaattataccttaataaagctgaggaaaaaataagcacctcacttagtgcttatgatttagtagcacataagattatgtaaaaagcattttggccaggtgcggtggctcacgcctgtaatcccagcactctgggaggctgaggcaggcggatcatgaggtcaagagatggagaccatcctggccaacatggcgaaatcctgtctctactaaaaatacaaaaattagctggatgtggtgctgtgtgcctgttgtcctagctactcaggaggctgaggcag

SEQ ID NO: 188396 - DNA, 178 bp, Homo sapiens
aatttgctttaaggcttatccaggagaaaattacttagctttgggaacaggtggtggaagaaaatcagccttagctccagaaacgggtggtgtagttgggcaaccttggatgacctgtgacgaggctggcctgagttagcaggctgggaaacgccaggtgggtgctgggcaaagtgag

SEQ ID NO: 188397 - DNA, 789 bp, Homo sapiens
gcccttcaagaccagacatgtacctgtctcctctccaggtctcacctggcactgaccccaagccccaggcgtctcctgtccagccacacctccaagagaagcctcaggcccttttgcatgcaggcccctagcctggaaggctccatctctgcttgtccggcctcacctgacctctggagtcaccatttccagggtgcttcctcccctaggtgggtcagagtctcctctgggctctctcatccttgtgtttccccacactctataccatgatgtcctgatttagagtctgtggttcacaatgcagtccacaagcctcagggggacagggacctgtggaggacggtggaggaaggaggggtggagggtgcctctgggctccgagtgtgcactgtgcccctgaccccttgctaggtttccagcccctcttgccgcacatgactgggtgtggttttctgtgagtccctgggaagcgcctgctgtggactggagcctttgggtcccagctccaacattcactgagggtttgttctgtgccaggtgccctgccagaacctggggaggatctacagatgggaaagcaggccacgccctgggggcaccagcccctaacttaatgtgtgaccttttctgaacctcagcttcctctgctgtgaaggggatgaggacccaagacccttccctgttaccttgggtacatctatgctgtggctgggatcagacatggccccgcatgaccctgaggctgcagctagaccagaacttgccctccactgggcctctggaacactg

SEQ ID NO: 188398 - DNA, 227 bp, Homo sapiens
ggaatttgggagacatcaaatccaaattctctccctgcaactcatttcttccttctctgtcttgcctccctcctttcctttctatgccttttctgtgtattttatcttccagggattatgctaaacactagggccaaataagaacatggctttattctcaaagaattaataataacaatgtatttttgtctatgatttgtagacagtatggagtgtggattatggaa

SEQ ID NO: 188399 - DNA, 166 bp, Homo sapiens
agccaatgattagtgagagattgggcccaaacacttcaagccagcaaaatctcccgctgagttgatgggtctctatgtggattcaggaaaaagtttatagttcagacagtttttagttcaggctgttttgcagtttctggtatctcctctgcaaaacacagaggtt

SEQ ID NO: 188400 - DNA, 439 bp, Homo sapiens
tgttggacaattatgcaacagaactgctttatgtgtacttcccattttatcacacagaatattaagaagatgtatattcgaaggccaacacttaataaaaaaaattttttttgctgtttcatcaaagatattaagtgaaaagtaaaactgacattttgtttgttttcaatgtgcatgttggggaaaaactcaatcgttattattagctcggtttggtaccactaaccttgatttgtgctaaggtgccagcagcaaatcaattgtgcaagtcactttgcttatgcctgtaatcctagcattttgagaggctgaggtggagggatcgcttgagcccaggcattcaagaccagcttggggaacatggctaaaccctgtccttacatattcttccctttttttttttttggaaagggagtctcttggtgtcgcccacccaatg

SEQ ID NO: 188401 - DNA, 369 bp, Homo sapiens
attggttggctgtaagtatttggctttatttctgggttctctattctgctccattcgtctccgtgcctatgtttataccagtaccatgctgttttggtgactatggtcttatagtatagtttgaagttgggtaatgagatgcctccagatttgttctttttgcttagtcttgctttggctttgtgggctcttttttggttccatatgaatttttggattgtttttttctagttctatgaagaatgatggtggtattttgatgaaaattgacttgaatttgaaagaaaaagatttctttaggcaatataggcattttcacaatattgattctatccatccctgaacatgggatatgtttccatttgtttg

SEQ ID NO: 188402 - DNA, 416 bp, Homo sapiens
tttgatgtgttcaggggtgcagagaactattgtgacttccagcagagatgtgtctcaggtttctttgagtggctttcagcaaaggaaccctttcttggtgctattgttctcaataccttgttgttaggcagtttagaggctttgctgttcaactggctcctctctctggcattcagaaaatctgtcaccagtaacgcagaccctggccttggaggaatagttaagattgtgaataataggattaagtgagataatatatgtaaaagtcccgggtaaacaataaaagtctatttcaatggaatggattattataatactattttttcagtcagcatctcttttctgaattgctcagagcacttcgttaacactaactggttaatccaccatccatccctggttggaggctggcattt

SEQ ID NO: 188403 - DNA, 270 bp, Homo sapiens
ttcagctgcttagttgggttaacagtttcctttccactagtatggtgtgaggagtgggaaaggcagcagagtaccactcacagcctgcccagtgagcccaaagcagtagtgagcccagtcagaagaaaagcctggcatactagaaagagcatggcctttgaaagattggtcagcctgggttcaaatccactgtttgcctcttcactgtgtgaacttgagcaagttcattaagctctgtcctcatctgttaaatgtgcataatcgtttaca

SEQ ID NO: 188404 - DNA, 146 bp, Homo sapiens
agttgatttaacatataaaaatcaattgatataatataccactttaacagaataaatggtaaaaactctatgattatttctttagatgcaggaaaaaatttgacagaattcatcacctttcattatagaaatgtttaaccatcaag

SEQ ID NO: 188405 - DNA, 255 bp, Homo sapiens
gtgtgaacccgggaggcggagcttgtagtgagccaagatcctgccactgcactccagcctgggcgacagagcgagactccgtctcaaaaaaacaaaacaaaacaaaaaacagaaatttaggttatcgattagaaaactttcgtcgtcctcctcctcctcctcttcttcttcctcctctttcttcttcactacttcttctccttctctttctctttttccttctctttctctttctcctccttctcctctcctcct

SEQ ID NO: 188406 - DNA, 513 bp, Homo sapiens
agacaacctagccaacaagagccctgcagagaagcatcccaggaacttctatcttccaagccctaattccctttagttatatcacaactctaccagccatatccacttacccaaatgtgttactttccctctgtcaagatttgggagatctgatttaaaaactataaaaacaacataggcttgacatagactacactttgccatttttagctatttaacctttactataaacatttttagctatttaacctttactacatatactatatatagtcaagaaatatttttgtaatgagttttgtaagttacacatttttattatacttatgaatacagtactattctttaaatataaatataatgaaaagatcattaattaaagaagaaagtcaagctgagcactgtgactcacatctataatcccagcactttggaaggctgggggtgggggcgcgaatcatttgaggtcaggagtttgagaccagcctggccaacatggtgaaaccctgtctc

SEQ ID NO: 188407 - DNA, 300 bp, Homo sapiens
tgaaaagccgtatttcatttcttctagctaaatttcctacttctttgtattattaagtaggtcttttccactcatgatcctaagcatcacacacaggttaaggcatccaaaggtcaaactgccatcctacctgccccatttttacttgagtttggctgagaacattctctattcacctcttcatccctccctgattggtttaggctaatcttgggttctgcttaggcaatattgcctaccaaagctgttcccagaggaagagctccagaagtcctagctgtaaatcaatcgctcaacgat

SEQ ID NO: 188408 - DNA, 244 bp, Homo sapiens
tctcgctatgttgctcaggctagtcttgaactcctgggctcaagtgatcctcctgcctcagtctcctgagtagctgggaccgtaggtgcatgccactgcccctggttcccagcccaccacagctcacagctctgggagtggcaggaaggctgggcctgggcagggggagcagcagaagtgcctgcaggggttggcaggggctgtgctgcactggcctgtgggcctgggtgagaggtgaggatgg

SEQ ID NO: 188409 - DNA, 448 bp, Homo sapiens
cagctatttccaggaaactgaactgcatcccaagaaaaagctcaagaatacaaaaatattcagcccccaacaaggtaaaattcatgatacctagcagctaatcaagacctgcaaagaaacagagaatacaactcataataaaaagaaaaacaaatcaatagaaacagacacagaaatgacacaaatgatacagttagtagctgaggactttaaaacagttattatcactgtatttcttatgttcaaaaggtggaagaaagatggagcacattaagcagaggcaaggaaaagatagcaaaaaaaagttgaatgaccatttttgaagattctgatgcctgagatgaaaaatacataccaaacaggattagtagactagacattgtagaagaaaagattagtgacgtttaatacgtagcaatagaaatgacccaatatgaaacacagggag

SEQ ID NO: 188410 - DNA, 475 bp, Homo sapiens
atctgtactggagagagaaaatcggggtcatgatggtttgtaaagtcatgcaagtgatgagcttatttaaaaagtgaatgtagatagaaaataaaaagttccactcctgaagtaccttactgtgtactggtcaagaagatgaagaagaaactgcaaaaaagactgagaaggaaacagcaaaataggaagaaaactaatttatttaatttggtaaataggatattattgatggacctaccaagatcagtgttagtagagtggtgggaatgtaagccaaaaatcaaggggcttacattttaaattggagatgaagctgaacccccagtgattataattcatatgtatcaatgaagtttgatggtgaacaaaagccaaaagatgatagatcacttaaggatgaggtataatgaagaaatgactgtttctggaatggggagacaaacatttttataggcagaagggacaaaaaatgtgg

SEQ ID NO: 188411 - DNA, 292 bp, Homo sapiens
atactattcagccataaaaaggataaaatcatgccatttggctcaatggggatagaactggtggccattatgtaaagtaaaataagcccagtacagaaagacaaacattgcatgttctcactgattcatatatattaatacagaataaagtaaagtagattctatggaagcatagagtagaattgtggtaaccaaaggttgggaagggaagtgagaaggaggagatgaagagaagttggttaaggggtacaaaaatacagttagatagaagaagtacgttttagtatttgac

SEQ ID NO: 188412 - DNA, 439 bp, Homo sapiens
gttctgggataactggctagacatatgcagaatattgaaactggacctcttcctttcaccatatacaaaaattaactctacatgtattaaagacttaaattcctaggaacaaacctaggaaataccattctgaacatcagccttggcaaagaatttattactaagtccctaaaagcaactgcaaaaaaaataaaaattgacaagtgagacctaattaaactagagcttctgtacagcaaaagaaactatcacagacaacctacagaatgggagcaaatattcacaaactatatatctgacaaaggtgcaatatctagactctgtaagaaacttaattcaacaaacaaaaaataaccccattaaaaaatggacatgaacaaacactcctgaaaaaaagatacatggagccaacaaatatacacagaaatgctcaacaccc

SEQ ID NO: 188413 - DNA, 768 bp, Homo sapiens
gctgggattacaggcgcccgctaccacacctggctaatttttgtatttttagtagagatggggtttcactatgttggccaggctggtctcaaactcccaacctcaggtgatgcacccgccttggtctcccaaagtgctgggattacaggcgtgagctaccatgccccaccgtttttgtggttttaagccacccagtctgtggtactttgccatagtagccctgggaaattaacacatcaataagaagtgatctgccatgatgaaggtattatgggagtttgggcaagaagatgactcaccctgatgggaagatgaaaaagacttcagaaaaagttttccaaaggaaaatggctcttgcactagtacttggacgatatacaaaaattaaacaggtgaaaaaggagaaaggagtgtcttgagcgaaggtgcttgtggatatggaaacgtgtttggtgacctgcagggagggggctgtttctccagcaagaatggctgtggaggttccccaaggcatgacacaggatgggcaagtgtaggtggagtcataaggcactttacccttcacccatggaatttacattttaacaggagggcaatggggctctgtcatgagggcaatggggctatttccacccggagtcctagcaggcagttcatggtgggcattttaaaacaaatttagaattttggggtctaagaattttgacaccctatcatagagccgagtttctcagtcttggcagtattgacatttgaggctaggtaatc

SEQ ID NO: 188414 - DNA, 313 bp, Homo sapiens
aggggacgggggaggatgaagacaagtaggttaaagagtacaaacatatagttagatataattaaattcaatgtttgatagcagagtagggtgactacagttaacaaaatcatagctgggtgatggacactctaaatactctgacttgatcacgatacattatatacatgcaacaaaattttacatgcaacctatcaatatgtacaaatttttctaaaaagctcagcaaactggaacttccttgctctgacagagtagcaaaaccaaggaagattcaatattgtagcactgtcaatactccctaattaatctt

SEQ ID NO: 188415 - DNA, 371 bp, Homo sapiens
aatcttgttttatccataaaccttgttttatttagtttcatgaggaattaacctgtgacaggcacaagctgggtgcagagttaccatgtttatttctttccactagaggtcactaaagaagtaacttcttaaacttaaggcaaatcagtgatattaatgtgtaaactaatatttccattaataaattttttgaggaatttttatcattaatttggaatctgttacagctaaaaagtcacaggaaaactatagagatggacaatctagtggttggcagggggcggggagggtatgactacaaagcagtgactgagggagtttcggggagggaactgttctatattctgactgtcgtcatggttacattaatc

SEQ ID NO: 188416 - DNA, 561 bp, Homo sapiens
cagaggatcccccgagtggcctgctcactgccgagtgggtccctgcagcagtggggaaggggaggacagagggagttcacaagaactgggaatgagagaatttaccatagacagaggcacaggatgctaaaaacaagacttttctggcaactttaggcgccaccatgtaggaaatgtttattggtgtgacctttggtttagtatgtgaaggtttacatgattggggagaaccacaggactcagatttgcagaaatgaaagatgcatagtaatgaagcttgttctatattaaaatggccacaagtgagctatatatttaggcaggtgaggctataggcatattataaatccacaacagaaggcaaagtcaatggtgcctcctgtatcaccataacaatgcataaaatgtatatttcaaagctagaaagtgataatcatggaaaatttataggagggatatctgaaaggcagctgaaaggcccagaagccatagggagtgcatgatttcataaatactgaaaaagaattattgcaggtctcctaccaagcccattatatgtgt

SEQ ID NO: 188417 - DNA, 614 bp, Homo sapiens
aatgcccaagaccggatggtttcatatgctaattctaccaaatattcaaagaacactaggccttcttaaactcttccaaaaattaaaaaagagaatgcactcccaaactcattttataaagtcagcatcaccctgattccaaagctaaagataacataagaaaattaccaggcaatatccctgatgaacataaatgcaaaaatcgttaataaaacactagcaaaccaaattcaacagcacattaaaatgattatacaacatgatagagtgggatttatccataggatacaaggtcagttaacatatgaaaatcaaccaatgtagtaaatcacaataagaggaaggaaacacaaaaaacagatgatcacatcagtagacctagaaaaagcatttgacaaaagtcaacatcctttcatgataaagactcaacaaaacaagtatggaagaaatttacctcaatgcaataaaggtcacttatgaaatgcccacaactaacatcacactcaatggtgaaagactgaaagcttttctttcctctaagatacagaacaaggaaaggatgctcactcttatcacttttaatcaacatagtactggaagtcatagccagggca

SEQ ID NO: 188418 - DNA, 596 bp, Homo sapiens
ctctgtgccatctcttatctgaatctctttgtgtttctcccctattcagatcaaccagtcaaggctcccataaagattttggcctcatcttgtttttttcatctttgctgcttgtagtcaacaggaattcagtacctttagctgtactgatgtgtttactctttcctagaaaagcaaggaaatgttttgcttctgcgttgttttttctttgcccccacacctagaatgtcttttttcacagcccacgtttaaagctgatctacctctcataagccacacattctagtttgtagagatgcttccccttgttatccttaagatctcattctcttctgttattttggtgcttaattttaggtagatgtatacattggttctggtatcctagtttttgcgaatcttgtccttttcatatatcgtacttcttcagttacacatctgtagaccaggtcttgtaatctccctttgctcttcatgtgcatgctcttggtttggaggacttactgttgagctgagtggctcaaagaatacctagaatgagatttttagccaaaaactaattcaggagtggcaaaagcttccgtcttcatttatac

SEQ ID NO: 188419 - DNA, 476 bp, Homo sapiens
atgtcataaaaataactactattttatgtgtgcgccattatctgaaaaaagctaggtggcactaacttactgcatgtatttatccttctgtataaagatgttcaacaatggctctactttagggaatacttcaccttccttgttagagaaaggaacatatgactggcaaaggaaactccaggataattaaaaacccttgtatgtgtcttcatttcacacattctttctctaggacttcttttgggaattagaccttgaaatagctcagacttttaaagatagagctgaaagttctattatatctagaatgaaaaagtccagtctaaatgaagaaacaatctttttgagggaatatataacttggggttgcggctattatagagtaaagggtacttcgacttgccttcctgtcatagacaactctcacattggccaaaacatacccagtggctgcttttaggcatcggaccatacat

SEQ ID NO: 188420 - DNA, 439 bp, Homo sapiens
tgaagaaaatgaacacattgcataatctaaaacctacctatcctgatagagtttccccttttctcatagctttcccatcttttaaaagccttcaagtatgaatgctctcaacttccctcatcattactcataaacttatcagtaacaggaccattcttattttctttacgcttacctcaatggaccattctctttttatgcctatttcccatagacataaaaggtaggaggtaaataaagtcagaaagaccaacagtctacagccagtttctaagctatcagaatatgacatttttctttgcaaatatagaaatataccttctgttaagtaaaagtaaagtgttaacaagccaccatagacagatactcctgcctatctgggtctcaaatcacagttttaagggctagtatcaaaagcaatgtgttcaagggtccctaa

SEQ ID NO: 188421 - DNA, 307 bp, Homo sapiens
caatagatacctgcaccctttattcactccctttcccaagtctgactagcatcctttcagatcgtttcctgtgtatttgaacacccactcaggcttttgttgttatataaaatgggctcaaactacaatctgctttttttcatgtaacataacttagagatctttctatgtcattacatgaaaacctctctccttctttgtaaggactgcttcatctcccatagtatggaagcgccaacagaactgatttcactgttccccactgctggacgacgggatcctctggaacgctatgcaccctagatac

SEQ ID NO: 188422 - DNA, 343 bp, Homo sapiens
tagatacctgcaccctttattcactccctttcccaagtctgactagcatcctttcagatcgtttcctgtgtatttgaacacccactcaggcttttgttgttatataaaatgggctcaaactacaatctgctttttttcatgtaacataacttagagatctttctatgtcattacatgaaaacctctctccttctttgtaaggactgcttcatctcccatagtatggaagcgccaacagaactgatttcactgttccccactgctggacatttaggttgctttcaaaatcccccctacaaaataaccaaacaacaaacatccttgtgcactggattgaggctgg

SEQ ID NO: 188423 - DNA, 529 bp, Homo sapiens
agaagtcattatgggcattgtgcgagtagagaaaagtaagctggtctgtagagggagaataaagcagtcatgggaagagaagcattaggcagggctcccacactcaaatgagtcaggcaggatgacagaagtaagataactgaattcaaattcaaattccagattctttcaactaggggctctcaaaagtgtgatgctccagcatcacctgggaacttgttagaaatgcaccttcccaagatccaccccaagacatgttagaaactctgggatggggctcagcaatcagcatttttacaagcccttttgggtaattctgatgcacgctttagactgcctatcgaactgtagacatctgacgaacaaatccaaaccacagtctgacaatgggtcacctctgttgaaagtgaaacagaacacagcagtactgatttttaatgactttccagaccctagttctagttccccatgattcctggtaacccaagtcctggagctgatctggcagtttcaaaacatttcttttcct

SEQ ID NO: 188424 - DNA, 198 bp, Homo sapiens
caaataatgcatcttttcctagtcacttcccattccatcttcaaacccaagcaatctgcttttgtttcattctccatggaaagtgttctgaccataaagatcaccaatccttccccttacataatctccctgtagccttttgatgtgttcttgagactcctaagtactcaggactctatactgttccttcttagtctc

SEQ ID NO: 188425 - DNA, 377 bp, Homo sapiens
gggagagagagggagagagagagagaaggagagagaggaagagggagagagagggagagagaaagagagagagggggaagagagagagagagagaagacacagagggaaagagaacacatatgtattgccaataattgaaggctgttgtgctgggagctgagacacattaggaagagtattagactgtattgaaggtaccaagaaggaaaaggatattgttggtagagcattaattttcagtactgcattagttctgggtggtagccccactctgttcttcatcccaccatgcacctccccacagggcaaggaggccacagggccaaggagacatgcctactccgaccctatatgtccctttctctctccactcctt

SEQ ID NO: 188426 - DNA, 366 bp, Homo sapiens
tgattggtaacttcataggagatttggcatatataagttaaagagcagacgttactgcttatatttatatcttgggcctgtagcacttaatattgtggataaccatttacttgtgattatgaaaactcctggggggcacaccgtggcatgcatgcccttcacataactttgtaagggtttcccttctccaggcattttccgttcttagccgaaataagaatgagttgctttcaagatgctttcataaagatttaaaagaaattgacccatctgagataatttttaatataacctgctcctagtataaaacccaggatataaatcatgaaacagaatacttcttcagtcttcatgaaaagctgggtg

SEQ ID NO: 188427 - DNA, 359 bp, Homo sapiens
ggccgatgaagtttcagcctcaactgatggcagcagcctctccagatggcctgccactgccatcacaccagctgtagcagggaggtgcagccggggttgaccgctccatggagttgacaggagctggggacaagtgggagccctgccccttccaagctggggcaggagctccccaggtgccgctgcagccattcataccacggctgcaggcctgggcttcccactccacagagcgcgcaggagccccaccctcctgtgaggggttgcaccagcccaagtcatggctgcagatctgagcctccctgtgctctttgggggctgggagcaggcaggagccctgcctttccaggtgcagctgc

SEQ ID NO: 188428 - DNA, 438 bp, Homo sapiens
aggcctctgtatatcttcctgtgtcattttgctggagtctgtaagccctcagaagacaggaatcccttctaagaaactccttttactgaaccccagagagggtgatcagggataaatgcttcagggtggtgggcacggcccctcttatccttacgggaagcatcttgactggatattcaggtcagggacagtgttcctcagcacgaggctggccttcagcacagaactctccagggaggggcagggctgggtgagcaagtgcaggggtggactgaggagggtgaggcaggctgagctggggacgcgtcctccaaaggtttcagtctttcattcttctaggtgcctttttaccttcaatgacacttttccactctcttttctcccttggatcacttctggaaagggttttaaagagctctgccatattctgaccccatt

SEQ ID NO: 188429 - DNA, 382 bp, Homo sapiens
aaaagttggtttcagggcctaaatacccatctcttatatttatgacatggtccttagcaaagtaatgtagtaggacacgagtttttcagtaaatggacaggtctgaatcctgtggatatgagttgttgaagggattactttgagcaaattatcaaatctttttgaacaccgtaaattttcccatttgttaaaatgagtgttctgagtatgtcacaggctttttgtaggaattaaatggtatattgtggctcttcaagtgtggtagctggacctgcattaagaagcatttgaggtgcttattaaaaatacagtttctggagccccacttcagagctactgaccttttgggggatatattctagggtcttcattttagtaaact

SEQ ID NO: 188430 - DNA, 403 bp, Homo sapiens
ctgcttcttgaccctggaagagtacagtaactcgcttcccttgctatttggtggttccaactctgcgatacaaactatatacgtttctgagccctcatggcaccaggctgagagctttctggaggtatggtttgccttgatgctcctctgccctaacccatctttctcacacccctgtaggtttccctgagagcagttcctcagtaaatcacttgcacaaacatctccatctcagctctgcttgaggggacctaaagacagagtggaactcaaggtcattatatggaggagctaaaacccatgctatagaacgtcagtgcaatggtttagggtggaggggcagctgcattgagatccagctcctcccttttgtcccagctgcttttttccttttctcccaccg

SEQ ID NO: 188431 - DNA, 374 bp, Homo sapiens
agagattgagaccatcctggccaacatggtaaaaccccgtctttactaaaaatacaaaaattagctgggtgtggtggtggttgcctgtagtcccagctactcaggaggctgaggcaggagaatcgcttgaactcaggaggtagaggttgcagtgagcagagatcatgccactgcattccagcctgggccacagaccaggactccgtttaaaaaaaaaaaaaagtaataagacaggggtcccaggaggctatatagtatgatatgcaggataatgagaatgagctaaaatgcctgagaaaaaaattgctgattcctagcttttattccttaactacaaaatattgatatttttgtttatatatttgaaaatattt

SEQ ID NO: 188432 - DNA, 687 bp, Homo sapiens
atcccagcattttgaggggctgaggcaggcagatcacctgaggtcaggagtttgagaccagcctggcctgcatggcaaaaccccatctccactaaaaatacaaaaattagctgggtgaggtggtgtgtgcctgtaatcccagctattcaggaggctgaggcctgagaattgcttgaacccaggaggtagaggttgcagtgagctgagatcgcaccactgcactccagcctgggcaacagagctagactctgcctcaaaaacaacaacaacaaatcatcaatgatttaccaatgaagatatactcaacctccttaacttgaaattggcagttcttccccatcttgctcaaccttaacttctgcgtatcacattaaaaactacatcctagccaatctggacccctagttctccaaacatatgacagctactcaccaactgaatgtcaaactctgcaaagtggagttgctacttcaacaagatgcatctgcttggaagctccttctggctttgctgcacatattcagtgtttgcttatttacacaggcaaatgtagcatttccctaccacggcaccaggaggctctaaagggatgaatatggctgtacttggaaggccaaggaaatcctaggagcatggaatgaggtggaacaatctaattctgctctcacctgactacagcgtaagcca

SEQ ID NO: 188433 - DNA, 487 bp, Homo sapiens
tcctcactcctaataaaatccctcaagagggttcaagagataacctcttcaccaaatctgttagaaatagattagacagtagtctgggtgcagtggcccacttctgtgatcacttgaggccaagagcttgaggtcagtttggacaatatagtaaaaccttgtttctgttttaaaaaacaaacaaacaatttgagagtctttctgagctacctgtggctcaggtagctgcccaataagcaacaacaagaaatacattacatgggcattgtggctcatacctataatcccagcactttgggaggccgaagcaggaggattgcttgaggccaggagtttgagaccagcctaggcaacatagcaagtcccccatctctatgaaaaatataaaattagctgggcatggtggcttgtacctgtggtctcagctacttgagaagctgaggcaggaggatcacttgagcccaggaggttgaggttgcagtgagcc

SEQ ID NO: 188434 - DNA, 304 bp, Homo sapiens
agttgatacctcaagaaaagaacctggaatcatcatgcagggccagagagtgaaaaccagctgactgctgagaagaaagaaggatcaaactaggtctttagggacattatttgagaggtcaactcaaacctcacctgaaactagtcctaaacctaacttttcaattatagaaggtgataattcccttgactctttaagctgcttgaatgaggtttttgttacctgcaatctaaagattcctgaataatatatacagtcggccaggtgctgtggctcacacctgtaatcccagcactttgggagg

SEQ ID NO: 188435 - DNA, 516 bp, Homo sapiens
cctcctttctctaggaagagttctaccattttcctcattgcccaagctcagggcaccttcttcccttcttgcttgtccaacatgctctaaatcatgctatcactgtgatttcccttgatattctgaacaaaatgagcacatccttaggaagcaagacctatgaagtagtttttttttctctctctctctttctgtattcttttggagtgggagtgggagagtggaggcggcaggtggtccatgtccaacttcctgcctgagctggagcaggggtctggaggtaggttcttgtggctactgatgcagaacagcgactcaggaaggtgtcactcagcttagactaaatcattctttggagacagttcccacatctaagtggagttttatttcaccctgatgttaacattaactgtggctctgggtgatgatcaggaaagctgaagaagcttctgtcagtgccagcaacattgagaagtataccatcatcatttgtgaattaagtgtaagacagaatta

SEQ ID NO: 188436 - DNA, 557 bp, Homo sapiens
atcatttagccttccttgaaggcttggtggtgacaaggacattagctttgtcctggacgaacgggatgtgaggcctccccagcacgtggccgggctcttggggtatctgtgtgctcatctcattcactcaccttgtgacccaaccactgctcaccagaggctggtagctcctccccccattcagagtcccgtccctctgctgtcgagctgtttcaggcccccagacattgttggactgatctcctgttgtccctgtcttctgagctttgccctcacacacaccattgttcaaactctgccacagctgcagtccttgcagacagtgtgtgtccctcctctgctcacaagcaatccttggctcccaactgcctgcagaatgaagtgggatttcttagcatagccctgcagactttggccatttgtcacacactggagccagcctgccccctactacacccgcccaaggatgcacttccttcccgtgcgtaggacaacgcacagcggacgctggtttcagagcgcaccaagcaggcacttgcctccacgcctgggtgtgc

SEQ ID NO: 188437 - DNA, 283 bp, Homo sapiens
  misc_feature (126)..(126): n is a, c, g, or t
ttacaaagctgtgccaccattagacaggcccatggacttcacagctaaattttaagtcactcagctccaggagctgagtctctctcctgtggttctagacaaggagaggagcccctcagagctttncccacggggtgccaccagccgaaaaccactggacgctatataatcccctttacgaggcttctctgagctcataccactggcctttggtccctctatcctcccagactccatcctttttgattacttatccctgccttgatgctaaaaagacatgaaa

SEQ ID NO: 188438 - DNA, 501 bp, Homo sapiens
cctatcttggtatctcactgtctcttagtctctgtctctccctgcgtacccagcttccagcctcccccaggctctctgctcctcatttctggttaatgtgtcctcccgctccagcccccccgaatcccgcttcttccctgcttaggtctatttttaggcatctcctagtttggggagaatgttctggccaaagatggcagaaacccagagcccaggcaggcaggctgggtgggagctgggtggggagggcaggtcctcttcgcccccgcccccctcccgtctctgatctctccccccacggaatgattctcacggggcagtgttaaccaggaccctgggggttgagggaactctgacctctgacctctcccatgacattgtctctctgtcccccacacctctggccccaccatgtctgccccatcctccccggatcggccttggtaagtgaacatccagccattctacttcctttccagtcatggggtggtgtttttaggg

SEQ ID NO: 188439 - DNA, 567 bp, Homo sapiens
cttcctgcttctgccgcttcctgcttctgctgcttcctgcttctgccgcttcctgcttctgccgcttcctgcttctgccgcttcctgcttctgctgcttcctgcttctgccgcttccagcttccagcctcccccaggctctctgctcctcatttctggttaatgtgtcctcccgctccagcccccccgaatcccgcttcttccctgcttaggtctatttttaggcatctcctagtttggggagaatgttctggccaaagatggcagaaacccagagcccaggcaggcaggctgggtgggagctgggtggggagggcaggtcctcttcgcccccgcccccctcccgtctctgatctctccccccacggaatgattctcacggggcagtgttaaccaggaccctgggggttgagggaactctgacctctgacctctcccatgacattgtctctctgtcccccacacctctggccccaccatgtctgccccatcctccccggatcggccttggtaagtgaacatccagccattctacttcctttccagtcatggggtggtgtttttaggg

SEQ ID NO: 188440 - DNA, 445 bp, Homo sapiens
tgtgctaagtcatcgggtagaaatactttcagctccaaaccatgccaggtgtgaaaagtgtctaactccattgctggatgcagtggaaggagagttgaggtgcataactgagaccccgttctagaaagtcttcccagatctttagagggtaagatgtctagaacaattatactctcattaattcataattaactcttaggtttaggagttaatgcgatttaaaggttttctattatctgaaagttagtattatggagaagagatatgtaatgattaaaagaacaacctgggatgcagtttaagggtgtgaggccttgcccctggcagcgaatgtcctttgcctttgctgacaagtggggattgcatctaatgagcatgagggttttcttcattattgttcatctactttctcacgttccccttttctttaacatactcacagttg

SEQ ID NO: 188441 - DNA, 382 bp, Homo sapiens
cagcacacacactaaaattcaaactcataagcttggtaatacttactttgacaatttgatcttctgctattcttattcatagacattaaaccataccaatcataccactaacaccattccccaaacatagttatactttccagcacctaaccatttacatctactactctctgtaagctgcacatctccatttacccaaatcatttaaagccagtatcaactctatcttttctcaaacttctctgaacttaggtaatacagctctcaggctactcctctctttcaccttgtcattgagtcctttatggacatcttagctccccccactacaaagagagttcttgaggaccagggttatgtctcatcaacttcccatttccca

SEQ ID NO: 188442 - DNA, 446 bp, Homo sapiens
cctatggaaagagaagtttggcaccatgctttctccctgactgtgaacttcttgaagacagagatcaagactgtgtttttcatcttttcttctttatctgagcacagtgccaggcactatgtaaacattcagtaaacactcagtaaacgttgaatgaattaaaggacttaatatgcattcagagtagctgactcagtaattccaaatctgagaaaatatcctaaggcagcgattctaaatatgaattcacagaaagaagcaaattaagtgcacaaagttgttctttgtaaacgtgaaaaattagagacaacctgaaagtccaaatctagaggattggttaagtaaattgtggtgaatctttagcccaggatcttacgcagccattttgtaaaggagcacgaagtttgaatgacacagaagtgttactacagggcttgaaggaaatc

SEQ ID NO: 188443 - DNA, 363 bp, Homo sapiens
tccaaaaaggatgccacaatatttagaccatccatttcagtgttttatcacgctgctacaaagggccttttgtacagatacatagtctttgtcttacaaagccccaaaatataggaaatatgctgagttttcctaactgcctaatgaataaccatttgtaatcaactgtccatactgaaaacccttaaaggtattatggaacacattttatatttttattacctgccaaatataacaattccattttagaactgaatctagccaaaagcataaagtgggaagagtttcctgtgatgctcttggcatatcctttcttaacccttctctctctctcatttcaggactctatttttttttttcttt

SEQ ID NO: 188444 - DNA, 338 bp, Homo sapiens
ggtgtctttctatgtgtgactcaggcacagttgacccagctcatagttatccaaagtggatgggtggcacacattgaaaggaaatgtgtctatcccatgcttagaaagttaagatcaaggttcatggcctggttttggaagcctacatcatgtttcaatcatggtataggatagaaggaagagtcaataagataaaagctacctggccgtctttgcccaaagctgcctggtgaagataagtgaaggtaaaataatcacattaaaatgttctgtaaaatgcacaacctccttgtgagcctggaagatgtcctgctatgctggaccagataacccacagg

SEQ ID NO: 188445 - DNA, 344 bp, Homo sapiens
ttttctcaaattttgttttaggtaaaggtagagttggaagcagttagaggtgtaacatgttgtagtgttttggaatattttgaagttaccagagtagccactactttgtgtgcatgattcctttctttagaaacatctattaccctctttgtacccatccagggagtgtggtcatggaaaagcaatccccatgcggcattactacattacagtgttgacacagggacacttcccttgcactaaattcctaatctaggcaggtatgtttgtctaagtcttttccataatctaattcattcactcagtattaccttaacaaatgtatcgtgagaacctgtgtttac

SEQ ID NO: 188446 - DNA, 323 bp, Homo sapiens
cattctgtgcgattcttgagtatgaaccatatattattttctggcctttctttacaattccacttatggctgaccttgaaccagaataggtctgtgattttactttccaaagtccaatacatgtatttttcttttgttcatgttgatatctgcattggcacacgtgaatttccaaatttggtcttcaccttttcagttttcataggcaaaaaataaatttggatgatgcaatagtcagtaaagaactccaaacaaaggttttcttgactagctggaggatatatggaaatccctaactgtggtgtatataaactgtaaaccca

SEQ ID NO: 188447 - DNA, 505 bp, Homo sapiens
agggtcttattgcaactggcgctagtccatctgtgtggacactcagtcacctccataaatcaaaacttcaagagtacattttcatataatattttatcaggcatctgaaggtttcaccaaagtttatattttcctactgcaaaactatgttccatgtagatctggcccatctggaggctattgttcctgcgttcatcctcccatggtcacatttcttggccaacagaaccatagaaatgggtctgccatgtgttaacgtttagtccaaatcatttttccactttagctctgcttcaaatggggctggcctggtgatactggagacaataaatgcgcctgtaagttccagataacaggctcttgtcattttcccaatctttcctcattgcaatgttccacagatgtaggtgtgccaaggcctctgggtcccagtgtagcaccttgaatgcaacagttcacacagaggtggcttcaggatgccagccaggagaagttcaggagcact

SEQ ID NO: 188448 - DNA, 420 bp, Homo sapiens
agaccctcccaatcctgaagagtttaactgagagtatagcaccttttaaaggtctaaatggaaacatttgccatctattgtcatctttagcgtagccacctatgagtcttcatctaaacactaagaatcttaggctgagtgggctgagtgcaggggctcatgcctgtaatctcaacactttgggaggcttaggccagaggattgcttgaggccaggagttcaaaacaagcctgggcaacacagtgagatcctgtctcttaaaaaaaaaaaaattagatgggcatggtggcaaatacctatagccccagctactcaggaggctgaggtgggaggattgcttaagcctaggagtttgaggctacagtgagctatgattgcaccactgcactttagcctgggtgacacagccagattctgtct

SEQ ID NO: 188449 - DNA, 484 bp, Homo sapiens
tgtaaaccagttccatccaccacccttttcttctttctgtaaatatttatcgtgttgcttctgtgtactatataactataagccgatttttcaggtaagaagggtaacataaccactaggttggcaaaatgaaggtttacattgtaggaaatttaagttggaattgagctgctggtgggacttagaaaccaccagtagatagttgaaaatgtggaaagttggagatggagatgagcactgagaactcagtatcataaacactatctttaaaggtggaaccttgtgggattgccccaggaggattaagtacagatattaccttggaagtgtgtatagttctagtattgttaccattgttcaggatatttttgaaactcctttaagatttccctttggattcttcagtacactcgtcttaatatcctcattttggcaaatctttgttctgaaagttaatttgaatttcagccaaggtttaaccaga

SEQ ID NO: 188450 - DNA, 301 bp, Homo sapiens
tcccaaacctgatatctccccactagtcatctatttatttattcttcccaaggctacattctggggggaaattctctggactaaaaacttaatggaatacgaatgggcatcagagtgttacagaaagagcactggactaaaagtcagagaagtggacattgatgtgggagtttctactatctggatgaatttgggcactatacaatctcgcttgcccacattttctatgtcaggaaaaagatgtagttaggtcattatgtgttctttccagctctaaatattgtctctgaattatttatat

SEQ ID NO: 188451 - DNA, 195 bp, Homo sapiens
ctgagattcaaattcagataatgcttactgaagagactgcattctttcttctactatttgtcctttttgacttcttaattaaaatgcaaactttgaagataaaaactgtcatcttacatattttctcagtaatcttacagtgcgtatcacagtgctgagcaaaatggtgcttgatgcatgggactaatcttaagc

SEQ ID NO: 188452 - DNA, 545 bp, Homo sapiens
tagtctatgcatctcatgtttaaattcataagctaactgagtaattgtcaaaaacattcccctattgcttagtggtttctattacttgtaggcaaaatatttataactaagaaaaatcagaaattaattgcaagtagctgacccaaacatatggaattggctgaatttgcagggaggagggtgatgatagttctcaagattcctccatcctgggaagaaagctggtaattcctgttaaaccaacagcctactgaggccaatgctttagaatattttttggcaaatgtcatagaatcaagatgtgttgactgcctcttactgcctttagtaagaatctaaatgagaatacgagctttgatccaaggttactgcctggaagcaaaaatgaaagaaaaagagagagggggagagaaataacagcagggcaagtatattatttattaagggaagtcctttctcctgatttccagcaatataatactgctaagtttcagataaataggccatttgcaaaacttaaccatttctaaagctaaagttgaagt

SEQ ID NO: 188453 - DNA, 829 bp, Homo sapiens
tggtctcgatctgacttcgtgatccgcccgcctcggcctaccaaattgctgggattacaggcgtgagccactgcgccggccccacattaagtcttttaagtagcctgctgttaattctgtcgtagtcttttctataaaacaatactgatccaatttgtgataaactcacccactctcatcgcagaatatatatttctcccgttcgtcttccttctttggcccactttatctgtctacctccttcattttgtttctccaggaaggactgatgtaaatgggattttcagaaactccctccagcatgcccctctctgcatctggaatacaggggtcagaggatctactctgtctagggtccttcctctccctggcaggtcttatggtagtgtacactgtggtttgcctctatcagtctgtccttcatttctgtgaccagatctccaacaggacatgttctaaagaagtgtggtagaaactagcccatttcaaactttgcaccgtgatttttctacacgccaccccactggggcttttgtgatcagttttataataaagagtggatctagattgaaccttagttttgctacagtgtttcattcagtcattccataaacatttattgagcgtgtactatgtgtcaggcagtgttctaggcatttgtaggaaagcgggagagagcagttggagcagtggacattgtgttcatttcagttgcagtcctccctgaagttttacagatctatagcaactcattttttttcagttcaaagaagcagtgggaaacctatgtctcctgctctcccccatgagatgtgtattgttttttcct

SEQ ID NO: 188454 - DNA, 170 bp, Homo sapiens
cccacttggcctctcagccttgtgtgctccgagccccgtggtgggcaggacactgctaggccatggcgggctcatggggaaggaagcaggcagagatcaaattcctctgctggggcccaatgagagttaagggggaggactccaaaaaggagcatggagcacacggtagg

SEQ ID NO: 188455 - DNA, 492 bp, Homo sapiens
cggtcatctcaaggaggctgaaaggtgaggaaatggtgtcactatgctttcctctcgcctagctgataccacaaagcggggttggataagcatctgtaggttagggcagagtgaatcttcatgaccaagcgtttggagttcgagcctcttaccatgagagctctgggcccagggtctttgactctgaaatttctgcgaggctaagtcatgcattgtgctggacagccagtgcttccagttgcctatggaaggtggcagctctcagacctctagtgcttggcttaattcactacatcacagacaaccttgccacttacttcctaaccactactgccaaagatctagggttttgaggaaagatcaaattattttccagccagaaacaaaacacaaatactgttacattataaacctcggccacctaactagtctccccacttgcaatttactttttagtactaccagattcatctccctaaagcaccacctttc

SEQ ID NO: 188456 - DNA, 253 bp, Homo sapiens
cagttctggacatgaatgacagtaatggttgtacaacaatgggagtgtactaatgccactgagctatacacttaaaaatggttaaaacacaaattttggccaggcacagtggcttgcacctgtaatccaagcactttgggaggccaagccaggaagatcacttgaaacctaaaacttgatacctgcttaggcaacacagtgagatcctgtctctataaaaattttttaaaaaattagcaaggtgctttcctgt

SEQ ID NO: 188457 - DNA, 263 bp, Homo sapiens
agcaaaggagatagaaagggaagtatcaaaaagaagaaaaccaggcatttgattgtccagaaccaaagggaggttaagagagcatggttaacacctacagagaggttaaggaaggtgaggaataataaaaggctatgtttgttgacaatctggacaggcatcctaattgtccaatcaccagttatctgatgattttggagagagggtttggagaggtagcagcacagatgtgttaacagcaaatgcttagtgtgggaaagtaa

SEQ ID NO: 188458 - DNA, 473 bp, Homo sapiens
ttatcattgagctgtatgagtttttaaatatattctagaaacaagtcctttgccagatgtatgtattacaaacatgttctcccagtgggtggcttgctttttcattttcttcaagtgtcttttgaagagcaagagttcaacatttcaatttgtcgaagtcttctggttagtacttttttttttctttctttctgtccctctcaaggttaagaagaccttcacctagaagtttgtgattttggcttttgcatttaggtctaggatctatttcaagttactttggtgcgtgtgtgtgtgtgtgtgtgtgtgtgtgcgcgcgcgcgcgcgtgcatgtgcgccttgaagtaaggattgaggtttattttcttttccatacagatatccagttgttttagcaccatttgctgaaaaaagctattctttctcctttaaattgcctgggctcttgtcaaaaatcaattgacggctggggg

SEQ ID NO: 188459 - DNA, 354 bp, Homo sapiens
aaatcccacagctaacattatattcagcggtgaaagactaaaagcttccccctatgaccaggaacagacaaggtgcccacttctaccactgctattcaacactttactggaagctctagtctgagtaattaggcaagaatgataaataaaaggcatataaattggaaaagaagaagtaaaactatctctatttgcaggtgacatgatcctatcatagaaaaccctaaaggagctacaaaagaatatattagaggtaatagacaaattcaacaaaattgcaggttacaagatcagaaataaaagttctacttctatatactagcaataaacaatatgaaaagaaaattaagggaa

SEQ ID NO: 188460 - DNA, 292 bp, Homo sapiens
aaagcagacattatgatgtcatttcatctattcaccatgttccacaggaacctgctatgaattatgaggccaccacttagaattgaaactgtagaagattgtaagcattctaagccgacatgcacatgcttcctattttagacctcactgatcttcagataacatatggtggtacaagtaattggaaaattggcacacctgtcaagaaagtatactagatggggcaaaaaaatgccatgctggagcacatgaagtgtcttagcaattaaatttattgttttttgtcaagcag

SEQ ID NO: 188461 - DNA, 191 bp, Homo sapiens
tccttgagatgagtgaaatttctgctctgagatcttctacctcgggatatttaaataagaaaagtacatgaacagcaggatcccttttaaagtgttctatacaatcttaatcttaggaatgcagaatgccatggttacacttgagaccacatttaaagtaatacttctttgatcaggcaatgatatactgt

SEQ ID NO: 188462 - DNA, 263 bp, Homo sapiens
gccaggcaaggggagggaggggagaagcaaacagaggtgcagcgtgtgaaggcccacaggggcttctgagcgatcaaagtacttgactatggctggcgagaggatgagtgttgatgctggagaggcgagcagggtgagcctgtggaggttctgcctgggccacgtgacagaggagaatgaatagattattgggacagggaaggcttttggggtggggttccgtcgacagggtgctgggggctctctctcaagccggccagatt

SEQ ID NO: 188463 - DNA, 148 bp, Homo sapiens
agtcgggggcgcggggaccgcgaaggaaagtgagagcgccgcgggagccccgagcgccctgtgcccattagggcatttgagataaagcgtttgagataaagcgatgagaagggtgaggggccctggagctgagtgggcgcgcagatag

SEQ ID NO: 188464 - DNA, 474 bp, Homo sapiens
taaaaatattctaaaattcatttcattctaatttctctgttctgaaatattcttttctgtatattaagttacagtaatgtaatttcctggtgtttaacctgactaacggcggtattctgactgagaatctttttcgtaattttataacaaaaattggatttgaaaggtatgacagtattttttatgagaatgtgctgctctgtataactcctgtgtatgtatggtgcatactgagctttattattgtcacagatttagagacagtttcttattttcacactgaatcatggtaccattataattttaaaagcagtgggattaattgatctctgcccttttaataaaatatgggtagagttttgggggctttttttgagacaggatctcactctgtcatctaggttggactgcagtggcacaatcacagctcactgcagcctctaacacttgatctcaagtgatcctcctgcatca

SEQ ID NO: 188465 - DNA, 593 bp, Homo sapiens
ttaattctcagtcagaatgagagattcgtacaatttgaaaataaatttgcactccttccactttccataattccttgaaaacatggcctaaataagtagtgatgtgtgggtgattatatttcaatggagagagaaagaaagagagagaagaaagaaaaaaggagaaagacacagagatagacaactagtttttgtgtctgtctgtgtatctgagagatacagactgatgtaagaaagaagagcaaaatgctaaggttggttggctcatggcagaaagatgaggtggcccagcaaagcagtaaagaagaggttactgaaaaaccacaatgaatgggcttgaattggctttcaccaaacagcttctgaaggccagagaggcccaggtggaaagaaacaggtggaggaagatggaactgcaagcagaattgcaagataacctcgtgaggataaatggccttatagaaaagggcaaaagagggctgtgggagggccctttgtacagccacttagaatttggaaagaacaagtctagtgggatgatgaatgaggttgatgggattgctaaaaaatagaaggcagtgatggtctgtggt

SEQ ID NO: 188466 - DNA, 297 bp, Homo sapiens
agagaagcagttgtggccagtgtcccatagggaagtagatgctgggtgacagtaaatgggagctctctgtattaattgtaccaattttctgcacatctcaagctcttttttttttttttgagacagggggcccccctttgtaaccaaggcgggcgggggggggcccatcctaagctaactgaaaacccccttctataaagggggaaggaggtttccctccaggcgaaaaactctggcaaaccccccttttcccctctctctttggacggacccaaagaccggtccccggcccaaaat

SEQ ID NO: 188467 - DNA, 454 bp, Homo sapiens
cataccaaacccacaagaccctgtgatgtgctgtgagcgaagcctgtgtcttggctggtagacagaaatgtgtccattactttctggcttggggaagacttcaggtatttgatgatatgtcctttggtttcagaagtcaattaaatcttagctgctctgagtaaacagccatttgtggttgtgtttagaaaatacagtaagatcagatttgtgctgctaggtattaggttggcattttacatgtggaatttgaaccggactatgaaatctatttcttctctaatttggttcaagacctgaacatgtaacctttgagtatacaacacaggtttagattataaaggcttcttttccttttttctttttttttttttttttgagacaaggttcttgctctgtcacccagatgaagaacccgcccactggagtgcagtggcataatcatggcttgctg

SEQ ID NO: 188468 - DNA, 214 bp, Homo sapiens
aaaatagttcagagtcctgtacagccttacccagcttccctaatgctaacatcatacataaacataaccacagtgaaattatctaattccaaaatcagcactaacaccagactattcaccaccacaaagacctgactccgacgcaatcaccctgctccagggcccacgcgggtggtgccgggtgctctcttctctccatgaggctgattttttt

SEQ ID NO: 188469 - DNA, 110 bp, Homo sapiens
cttctaccctgttgtcaacttctatcccattgcaattttattttcttcataacacttaccactctctaaaattatcttatttatgtttgtttacctgtttatggtctgtt

SEQ ID NO: 188470 - DNA, 256 bp, Homo sapiens
agaaaaccaaatatggcatgttcttacttataagtgggaagtaaatcttgggtagacatggacataaaactggaaacaatagacgctggggattccaaatggagggacagagggggaaagggctgacacccttcctcatggctaccatgtccactatctgggtgacaagctcaatggaagcccaaatctcagcatcatgcaatattcccttgtaacctgcacatgtgcccatgaatctgaaataaaaatggaaatt

SEQ ID NO: 188471 - DNA, 428 bp, Homo sapiens
actggttagataacaaagtcagcataaatcgagctctgctttcttatcacagtgaagcagctgtgccaagggtgtgagacacctccactccatgtacccaaagctttcttattctcagtgtttgaaatagattcagcttcaggtgagtgagtcttttgtgccttctttttctctgactcctatattcatatccagaaatacctatgaaaaacatcaaagaaaaaaatctatctccctcccccaaatccaaaggctaatcaaaataaaatccccagaaagactggattagttaactgtgttctcaaattgaatttgagcttccgaataaagacacatgaaaatgcaattaaattaaatctaatgcagaaacattttactaagttgagaggcaccacaattttaataaaactgtgggaaattatgctatt

SEQ ID NO: 188472 - DNA, 444 bp, Homo sapiens
gacttttcccctccctttctagcagctgcgatcaccctgaactctgtcctttggttctctaagccagtgggacagaagatcttctattaggcttccagtcacccagtgagcagagtgggccttgccccctagcttaaagccataataggaatgttgcctagtgccattcccttcacctaaagggagaaacccctccagtatgtttcttctttttcttgttctctggtgcctttagaaagttgttttttgtattttttccagagtgtatacttattcgaaggtagacagttggtctgacagaaactactcaaccactaaccaaaagcagaaagaagtgtacatctttgaaaacagaattccatttagttttaaatagtctactcagactgatcttttttggttatgtctcaattaatatgatgttgttggtaagtcaagtatata

SEQ ID NO: 188473 - DNA, 360 bp, Homo sapiens
caataaatgtatgtgttctgactgctccactgactgctccccgcccctgccccaatctcttcctctgctcaggcctccctatcctctcagacacaacaatattgacatgaggccaattaataaccctacaaaggcctctaagtgttaaagtgaagggaagagtcacacatctctcactttaaatcaaccgctataaatgattttgcttaatgaggaaggcatgtcaaaagccacgacaggtcaaaactaggcctctttagccaaacagtgaaccaagttgggcatgcaaaggaaagttcttgaagaaaacttaaactgctaccgcgactcagcaaagcttttaaatgaatttcttccaga

SEQ ID NO: 188474 - DNA, 859 bp, Homo sapiens
tggtgaaactctgttctactaaaaatacaaaaaaattagcctagcgtcgtggtagctaccacgctaccaagcatggtggtagctgtagtcttagctactcaggaggctgaagcagaagaatcacttgaacctgggaggcagaggttgcagtgaggtgacatcgcgccactgcacttcagcctggacaacagagtgagactccatctcagagaaaaataaaaaagtcttggatccattttgatgccttttgtggcacttcacatgaggaatctgtgcttatcagttatcaaagtaaggaagactttattatgagccactagtttctatatatggtgtactccctttaatgacagactgatcatcttccacaagtatttacccagcattttaaacactttgagttccgctcagaagaaaacaactttcaaaaaattttttccatgcattttccaagggagaatgataaggtttcaactgggtgacttgtccaccatggaaaaccaaacatggatggcagggatgttcttgaatctgcagcccatgttggttagtgcagccctacttccaaagcatggaatatgctttcagaaaatgcatattctatttttcctccttgcatctttctggtccttctgcagaaggtgctgtcaccgtgtaagtattgcctggcctcttcagagacacagaatgaccccataccccacaggaaatgaccttagattatttccctttgtggaaaatgtgtctggttgaaaatgtcttctggatgagaaagcatggggtaggtgtgaaccgttacaacattgaattatcgttttccttttcaattagcaccagtcactgccaccttgtgtgacca

SEQ ID NO: 188475 - DNA, 1216 bp, Homo sapiens
cctgacgaggagacccaagaggcggccccatcccaagacgctgctataaaatgaagcgactccctgccccatcctcttcctctggccacaaagctgagttaggtcgtagagcggcaccgccctctccctctcctgcgctagtctgcaggagcagccccttccctaactggcagattcaaggttttggaagacagaccattgccccatcctcatctcctggttctgtctaaaaggggacagttgccctgccttttggcaagacctaggttctcaccccaatttcagggatgtcccattcacccccctacccccatccccaatgagaagggacctgttggctggtatgccttcttgctagtgactggctgagctcaccactgcaggtgggtcacacacagcctcataggcaggcacagctggaagggaccagagagacatttagatccactctcttcagctagtaaatgtggaacttgaggctcagagagggacacttcttctgcctttaactgcagccagctcctcatgaacagtgagattgttcctgcatgaatagtgtctgttcctgagtttggaatcctgggctatgaagggacaggtccaaaggctacatctctacctacctgtggcctgatccatctcttaccttggcagtgggatgagaatctaagctgctctccaagaagtgtagctaggggtggaggtaggttactcattaccccacgccacaatgtcatcgcatgggctgtggccagtccctaacagcttcttccagaggctcagctccaaggacttcagatgctgccctaaagagcccaggtttctcaattccagggttccgctttctgcagctggtcacacctgctctctggctttctccagaaagtgatgcccaaacccctgactgaccttgaggcagctgagtgaaatgttctagaagagcttcctgcagcttcattgtccttcccttttctaacatggttaggccttgatgatgggcatgtggattacccaatgtgtggatcacccatggaaaatctggaaggccaggaggccttcccacacactctggggttgaagtggggtgtaagggggatgggtggggaagtgtctaccctcaactaccagcacacatgcagaaaatgcaagtggaccttaatagtagcctaaataaaatacccggaggagatataatcaacaggggggaaaagtgtgt

SEQ ID NO: 188476 - DNA, 823 bp, Homo sapiens
caggcggatcacctggggtcaggagttcaagaccagcctggctgacatggtgaaaccccatctctactaataatacaaaaaaaaaagctgggcatggtggcatgcacctgtagtcccagctactagggaggctgaggcacaagaatggcttgaacctgggaggcgaaggttgcagtgaaccaagatcgcgccactgtactccagcctgggcaacagagcaagacagagactccatctcaaaataaataaatagaaggctctccaggacattttgatgcccactgggatatgggaactcctgccatggggaggagggcgtctttaagaaggaataggccctattgagatgccagctgtagacctctaggagttgaccatcgagcctgagaaggtaaggagagggtgtaggagacccctgactctgacctccaccctctcattcctctccagggcagtcccgcactctgatggccacatctggtgccaggtagtttctcgtaaagatctacactcacattacaacctagacatcccactagtaggtatttacccaagacacctgaaagcatgtgtgtacccaaagactcgtaaatgaatgcaactctatatgtaatagccaaaattagaaacaatccaaatgttcatcagcaggtgagtggtaaaacaagttgtgatatgttcatacaatgttgctactcagtaataaaaagaaatgagctacagatacagataaggaaacttggaggtgatatgttcataatcttgtttgggtcaaaggtttcagggatgtatacatgtgtcaaaacatatcaaaccgtataat

SEQ ID NO: 188477 - DNA, 491 bp, Homo sapiens
catatggagaatgccccccacccccatctcctcttctcacttcagcaaaaaaaggaaagacaacaacaaaaaacaactaaccccactgcttcctgtaatcaaaggaatacgaactggctaatcacccaaccccctacaaccttcttaaggttaggggaaaatctgggctccttcagaaaaaaggccacctgataggactcatggcgtcagcttccttcatctcggttcatgcttaaaaggcctcttcactgggaagcttcccagtgaggttttccacgcacatctggacactttccacaataggcctttgaagaggcctgaagtattccgggaaagtctgcctcactgggctgaggtttaaagagcagaagcccacatttatttttctttcccgccttctttgacaaaactcccctcagtggtttgtgggcatttgcaaagcagccctgattttcagcttgctacttctagggctgaaatcttaaagaaaa

SEQ ID NO: 188478 - DNA, 1985 bp, Homo sapiens
  misc_feature (961)..(961): n is a, c, g, or t
  misc_feature (1500)..(1500): n is a, c, g, or t
  misc_feature (1587)..(1587): n is a, c, g, or t
  misc_feature (1589)..(1589): n is a, c, g, or t
  misc_feature (1591)..(1591): n is a, c, g, or t
  misc_feature (1597)..(1598): n is a, c, g, or t
  misc_feature (1600)..(1601): n is a, c, g, or t
  misc_feature (1603)..(1604): n is a, c, g, or t
ggtcaggacccccaaacgcgtctcgcgtccctaggcggcggcggccgggcgtcccgggatggccttcatggagaagccgccagccggcaaggtgctgctggacgacacggtgccgctgacagcagccatcgaggcgagccagagcctgcagtcccacacggaatatattattcgagtgcaaagaggaatttctgtggaaaacagctggcagattgttagaagatacagtgactttgatttgcttaacaacagcttacagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgncggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgangtacagcaactccaataattcagcaggatctggggccagctcacctctcacgtccccgtcatcgccaactccaccctctacatcagnananctgcannanntnnacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaacctgtgatcacagtgctccgaagatcggctgaagcttcctgtttacacttggagggaaaagttcttttttattcctactcacccctaccccccaactaccctcttcctgggaaagtaattgctgagccagtacagccacaaacagtactattttgcagatgctcatgtaagcagcttttcgagagaaataattctttaagcagaataaagttaggctggcatgc

SEQ ID NO: 188479 - DNA, 1747 bp, Homo sapiens
  misc_feature (723)..(723): n is a, c, g, or t
  misc_feature (1262)..(1262): n is a, c, g, or t
  misc_feature (1349)..(1349): n is a, c, g, or t
  misc_feature (1351)..(1351): n is a, c, g, or t
  misc_feature (1353)..(1353): n is a, c, g, or t
  misc_feature (1359)..(1360): n is a, c, g, or t
  misc_feature (1362)..(1363): n is a, c, g, or t
  misc_feature (1365)..(1366): n is a, c, g, or t
agcgggcgtgttgacagcggcggcggtggaaccgggcgggcggcgggagtcggcgcctcgggttcctacctcgcgtccctaggcggcggcggccgggcgtcccgggatggccttcatggagaagccgccagccggcaaggtgctgctggacgacacggtgccgctgacagcagccatcgaggcgagccagagcctgcagtcccacacgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgncggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgangtacagcaactccaataattcagcaggatctggggccagctcacctctcacgtccccgtcatcgccaactccaccctctacatcagnananctgcannanntnnacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaacctgtgatcacagtgctccgaagatcggctgaagcttcctgtttacacttggagggaaaagttcttttttattcctactcacccctaccccccaactaccctcttcctgggaaagtaattgctgagccagtacagccacaaacagtactattttgcagatgctcatgtaagcagcttttcgagagaaataattctttaagcagaataaagttaggctggcatgc

SEQ ID NO: 188480 - DNA, 2033 bp, Homo sapiens
  misc_feature (1009)..(1009): n is a, c, g, or t
  misc_feature (1548)..(1548): n is a, c, g, or t
  misc_feature (1635)..(1635): n is a, c, g, or t
  misc_feature (1637)..(1637): n is a, c, g, or t
  misc_feature (1639)..(1639): n is a, c, g, or t
  misc_feature (1645)..(1646): n is a, c, g, or t
  misc_feature (1648)..(1649): n is a, c, g, or t
  misc_feature (1651)..(1652): n is a, c, g, or t
agcgggcgtgttgacagcggcggcggtggaaccgggcgggcggcgggagtcggcgcctcgggttcctacctcgcgtccctaggcggcggcggccgggcgtcccgggatggccttcatggagaagccgccagccggcaaggtgctgctggacgacacggtgccgctgacagcagccatcgaggcgagccagagcctgcagtcccacacggaatatattattcgagtgcaaagaggaatttctgtggaaaacagctggcagattgttagaagatacagtgactttgatttgcttaacaacagcttacagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgncggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgangtacagcaactccaataattcagcaggatctggggccagctcacctctcacgtccccgtcatcgccaactccaccctctacatcagnananctgcannanntnnacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaacctgtgatcacagtgctccgaagatcggctgaagcttcctgtttacacttggagggaaaagttcttttttattcctactcacccctaccccccaactaccctcttcctgggaaagtaattgctgagccagtacagccacaaacagtactattttgcagatgctcatgtaagcagcttttcgagagaaataattctttaagcagaataaagttaggctggcatgc

SEQ ID NO: 188481 - DNA, 1982 bp, Homo sapiens
  misc_feature (958)..(958): n is a, c, g, or t
  misc_feature (1497)..(1497): n is a, c, g, or t
  misc_feature (1584)..(1584): n is a, c, g, or t
  misc_feature (1586)..(1586): n is a, c, g, or t
  misc_feature (1588)..(1588): n is a, c, g, or t
  misc_feature (1594)..(1595): n is a, c, g, or t
  misc_feature (1597)..(1598): n is a, c, g, or t
  misc_feature (1600)..(1601): n is a, c, g, or t
agcgggcgtgttgacagcggcggcggtggaaccgggcgggcggcgggagtcggcgcctcgggttcctacctcgcgtccctaggcggcggcggccgggcgtcccgggatggccttcatggagaagccgccagccggcaaggtgctgctggacgacacggtgccgctgacagcagccatcgaggcgagccagagcctgcagtcccacacgattgttagaagatacagtgactttgatttgcttaacaacagcttacagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgncggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgangtacagcaactccaataattcagcaggatctggggccagctcacctctcacgtccccgtcatcgccaactccaccctctacatcagnananctgcannanntnnacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaacctgtgatcacagtgctccgaagatcggctgaagcttcctgtttacacttggagggaaaagttcttttttattcctactcacccctaccccccaactaccctcttcctgggaaagtaattgctgagccagtacagccacaaacagtactattttgcagatgctcatgtaagcagcttttcgagagaaataattctttaagcagaataaagttaggctggcatgc

SEQ ID NO: 188482 - DNA, 2079 bp, Homo sapiens
  misc_feature (1055)..(1055): n is a, c, g, or t
  misc_feature (1594)..(1594): n is a, c, g, or t
  misc_feature (1681)..(1681): n is a, c, g, or t
  misc_feature (1683)..(1683): n is a, c, g, or t
  misc_feature (1685)..(1685): n is a, c, g, or t
  misc_feature (1691)..(1692): n is a, c, g, or t
  misc_feature (1694)..(1695): n is a, c, g, or t
  misc_feature (1697)..(1698): n is a, c, g, or t
gatggcgcccgcggggccgtggcggctgagcgtgatgctccgggttctcggcggcggctgtggccttggccggggccttgggtctctcccggtcgtgagcgatcagcgcctctccgccggccgggctagccgggacagagaggagacggccacgaagagaggaggcagtgagcaacaggacgagaccgcggcgtctccagcctcggtaccatggccgggatcatcaagaaacaaatcttgaagcacctctccaggaatatattattcgagtgcaaagaggaatttctgtggaaaacagctggcagattgttagaagatacagtgactttgatttgcttaacaacagcttacagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgncggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgangtacagcaactccaataattcagcaggatctggggccagctcacctctcacgtccccgtcatcgccaactccaccctctacatcagnananctgcannanntnnacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaacctgtgatcacagtgctccgaagatcggctgaagcttcctgtttacacttggagggaaaagttcttttttattcctactcacccctaccccccaactaccctcttcctgggaaagtaattgctgagccagtacagccacaaacagtactattttgcagatgctcatgtaagcagcttttcgagagaaataattctttaagcagaataaagttaggctggcatgc

SEQ ID NO: 188483 - DNA, 608 bp, Homo sapiens
tgaagtgtttttccagaagtctgataccaatcttattttcttaattttataacagttttagtctggatgcccaatttctggtgactttgcagaatgtgttggcgctgattgctctggactgaccataccaggtacacagtatgccttttcaatagagagcttcaagtcattttcctttcaaggaagtttttagaatgtgttatagctagaatatacaatttgttatatagtttttggaatttgttctttgccaatgttttgccttagatcatactgttagaagaatgttttggctttttcctttagggaatcctattacatctattttttatcttgtcttctatacttttatagtttctatcatttcaaaatttctaattgtttttgcagctattttcatattcacctgttacacagacgaattattcccaagcttttctaattcagatttaaatggttctttcatatcatgttattttcttaattttttaagttcattttgtagtatcaggtggcagttttctgctgctttatggtcatatttttctgttaagtctgcactttctgaagatgtattattcagattgttgttctccccctttgttttc

SEQ ID NO: 188484 - DNA, 344 bp, Homo sapiens
agatcatattcctcaaactctagagtagtatttgggtagtatctgggtagcaatttccccttcctggacagcaatttgattcagtgggtccgggttgaggcacagttatctacatgttaacaagctccatggggtcttccaggtatagaaaccacccctacacttggtcacccctctacctaccagcactgcacagagggctgagaggtccctatgaagggactgctatggggacatcctctggaacccatacatcaaagggctcctgaccactgggtcacaagtcagagccctgaaaacaaacaccagccttgaaatctcaaacaaagaatgcttagaatggg

SEQ ID NO: 188485 - DNA, 394 bp, Homo sapiens
cctgatcccttttgatgatctactagatgctatttcatctggtccattcctcctcctgctgccctatttcataccctcaactccttgatcacgttgtctcaaccttcttattggtctttctgtcctgaatttgctaagtttgtgtcctctgcctagtatggtcttccctctgtgaatctttgcagtgttccctgtctttaggcccaaatgttacctccttaaagagggcccaaggatccacctaagtaagtagtccccctgcccacctcctctgcatgttaacttgtacttttcccccccctccaatgtggcacttgccactatttgattttttccttgttttctgtcttcccctctctgaaagcttcaagagagtagggagcttaagtcttaa

SEQ ID NO: 188486 - DNA, 520 bp, Homo sapiens
aggtttctttattcgtgttgcacgagactatggcatcctttcttccttactttttcatgtgactcctgtttgaattgatactctcatgtattgttatattaaagctaccagaggaagctaaagctgcatgaattttatagttctaccttcctgtgaaagggatgatgatgctatttttcttctgactaacaaatatttggagagatacattatagcttttcagtatctaattattactctctagctatctatagataaatttggtagttctgaaatagttatagtagctttcttataacctaatacattggtatctaaacaacacagaaacttatatactttggccacagaataagtagttttctgtccagtatttttcatgttatctttatagcatttttgagaccatgaattctttttaagaacatgagtcttttaaaactaaattgaactatgttaagaaaataatataccatgaccaaacgggtagggtgcaacacgaataaggggatcctcgaga

SEQ ID NO: 188487 - DNA, 658 bp, Homo sapiens
ttggggggcaaacatagtggattatacctgtaacctggtttcagcttcagcgtaagctttcccatccccttttattactttatatgagttgagtttattatgcaatttcttttctggtctctgatagcaacattaaacagcaagctgacattttgcagacgaagactttttctgagagctttgcaagtattacacaatctatttgttgcaatgtgaaatgtacttttctattacatttgttaccatgtcaaatttatcttgtgagaacattagttattaaataataatcacagtaccgaaatgatcattaaatttatgctgagaatcagagttttccaggctctatcaggatctaacgaggaatttaaccaaagttctctttgaataagcagtggactccttcctgtgtgttatgcttgccagactaaggggtgattatcttttctaggccatgtatagtttttatttaagaattaacaatgaggcagagcttttgtgacaccaaaacacttaggaaagagtattgctgatgtctctttatactctattcaaatcattattacacagcatttaaatatcacacttgtttcaacccactgtgcatccatccattcattcaataattttttattgaataatttttatttgccagacagtg

SEQ ID NO: 188488 - DNA, 659 bp, Homo sapiens
ttggggggcaaacatagtggattatacctgtaacctggtttcagcttcagcgtaagctttcccatcccctgtaaaacttctcttagcagtgaaatggttgacaggaatggcatccagtcacaaatttattactttatatgagttgagtttattatgcaatttcttttctggtctctgatagcaacattaaacagcaagctgacattttgcagacgaagactttttctgagagctttgcaagtattacacaatctatttgttgcaatgtgaaatgtacttttctattacatttgttaccatgtcaaatttatcttgtgagaacattagttattaaataataatcacagtaccgaaatgatcattaaatttatgctgagaatcagagttttccaggctctatcaggatctaacgaggaatttaaccaaagttctctttgaataagcagtggactccttcctgtgtgttatgcttgccagactaaggggtgattatcttttctaggccatgtatagtttttatttaagaattaacaatgaggcagagcttttgtgacaccttattacacagcatttaaatatcacacttgtttcaacccactgtgcatccatccattcattcaataattttttattgaataatttttatttgccagacagtg

SEQ ID NO: 188489 - DNA, 227 bp, Homo sapiens
aattctttaggtatccattatctgagaatgtttctattttcctctagttcctgaggcacaatttcaccagatacagaaattcacgattgacagtccttttatttccgcacttgaaaaatatcatgtcttgtccttcttcgtgttttcatacagaaaatctactgtcatttgaactggtgttccctataggtaatgtaacatttcagatggcctccatgttttcagat

SEQ ID NO: 188490 - DNA, 275 bp, Homo sapiens
agggcaagaaaatatttctagcttcccagggacacacattttgcaaatgttatcccataatgtacaaaagaagccatcacctttctgaaagcaactttttcatatctgcatagcaggcctcatgcaagaaggttaaaaagatagccacggagcacacccattcagtagttagcccatacctgtagctttacacttccctctctggactatgtcttcactctaaaaaaccaaggaaagaaaaataagtgggccatgcctagacgtctctcatgact

SEQ ID NO: 188491 - DNA, 231 bp, Homo sapiens
tctaacatatgtgtaactggaattccagaaagagagacaataagacagaaacaaaatatgaagagataataaccaaaatttttcaaaattaatacaaaagaatccaaaaagctcagagaacactaggcagcatcaaataaacaaacaacaacaacaacaacaacaaaaatccacaattagacacattatattcaaactgatggtggaaaaaatcaaagataaagagaaaac

SEQ ID NO: 188492 - DNA, 212 bp, Homo sapiens
ctttcaacctgcactcaacagaaataatgaaagatatttatctcaaaggcagataggtaagaatgtcaagaaaacaaaatagagacatgtaaaataagagaaaaaaatcataggaaaaactaagattagtgaaagaaacattattactttacctaatgcatctaaaagacaaaaagtgtaaaactggcataaatatgattgttatattaatg

SEQ ID NO: 188493 - DNA, 204 bp, Homo sapiens
acacctagagtagttcagtggagccattatagtcttctgaactccagaactgtaagatttgtgttgttttaagccactaatttgtggcactttgtgacagcagcaacaggaaattaactcagcaaggaaccctaaaaatatcaatctgggatgttatagaagaaggcttgtattaacagacctcctcccctcttggagaccaga

SEQ ID NO: 188494 - DNA, 602 bp, Homo sapiens
tctgatgctgagccgaggctggactgtgctgccgccatctctgttcactgcaacctccctgcctgattctcctgcctcagcctgcctagtgcctgggattgcaggcgcccgctgccacgcctgactggtttttgtattttttggtagagatggggtttcaccatgttagccagactggtctcgaactcctgacctcaagtgatctgcctgcctcagcctctgaaagtgccgggattataggcatgacccactgcaacccagctggtgttttatatttttatataattttcttccatcttcataatgaaaagttagcttcatttaagcatcattcagtaagggctgctgtccaacagaacttctgcagtgatggttatattctgtatctctgctatccaatatggtagcctttcatcatgtatggcagttgagcatttgaaatgtggtttgtagaactaaagtgtttaattttaaacttggttttattttaattaaatttacatttaaatagccatacatggccgctggctactgtattggtcagtgcagtatcagactcttttgtgtttgaattgcaaaatcagaatttatctctgcctttt

SEQ ID NO: 188495 - DNA, 321 bp, Homo sapiens
atcttgaacacactgcctgagatccttcctgggacttgaaataagtgactgaatttattttgaccaagtggtcccttgccctggacattggtctgtgcactctgaaggcagttgggagtaactgggatggctgtaagttggagctagaagttgctgttcactctcttctccaagcaatccctccgaagattgaaaaaacagattggtgtctcaaaaatacatgacagcacctcccattgccctgctgtgaaatccctccatgaacctgaaagggcacagaacacgctgcttcccactttctgggtgaggctgttacacatc

SEQ ID NO: 188496 - DNA, 416 bp, Homo sapiens
acgggacacttcagttctctcaaggaaaatgggatgtgataggaaaagcaaaaccaacgaacagagattcaccatgtcagagtgagaaagagtagtgggttatatttaaaaaggattttatacattggaaagtattttcacaagcatcttatttgctcctttggttatgaccccataggcctttattccaaggcaacagattttaaaaagactgagaagttaaatggcttgcctgtgtaatctggaaaattggtaacagactcaagactcacccagagtctgttatgtttcccatagcacctgtgacacccaaggtggaggtgccttaattaccagcacatacaaattatgagaggaggagcccctctaggcagtcacagtcagagcagcacaaagagactgtaatagatgatctt

SEQ ID NO: 188497 - DNA, 271 bp, Homo sapiens
gtgattgagtcttggattagaatgatcgtagaaataagtaaggatagaacaagaaatgacatggaagaaaaactgataaaactgggcaaatgtttaacgtgaaagtaacaaaacttatagagggctcactctgttgaatttaaatattaggctgtttcattggagtgagtgtggttttataaaactttgaagacctcagtcgttgaagttgaaaatgtcttaagattttgagtctggatagaagcttataggttgggatgggtgtcagcgt

SEQ ID NO: 188498 - DNA, 133 bp, Homo sapiens
ggtctcgaactcctgacctcaggtgatccatctgccttggcctcccaaagtgctgagattacaggcgtgggtcactgcgcccagcctcaggtgatttcttctttcccattcaattttactttttcaataaact

SEQ ID NO: 188499 - DNA, 722 bp, Homo sapiens
aatgagaacaaggcattagttcactgctgtattctcagcatctagacccatgcctggaacatggtaggtgttctgtcactgcaatgttgaataaataaatgaatgcatggtcctggcttcaagaattcacaacttagaaagagaaacagatttatgaacatcatcaaatgtatccgagtgaagtgatagtaatatgaagagaatattaggaaagccagaaactaaatatgaatcaaggaaaaatattgcaagatccctactgtaaaccttctttcttattaattttaaagaaaattgcatcaaaaacaaagggctgacagttgcagttccatgcatttcaaagcttgaggaaggaagatgaaaaggggaagaaaacaaaaggaaaaatacaggtatacagtagacatgattttataagcaaggattttgaatcatttataaattggttgttccaccatttcccaggcttattgtttactatcattacaagacaagacgtgaggcccagtcatgctactcctttgtgcatatcacatactcagagggtagaaaggatatatgtcccctcatggaaagactcttcctataaagtattcaatgcacttgacattattcactcttcaatcttaacctgaatcttattatgtggggtctgttatttccattctactaatgaggaatctgaggcgaagagagacagcgactttcctaaagtcacacag

SEQ ID NO: 188500 - DNA, 590 bp, Homo sapiens
tgcaaaaaaagtattgttacttacactctttggaataattcacacgttaaagctacagaaaaatatcaatccttcatttaagacctcatagaggatggggaaataatctttccatttacaaatttgttcagtaaaacgggttctgaaaaggggcttttaacttttccttgaatgatcaagtaccaatggtgtttcagaaataaaggtcaagaatgaagaaaacgagaaaaaaaaaagtacaattatatctgaaacaaacatccagcctaaaataaaattaaaacaaaaaatctcttcacaatacagtgaccaggctccatctataccttatacacttcagcttcacatcctgcaaactataaagttacttggccaaaatcacaacagtcttggccgctgttaggggctgaaatgtgtcccctcaaaaattcacaaatgtaagtcctaacctccagtacctcacaatgtgattctatttagatttagggccctaatccaatctaactggtatccttttaaatgaagattaggacacagacaacacagacaaaagaatgaccatgtgaggacagagagagaagacagccatc

SEQ ID NO: 188501 - DNA, 181 bp, Homo sapiens
cccttggaccctatccctctgtcagctgttgactcaatatttgataccttgatcattttcagattaacctaccccctctcctgcctgtttctcattaatgtgaatttcatactggaagatgaatttcatacccaccacctcaccagtattggcgagacggtcaggattaacacctgtttct

SEQ ID NO: 188502 - DNA, 236 bp, Homo sapiens
tcagcagatttctgctcatggcagatcttcttccaatgtaaacggtggacctgagcttgaccgttgcataagtcctgaaggtgtgaatggaaacagatgctctgaatcatcaactcttcttgagaaatacaaaattggaaaggtcattggtgatggcaattttgcagtagtcaaagagtgtatagacaggtccactggaaaggagtttgccctaaagattatagacaaagccaaat

SEQ ID NO: 188503 - DNA, 379 bp, Homo sapiens
gtgtgattagttaagcttctgtctcctcaactagaaagagaatgcaagccccaagagggaaaggatcatacttgtcttgttcatcactgtgtctccagcatctaacatagtgtctggctcaaaatagacaaaataaataattggggacaaaacagaccagctgaacggagtctccatggcaggattctgagccttcagggatcctcccatgggtcctgggttgatgtcccagggctaaggtactggcctgagatcagaaactaggataagctaagggaacaggagtgacgtgggtgtaatagaaagaatgtcatatattagtggaaaagatcaagcagacgcccaaagactgtgacagtgaaacaagaatgagagagaa

SEQ ID NO: 188504 - DNA, 621 bp, Homo sapiens
taaacttgggggtgctgttatacaaacgaactgtatatgtttaggaagatccttaagatactctacagcagcaactcccaaacttttttagcactagggactggtttcgtggaagacaatgtttccacagaattgggttggttgggggatgtattcactttggttgcagaagaatatatagttgaaccagcatcatttattgaaaaaattcttctttccccactgtactgtgtcacctttgtcataaatgagacaaccgtccatatatgggtttgtttctaaattttttagtattctgttgagctatatttccttgtgccaacaccatcctgtgttaacttctatagtaatatgtttttttttggcggaggggggagcaatggagtctcactctatcacccaggctggagtgcagtggtgcgatctcggctcactgcaacctccgccttctgggttcaagtgattctcctgctttagcctcctgagtagctggaataacaggcatgcaccaccatgcctggctaatttttgtatttttagtagatactgggtttcaccatgttggccaggctggtctcgaactcctgacctcaggttatctgcctgcctcagtttcccaaa

SEQ ID NO: 188505 - DNA, 251 bp, Homo sapiens
ttctagtaagaaaaaaatgcctgtctccaagtacagttattttcacgttagtgaaggtcaagacattcatttaacaattatttatttactgtgcaatattggctgtaagctaggtgctggaaatcaaatggtgaacaaggtagatatgtctctgcttttagagatctcacagtctaaagtaaacaggcaagtacaatatcatacaagcgctattgacagaaaaagaaaagacagcattcaacgaatgcaca

SEQ ID NO: 188506 - DNA, 615 bp, Homo sapiens
tcttccatgccaaaacatcaacaagcattaattgagcaatagccacagtatgttgtaaacatactgtgggaaaacaatgaccagtaacacagatacaacaccggtcaggcaaggcagatgattaagaagtaaacaaacaataactacagattatggtaagtactggttgtgctaggggatgacaggagagactacttagataggtttgtaaggaaatatccctatgaggaattaacacctaaactgagacctgaaaaataaggatttatctatatggagagtagcggaaagagcatttttatgtagagagaacagtgagcattgaggctacaggtaaagtctctggcatgttctgaggacctaaggtcacagtagataatgattgtaagtgtaaacagagtcagctggattgatagatcatacagtgtcttctagaccacagaaaggagtttgggttttattttaattgcaatgagaagccactgaaatgttctaagcaggctgtgtcaaactctgatttccatttctaaaatactttctggcaactgtgtggtgaatagttggggactggacaggagggaggaaggaatagggagacgtggttggaaactcaac

SEQ ID NO: 188507 - DNA, 536 bp, Homo sapiens
cataatttctggctgtagctttactgggtgattgtgcctaagggtctctcatagtctggggctcactcacatgacttttggcaggaagccttggttccttattggttgttggctggaggcctcagtttcttgacacatgagactctctataggccacttgactgtacatgcaacattgcatctggtatcccatagagtgagtcattcaagagacagaaagagatgacacagaagccacaatatcttttataacataatctcagaagtaaccaaacattacttttgctctattctattggtgacataaactaaccctatataatatcagtggtgactgcacagtggtataaatagcaagaggtgagggtcatcgggaaccatctcagaggctggctaccacagtctgccttctggcctccagtgattcacgtttctcgcacatgtagaatgcactcactctctccaaaggcccactagaatgggccttccgtcccattacagccattacagcatcagctcaaagtccagaatatcat

SEQ ID NO: 188508 - DNA, 337 bp, Homo sapiens
catctaataatcttagaatataacaacatgaaaatgtgacttgtgactaggaaactgagaactgtaaatgatgttaataaaaatacaagctgatctgtttggggagataagaggggggttgtagattttattttttggttgtgaaaatagaaatagggtttaaatatatttttgccttcttcaaacaatactgaagagtgaaagaagaggtagtcttgtaaaccagtggttaaaaaccatagctattctatcctacgtcttcactatcattctaagtggattgtatgagaaatgaggggggggaaaaagtactattttccagttaaggctctcattt

SEQ ID NO: 188509 - DNA, 140 bp, Homo sapiens
cctgcctcagctttccaaagtgctgggattacaggcgtgagccaccacgccaagtccttgattgattttcttaaccccttgatggcagcttttgtagatgtttcttacttccaacaataataataatgataaataataaa

SEQ ID NO: 188510 - DNA, 660 bp, Homo sapiens
gtgccattacggccggggctgcctcagcctcccgagtacgcgggaccacaggcgcctgccatcatgcccggctaattttttttcgttggtttttcgttttttggtatcgttagtagagacggggtttcaccatgttagccaggatggtcttgatgtcctgacctcgtgacccgcccgcctcggcctcccaaagtgcgaatgaaagctttaagagggctgcttgtttctggcagctctcaggttcttcctgtctgcctcagaagtggcatattccacatacgggctgcatcttcagtctggactcatcctcttcaagatgagacaggtggacgcagagctgcaccaacctccggtgatttccacacaatgtgtcctagaagaagagaccctacactgggcttgtgaccagcggaaactgaatcaatgctggagacacattctaacagtcgaatgggcagctcacaggaggtgttctaatctattatgagtcagccaaacccaattttgtgaaccaatgcaacacggacaagaatgtttgaaggcaccatgataatgccatcctatgagatcttcttttggaaacatccattagccttcaatgtcacatcttaactgcagtcttctgtctccctacaaatcgtagtcatctctattactaca

SEQ ID NO: 188511 - DNA, 386 bp, Homo sapiens
gtggggaagcagtttagtctcatgtagttccttctatagatttccaatttgagacaattttggaaggtatagggaggtagcacattcagtggttaagaacatagtcctctggagttaatgaccttggaaaattattcaactttctgaaccttagtttcttatctataaaactgggacaagagccaggtgtgggcaacacagcaagattctgtcttaaaacaacaacaacaacaacaacaacaaaaaacatggtacaagtacactatcttagaggattgttggaggactaaattaggtaactcatgtaaagtgcttagcattatgcttaatgcataataaattctcaatagtgtcaggtaatgatgataacagaaagctataatagt

SEQ ID NO: 188512 - DNA, 477 bp, Homo sapiens
agctatgttaaaagttagaagggaactctattcctgtcaagggaattatatgttttactcctgtgcatttttctcattgatagtcttatggaggaagttaaagctgtagaaatgatttttaaaattaaatctttccaatcatttctactattttggttattttgataaggacaggaagtaaccatggtttcactttttggacttgtttgcacgcaatccaggaaaaaattttacagacttatttctaaatctttctaaaataaaaatgtgtgtgtgtgtgtgtatgtgtaagtatgtgtgtgtgtgtgcgcttttaaattttgaaccccaaaccctctctagcaatcccaccttatgtttgggttgcagtgacatttctttattaatttttatgcttatgtaaacttcctgtgtttctgcaagttggaccaacaaagaagttggctacctctgtcacatcagatgtttgaggtacaa

SEQ ID NO: 188513 - DNA, 303 bp, Homo sapiens
gcatgtgggagaagacagcatgtctaggacattacgctgaggctgaggcagtaggcaaggaagtccaacctgcaggctaagagtcagttttcactcctgtgggaaaagcatgcccagctctcagcaaaagcatagaaatcaagagagaacagtaaaggcaaacaggatatgtagcctagttccagttgaaggtattattcctaacaatgaaaaatgtcaatataactatttccagagttaaaacttcagacacatgctatgacaatgagacagtatgtttgaaactacagatgtccaaggaaa

SEQ ID NO: 188514 - DNA, 550 bp, Homo sapiens
atccgtttcttgaatgcaaccagtgcatggcagcctttcctatttctgttaatgctaaaaggctgctgcatggaatctctttggttggtaaatagaacagagcaggtcacaggtcatcccacacattgggcagccaccggatcattaaatggttggggacaagaggaggctcctactcggcaatcagcctctaatactcccagctccatggattgctttctctcccctaccaagaatactgccatccaaggagacgaaacataaacttggtggagctggtggggaagaagctaattttctattacagagcatctccatttcgcacagagccctgaaattgtgtttatgaacctaatgtgtactttagaggaatgtggttggcagtaatgagctcataactctcaggagtttggaggccagcgagtagcagattgttgaatcaataaaaatagcagtaagtacctctgcggctcttctgttcaaggacaaaagtggctactttgggggcaggagacgtactttctcccttgcttgtagaaggtgcatattc

SEQ ID NO: 188515 - DNA, 433 bp, Homo sapiens
ctaggaatgataggagctagggaagtagagatggggagagcactggacaaacagcagaaacagcatgtacaaaagccctgaggtcagaagagctgggtactccttgtactgaaaggaggccacagtgagggagcaaaagatagaccaaagatgaggttgggaagtagacagggctgaatctggcgagaacacacaggtcttgggaaggactcttgactggaaccagtgagtggttttaagtggtggggggcatggctgcagttcttgctgtactccagtagctgaaggggtaatggcttagagcgggtttcaggagaccagggaggaggctatcttccaggggaagagtggttggacttggaggggatagtggagccggagagaaggggcagagccaagatgtgcgcagggagtgggtacaataggacctggt

SEQ ID NO: 188516 - DNA, 261 bp, Homo sapiens
acataggagtggtaaccagaaggaaatgaggagtctaaacaaggttagctttttaaaatgggagatattgtagaatgttggtatgccaaaaggagtgattcagtcaagaggaaggaattgatacaaaagaaagaggggctaattatagaagccaagtcccttcgtaggtgtgggagataatccagtgcataactggaggagttagtctttgaaagtatatgaccatggagtggttggctgtgtgtggtggaagaaaagata

SEQ ID NO: 188517 - DNA, 321 bp, Homo sapiens
tatagaggtcaaaattgttttcataataatactagtgagttatttgcctttttcaccatatggacaaatgctgctatagcaattgtgggggaaaaaaatagatgaagccttatcaaggggccaaatcaaagcagtggcacccaactgtactagtagtcaactcttcatcaccatgctctcacagtaaaaattattaattttactaaatcttgaccctgaatacacatcttaacattttacatgacaaaccgggaagcatgcatgaagcactcctgttgtgtaaagaagtatgaagactgaagaaaaagcactgtgcaattg

SEQ ID NO: 188518 - DNA, 409 bp, Homo sapiens
gtgttaagggaaggaatgcagggatcttaacgctacttcttctatcatgtaaaacccactcaaaggactcagtccacctctgtttttggctcttacccatggtttatgcagactgagtaaccaagctaagccagcaacggaggacaaccaagtacgttgtcatctccatagtgggctggtaattatactccagtccatctgaagcagcctcattgtctggggtgataaccaaggttcactgtctcatggccagggaagtcaaggacgcagacacacaaagagtgaagtaaagagtggaagtttaacaggcgtaagaaacagaatagctctctgctggagagaggggtcctggaggaatggatcaccggatccacagtggaatgcaggggggtttatagatgcctggtga

SEQ ID NO: 188519 - DNA, 272 bp, Homo sapiens
ttttttgtagagatgatctgtgttgcccaggctggccttgaactcctggcctcaagcgatcctcctgccccagccttccaaagtgctgagactatagacgtgagctaccgcacatggcctcaccttcattcttaaaagatgttttggttggggatagtattttaagagccttagttattttcaacatattgaggattctgttgtcttttagtgtcttattgaagagaagacagctgtcagtctttttgtgcctttgaagttaatctaccttt

SEQ ID NO: 188520 - DNA, 358 bp, Homo sapiens
aggatacattgtgaaagcatcactaccatcaagattataaacatattcatcacctcccaaagttctccctcccattctaattattatttttattggtaagaataattaacataaaattcaccctcctattatattttaagtatgcaatacagtattcatagctataagcactaagctgtaaattagacctcctgaacttatttatgtggtatatctaaaactttgtactgtaatcacacctacacacttacctgcaccacagctcctggccagtctaccctctgcttctgagtttgtttttttgagatttcaaatacaagtggaatcatacagtatttgtcattctgtgtttggttta

SEQ ID NO: 188521 - DNA, 577 bp, Homo sapiens
tcaggccagaaggtcagattcttactgcttttacccacagctcagcagttttccaagcatcagtgcttctcagattatccttatcagtttcctttttgtcggagacaaggtctccctacgttgcccaggctggcgtcatgcggtcctctggccttagcctcccacgtagcatatgctaccatacccagttctggattggctgatctgaatcggccctacccagaagtctgcccccaacaatttttgctcattcactctcctgtctttaccttctgggaaatcaatatgacagcccaaatttcatctaccaacctccacttctatcccaagctctactctcgtgggacaagacacactcaatgtctggcacagggcgtggcatacattaatgtttcacacactaacaggaactaggccaactgaaaccttgctcacccagcagcggtctcggaccttgacccctgggcctcagtgtctcccacacccttcggcatcaacaagaaccagcgccctctcatcatctttacatgctgtgtacccagccctggctgctggcaaacatcgctgcacacgccct

SEQ ID NO: 188522 - DNA, 211 bp, Homo sapiens
agaagatgcaaaagccagaataaatgctaactcccagcttttttacttagacaaactggatgtatgttgatgaaattggctgagatgaaacaattgaagaggaacagatttgtgagacacatgaccaagagttgttcttgggacacattaaatttgagatgcttgttagagatccatgtgaagagtgtaggcagttggaaatatgagtctg

SEQ ID NO: 188523 - DNA, 457 bp, Homo sapiens
gtctggtttcaaaaagctctatgacctgaatatttccctctaaaaatttatatgctgaaatcttaaccctgaaagtgatggtattaggaggtgaggcctttggaaagttattgggtcatgaggggtctacccttatgtgattagtgccattacaaaagttccctagagagctacctgctcctttcaccatgtgggaacacagcaagaaggtgccatctatgaactagaaagttgggcctcaccagacttgccgctaccttaatcttgaacttcccagctttcatagctatgagataaaaattttgtgccttataagccactcagtctatagtacctatttcaatacaacagctacagaaacaaagataggaagaatcaccaactctttctttttctttttaagaatatttgaattgtgtttattctaagatctgcccccgatttatacttttccttt

SEQ ID NO: 188524 - DNA, 342 bp, Homo sapiens
ccttttcctagacaaaatagtttcgattccactcaagtgcaatgtcaacaaaaccagcaacgaggcaaacttcccagcaacagagccactaaccaaatttcactcatgtatcacagtagtagcaggaacttggaaacccttgtccactcaacaattattgttagatatttaggagagagcctgccatctgtgacgtatgggcaatcccagcgcccggctcagtcctgagaaactcatgtgctttctggccctgagtcataaggacccgatggcattccacagccaaagaaaagagtgaatcatttaaaacagggcttggcgtcaatcttgagactaagtcac

SEQ ID NO: 188525 - DNA, 262 bp, Homo sapiens
tgggtcggttctgcaaatgacttggagaactgggctcttcttcatcaggcttatgtcagcctgaggttataagccaagcagacagctctattttcagtcttcagtatacatgatgagtatcttctacttctaggaaagttctgttcactggagaccctctggcccaccctgaaattggatacagggacagggacctgatctgtgttttattcttctgccttgtcatcagcttctttcccatttgattttcctaatttctatg

SEQ ID NO: 188526 - DNA, 373 bp, Homo sapiens
aagtcttaagtcagtctgcctccatgctgagcccagctgaatgaaactggttctgagcacagcacaactgcagaagtggatcacactgaaaggaaagagaccagactgagccgaggctatcaacacccaaagaaaagaaagcggagttactctgctagtgctttttatggatgtgcattccaactcaggagcacacagagctgaactagggaagagcaatccctcttgattgggctcctgtcacttgaacttgagtggtaaacactcaactacagatctgaatggtatgagaggaagaatggcctgggtacagtgcggctgcttggaagacttggccacgggtgggcaaaagatagtgctagacccacaactt

SEQ ID NO: 188527 - DNA, 473 bp, Homo sapiens
tgaggctagtgtcttgacaaggcattcaggggaagactttgcagaaggcaggatcaaagtagtctgagtgcatggagaggttaaagtaagcaaagatattttctgtagagatgcattacaggagaattaaagaggaaacacttttggccctgctctctactaaaagaagacaaaattggaagcacttcagtgaagcagtggggttgaatttcacttctaagggacagggatcagtgggcactaggaaattagtgagtctggactatttctaaagaaagtaatccattctgaaacaaagttcacaagtgtaataaaaagtatactgttttcatgaatcttcatctttcaggctgagtttcagttttttctttgtctttaaccgtgtcagtgggctgcttactctgcttctcatttgctgttctttccttccatgaaaagaacccgtttgtaactcttccatttcttagctgcat

SEQ ID NO: 188528 - DNA, 372 bp, Homo sapiens
caggaggctgaggcaggagaatcacttgaatcctggaggtggaggttgcagtgagccgagattgcaccattacactccagcctggacaacagagcaagaccccatctcgaatgaataaatgaatgaataaacaaataaatagctatatgtggcattattttaagcaaatggtagaaggtaagaaagagattccatctgaatgttctctgctgagtagcatagtgattataacactggagctgcaaggaaggaaatgtaatcacagacctttccttttctctgcagagaatatttatatggttgctagaatgtaagcactatttattgtattttgatttttaaaatttaacctatagccaaagctctgaacaa

SEQ ID NO: 188529 - DNA, 206 bp, Homo sapiens
gggattctcagatcgtgcaccgttcagccgtttgatggaattcgcgccaccctgaccagcgagcccagatggcgcttaaatctgtcactctttaacgaccctactgttttttaaaaatatttttatatttgagctcattcagttaatctgagagattaatcttttccaagatatgtctggggagggctttactgagggtttcactt

SEQ ID NO: 188530 - DNA, 337 bp, Homo sapiens
ctcaaacagtgagtacattttgccccatcaattacatctctcagaattcatcctaaggaaaaaagaaaatgtgtaaagatcaagtacaagaacattcatgaaagtgctatactatcacataaactagaaatagatgtcccacaagaagatctataatatactgtggcacttacatacaatgaacttctgtgcagcaattaaagtaatatagaattatcatagagagatgtcatattctatggctattgcataacatggaatctatgacaatatctcatagaggacctatgaaagggaagggaagcacgattgacccaagcctcaaaattaaacttga

SEQ ID NO: 188531 - DNA, 551 bp, Homo sapiens
tgcctgtagccacccgcctaggagcattaattgaaaattaatccgctcggtacgtgccggcgtgcaaatcaaagctaagtgtctcaattaggaagagaaatggagtcgggcactcttctcagatgctggcttatttatggggataatatcatttttaatgagggaagctactaaaaggcacaacaaatgcaacatttaatagaaaaatattacagcattccatcagcagaacacagccaggagagtgggttccagggatgcaggagcacgcgggtgtctctatggttgtccaagcaccttgtacaagcatgtgtgtgcacacgtgtccccatgagccctcgtgtctgcatgcacactgtacacggacggctgcatgcatctccttctctggatatgtgtgtatgtgaatattagtgtctgggtctggtgtttggggagtagtgaagctttccgctgtttttgctgcaaaagatgaatttcccatctgccgcctaaagaactgtcattctgggccctgggccagccaaataaaaatctaaggtatttcccaa

SEQ ID NO: 188532 - DNA, 422 bp, Homo sapiens
caggctcgtaggtgaagagacttgcgtagtctcagatgagactttggactacagacttttgagctcacgctgaaatgagctaagaattcagagactgttgaaaagggaggattgtattttgcaatgtgagaaggacatgagatttgggaggggtcaggggtggaatgaggtggtttgaatctgttttcctgcacaaatctcacgtcaaattgtaacccctaatcttggtggaggagcctggtgggaggtgattggatcatgggggcagatttccaccttactgtccttgtgatattgagtaagttctcaagagatcaggtggtttaaaagtgtgtagcacctttcctttcattctctctgccttctcctctggccacataagacatggttcctccctctttaccttctgccaagattgtaag

SEQ ID NO: 188533 - DNA, 524 bp, Homo sapiens
ataattttttacagagtgaatgtagagatggggttttgccatgttgcccatgctggtcttgaactgcctggctcaagtgatctgctcacctcggcctctcacattgctgggattacagatgtgagccattgcatgccagggcgatactgactgattttcataacttagcttgcaaagtggatatctatttttctttatttttatttttttggagacagagtcttgctatgttgcccaggctggtcttaaacacctggccttaaatgatcctcccatctcagcctcccaagtagctgtgattacaggtgtgagtcactgtacccagctattttttcaattttttaaaattgtggcaaaatatacgtaatataggatgtaccatctttttaaattatacagttcagtgatattaagtacattcatattgttctgtaagtatcacaaccatccatctccagaactgttttcttcttgtgaaactgaatttctatatcctttaaacattcactctgtaccagtcttgc

SEQ ID NO: 188534 - DNA, 382 bp, Homo sapiens
acctgactaatgcacactcactgccgagggggcctttaggcctctggtttcacacttcttttgtcttgtctgtcccttggtgttgatcttgctttagagagagtaattggaacgagagcgtgttatttctgcttgagaatgggtaccccaaatccagtaggtagatgcattccttcatttctacagaggaaaaaaattgccagtactatcctgatttggctggttgcacttcagggtttcagctttaaccattttagggactattgacaaaagtaaactttttatatgctgaaatggtgatgtttgggggtgtcagtggtcttaacaggaaagcccttcttcttcactagcaaccttgcattgttctaggaaattccagtcc

SEQ ID NO: 188535 - DNA, 506 bp, Homo sapiens
ctttgctcactgctgtatcaccaaatgattagaacagtgtctgtcgcataggagctcgacaaatacttgttaaatgaatgagtggcatagaggtcatggtgcactagaaagtgaacgggccctggagtgaagctcacctactccccgggaagctcagcttctcggagtctcagctgatgggatacctgcttttaaagatctccaagtcccttcttaccttcccacaaaaaacgcagatcatggcccatgcctgctgttccacctcagtggaaagcagcgggaatgaagctcaagcaaagaccaggggtggggcctggctgtggagcccactcctaagtggcttcagacggcatcacgcaattggtgtggagacaaattcacccccgactgcatttgcatatgttgaggttaagatgaactttcactctctgggcacaacacacaagcagggagccccaaaactgagtgaacagtggcaggggcagccaggaacgaagaagctgctg

SEQ ID NO: 188536 - DNA, 713 bp, Homo sapiens
ggtggtgcatgcctggaatcccagctccttgggaggctgaggcaggagaattgcttgaaccagggagttagaggatgcagtgagccgagatcgggccactgcactccagcctgatgagagagtgagactgagacagtgaaaaccctctcctgtctctctcgcctgggcgatagaggagggacatgttgagatggcaagtcacacagggtgcagcctgactgctgagtccctttagagagcagagatgtcctagagaaacacttgccttgcattcaatttgatgttagctggaataaaacttgggttcagccattgagatttcagggctgtttgtcgtcatgacgtaactctgcctacgctgctagtccactaaggtggggatccactgtagtcatctgccatggtttagttacctacctcctagtgctggacacttgggttacttccagctctccaccgccacaaacaaagctaccacatgtcctcataaggacctgagcaagtttctgtggagtccatgtccaggagtttgcaggaacatagaatataggcatagttcatgtctctaagtacagccagattgcacactagagtggctgcagtcctttatgctcctactcacagttcatgaggttaccatttctgaaaccacagtatattttagcagcttaaagcatggactcaagtcagatggcttgacttggaatccaaga

SEQ ID NO: 188537 - DNA, 320 bp, Homo sapiens
cactgtgaaggtccgcggcttcattcctaagtcagtcagatcagaaacccagtggcgggaaccaactccggacacaccgggcccaccaaggggaagaatatggtagactggaggatctgcagagtcaacgtgtataagcaagacctgagggagtatgattgggatgggtcccaagggtgctgaatcaagggagactggatttggaagtggataagggagagtttgtcagtctaagagcacggtcccatgatgccggttttccaccatggcaagtgccttagggtacggggctgatatgcttatgggttggccgttggaca

SEQ ID NO: 188538 - DNA, 349 bp, Homo sapiens
ccagagcttgcttatctgcagttattcttccaaatcacggagaaacacaaaatccagataggtcttttaagtacagcaaacacacttccgtgtgctttaactgacacaaatatgtgtgatgaaatgaaatgcacagaatcgcaaatgttatccttataggcaatgtgttccttcatttcacattttaggcaatcacaaagcaattaaacttctgtgtgcacgggacactgaagtcatgtgtggcatgcttcctgggactcaaggcgtcgggcttgttaatgggaaggagggagtcagaaagataggcttattcattccctggcagttaaaatacagactggctgaatca

SEQ ID NO: 188539 - DNA, 305 bp, Homo sapiens
gcccttttctctcttctctgcttccatacacaaattcaacttcttcaaccccttgttttacacatttttagtgacactcttgcccgtgatgttatcatttaaaaactttatttaggctgggtgcagttgctcacatctgtaatcccagcactttggaaggctgaggtgtgcggatcacctgaggtcaagagttcgaaaccagcctggccagcatggtgaaatcctgtctctactaaaaatacaaaaattagtccggcatggtggtgggctcctgtaatcccagctactcaggaggctgaggcagg

SEQ ID NO: 188540 - DNA, 595 bp, Homo sapiens
ctgtgagactgtaaaataaaaaccaagttgcatacttccaagatacaattgtgttccaggaattaggtaaatattctcataccaaaggaaaaaaaatggccaaaagaaaggggtaataagccccacataattctgaaacccagcagagctgtcattaaatcttaaatccccaaaattatctcctttgactgtatgtcctgcatccaggtcacactactgcaaggagtgggctcccaaggctttggtcaggtccactgtggctttgtggggtgcagtgtggctgctttcatgtgctggagttgagtgcctatgacttttccatgacgagattgcatgatgctgttagatctaccattcctcagtttggaaggcagtggtcttcttcccacagctccactgggtagtgttccagtggggacattccatggggttccaatgccacatttccctttggcactgccctattcaaatatctgtgtgggactctacctttgtggcagccttctgcctgagcactcaggctttctgatacatcttctgaaatctatgtggaagctgccaagcctcctttattcttgcattctgtgcactagca

SEQ ID NO: 188541 - DNA, 121 bp, Homo sapiens
gaatattagaaatcagtattggggtttcttttaaaatgttttgtactaagaatgaaactattttcaaacagtctttgaaaattttgttttctcttcccactcttgaatcctctactaggct

SEQ ID NO: 188542 - DNA, 515 bp, Homo sapiens
  misc_feature (510)..(510): n is a, c, g, or t
tagaatcgagctcggtaccagattccctttcaatcctccccctttccatccctattactttttaacatcattaagattcattataaccaaagtgtgtcctagaataacctcctacggtttactcgtgtgcagaatgtggatgagaaggcctgcctgcctgcctcagaagtgcaagctgtgcatgtgttcaccatcagcaggagcttattacacatgtattgaatgactaacatgggctgtcaactgtaagccctgacaaattcgaaggtgtttgttgctgtgcttccgaatgcatagtgctggttctaaatgtgcttgttgccttgcagtgcatttattgggcatgttgctcttttggcctatgtggtgatgttatcagcccaggtcctctgagaagcagattccaagaagggattagacctgcatgagatgagattgactgggagaaagacctgagaaggaccaaggggagggagcaggagctggcagactgccgtgcaggtctgacancccgt

SEQ ID NO: 188543 - DNA, 327 bp, Homo sapiens
ccactgcactccagcctgggtgacagagtgagactccgtcttaaaaaaaaccttaaagaatcagttagcgaagcaaaagccaatagggagggaatataatttctggaatgtctgtctataagggaataaaggctgaacctacaaagaagtccctaaagttctgatttaaatacaagaacaacgttatttgcatcatagcactttggagctggaaggatcctcaaaccatttagttgtagtggctaattttgtagaggaggaaaactagggcccagctaggggcctggtctcccaacttttggcttgacagtggcagctctaccctcc

SEQ ID NO: 188544 - DNA, 512 bp, Homo sapiens
cttgcactctcccctccccaccttcaggcctggatttctttgatatccagaggggccggagtttgtcctgctcctgtgacactgggaacttcattgttggctcctccttggggatgaaggcccaccctggccttgctccacgctgcctgatgccctctcctgctgtccttctgctgatggccagcacagctcccaatgagaccctgaggggcacctcccttctgcacctcctcagtccctctccctttccctctgtcgcctggctccacctccagctggacctgattgagaatgggaacatccttagtgtgggtggctaggtctgctgaacaggatgagggcacattaggtgcatttagaagaacctgggaaagttgcaatgaatcagtgtccctcctgtctggtgtttctgcctgttagagggtagggactctggggctggtcatgtggaagattggctaggggtgcttgcgatgggcttatggtttcgaggaagggaagagggaaatggt

SEQ ID NO: 188545 - DNA, 429 bp, Homo sapiens
  misc_feature (118)..(118): n is a, c, g, or t
agagctttaggctgacaccctgtgagatcttgggctatgctactgggcttacgagggccttgatcagcctggcacgtgctctcatggcctaggcatagtcggcctgcatcttctttgngcccttatagttgtgcttcttggcaaagcgcatgttcctcaggaacttggggtccacccccttaagagattcgtatctacatgatggggttgcttgtttttttcttgtacatttgttcatgttccttgtagattctggatgttagccctttgccagatggatagattgcaaaaattttctcccattctgtagcttgcctgttcactctgataatagtttcttttgctgtgcagaagctctttagtttacttagatcccatttgtcaattttggcatttgttgcaattgcttttggtgttttagtcataaag

SEQ ID NO: 188546 - DNA, 797 bp, Homo sapiens
cagtcatgctcctctggttcatctcgcatcctgtgttgtccacattgcacccctgtccctttccatttatcacgccagtcttgacaaagaggcatgctgtttttttccctgctttaacctgtttcagaaatgctgaccttgcgaaggtcttcaccaccatgaagtttcccagagagactctcaccactgctgttcagacacaaggaccatgccataacctgtcatcaggaaagagactatgttaaagaaggattttcatcctgtcttatgaagaaattccatttcaatgctgcgataatgcaaagtaattcttctcaaccatctgaaatcacaattgttcctttctggagatggcatgtgaagatattcccaagactgtgactaagttggttggaggttgtaacaccatcattccattgcctctcgctgctctgctgttgctttccaccagcgtaaaatcaattaagggaaaggcatggaaggaatgccctgtccaccgttgataaaattgggagaccctaatggacttaagtcccagtaagaataaatccagatatccctggtaggttgtaaaatggtttgttggtcagaagcaatgttgtgggggatactatgacagtaaacaaggcatctggtaaatccccggggccaaaacttagagaatgcaagaaaggcaaatccatattctcgcagagtacaaaaataaatatctattccagtgacaataaatcactttcttctctgtggacaaaaacgaatctcatgtaattgacctgccatgagttgccagttagtgc

SEQ ID NO: 188547 - DNA, 708 bp, Homo sapiens
agtgtcttcagtgcaggaggtagggagcaagcgtgaagcagggtgggcagcaggcctggctcagatgccggccatccctctatgtgtgtgtggttttagcatgcagactagaagtaaaggtgaatccgtttataatctgtccacctcagaatctggggaaatccactccccatttcaactgcttttaatgatattctataccccaggttttaaggatatgaagagcaaatcataaatgtgttaattttgtaaatgaatacaaaagtaattccagagtttaactctaatatataagagcgcttaagttatttttattgattctgccatggccctccagtgtcctcctaattgattagctaagcatgtccagtttaatgtcagtggctttcagaggctggcctcttcatatgagctactgctgggaggaaggggcataaacccacacctgaattactctctattgtctggactacgaaaagaatacttgactacaacaaagaataccggaatatctagagaattacaagtcttagctctgtgatctagtggttgtgagaatttggtcaagtcctttaactttcagggagggcctaaagtttcctcagccctcaaatgaagacagggtgaggtgaggatcaacttaaataaatggagtaactggtttgaaaagagtcaagttccatatgagaataaggtattatgttcatt

SEQ ID NO: 188548 - DNA, 465 bp, Homo sapiens
gaggatccccatggccggtgaagagccacatcacaaaggagcacctccaaatggccaagaagcatatgaaaatatgttcaatctcattagccaacagggaattcaaattagaactacaccaggatggctgaaagtgcaaagactgacaatatcaagggctggtggggatgcagaacaactggaactctcctatgcactgcggaaggggtaaattaataccgcccctttggaagaacagtttagaagcatcactaaagctgaatatattcatgcctactccggaaatcctgagcccagtggctccctttgaagaactgccttggggttcatgttgcagcatcaaacagggatggaagatgcatcttgctttagcagcaggagcctggaaagcagctgaagccctggagggtgcctggcacacagaatcttgtgctgagcccggagcacaatgggagcgggctggcg

SEQ ID NO: 188549 - DNA, 498 bp, Homo sapiens
cttagacattacacattcttaattttgattcaactcctggaatatttttaaacttcattttagttgtctagatttcactttttccaggaatcctttcttagcctctccaagtttgagatttgcccccttctttgtgcagtgataatcactctgtttcctttatcataagcatttatgctattttttaattgcttgtttttttctcaccaagttcaaagtgtatgtgtgtgtgtccacaaagaagtgtgtaccatattttccccttccctatctttctggcacttaccaaatacataaatatttgttgagtgaatgaatttttaatacattcactctttcagtgcaaaaaaaaaaaaaaaagaaccacaaatctaatggaaattgagtaataaacttagttactctctgtctttgttttgttcggttagatgtgcagagttaccttaaaatgtgttattgtcaaattgtgctaaaagtttttaatgtgccaggcatctt

SEQ ID NO: 188550 - DNA, 618 bp, Homo sapiens
gagacggagtcttgctctgtcgcccaggctggagtgcagtggcgcgatctcggctcactgcaaactccgcctcccgggttcacgccattctcctgcctcagcctcttgagtagctgggactacaggcacccgccaccacacccggctaattttttgtatttttagtagagacggggtttcaccgtgttagccaggatggtctcgatctcctgacctcgtgatccgcccgtctcggcctcctaaagtgctgggactacaggcgtgagccaccacacccggcccctgacccggtgaaaacttttaacccctaaacaagaatgactgctgtagcctctccggatgggatgagaatattcacatttcattctcataaaaatgctaccaaggtcaggcacagtggcacatgctacctgtaatcctggcactttggaaggctgagttgggcagatcacttgaggtcaggattcaaaactgacctgggcaacatagtgagacccatatctattttaaaaaatgttttttaaattaagctgggcatggtggagcatgcctgtagtcccagctactcaggaggctaagacaggaggatcacttgaggccaggagtttgagatcagac

SEQ ID NO: 188551 - DNA, 400 bp, Homo sapiens
gcaagtcaggacacgctcagtgagcaaccctcagaatgcatggacagccagccactagtttaccatgcactggctcattcacgcacccagtgaacaaatggttatgacgacccctgtcctcctgagatttacatgataatcactctaatttctctgagaagaggactcagtggaatgtatttgggtttggggcttggagtcatgctggcctgggtctgaattcttgccctgctacattcactgggcagcaaagggcatgtgtgccacttcctctttctggacccaagaatgccaccacttccctcccaagattcagtaaaaaaaaagctaacatgacacatgtgaggcatccagagtccctgtcaccttagtcacttaaatgttggtgcgtccgtagcgg

SEQ ID NO: 188552 - DNA, 292 bp, Homo sapiens
atctttaggcaatatcagtatctcagtttagtagatacataaaattaaccaccgcagataatgattttttgcataaattcatttatcatgtatttattgaacctctgtcttgtatttaatcttttgaataatataaagagctatgagataatttttttagctggaggaacataacatccaaattcctctcttaagaatagttttggacatgggctgggaagaaagtcttagcatgttcaaaacagaattcttgatttccaccacccatcacctgccacatttgcctacacaa

SEQ ID NO: 188553 - DNA, 115 bp, Homo sapiens
ggtcccaactccattgttttgttaaaagtaatcatttaaagattagctcttcataaggccagttaccaactattaaatattcaaagcaatatagttttaaaatctcctacatata

SEQ ID NO: 188554 - DNA, 340 bp, Homo sapiens
aactagttatcctactccctcggtaaagaactaataggctcggcacctacttttcaatcatttacattttgttacaccctatcagcctcaaaaagaaaagaaaaaagctataccaaaaaaaaaaaacaaatttaagttgacaggtacaataactcttacaggaaaagagatgtgaattatgttattctagtaactgattcttaaatgatacacctacagttttctaatgctctaatctttctatcctcaaggttttccagatttcagagacagcacaggcagaaactaagtgtatataccacttgatcaagcttactgcggatttattcttggatagcta

SEQ ID NO: 188555 - DNA, 556 bp, Homo sapiens
ttcaaactaatattgttctttgatgagctacagagtgcatttgtttaagcagttgttggaaagcagaccctgcatggtagactggaaagaacattggactagaactgggaaaatcagccatgtgaccttgttaagatagggacattcgttttctatagcctcagtttcctcatctgtaaaatggccataaaaattccaattctgcttatttcataaagatgatgtgatcaactccctcacttcacacatgaggaaactctcttgaggtcatatagctaattggtgacagtatcaggactcaacataaaagtcttttgaagacttggactttctgtagtaacaaagctgccattgaagcaacagataggaaagtgctttgaaaaatgtcacataagggttttgttcagtagaagtaataggactatatctgccaaagtcattttgtggcaattaattaggaaatgccttttgagactgtacctgtaccttcagatacaaccatctttattttaaaatcaaatacactctatttcatttctcaacaatgacactagaa

SEQ ID NO: 188556 - DNA, 299 bp, Homo sapiens
tgctgtgctggcaggtgtctcccacaagaagcttctaaatatgacttcacagagatttcttatatctgcaaaggatggtacttttttgcatttaatagtgaagaattgcttgttttgtgctcaagacagaaagacatttttattgttgttgttgttgttttttgagatggagtgtcgctctgtcgcccaagctggagtacagtggcatgatctaggctcactgcaacctctgcttcccaggttcaagtgattctcttgacttagcctccttggtgccttggcctctttggtgcctctgg

SEQ ID NO: 188557 - DNA, 387 bp, Homo sapiens
gtcaataagagactgaaaaattactggctgaagctcagagaacctttgcttaaaaggagcctggctgggctgagttatggtgtcttgccttttctgcgtcctgctagactaaggatatgatggctggcactgcagtggccacattgcaattttgaaataatcctaaagttggaagccatgtgctccttaggaactaagagagaaggaacctgagttccaatgactatagagtcgccaaatagacctagacgactgaaatataaacccctaatttgtttataccaaatgctggggagggtaggggaggtgtctctgttatgcaaagctgaatctaattcttcacagacaaaatgtctaaatcacttctgtgtgactatggaaagacat

SEQ ID NO: 188558 - DNA, 183 bp, Homo sapiens
gcagtaagaaacttacaaaataaaactttgatttcactgtcttagccactcccctaaaacaatacctttttcttctttccatattaagaaaaaatcacttgaaataaaggaataaatgggggaaaaaaaaaagtcccttcagtgaccaggcgcagtggctcatgcctgtaatcccagcacttt

SEQ ID NO: 188559 - DNA, 282 bp, Homo sapiens
cagtccctttggagagaccgctgtggaagttaacacaggtgaggtgtcagcaccttgcctggtacaggctgtaagcgcttcatacatggcagttgccatttttatggcctcatggaacaagggacttaggtaagattttcagaaaccatgatgcttcgaagacagcagcgggccaggggtcaggagcctggcactgacttgctgtgggacctcgagccatcatttcccttgtctggaagctgggggcctgggctttaatgagggccatagacccccctaagg

SEQ ID NO: 188560 - DNA, 236 bp, Homo sapiens
tcctacaagaagttacatgctacttgccataggcatttttgcattttatgattctaaaagaaagaatttttgtgcataatgccttcttgcatagctaaagatctacagagaatagaattgaaagtcttctatatttcaatggaatttagacagtccttagatagcatacgtgtaaagggatgttgattgacccagtgccataaattatgttgtgatgaaaaggaactatgtgaaac

SEQ ID NO: 188561 - DNA, 502 bp, Homo sapiens
ctcatttccaagtagtcgccttttaaggataagaacccacagaagttaagagtcaggcaaaattgggagggaaagagtaagaaagccaagtattggatgtgtgtgatctaaccaaggacaaatcacaactctccagaccaaggccactgcaactgaaaggttacagaacaaaagatactggactccagccacaccctaactccagaggactcagaagagatcttaccacgacctcagctagagaagcctacacagcacacaggagcctgaacttaggaccactttgttaggaaagggacccagggacaagtcaccactcactttaacttcttcccacatgggacaacataaaatgtgtagagagacaaaatccatgggagccccactatttttgagaagcaagaatatctgctgctctctgagcgccagggatttccaaaatgaagcactgcatacctcataacagctcccaccaatagaagtcaagccaatatatcactaa

SEQ ID NO: 188562 - DNA, 403 bp, Homo sapiens
aggctttaatagagcaacatatatcacgatgtcctaagcaaggtgatatatacagtgtattactgccttatttaattatagaatgctttttctgtgggtttcttgaatttgagcatagtttgggaaaaaggacaagcacttaccccgtgtgctggatacttactggttgtcccggggcatctatttctcacattcctctttccccagatatatttggtaataagttatttaataccagatttgatttgataatcagttgttcaatttacagtattgggtgaataagtttttttaatgtattttaaatgtatgacagttgtattttatcatacaattattatgataaaaacactcatttacttcttcggtctcatctggtctcttgctatcctgatggcaggca

SEQ ID NO: 188563 - DNA, 388 bp, Homo sapiens
attcacttccaaggctttatgtaccataccatctacatactgactgccaaactgtttatctgcagtcccaaactgtttatctccaggttctgtttctgagctccagatttgtagaagcatctgcctacttgacatttctcctttgatgtctaatatgcattcaaacatagtatgtattaaataaacctcttgattttttcctccaaagccttttcctcttctttttttatctcagtgaaagttaccatctactcatttgcttaagtaaaaaatctagatgtcagacttaattcatacctcccctgcctgtctccccaaacctcacatctaatttatccgtcctttgttggctcatctttaacataaatcctcaacctctccatttctc

SEQ ID NO: 188564 - DNA, 791 bp, Homo sapiens
cacagaaaaaaccaaatggaaattctggaagtaaaaagtcccataactgaaacgaaaaattcactagagggactcaacagtatatttgggctacaagaaaaatctactaaagacagatctatagaaattatgcaactggaaaacagaaaataaaaaagaagaaaaatgaacacagccttagagaaatgtgggacaccattatgtgcaccaacatttgcataacgaaagtatcagaagagggaaaaaaaagtagaaaaaatatttgtggctgaaaacttatccagcttaaggcaaaacattaatctacatattcaagttcaatacactctaaacaggataaacacaaagagatctacacccacatacaccacagtaaaactgttgaaagacaaagaccaaaaaataatcttaaaagcagaaaaagaaaaatgatttaccacacacaagggaactcctgcaagcttgacagctgactactcatcagaaagttctgactagttctcaccaagatattatcaatagaagtacagtgtgacatttctaggctggagcaccgcattgccaaaccctagaacactttttcttccggcacagtgaatagcaacactcaagatggcggctggtccatcagcccggatttcataattacacactttgacccagcattcccacttctgagaattcattccctagagatatcagaacatgtatgaacacatatacaatgacacaggtacaagattattccctacagcattacctattaaaacaaaagattaacacaacccaaa

SEQ ID NO: 188565 - DNA, 289 bp, Homo sapiens
ggtagagccaaggtttctctatgttgcccaagctggtcttgaactcctgggctcaagctatcctcctgctttagccactcaaagagctaggattgcaggtgtgtgccactgtgcctagcctaaatgatacgctttcaatggtgaaatgtatggtatatgaatgatatcttaataacggttacaaaatgaaatgaggaccatactatatgctagccataaagggttcgacgtatcagctgtattttctctatgaacagtaaaaataatatttttatatgtgtgtacaaat

SEQ ID NO: 188566 - DNA, 616 bp, Homo sapiens
ctgtggacgctgaggagtgggcctggtctcgctgcagccacgggatctttatcggtcatcctcgaggaacacgagccctattaagtaaaatgcccaagtgctgcctgcattctctgctctggagtttatgaatatgatttgttttgtggcatttctaatgaacttttaagatctttttcctatctctggttctcagtcagattctttcctactaaggtatgcaaggcaagcctgccatcccattcctaaaccctgcgtccactgttaggcagtgttactcaccagggtggattctccagaacgctgaaacagcacagcttgtcttaggtggcaaccatgtcaaaaagatgcaatttggctcttcctgagatgtccataggaccttgcagtgaggtgtggagccagaaaacagggccctcccggctcctgctccccacagataggcagtccctatgatcttgcccagagggaacatttttatagagctgtaaacagtatatggccttggccctcagctgcaagctcttaaagcgagtgcagagttaatatcttcatgaacttatgcttcattagaaaagagacagtcacagtatgtggacacctggctgcctctagt

SEQ ID NO: 188567 - DNA, 456 bp, Homo sapiens
gtaattagattttgcaccgtacctgggtgcagtcaatagctaataatgataaacattagactagagagtgataatgagatagatgatagggatttgcactgagtaggacatgcccggggcatgaatgaaattaaaatgtgtctgaaagaaatgaaatagtgagacataaatcagcaagaattttatcaggtttgttttggcccctattatatgttatagatttaagatcatttatgtttataagttaactctgtatatgctttcaggtttcaccttttaaattaataaaaggttgatttatgtaatatttcaagtaaaaacagctaagtgaaccaggctaacaaagcattatttaatagacatcctcagggacctaatttaatgaataggtagagggatgttatttgtaacttagttcacaaattatttctatatcaataggtgactttaaatggc

SEQ ID NO: 188568 - DNA, 246 bp, Homo sapiens
atacaaaagagggactaacaatctatatgtagactatgctgtgttagtggctgggggaaaaaagattcttaatgttttcctctcccttgaatggcaaatagaacatgcctaaaatgaagaaaatattgattttaaaccaactgatacgtctgcaaactttattttaactttgagccactgaaagggatttaaaatcaaaggaacaatatatttcctatatcttttaggctactctgtatgggggat

SEQ ID NO: 188569 - DNA, 256 bp, Homo sapiens
gaacaggcctactttttgcagaccaggctacctgtggccctgggaaacgttaagctctgcactttcctaatcatcttaggttttagcatgcccatccagatgcggttttggtgtttcagctgacctatctctgcccagtgtggaggatatacagtactctgtggttcttcccttcaagtaataataggattctccactgcccaggaagcaaagatcctgggtgagggattggggaaagagtagaatgccccagcaa

SEQ ID NO: 188570 - DNA, 560 bp, Homo sapiens
taggtctggatctggctgtgtgttcatcagacgtcgtggaattggaaaacccttgcgggtcctacctgacccacggcacccaaaaggcacctctgcatggaaaggctccccctgaaacccctagcccacctcgagtgggaccgtcttacaggtgaggtgcacgaaaggcttctccgaagtgacagctcggaaggatgcacgtccggctgcgccaagctggttaccccgcctttatcccacttcggcgtcagcctgggctctgggaactgcagcctgtgcctccagccgcgcgcttcctcctgcttccagaggagcagggcagtgcagccaggcctcgcaaaccccacttctggggcccccagcgggagcaggaaggaaagccgctgagatgcgccgtgagtgtcgcacggcttggagaagtgggttgctgggttgcataaggtggaaggaacttgctagtttgcaaaagacagctcttggcgggagccggaacccggagcccgccgactcgcgcacccctcctcatttactgccttcgacgcgcgccaccccgactgcgc

SEQ ID NO: 188571 - DNA, 351 bp, Homo sapiens
ccctacctacctgaagcctccagtgggttctctgcacacccacaatgcaatccaaggctctcaccaaggcctgcaagatcctacatgaactggtccctgcctactctctgattccattttccacgacttttccttgctcactccagctcagcctccatgctgtccctcaagcaggccaagcacaggacctacacacagcctatctgctctgcccagaatgctcttcccacaggtagtaaggtcattcctttactcaattcagggtgctgggtcacatggcaaatccttgcagcaactgtccctgaaccatgatgtgtatcggcctctgcgtttttcctctattcttttttt

SEQ ID NO: 188572 - DNA, 1492 bp, Homo sapiens
gccgccttgacctcttgggcttaagctatcctcttgcctcagcctcccaagtagctgggactacaggtgtgcaccaccatgcctggctatttatttctatagagatggggtctcacatgttgcttatgctggtctcaaattcctggcctcaagcaatcctgccttggcctcccaaaatcctgggattatagatatgagtcactgtgtccagtacacttaaaatacgtgtgcacacacacacacacacatgtgagccatatgtctcaccacttgacatagtttgtgtttaaggtctttctctgccattatcatgctatcttctattttgttcattgctgtgtctccagcacttagaacaatgcctgacacatagtaggtgctcaataaatatttcttgaatgcaaatacactcaataaactaggaatgaaggaaaagttaaccaactgataaaggtcatctgcaaaaccccccacagctaacatcatacttagtggtgaaagactgaaaactttcatcctgagtttgaaacaagacaaaagtgcctgttctcaccatttctattcaacattgtactgaaggctctagccagggcaattaggcaagaaaacaaaatagaagggatccagattggaaagaagtaaaactatctctacttgccaataatgtaattttgtgtataaaaaatttcaaggaatccacacacaaaactattggaatttaaaaacaaatttagccaagtggtaggatacaagatcaatatgcaaacatcagttcaatttctatacattggcaatagatactatgaaaatgaaattagaaaaacaattcctaaggcatcaaaaataataaaatacacagaaaaaaatttatcaaaagaagtatcacatacactgaaaattgtaaaacatcattgaaagaaattaaagaagacctaaataaatggaaagatatcctgtactgatgggttggaagacttaatattgttaacatggcaataatccccaaattaatatacagattcaatgaaatgcctatcaaaatcccagctgcctttttgcagaagttgacaagctgattctaaaatttatatagaaatgcaagtgactcagaatagccaaagcaatcgttttattttattttttgagtcagagtctcactctgtcacaaagactggagtacagtggtgcaatctcagctcactgcaatctccacctcccaggtgaggcaggagaatggtgtgaacccgggaagcggagttgcagggaaggcgacgaatgccgccaatggcagtccggaagtacgggcatggagcgacaggagcgaagactccgtcacaaaaaaaaaaaaacacaaaacaaaaaaaacacagaactgaacgcgccagagccaagacacggattaaaacacgaaagtgagaaaagaacaaaagaaataaaaaagggcacagaaggacacaagaaaacccgagcaaaaaaggaaggaaaaaacaca

SEQ ID NO: 188573 - DNA, 633 bp, Homo sapiens
gcaaaagacagtaaaggaaacacgcccccaccccatcctaactcacacacaaaaaagcccattcaagtcctcttcccccatttcctggatgagtgtcctgggcaagtaacttaatctctctgagtctatatcatcacctgtaaaaagagagacaactgccctcaccatatatgagtgttacattggaaacaccttgtgaatgtaaaagggtagagaagagtgtaccacttctgttttgatttctctgaatcagtatgtagtagttttctgttgttgcgaaatgaattaccacaaatttagcagcttaaaacaacatccatttaatatcccacgattctataggtcagaagtccaggcagtctcacctggactctgctcagagtctcacaaggccaacatcaaagtgtcagccaactgggttcttatctgggggatttgggaaatattctgcttccaattttttacagttgttgacagaatcctgttccttgtggcttcaggtctgacatccacattttgtcactgtcagctgggggttggggttggtctcggcctctccaggctgctcatattccttctcatggggttccctccaccttcaaagccacagaaggaacatcaaatcctcacctt

SEQ ID NO: 188574 - DNA, 386 bp, Homo sapiens
gagtaaaactctgtttgcaggccattattagttctggcaataggtgagggagaaggtcaaagctaatattttaaagaatagtttggaattattgatggttttcaattatctctgctaaatcattttatttagggagtatctgcacagaattaacaaggaaagagagcaaagtcttgtatcactggcccattattgcctgttttcctcatctgtaaaacaggagtagtgtagcctaccttcaccttggtttcgtgcttcaccaggaattttgtgctgtgtgcaatcttgtattaggcattgtcacgacttaatgacctttttgggcagcgttttcctatatagagttatgagtgcatcttttataaactccatttactccttattgg

SEQ ID NO: 188575 - DNA, 708 bp, Homo sapiens
taagacaaggataaattcttccatggctgtaaactactctgtgggcatagagctaaaggttttgaacttactcttagaggactctggtaactgatatgatacaaagaacctaggaagatataaaaagaaccaaaggcattctgttacctcacctgagaacagagagagcaaattttctgaattaacagagtagactcctattgctgcatatttttgtatatatgagtgtgtgtgcacacgggaggacacacctgtgtgagtggggggggcagtgtgtgtatatggggcagaagtcagggcataaggattgaggaacacatggagaatgtatctgagttgatagagttaataacagactctacacaattacaggaaacacttgcacactgaaaataatcacaaaaaatatagaaaatttggccgggcgcagtggctcacgcctgtaatcccagcactttgggaggccaaggcaggtggatcacgaggtcaggagatcaagaccatcctggctaacatagggaaaccccgtctctactaaaaaatacaaaaaattagccgggtgtggtggcaggtgcctatagtcccagccactcgggagtctgaggcaggagaatggcgtgaacacaggaggtgaagcttgcagtgagctgagattgcgccactgcactccagcctgggcgacagagcaagactctgtctcaaaaaaaa

SEQ ID NO: 188576 - DNA, 345 bp, Homo sapiens
agagcgaagaaactccacctcaaataataataataataataatgtgatgcaatgcaaaatgcagtattacaacttttattgtgatttttataaaatcctaaatatctttgatttatgttttcgttgagtatgtcttcctttctgtttgatacaatctaaaaattttagagctatgaacaccagaggaaataatgcccttcttttacagtaaaggaaactgaaggccatagagagtaggcacctttcctagggtcatacaaatacatcagtcagaactggattgtagctcctgactcagtctaaggctgtgaactttacctggaaatagggaggtgtatagacacg

SEQ ID NO: 188577 - DNA, 1321 bp, Homo sapiens
cgtcattttgaattccacagggctacacacttattagcattacattttaaattatcagctgattttaaaacatcacttttagtatctaaacagaacatacaatctgcagttcataaaagagactgttcataaaactccaggttggcacggccaatgcgtaaatctcaaatacgctcacaaggcatttcagccacataactggaattgtatttctataaaaacagttggagtaatcactttctgtcatgatttagaacaaatggggagagtgaagctgttcaaaatctccctcaatgtcttcccctttcttttaaaagtcctttaggaggagtctaaagctctcactaaatgaaaaatacattcccaggaggaggagatggtttccatcccttcacatctggattcagagcatgaggatattggatggaacaattacacggtgatgatactaaaggggaataattattttacaattacctgagagcatcacatttgctgctctaattagtttttgtttcccacataggtttttcccaggaatgtgcagctccatttctcttaagtttagcaagagctgtttcttaaggaaaaataaaaatacattttctgcactgctacacaagtagcacaccactgatactggcttcattatattactcggcacctccttggtggaggaaacaaacaggatgcatgagaacttgtaggtgctaatgaactggaaatcattagtagtttccaaaccctcccttctgtggttctgtaaaacaaacattacactgacaaacatctaactctttgtgatggcctaatccgaaaacaaaaagcgaaaatgtgaccctcccgtgaagaaacaaaatctcccaaacggtaatactctaaagtggaaataatgacctattaagtttgggtaaagtgcagcattgaacataagcaacattgatgacttattaattttgctccttgactcatgttgaaaatataacattttccatttaaatgcaaattagatacggaatgcttatagtactgcttaacatttatgagagtttgttttcatttttgtcggtttttacaaaaaattcaacaatgacatcatattcccattataatctacatataagtctcaacaatgatcgctaccctgattttttgcccaagagctgggtcatattgggcgctggctgtattacactcagctgtatcagatcattttgcatgccaaacgtaacctgtctttttatgctaagtaaacgagtgtttaacctttaataaaagtaaggaaggggtaaagagaaatgaagtttggggatttatgtaa

SEQ ID NO: 188578 - DNA, 380 bp, Homo sapiens
caatgtactctacaaagcttttaaaacataatttttggtatttagatattccttgagagagtcgttttgtgagtatttatttactggattataaaaagtagtagcccaaaaggcttggttatgaatcaagcaagcaagtaagcaaagcaattagaaaattgcacaggcaatttaggcagtattaaattaaataataaagaagtgactcagactacgaaaacatatctacttaaaatatacaaatgctgttaaaaaaaaatacaaatgctggaaaaacataagcattccaaaaagtagctagtgcttttgtctaattctcagttgcccccacaaaaagataccttaaaaactcactgttattttaaattaaattcttctct

SEQ ID NO: 188579 - DNA, 522 bp, Homo sapiens
ttactgagcagacactattcatcaggcaattttagccattctgtttttaatgagggaaatagtaacatctccattatatagaagggactgaagctcacaaaggttttgatatttcccaggtcacacagctaataagaagtagagagaggaggattgggagggcaggcctctctgacctcaaatccatccacagtcttcttttcagtacactagcattgccctgccagggctgagacaagatatgccaaaggaagcaatacagtcacctatgaacagaggccctatctcagaggagctcctttgctccagacaacccagtgttactctgtctgtctagaaacaaaagaacccctttttgccgccatcaagggatataaaagcattccactttctcaaaatttgttgaaatggagttggtgacatctggtattaattatataagcaaatctaaatggtagacacattgggtatcgctttttaaaaatctttctcacagatacatacataccataccacccaccg

SEQ ID NO: 188580 - DNA, 170 bp, Homo sapiens
ctttgaccctgttggcccactgatggtttaactggctaatgggggcatcttggagaaaaagctaattcccataactatggggatgtgaaatggcttttctggcctttttgggaaagtagctatcagattcaataaaaagggctgccttccatcctgcttagcccggcctt

SEQ ID NO: 188581 - DNA, 513 bp, Homo sapiens
cctgttctgtatgtgtctaatttacttctctctttctggatcagctctctctccacctgcctactggtagaatatggtcaccagtacacagctattatagggctagccatatctagagactcatcaccgttctctctccctgtcttcatttcttccttctctcccaattcaaaattcctgggagaagaaactctagttagggcagtaaggttatctgcaaatttgcctatctcattcttactttccacaatgtgagaaagtaagggtattctagtaaagtggaaaaccattctcaactgctaataatacaagagaattggcctaacataggactgtctttagaaattttcagccaagcattagttgagataattgtaaatgaactcccaaaatatctaccaacacaaactcaatatttattactatttttgccactcttattttatgtatacttttcttcctttcttcttatccaagtgttgaaagcaaatcctatatattatgctatcattc

SEQ ID NO: 188582 - DNA, 352 bp, Homo sapiens
ggttcttctccatatctaggcttctctggggactaggcagaagtggctataggctctgcagtcagacagctcaggagcatggaaacctctcgagctccatggcgcactcacattgggtttctcatcagactgaaatgcaagtggacagatgacaacaaatatgagaataaatcaaaggcaagttcctcctccttactgtggaaacttgttctctgaaacagggaagggcaggaggcagggggtgaaaaaagtggactttccttagaaggtgggacacctgttgaataaagcactcaagcaccgccctcctcatttaagttgtcaaagaaggaaactaaaagccatgtgcatc

SEQ ID NO: 188583 - DNA, 652 bp, Homo sapiens
ttttaattcaagagctaatgataatgataactggagagattgaactttatataaattatttatgagtctaatcgaggaataattgacagtgaatgaaaaaagtaagaaaaagcactgccattcttttctactgaaaattatgttaattttcagtagaaatctgtatgcaccatccatattgtgaaactaaaattcattaaacaatatttacgtaagaacaactgtcataacttattttaatagttaaagaaaatgagactgtttaagtgatgtggaaaaagttatagttttagaatttcaacacattttacaggttaatcatatttagacttcaacctttcaagtgtctattgcatgtctattttatgccttgaaccatgaccaatcttatcctaagggaacttcaagagtaagtttcaaatttgttttgaatcctcactggcttagactgagcagaagtcttttaaaaatgcatattcctggaatccacacacagagatttctaatgtgtaggcctagaatacttccaaggaattggtaatatgaaccccatggggttgttgtctatactgaaatttgagaatcactgagctgaaaaataaatagtctttactttttcttgttatttatcatttaattcaaatattgcata

SEQ ID NO: 188584 - DNA, 1215 bp, Homo sapiens
gggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaacaaaaaagaaaacaagagggaggaaaaaaaagaacctacttaagatagaacatggtttgggctatggcttgactcatgggctttcagtgcttttttccatttgttgaaagtaacatttctctctctctctctttttttttttttttttttaaagcaaaccattgtatgtgtaagtgtttaagttacctttttgtctattggtctctttgccagccctcccctttcccaatgaaagccatgtcaaattaatcactg

SEQ ID NO: 188585 - DNA, 535 bp, Homo sapiens
gtatgtgaagttgttttgtgtactttggttgtttggtcataattgtagtttgtgaccttggttactttggcattttctaggatgctaaatgttacaaccagtcccttaaattgggtagatactccgtgttaaaagagatgactgtattggttcctgttaatatttttaaaggttcagagattctcacgattgcccaccatttgtaatggttgcaccctttatttaatgatgtctgtgttcaaacactgaatgaacaatttgcttaagtaacagtcacattaggcattgtgattgagatttgtattttgccctggtggaggaggttgtagacctcttttcacagaaaaaaacatgttaataataaaatttaggtgtttcacaggttattcagattagttaattctatgtatttttgttttgtgtttggttttcttgtttcacttattcataattggaccaaaaaggccctgtcagttcagttttgtttccctggtctcaaccagtactacttggaagtgatggaactaccaaaagt

SEQ ID NO: 188586 - DNA, 273 bp, Homo sapiens
cttccagtgtattcctgcactgacaccttcacatactgctctttcttccttgaggtcttatcttgtaagactcgtcataaatgacctttttcccagagatgccctccctaatcccaatgcatcagtaggagatcttccttgacactctctcaaattacctttctcttgccttcataaagtgctcgtttttgatgtataaaaaggtatgccagcatccatctgcacttctctggtcaagtgggcagaacaaattacattggagcagaagtttca

SEQ ID NO: 188587 - DNA, 281 bp, Homo sapiens
tggtattacaggcatgcgccaccatgcctggctaattttgtatttttagtagagacggggtttctccacgttggtcaggctggtctcgaactcccaacctcaggtgatccacctgcctctgctcccaaagtgctgggattacaggcatgagccactgcaccaggcctaaatatctcttaagtctgcccacctctccccatctctcacctagacgactccaaaacattcaaacatggtctgcctgcatcactgggacggagccagtgacactgtagtagcag

SEQ ID NO: 188588 - DNA, 393 bp, Homo sapiens
cgttggacttcatttctttattatagtatttatggcagcatatttcatattagaattgttcacacttgggtgtgactcccccattatattttgaatctctggagagcaggatctaatttcagctggaatgagatgaggctggggaatgctggaaattgtacagactgtgtaatgggatattcacaggttagaatcccaagtctgacacttgggaattgtgagcttaagaaagttattcaatgtctccaagtcctaaggtgctcatttgttaaattgggtaactgtgcccattttgtggaatacatctttattaataactgctctggactgtatgctttggcaactaccaagaaaataaaccattttaaagccagcatatagtagatgctcaat

SEQ ID NO: 188589 - DNA, 173 bp, Homo sapiens
ttttgaaagttggtagcattgacatatcctggaattgtgaccatttaaattctcagataacacaccatgtgataatctttttatagggttatgtcaagaatcttttgtatataccacctcttccccacagtgatgaagaaacaaaggaatgcatgttagttgcaaaaagtctg

SEQ ID NO: 188590 - DNA, 342 bp, Homo sapiens
ctactgctactacagaggcgccaggaggtttcgtggagttagggtaccagtcggtgataccatgcatggggtctggaaatggaaaatacatgaaatacccctcagaaaacctctgagacttgtcttaaaataattactcctgttccaccaaggctctgaaaaactggcttcatctagagtgcggagaaacaaacaacaggaataactcttctaccacaggccagtgtttcttagagtagatgagggcttgccaacactacttggccagcaccctaagatagtggtttagacatgaccctgaattcaaagagaaaaatgactattcagtgtacaccctgccct

SEQ ID NO: 188591 - DNA, 422 bp, Homo sapiens
tccgccttgctcctctcttcactggggtttatatgccctctgagccctcggctcccggggtctaactgcctagaatgtcagcagtaggcctgtaaaaagtgcttcttcccacatactgtaacactgggcttcagtgtgggggaccctggggctcagaccaggaaactacatgcccgatttgcaacaacttggctgcgacttttatgacgttttggggagtccagaaaagcagagctgtggaaagaggtttcattcaagctccagacttgggtggcccttcatccccactgaagtggctatggtaaattgtcttccgttgcaacacgaatggaaaagtaatttggggttgggccaatacaaaaacagttgaaagaggcaaaatattggattaaagccatactatggaatggggagagaggagg

SEQ ID NO: 188592 - DNA, 598 bp, Homo sapiens
ttgtcttagtaagtttaagagtctgagtgaaataactcagtgagttaggaaagtggtgataatgtaggtcccatcggcattcctgacccccttttgcctttttgttctatttactgggtatccataggaccttaaaaccaagagcaaacaattgaatgagatgaatttgttttaatctgcatgactagattacagccacaaacccaataaatacgcagaaggtggctgtgggcagatgcagggcatggagggccatcgggctggcaaggctctgtggtcaaagggaacatgctgaccttggcgatggcagaagagcaaagtgaccagggacgtgtatggagccatgtgagagctgatttcttcacttgcccaatggaggtgataacaaggattcctgtttcataaagatgatcgtgaaaacaaaatgtgatagtgcacgagaaagtgtttggaaaagatatgaagatgttatttgcaagaagcccttggagcagaggtcctgcttatctaccatttaaatgaatatagggtatgtttgccatttcaactctactgtgtgagcactaagggatcctcttgctggtgatcattttcaaag

SEQ ID NO: 188593 - DNA, 397 bp, Homo sapiens
aaaaggtgattgcctgtttcctttactggaaagcaatgttatacttttcatataaaaaaaagccctttcctttgattttgtaaaaaaaaacaagacttttttttattggagcagggcccaggaactttttttgagattatattcagggatgataatttttttagcccaaaaaaaaaaaaaaaaaaaaaaaaaaaggtgaatttgaacatctggctcttgctcatggatatattacaaaagcaaagtaatcacactgtgctcctggagcgcagcaataacattgttgattcagaagtcagacagtaagaaaattttagagtgcccacatatgtatacacaaatacatgctaatgcgaattagaactgcctgtaacgaggtttcatgatagccctattt

SEQ ID NO: 188594 - DNA, 643 bp, Homo sapiens
tactcatcctactatagtcattcctcctatctagctgtaacgtattcctgacttattcctcctatgtagctgtaattttgtatcctttaacaaatctctccctatgccccccttccatacccattttatactcagtcaccacatacacacataatacccacaaacttctttaagaatagaatgatacattccttttttgtttttttaagatggagtttcactcttgtcacccaggctggaatgcaacggtgtgatcttggctcactgcaacctccgcctccccagttcaagtgattctcctccctcagcctcctgagtaactgggattacaggcatgtgccaccatgcccggctgattttttgtatttttagtagagacggggttttgccatgttagccaggctggtctcaaactcctgaccttaggcgatctgcccaccttggccttctaaagtgctgggattacaggcttgacccatcgtgcccagccagaatgatacattcttaacatgaaggacaatgtttattggaaacctgcagtcaataccctgtttaacagtaaaattgggaacaagacaagatgtccattattttttaaacttaatttggaagccttagttgtagcagttagataagaaaatga

SEQ ID NO: 188595 - DNA, 222 bp, Homo sapiens
cactgcaaacagggataagtgggctcgtgctccttagtgggactcattgataaggaggcacttagtagagtgataatatcttcaccctctataccatctaataagtcaaacaggtagcttgggatcggtgcagtagcatttgggtatatgttctggcctggctttactaaacaatttgcaaggcaaagctaaaaccaaaacatatggtggccactccaaaag

SEQ ID NO: 188596 - DNA, 330 bp, Homo sapiens
ttcccaccaccatatgcacaaacacaggcacacaagtgcagatagaagatgagctgtttggacttgcgagggcatgtgtgcttggtgtgtggcacattgaatggcctcttgctatatatagtgctcagaggggatgatccagatgtctggcatggggagactggtactgagatttctgctcttgttctgttagtgagagtggattagcagcttccctctgtttctgctaggtactgccactggcatcactgccaaaatgccacctcagatcgttggcagcaaactggagctggagtgaaaataacctcacgtagtcactcagccaaggga

SEQ ID NO: 188597 - DNA, 685 bp, Homo sapiens
atttaaagaaattttttcttcaagttttcccactgtatataataaaccctagaaaaaaataaaatacattctagcaaaaatatttgttcaaataagcactttcatcttagaatacctatttctatggtgagcaaagacattaagtttttgaaatctgggcttaacttccataaatagtctgcatttcctccctacttttctctgtaaactgagatttaaagcatttaaaagcagtacttttggctgagcatggtggctcatgcctgcaatcgcagcacttgaggagactgaggcaggaggattgcttgagactaggagttccatgccagcctagccaacatagcaagacccccatctctaaatacatgcatacatacatacctacatacataaaagcagtatttttttttttaactggcaggagtcttgatatggtttggctctgtgtccccacccaaatcttatcttatagttcccataattcctatgggttgtggaagggacccagctgggagataactgaatcatgggggtaggtcttttccatgctattctcatgatagtgaataagtctcataagatctgatggttttaaaaacaggagtttccctgcacaggctttctgtctttgccctctgccatccatgtaagacatgactagctcctccttgccttccaccatgat

SEQ ID NO: 188598 - DNA, 373 bp, Homo sapiens
cattcttctataaatcctttaaaaaaatactctatttcctttgagtttaatgtgttgctattcttctaactacctgattttcagcatgtcttcttttctaatatacgtattttaagctataaatttccctctaaacatgacttcagctgtaccccattttatatatacatatttgctattgttcaactcaaaatatttaagctttctgtgactcataaattacttagaaatagacatctaaaatttccaaatacattgagattttctttttattgatcctggcttaattctgttgtcagaacatactctataatttcaactcttttgaaagctgttgagacttgtgttatggccagcatatagtgaatttcga

SEQ ID NO: 188599 - DNA, 171 bp, Homo sapiens
ttgaataacaacagaatcagagcctctggattttcctttctcatccatctgaatttctttccttttttgggggtggaggtgtgttcaattgaaacttttgatgtggtgataggattcccaatttttctgcaggagagttgggagtttattcctgagttttctcagttcatt

SEQ ID NO: 188600 - DNA, 469 bp, Homo sapiens
tacagtaactatgtaaggtaagattgctcatgagtgcctaccctgttgaagatgctttggcagctgctgagtgtgagagggtagcaggatgaataggaccctcctgcctgtcctaaagaaggctgcaactgcagcacacaatgtgcgtggagacaactgcctgtaatgccagatactgcagggccttagagagtaaacacaggccttggagtcagacagacctgtagcatggggaggagcctgtcttcccagtggctggtggtgaatttgatgaggtagcatgtgtagagtgcctagtgcagtgccggcatatgagaggctcccaataaatgcagctgatgttgtcatggtccagcagcatatgggaagaggaaggaattattaacttgaccagggagaagaagaaggaaagcactacagagcaggtagtgttggagcttggagccaggccctgggaggatttccctag

SEQ ID NO: 188601 - DNA, 255 bp, Homo sapiens
acaacaaccccctgtggcacaatttaccttctaacaaacctgcagatgtacccgaacctaaaataaaagtttataaagaaaagaaggccaatgagtttgaagttaaaggtgttgactttagtaactataaagaagtctcttataagaaacttattttagttttagaaggtaatcatttagaaggtaattattgttcctgttatctaatatctatattaggagatgaagcagtaacgtcccaacttgaaatgaaca

SEQ ID NO: 188602 - DNA, 430 bp, Homo sapiens
acaaaaggccatcttgggagcagcccacccctatcttgggagtggcccgccacatcttgggagctctaagaacaaagaccatcctataacatctggtggcccgtatgggtattcttcaaagtggtgagtaatattggacccctttcacttgctattctgtcccatccttccttagaattggaggaaaatactgggcacctgttggctggttaaaaagattagcgtggctgctggacttaagactcaggtgtgaggctgtctggggaagggctttctaacaacccccaacccttctgggttgcgagcattggtctgcccagaaccagcttccactttcaattttcctggggaagctgagggccaactagaggcagaaagctggcatcctgaactcctggcattagctggttgagatcatggcacagtcaga

SEQ ID NO: 188603 - DNA, 515 bp, Homo sapiens
gcctaacctaccgaacatcatagcttagcatagcctaccttcaactgctcagagcactaacattagtctgcagctgggaaaatcaactaacacaaagcctattataatcaagtgttgaagatctcatgtaactgaatgagtactatactgaaagtgaaaaacagaatgggggtaggagtacctgaagtacggtttctactaaatgtacattgttttcgcaccatcggaaagtcaaaaaatcattaagtcaaaccatcctgagttggggcctgcctgcatatagagatagagtctagttgggggggagaaaaaaagaactagattctaggccaggcacggtggctcacacctgtaatcccagcactttgggaggtcaaggcagatggatcacctgaggtcatgagtttgagaccagcctggccaacagggtgaaaccatctctactaaaaatacaaagttagccaggtgtggtggcacatgctacttgggaggctgaagcaggagaatctcttgaa

SEQ ID NO: 188604 - DNA, 170 bp, Homo sapiens
tcagcatcactactctgtgctttggggccataatgaagtagaataaggttgacttgaacacaagcattgagaaacatgacagtcgatctgataaccaagccagctactgagtaacaggtgagtggccgtaggcagtgtggatacactggacaaaggggtgattcatgtcc

SEQ ID NO: 188605 - DNA, 520 bp, Homo sapiens
tccagactgccttcagactctccagactgccttcagactctcccttcagtattctgtccttgctgagctctgaatcggagcagtaccagtgggatggaaacctgaagccacaggcaaagtcggcccacctggcaggcttgcttctgcgaagccccacacactacagtagttgccgttggcctctgctgcttgaccccagcaacgaggccctcatctggttggacccgctgcctctggaagagaatcgatcttttgcgccagccctcactgagggtagagggaaaggcctcatgagaaatcaaaagagagagagtaaaacggacatgaaagaggaagatgatgagagtgaagagagtaatgaggctgaggaccagacaaaagagcagaaggcagaggaaaggcctcatgagaaatcaaagagagagagtaaaacggacatgaaagaggaagatgatgaggtaagagagtaatgagtctgaagcagtctggaggtccgcgctcgattctatcatgtctactt

SEQ ID NO: 188606 - DNA, 155 bp, Homo sapiens
tcattaaggatttataaattcaaatgtctgaactttattttatgcaaatatttaaaaagcaaatttataaacatacacaatatcaaagaagacgttaaaatatttcagaagaaaatcattattgaataaatccttttgttttaggtgaagctatg

SEQ ID NO: 188607 - DNA, 280 bp, Homo sapiens
ttggacatccctgttctgccgtcctgatacctctagttgtgggttttatgtgtagcacagggtgaagctttagttctcagaacccacccctgctgtaccctgtgccctcgccctccgctgtgtttgccctgaccctcctgtaccctgcgtcctcgccctctgctgtgctcacccgaccctgctgtaccctgcgccctcgtcctctgccgtttgcccctgaccctgctgtaccatgccctcgccctctgctgtgttcaccctgaccctgctgtaccctgcg

SEQ ID NO: 188608 - DNA, 358 bp, Homo sapiens
ctaaactatactgtctccctccaatgcagtgtttctcacccattttcttcattattgtcctcctaagtagccttttcagacattcttttcctcatcacgctccctgtgaaattttaataccagatacactgcacacttgtttgtgctgcatgtacatctgtactttatatgtaaaaagaataagatttttttttcacacatgcatccctcaagagttaatttctgcccccttgagggtaacaccacacccactgagaacataaactctggggcaatgttcctcgctgtgggcaccgttgacacttaaagccagacaatcctttggtgtggggcgctgtcatgtgcattataggaggtt

SEQ ID NO: 188609 - DNA, 300 bp, Homo sapiens
agtggcatggcagcctgtactttcggggagtgagattagatttagtccctgcactctgcttctctgtgctgcagggagatgtactggctgcttctgaggaggaaaaggctccaatccaaagccctaaaggagtagaggctgccaaggagctgtacacacacttgtgtgatgtggtggacaaggtggatggagactctgtgcccatggagatactaaaacaagaagtcaggaatacccttctcaatggggctgccatcttctttcctaatcgacagacccgacggaaccatctcttcacca

SEQ ID NO: 188610 - DNA, 496 bp, Homo sapiens
ccattgcactccagcgtgggcaatagagcaagactctgtctcataaataaataaataaataaataaataaaataaaaaatagccaggcatggtgttgcatgcctgtggtcccagctacccaggagactgaggtgggaagattgcttgagccttgacctaggctgtggtgagctgagatcctgccactgtactctagcctgggcaacagagcaagaccctgtctcgaaaaagataatctgaaacaaaaagacaattgatgcctctgcttgtaaaaatatgcacaaataccacagacccatggagaaattgtctccgaacacctttccaatcctccgttttttttttttccttataaattggagtgagcaatatagcaatatcttctttattgagtagttgaacagagtaaaggtactaagatttggcaagttcttggagcagagcatagtaagtgctacataaatgtttgctattattactcctgaagtgtcaacgt

SEQ ID NO: 188611 - DNA, 532 bp, Homo sapiens
cccaggaggcagagattgcagtgagccgagatcacaccactgcactccagcctggtgacagagcgagactctgtctaaaaaacaacaacaaaaaaaaaacccacaaagactggtgttatatattgagccatcatgtcatttaagttttttaattttgaaagaactgagctttggaaaacttacaagaataactcaaagagctcccttctattcttcacccaaattctaactgtttagcattttcccacattttattgtgtgtgtgtgtgtgtgtgcgtgtgtgttctgacccatttgagagtacatttgcctatgtcataccccttgaatactttggtatgtatctcctaagacaaggaggtgtgtacctagccacagtaatccaaatcaggacacgcaactttgatacaatcctgttatccagtctatagccgatattgcagattcactcaccgtcccaattctgtccttcatgcccatttcttgcagaccaggacctaaactcttaccacgcatggggtttagttgttag

SEQ ID NO: 188612 - DNA, 263 bp, Homo sapiens
cctatacctagacagtctccgcccactcatccagcactgcaaagcccagacattccttctttagggaagcttgttctgattcccaagaccagatcacttcctgttgggaaactcttttatagcaccccatactttacgctccaaacatctaaaatgatttgtaattagatatttttgtttgtgatggttttatttaactccatccattaggataaaatggtgactgtatcttctgtgcttggctcataatgggtatacataat

SEQ ID NO: 188613 - DNA, 513 bp, Homo sapiens
aatccgtaccatagctctggtaggaaagagaaagaaactacagttagctttgtatgtgctaggcctgtgtgagcctctctccatgtgttatcttatttgatccttaccacaaccctctgaagcacagctgggattctcaaacttgggtgagcagcagaatcacctggaggacttgttaaaacaaatttctgggccccgccccccagagtttctggttaggaggtaggcctgggatgggctgagaatttgcatttggcttaggtgatgctaatgctgctggcccagggaccacactttgagaaccactggtgtagatgccatgattctcatcttgtagctaaggaaccaaggctcagagaggtcattactttcctaaggcgcaccagacagaaagtggcctagcagatatttccatggaggtcgcctggttctggggtctgtaaagtttccgcttcttcctcctggttttctgcctcatcctctgttccactatgcctgtctttaggaactaat

SEQ ID NO: 188614 - DNA, 353 bp, Homo sapiens
aattctcctgacaggaattggaattttgcacacatcccaagaatgaactgactcttaatgtgctgtgtgtgtgtgaaggatggagtattaaaaagcatcaggaagggtcactaagctagggaagagtgcctgctgattctccagcatgacaacaaagggtctgggggctatattttcctcctgctcatggtcattataatattagtgatagtcaataatatttactgagttctggcctctgtgacagtcactgtgctgggtgcttttcatccatgatctcgtttaaggagagagagagagagaatgtgtgtgtgtgtgtgtgtgtgtgtgtgtgtgtgtgtgtgtgtgtgtgt

SEQ ID NO: 188615 - DNA, 291 bp, Homo sapiens
tgggggattgcagcgagtgacatgtgtgatgctctggaggtgggaagaaacaagtagagtgatgagaacaacacattgatttcctggcatgaagagaaatatggagaattctcttcatgaaatgtggaaagcagatttagcaaatagcttgaaggctgggcagagatactggatgtgatagaataaaaaaaacaaaggtagagttatgttctgtgtcaaagacacgaacggcatgttaagaaaaaagtctttgtaaggtgttgctgctgcagtggattgcaatcccctcga

SEQ ID NO: 188616 - DNA, 387 bp, Homo sapiens
tgtttagggtcctgcgtaccacaccacactgggctaatttttatatttttggtaaagatggggtagcttcagcatgttggccaggctggtcttgaattcctgagttcatgcgatccacccacctcacaaagtgctgacataacaggcatgacccagtgcacctggcttttctgaacttttttagcttatattaggtttgtctgttctagaattttgtatacatttatttatattataggacactttttagcttagctttccccactcggggttagaaagattatattgatccatgatcatgatgtcgattcatagagttgattattcccatttattgataaatattactccataatatgcatataatttatcaatttcctctcaata

SEQ ID NO: 188617 - DNA, 560 bp, Homo sapiens
tgatgcatgcctgtaatcccagctactccggaagctgagccagaagaatcacttgaaaccaggaggcagaggttgcactgagccaagatctcgccattgcaatccagcctgggaaacagggtgagactccatctcaaaaagaaaagcaacaccaaggaggctaacaaaatctacctgaagaatgccctcaagaagattcataaaacaccaggataccttagtgttgggtaaaaatggaatcaagaccgctcaactcagtcatacagcagattgattcagacccaaatgcctctcctacaaagaaatatctcccacctactaaacgagtctaggacacaataagaaactaatctaaaaggaatactaagaaataaatatttagcaaaatttaagtccagccagatgctatagctcatgcctataatcccagcacttttggaggccaaggtggacacatcacttgagctcaggagttcaagatgagcctgggcaacatgacaaaacctaatctctactaaaaacacaaaaattagccagacatggtggcatgtgcctgtagt

SEQ ID NO: 188618 - DNA, 365 bp, Homo sapiens
caccacgcccggctaatttttgtattgttagtggagacggggtttcatcatcttggccaggctggtcttgaactcctgaccttgagatctacctgcctcggcctcccaaagtgctggaattacaggtgttagccaccgtgcccgaccacattcttctttcagttcatatttggatatcctttttttctacagtgagaagaactctggtaacaacataaacgcactcatttgttcagttgtacaatatgtgcataatgaaaattgtaataccaatagtatttccagctacaaacctactaagtttgatttaatatttctttgcaattttttgtgtgcttacatataggccactaagggtgtgcttt

SEQ ID NO: 188619 - DNA, 535 bp, Homo sapiens
gcaggagacattggtggctggttaaatgtggagtgaagggatgagggaggaagaaaattattgaaaggtttcatggtacagggcaatgttctcagaattaggactctgagtgccagagaagcccagaaaaaaacatgggtttgcataaaggtgactcattggtgacaaaacatgatgtagacaggcagatccagattttgtaaggactgtagcttagattaccttgagaatgttgttaagaacagtagtcgcaaagttaatatacaaaattgagtaggaatgtgaatttttttaaagaacagaaaatcacaatatatcaaaaattgtgctgccggggcaacatggcgaaatgctgcctccacaaaaaaaatataaatacaaaaaattagctgggcatggtggcacatcctgtagttccagctactcaggaggctgaggtgggaggattgcttgatccaggaaggtggaggttgcagtgaaccaagattgtacgactgcactccagcctgggtgacagagtgaaatcccatctaaa

SEQ ID NO: 188620 - DNA, 347 bp, Homo sapiens
ctgtgtaagtgtgaccctgcagtagggcagggagaacagttggaggggtctcctccctgcctccccttgggggtatccagagtgcctagggttgaattggaagggaggacacgcaggtagagaggacacagggttagctgtgtattcctgctatgcagacccctgcaactgagctgctgctcaattgtcctttattcatttgagaagcaggattgtgtcattcagtgacagcagaaagattccatctcttgtgccatttcaatcgattggtagtggctgccagccagactcctagggagaaagactgcggggatccattagtgatgtctgctacagcaggagcgtag

SEQ ID NO: 188621 - DNA, 299 bp, Homo sapiens
ccccagcccctcatgcacattaggcagagccaggctgtttccattcactccacaggaagtgaactccccccagcctcctccctccaccttttgtccttgggatacatccccggcccgggcctctctgggtacgggtgtcagcactgggatgaactgtggtttctttctcgttcatcctggcctggaccccaatttctgagaatcatggggtggtgggaagtattccaggaaagttctggctcatgtccttctggaaagacatgtgctttccctaacaaatcactctgtgctacactcac

SEQ ID NO: 188622 - DNA, 238 bp, Homo sapiens
ggtagcagtgagcctagataatgccactgtactccagactgggtaacagagtgagactccatatcaagaaaaaataaatgtgcaaaactggaaggaaatctattactgtaagatttgaccagtatgtacaagatgaaccaaagcaaggtattttgatcataatggtttgactgataactactgagttttttgcacttcaaattattaacagttaagcatgagaaagtacagttataat

SEQ ID NO: 188623 - DNA, 421 bp, Homo sapiens
tcttatcaaacagttaaataaaggttgctgcaatagacttaaatgttaggcttagcttgagatttaatgaagccttggtctgagagaatgaggaatgttaagtgtatggaatctggagtccctcctttactttatattatgatggagctgaagaagtatgttgctagccttctgatataccccgggagtatttagttgataccacatttcagttgttttccaggtttctgaaagagactctggtgagagagatatctttactgaacatttcattctgtttcattattcatttcattcttgttttactggaatcagcccttgttgtaaacaagccacaattctttactctgagtcactggagagatttctgtctcctaagtttcacctggcaaactgatcaaaagtaggcatgactggcaaa

SEQ ID NO: 188624 - DNA, 347 bp, Homo sapiens
ctacatttttattagagatggagtttcaccacgttggccaggttggtcttgaactcctgacctcaaatgatccacctgcctcagtctcccaaagtgctgggattacaggcgtgagccactatgctcaggcagggactaccctcttatatgtggtatccattgactgaaatgttcttatgcggtgcatgactgtattttacttttgtgtttgtatataaaattcaagatatcaatcagatgacatggggaatttttactatctctcatggtgttacgatagtccttcctcattggaagaatgtagattgattaattgttgttagaacctgttgattgtgaccccctaa

SEQ ID NO: 188625 - DNA, 145 bp, Homo sapiens
tatcaacagttatcaacacagagccagtcattttcatctataagccagcatacttctcccccaggccccatctctgatgatttttagatttgctcctttgatctctcagcatctgcttcatagttatttggttaggagtcagcat

SEQ ID NO: 188626 - DNA, 255 bp, Homo sapiens
ctcattacaatgatgtactatataaaacgaacagactttacctgtgattgctacaagcatctgctataagacaagggatctgacaaacagcatacaatcacaaattaccagtgttccacagaatagaaagattaattccaatatggtacaactgacagatggcaaaaagaactgaagacaaaacagaccattagcactcacgtaccacagagactatgcctctcctagttgattttctctctttcataaaatatt

SEQ ID NO: 188627 - DNA, 302 bp, Homo sapiens
aagacatgaaatcatctaaatggtagaccagataaagaaaatgtggtatatatacaccatggaatactacacagccataaaaagagtgagatcatgctctttgcaagaatatggatgaagctggaggccattatccttagcaaagtaacacaggaacagaaaaccagatacagtatgttctcacttataagtgggagctaaatgatgagatcacatggacacatagaggggaacaagttcttttctctccttccttcctcccttccttccctccttccttcactttctcccttccataccta

SEQ ID NO: 188628 - DNA, 430 bp, Homo sapiens
ggatcacgcgttatccgtaccagtgcttcccatactgtgctagcgaggaggaacaacttcatgttgcagctgaagaaactgtggtcttagagattaaatgacttgtcttcattcccacagttcaaaagtggtaaacacaaactcaaacccagcttcctaatgtctagccaagtgtcctcagtcttgaaactaaaactgtttatttctcccttatcctccatctactgccctatttttctccttcgttttactgtcacaattcccacagttgcagttaagttcctagactgttttctacttgccttctccataagcccagccagttgggttcagtgcccaccaagactgaaggtaccagttgcaagggcactaagtgagcagcatctttagcattcaatgctatctaaggttagtctttcccgatatacca

SEQ ID NO: 188629 - DNA, 450 bp, Homo sapiens
atacagtggggaaaggacaccctattcaacaaatggtggtgggataattggcaagtcacatgtagaagaatgaaactggatcctcatctctcaccttatacaaacatcaactcaagatgaatcaaagactgaaatctaagacctgacaccacaaaaattatggatgataacattggaaaaattcttccagacactggcttaggcaaagacttcataaccgagaagccaaaagcaaatgaaacaaaaacaaagataaacagatgagacttaaactaaaaatcttctgcagagtatacaaacaacccacagagtgagacaaaatctccacaaactatgcatcagacaaaggactgatatccagaatctacaaggaacccaaataaatcaggaagacaaaacaacaacaacaacaacaacaacaacaacaaataattccaccacaaagtgtgc

SEQ ID NO: 188630 - DNA, 409 bp, Homo sapiens
ttaaatattctgcccaaagaaaaacaataaaaaattagagcaatcagttttagaattcaggcattctggcttcaaagcttgtgcatttttcaaaatcctacgtatcaagaaaaatgaagtcagtagctaacctgccatctgggcctttgcagtttctatgcctactctcgaagtagcactgaattccgttccccattttcaatgtgtagtccaagggatttggtaccttgataggactaagaaagggaaaatggtcataaattaaccaggtgaatattaaattacagagaataagactattcatccaaactgcatttcctacagatttatccaataatgggcaagtcaagctgcacacatcatgcttgctctcattatctttaacaaagagtttgacagtctttctaaa

SEQ ID NO: 188631 - DNA, 284 bp, Homo sapiens
tgagctcatcctctccttgtctactccttgtcagaggtttggcatttgaggaatttggccttgggcaaggtgctgaagctgactgctttgtggttttaagggaaagcttaaaagattttctcgctatgggtattctctgcaataaaaatccattttaattgtttatgacattaatcaatgaaagatttatctgctttgggagaaatttctctagaacagttgaaagcttctgcctaaaagttgattaagagagatttttcttctttggcctccaacggataccc

SEQ ID NO: 188632 - DNA, 208 bp, Homo sapiens
ccctgatggaccaggacagcgccagcactaagacatgccctgaaactcacaggaagacctgatcaagaagacgggaacagcacagggcactgggagctgcaaacacccacgatactgtcagagatggagaaaggtatgacaggaagagcagatcaagaagacgggaacagcacgaggcactgggagctgcaaacgcctgcgataatgt

SEQ ID NO: 188633 - DNA, 135 bp, Homo sapiens
ccgcacccggccatataacaagcccctttcagccacaccttggtacatgttaatagggtgatttttgagaagtccctagattaccacattctggttggctggttgccataggaaccaaccatgtgctcagaggct

SEQ ID NO: 188634 - DNA, 397 bp, Homo sapiens
ttaacttccacagacaattttgctccccttattcataaagaaatccagccaatgctcatgtaccttttaaagttcttggagtctctaaatataatccttgtaatttataaaaaaaagaagggatacaacttcattaattttctctcctacatacaagtggcttctatgttcaaagatatttcagaatgcttaccatacaagtaaaagtttatctttataatgactaattcacattcattatcaaaaccactaattctcaaaggatcaacaatgtattccacttctctggcctgctttgtattttaactcatcagtatttaccaagcctacactataatattctagaggttagaaataaagtgaggaacacactggataagatcactaccctcctaga

SEQ ID NO: 188635 - DNA, 677 bp, Homo sapiens
cttaaatattgttcactcagtctgccttattttcagtccctacattttattcccctttccagaggtacatggtgttgtcagttcctgaaactttgaagattctgtgctgtaactggagtgtttatccagttttactccttctggcttgaggtttgtctcagatgtactaggtcagttatttctcgtctgttcttttgccaacttccaaacatctgtgttgtgtgcactgctgttagtcccgcttttgtggttttatattatttgatgtaaaaatccctttactgtcaattagtggagttttgggatttaatgaaattgggattaatcctcccttgtgagcagagccaggtgtgaatttcttttaatttccctattgggctttgttgaatttactgattctgaggattggcatctgtcaacagctctggaacattctctgttatctcgagaagtattttatcttctgcattctttctgttttcttcttttggaactcttattagaccttcatctttcattttattctccttgtctcttaatttcttttttatatattctcttttttggtctctttgtactatattctggatactgtcctaagattcatctttcagttagtgaattttgtcttcagctgtgtctgtctatttaatacataaaaggtgcttttattatta

SEQ ID NO: 188636 - DNA, 161 bp, Homo sapiens
taaagaactgttaagccacacagaaatccagaattatcacagaatcaggaatatacacaaatcacagaaaataatattcaaatatattaaatactcctcaataataccagagccctaaacacactgctctgggtcttcaattaaatacttttagttttctg

SEQ ID NO: 188637 - DNA, 190 bp, Homo sapiens
  misc_feature (6)..(6): n is a, c, g, or t
ggtccnaattgaaaagcaagggtaagacccagagagtgactggctcaccagatgctcctgagtccaactgaaacagggaggacggcctcttagaggtggaacaagatggctgggggaatacaccgtgtaggagaaaggacagagtggatggattgatcctttctagaaggagacaggtcacgtcattgtg

SEQ ID NO: 188638 - DNA, 341 bp, Homo sapiens
atgtaagccttcaggcgtaattggagttcttagcaaaatactttggtttttaatatttctatgaccctctaagggggacttagcaattactcttaaattttcaaagtggtgcatggagttttagctgtgtgacttccattaaagtccataggagtcttgttgctaaaacatcacacaactcacgaaaatgtgccccttcttgtgaaattgttagaagtaatgggtatggaagtatagcacagcatttctggtacatttacaagctttctgtacttgtttcaaactttatacctttatgaaaactcaatagttctacaaaaattgaaggggggaaaaagcct

SEQ ID NO: 188639 - DNA, 529 bp, Homo sapiens
gatccttttctcctttgtaatgggaaagatgaagatggtgtaaatgcaagtttatttgctggtggcatgattatgggtggggaggtgccatttgatagtttctattttctcattagttaggcagcagtgtcatcacctaacagtttagcaacagtgtagtatggattgatgtgaagtgaatcatttgaaaaaatgtgaagtaattatcggtatagtgttgctgtcattgctggataatagaaagtgttcccttgaaattgattattattactttagagtgatattactcttcccaattatgctattttctaagaatgccatacaaatgcaggcctgcaaaaacatatagaagcattaaggggaaagtgcattagataatgattactaatgtcaaggaatacatcttggaccatggaatttaaactagacagggaggcaagtgaggacaggagaggaatgatggatggtgggtcaaagagctggtggcttcattgacatttaataattggttcagcagggttacttgatc

SEQ ID NO: 188640 - DNA, 447 bp, Homo sapiens
tccctccagaaggtatgggtttgatacagtttctataaggacagaaaggctgggcacgctggatacacacactgtgtgcattcctctaagaactcagaggacagctggataaatgggtttgagagccaaacggacctgtgtgtaaatcttggctctgcaatttcctgcctatgttaccttacacaagtcatgccatctaaggttctcctttcctggtctacaaggtgggataatgatatctccttctcatggggctgttgtgaacattaaatgagatggcatgttaaatatataggactgtgccagggatgtaccaggcactcagtaaatgttagtttccccttttcttaaaacaaatcagcaacaacaaaccctctgaaggccaatggcatacacaccatgcttgcttcctacagtgcctaaggtcaggaccccttttcccaggag

SEQ ID NO: 188641 - DNA, 481 bp, Homo sapiens
ttcaggctctacttctaattctggttctctagctacatctccctcatctgcagtgacctctccacggaagtcttgaactcctcaaaagcaaattattgaaaaagatgaaggtcctttttatacccatctaggagcaggtcctaatgtggcagctattagagaaatcatggaagaaaggtttggacagaagggtaaagctattaggattgaaagagtcatctatactggtaaagaaggcaaaagttctcagggatgtcctattgctaagtgggtaagtgtgacttgataaagcctttggtcttaaatcttgggcattttgatttgtaaatctgaccctgagaattgggttacccagatcaaagactcatgccagttaaaaagaacattacctgtattttttatcatgtgttatctcttaagaagaggcagattagttctaaaatcaacaaattgtatttaattgaaataatttagtgatgag

SEQ ID NO: 188642 - DNA, 339 bp, Homo sapiens
gacaaccttatatcatcccacaagtcactgagatttctgttcaatttttttctatgatttttggattgggtaatttctactaatttatatttcagtttactggttctttctactgccgtacctaatgttatgttgagaccatgtagccaataaaaattctttcacctattttgcttttcagtttagagtttccatttttgtagtttccatttctctgtaaagatttcctgtctggggctgggtgtggtggctcatgcctgtaattccagcactttgggaagttggggagggggagcatgggatcacttgagcctaggagttcgagaccagcctgggcaa

SEQ ID NO: 188643 - DNA, 440 bp, Homo sapiens
cctcccaaagttctaggattttaagtgtgagccactgtgcccagcctacattcttattgtatcacaatatcacagtgggacagaaggaatcgttatgatatattattaattgataacaaattgatataattgatatgatgtttatgattaaaagggtcagaacccttttagtagtaagtcctgtggacacacctggttgctaggaaggttgggacatagagtgtttattctcattggccacagacttactattaccaaggaagaaagggaaaatgggtattgggggacaactggcaattcctgtcacaattgtctgcaaagatagcaaataatctgcctatggattaactaacaatggcagcctccaaagctgtgttgagaagaattctgaaattttacagtgagaagacgatgtgatagattgcttatgtctaaaatgt

SEQ ID NO: 188644 - DNA, 365 bp, Homo sapiens
gaaaagaaaaaatttagccagacatagtgacatgcacctgtattcctagctttggaggctcaggggagaggattgcttgagcccaggagtttgaagttgtaatgagctatcatcacaccactgctcttcagcctggtaaaagactctgtctctttaaaaaaaattatattttgaataagtaatatgtggttcaaaattaagtcttatactcaccatgatcctgtctaccaccccccactgccaagttagtaatcgactactttttttttagtctgtgtgtgtccctctctagtgttttttatgtaggtagatgaaagcaaatgttttcatccttttctggtacaatgtggcaaactatataacct

SEQ ID NO: 188645 - DNA, 359 bp, Homo sapiens
tgtgcggagataaatatgtgggagtatgcaatgtgagatgaacagggtgggggctggaatcctgttaacaactgatacatttaagaaaaagcagggatgaaggatcagagaaatccaatatgtaagataaaggctaaaaagtgttcagcaatgacttctggcttctcctagactaggttgaaatttaagctctaccatttacaagcttggtgtccctgggcaagttacttgtttgtgcctaaatttcctcatggataggatcgttgtgagcatgaaataagttaatacctgaaaagctctcagaatagtgctggcacggagtaagtgcctgcatgtgttagtagttgctacatccaaca

SEQ ID NO: 188646 - DNA, 621 bp, Homo sapiens
ttcaagcaattcctttgcctcagcctcccaagtagctgggactacaggtgcgcatcaccatgcctggctgattttttgtattttggtagagacggggtttcaccatgttggccaggatggtctcgatttctcgtgatccacccaccttggcctcccgaagtgctgggattacaggcgtgagccaccgcgcctggccaactttgatctttttaaacaaaattcacattacattgtgaatgggatccttgtcattaggtcttaatcttaaatttaggctaagacttttaaaactagcttttgataaatgaatgagcattaagttcttgtttgcaaacacccatttggccatgcggaatcaagaaagttgttacttcttcgaaagatgatttttcagtaatctctaagtcatcgtgtatttgtgatcatatatttcttaggtatagaaaattagacccttatactgaaataaagtataaagatttagcttgatatgctactgaatctaatttgagagacctggggaaggggataataatggtcttgtgtccttgtacacttttgtctaaaagaaggctttgatgactttttagagtaagttttaaagtcattctatatggcttg

SEQ ID NO: 188647 - DNA, 114 bp, Homo sapiens
taaacacccttcctccctaaagttccacatcctggaaatctgtcctccagcctactacaacaaatgtgcaaagacatgtcaacagggatgttaactgcggcactcggtcatagc

SEQ ID NO: 188648 - DNA, 543 bp, Homo sapiens
atgcctagttttcctctgcactgggctcctgctctatgatcggccatgtggaaggagatgatgttcagaccaggagcttgtgggaagtctgccagtgctgcaggtagggcccagagcccccagggcttcgtcagcccacaggcacaaaggtgggcctcctccctctctgtagaggagtatcccacttgtcccgccagtcaagccctggcagaacagtagcttcccaatcttgctgtgctgggtgttctccgaggaacatagggaggcagattcagagagccagacttgcctttgccctcatctccaaagggagtcctggtatgaggtttcattctttaaaaaaaaagatatatatttttttttttcagcaaaatcgacagttctgggtgagcgtgaaggagggaatcagttgcctcccttatctggcaggtgcttgctgtgcccactgaatcagagatccagtgaggaaggggaactcagcccctgggatgggggtatagacacatgttagaatgcatagcacatgcacagaagggaggcaca

SEQ ID NO: 188649 - DNA, 374 bp, Homo sapiens
agatagatgaaatctaaattacctaatttcacatttctctatcagaaaattcagcaatgtttgtgtgcaatgatttattaaagaatgaataacttttttggattaattctgagtaaaaaaagacttgtaaacgtaaatatacctttttcttcattcaataaatatgtatttagtacttactgtatggcaggtagtactctagagacttgtagtatatctctgaaaaaacgggcagagttctctctttgtagagcttgcttttgagaaggagggggacaagtaataaataatgagcagggtaagagatttaagtattgggcggtggcatgatagggcaggtggcaatattgaatagcacagtcagggtagacctt

SEQ ID NO: 188650 - DNA, 330 bp, Homo sapiens
tggatcctacactgaaaaaggagagggccactggtagcccacagcagggtgtctgagcctcagttaggcaagagggcatctgcacatgagaacagctttgcatagagtgacagagcccacgagggataaggagcccattcacgcagaggagggggtggcaatggcaacgagagattggtggcatacagggtgactaatctaataaattcatgtactaaggataatttgagctaggcttttcattgtcagaaaagggaattacaagcacaaaatggagaaaaactagaatgcatcctgcggtggtttttgttgttgttgtttttcttgaga

SEQ ID NO: 188651 - DNA, 250 bp, Homo sapiens
ggtggggggagggcattggcattcctgctattcccgaggtttccctgcctctcctgtgagttgagggcacccctgtgaaacctaagggcacgctgtggcagagaacatgcacggagctcctgcttctctcccgacagccctgggaaggccttactactttaggtcctaactaacaatatccaaacgaccaggtggtggtcccacagcaagggagctgtcagtcagagctgtgcctctgcccccgtatttt

SEQ ID NO: 188652 - DNA, 668 bp, Homo sapiens
ttgctatttccgccgcaaacacctcctgttggttaacaccttttcagacctcaagactcagtcaagatgtaacttccagaaagccttgactcagcctacgactagttcagatcagtaacacttctctggttttctcttttctcacagctctctgtgagtacttgatcataatacttatcacataggattgtagctatctgtttccttgttggttcctaccactagataggaagatccttgagggtagggactgtgttttagtctcccttgaattcccagaacctggaacacagtaggagcttaattgaagtttgccaaatgaatgactgaaagtctttctttggtagagattctcatgctcaaacttgtatagctgtactgttcttggcctaggtggtaatcttatcagctcaaatgggaaggggaggggaagggtaggaaggaaagggtaacaaaagattggctagaaccactgctattgttatacaactcctgctacatgaactcttatctaagacagagtagaagaggccctcataagggaaatcacgtcaataaaaaaattttagactgggcacggtggctcacgtctgtaatcctagtgctttgggaagctggggtgggatgattgcttgaggtcaggagttcaaggctgcagtgagacatga

SEQ ID NO: 188653 - DNA, 309 bp, Homo sapiens
ttaggtataagtcaaaatatgtataaaagtatgagaaaattgataaaacttggatgaaagaaattaaaaaagaactaaatgaatggaaagatattacatattcatcaataggaagactcaatattgtcagaatgtccattcttctcaatttgatctatagattcaatagaattcaattcaaaatcccagccaattactttgtagctattgacaaatgaatgctgaagtttatacaaagaggcaattgactcaaattaaccaacacaatattgaagaacaacaaacaaagttggaggactgaggctacct

SEQ ID NO: 188654 - DNA, 273 bp, Homo sapiens
tcgtgggtcttgcccgcgctgttcacccgacgacctgcagtgggacctggtgggagactttgcctggctggcgctgcgtcgagttctgtgccccgccggtgttctctcaccagggcacatggttttctccgtgggttcagagcagaagctcactttgttacgccgaggaagaaaaatacaaaccatttacatccaatgatttccctgcttgctgcccaggaatcggagggtttgtttcttgaagttcccgtaaacgtctgtagacacttccga

SEQ ID NO: 188655 - DNA, 326 bp, Homo sapiens
gaattatttacaagtgcaggagcctttaggcctctttctttagaatggaattgttttgaaagcatttcaaataaatatttcatccattattacttaaaaattttgcactttattctactgtaacactaaaacttatctttgagtttagtattaccaagtgcatcgaattacagattaaccgattgaccagctgctatttagtaaggtctcaactcccttaagagtaacccaatccacaaacttgactatgactaagcacttatcttgagttatttgaaagaaatatgaaacggtcgtcttgcttttagagtaattttaatcaactg

SEQ ID NO: 188656 - DNA, 501 bp, Homo sapiens
ctagactcattgcttcaaagaactttatatactgatacctttcaagatgtatatctctagacccaagctccttgcctgagctccagaacttgtatatccaactatctactcagcatataacttggatgtctaataagcatctcaaatttaacatggccaaaaccaagctatcggatttctatcacaccccaagtctgcttcccctgagcctttccggtcctagtaaattacacaattatacactcagttgctcaggacaaatacctaggagccctatttgtctcttctcttttcctcacacagcacattcaatccatcagtatctacttccaattcatcaataggttccattagctccaacttccaaaatatattctgaacctaaccacttctttccatctctactcttccaatctaggtcaatgccatcatcacttctcactggtctctgtggctgcactcttgattcctcattgtccttcctctatccacatagcagcc

SEQ ID NO: 188657 - DNA, 549 bp, Homo sapiens
aaccatttccttgggagaagattacagctcaagtctgttgaactttattgccttgggcctcatgacagtcttcagaaacatgcaaggcatttctgttaaagaaattcagatgtgctaggacacagatgacattcttgtgcatagcagtgtcctaagggggtgaggaataagtcaggaagaaaaagatgattcatactttttgctgcattctgggattattatatataatccatagagaggatggagaccttgcagagataccacataggaaaaaggtgcggtgttttcctacatggcctgactgtattttaaaataaaaacctaaacacgactccaaggtaatgactgccttcaaagtaatattttagttgattttaatattctctttgaaggaagttctcattgactcatatttcttttctccctctcctttctcacacacattcatttccagaggtttgactgagggagagctgctactgagttttaacagtcactctttttatatgtaaaactcatgttcttgaatttaaaacaaaagattacttg

SEQ ID NO: 188658 - DNA, 712 bp, Homo sapiens
ggtccggcttaggatgttcacatgagcagaggagcttgagactagtcatgggaaacatgatgagttcccatctctactaaaaatacaaaaattagccaggcctggtggtgggcgcctgtaatcccagctactcaggaggcttgaggcaggagaatcgcttgaacctgggagactgaggttgcagtgagcggagatcatgccattgcactccagcctgggcaacaagagcgaaactgtgtctcaaaacaaatgaaaagaaaaggctgtcatgttagatccaccctcctcctcaggggaacccctgggctgctctctgggtagagatgggaacccaggcctcgggccagtgagtggaaggaaactttgggatgattgacttgggactgggctagaggtgaagaatctcccagtaggcaaagttcggccttacgtttttttgtttcaagcaaaccacatcattacccacagaggccattggtgagatatttgtaagtctcctgacagtggctggagttcgttgcttggttgttgtttctctgtctcagccctggagatgggagtgaccacctgctctctctggacagaggctgtccacgttcatgcaattccttggacaccggtggtgcagcgggaggcgtaactgggagtgggagaccctgaactgtgccggttcttgcagagtatcactgtgacttcaggcgagtcaccccac

SEQ ID NO: 188659 - DNA, 403 bp, Homo sapiens
gttttactgtatgttgtaagggggcccagattcctgggtgtcttgcaggtaggtcatactagttacttaaaggtagagctttcttcagagggagggaatacaaatgagaaaaaaggcagacatggcgaacaagaaaacctattcagctgctacacttacaaaggcatattcttaaaggctaaatccagttatcaatagtattccctgtgctgagaaaattggtgccaattttaactgctttttctgcttttccaaattatgtgacatttttggagcctaaacaaacctgcaatgattccgtattgaccacctaccaataaacctcaactacacacataccttttctttcttgcctgtgaccctttctctctgtctttaattgtaactgcaactctaaggcatt

SEQ ID NO: 188660 - DNA, 287 bp, Homo sapiens
gcacagtgggccgggcactgctcacatgttctgtgtttgttgattcattccatcctcccagcaacaccctatgaggaaggttctgtcatctccatcattccagaggccacacttttagccctaccccacacttctcacctaggaagaagccaagaaagcgtgtccaggagagggagcaagggagggaagcttctgatactactgggaggcaaagtggggacagttgcagtggattcaggacccggaggacaggggagttgaaaaagtgagggctgaacccgggacgg

SEQ ID NO: 188661 - DNA, 299 bp, Homo sapiens
caggctggtctcgaactcccaacctcgggtgatctgcccgcctcggcctcccaaagtcctgggattacaggtgtgagccactgcacctggccgatcccgtcccatctcttaaaaaaaaaaatcaaaaagataaacatacatttgtaatggctggctatctggagacagagggccagagcagatgactgactgaggtcctttccaggggtagaatatgccgatgtcataaggctaaaggtagcatagttttggcggctgaagccattcctaggctggaaagggaattaggatttggtacg

SEQ ID NO: 188662 - DNA, 501 bp, Homo sapiens
ggtctctccacacggacgcgcataacatttggtgccgaagacccgggacaggaggactgcttcaggagatcggtcccctgtcatcgccctcactccatgaggagatccacctatgaccttgggtcctcagatcaaccagcccgaggaacatctcgccaatttcaaatcaggtaagtggtcttttcactctcttctccagcctctcgctacccttcaatctccctctcttgctatccttcaatctccctgtccttccaattccacttattttcctttctagtagagacaaaggagactcattttatccgtggacccaaaactccagtgccagttacagacttgggaagacattcttcccttggtgtttaatcactgcagggacacctgcctgattattcacccacactccattggtgtctgatcaccgcggggatgcctgccttggtcattcacccacattcccttggtggcaagtcagttgcagggatgcctgctttggct

SEQ ID NO: 188663 - DNA, 386 bp, Homo sapiens
ttgccaggataatggagggggtgcgggcaggagggaagtgggtgtagctattaaagagcaacaagagggagccttgtgatgatgggaatgttcagtatcttgactgtggtggaaacacaaacctatgtaagtggtaagattgcacagaacttaacacacatgcacacatacacaaataaaccagtatcctggttgtcctatgctagttttgcaaaatgttaccattgagagaaactgaacaaagtatacaaaggatccctctgtgttatttcttactactgcatatgaatctacaattatctcaataaaaattaccaataaaaaagtctccaaatattgccaaaggtccccatggcaaaactgtccctggttgggcaatcaagctt

SEQ ID NO: 188664 - DNA, 455 bp, Homo sapiens
tcctgccttggcctcccaaagtgctggacttacaggcatgagctgacatgcctggcctgatatgtcagttttcagtggttgtcagtgtttctttgttttctcctctgtcctaggcacttgtcactaggaaagtgcctaatgactccatcaggtgtggcatttattattgttgcaacagggaattgataagagaaaagaaggctatctgggggatgagttagccaagaagtggaagaagacagctgttattaggttgctgtcaaaatagcttgctttactctctggcatgtatcactccagggaatgaaataatccaagaatgataagctctcaattgccatctgttggtttgtgatgctgcttgccttgttctagttaacattgaacactgacctcacatggcacttggagaaacttagaggaggataagatgatcatagggtgtaaagcaaact

SEQ ID NO: 188665 - DNA, 400 bp, Homo sapiens
  misc_feature (302)..(302): n is a, c, g, or t
  misc_feature (320)..(320): n is a, c, g, or t
  misc_feature (384)..(384): n is a, c, g, or t
ctaacagcaaatttagcaaggtcacagaaggcaaggctgatataaaagatcaattatacttttatatgccagagagagacacttagaaaatgaaattaatgaaatagtaagctgttcaagacttcgcattgaaaaccacaatacgttgctgagagaaactgatgagacaaataaacgtatagatacaccatgtaaagatagaaatactaaatatcgttaagatgttctaatgaacctgtcttggcctctcaaagtgctgggattacaggcgtgcgccaccgtgcccggccccaatctttttnatagtttgtggttggttngtcctatctaaaaagtctgcctacccaaaggttttgaagacttatcagctttgttactagaagnttgtagtcagctttat

SEQ ID NO: 188666 - DNA, 238 bp, Homo sapiens
ttcaaaggagattacaccaaaaagcacattgcttttcatttattcattacagatctgtcatagcagcatttttatttttttgccctgaattgtagtgtcgttgtaataataaattttgttccagactcaggatattttaaaggtttataagccttttaactaatgttaccgtcttatttaaattgatcaaattggcatttcaacacgataatcttgcatttcttaaagttgaactaac

SEQ ID NO: 188667 - DNA, 603 bp, Homo sapiens
aaatcaaatgcaagccattgctttgggaggtcaaacattattttacaaaatagtgaaaatcatggagattattttaagcgtggattaattaagatgagtttatccaaattttagaagctgttatttctcttaggttttattttcagtgttttagctggaactgaaagaggattagcatctagggtacttgctcaaaggcacattgccctatgttttcacatttatataaataaatatctgtaagccccaactctcaatgtgactatatttggagatacagcctttatggaagtaattaaggttaaatgaggtactgaggatagggccctgatttaacataagtgtcattataagaaaagacatcttgctgtctgaaagccagaagcaagccctcaccagaacccaaccatattggcaccctgatctcaaacttccagcctccagaactgtgagaataaaaattgcttgtttgccacccattatggtagcccaagctgactaatacagactgcagaggagatcaccgtttatatgatcagtttaggtgctggatcagccagtagcagacagtcagccctccatcctccctcccttcacgtatgc

SEQ ID NO: 188668 - DNA, 713 bp, Homo sapiens
aaatcaaatgcaagccattgctttgggaggtcaaacattattttacaaaatagtgaaaatcatggagattattttaagcgtggattaattaagatgagtttatccaaattttagaagctgttatttctcttaggttttattttcagtgttttagctggaactgaaagaggattagcatctagggtacttgctcaaaggcacattgccctatgttttcacatttatataaataaatatctgtaagccccaactctcaatgtgactatatttggagatacagcctttatggaagtaattaaggttaaatgaggtactgaggatagggccctgatttaacataagtgtcattataagaaaagacatcttgctgtctgaaagccagaagcaagccctcaccagaacccaaccatattggcaccctgatcgagggccaaatcagtgggttttaaaaaacttataaagaacagaggtttatttggcttacagttctgtaggctatacaagcatggcaccagcatctgctccacttctagtgaggccacaggaagcttttactcatggcaaaaggcaaagaaggaacaaatgtatcacatggcaagagagtgaggagccagagatagaggggggaggccccagactctttttaacaaccagatttcaagtgaactaacagagcaagaactcattcatttggcccttatcgaggggtaccg

SEQ ID NO: 188669 - DNA, 409 bp, Homo sapiens
gtgcccctcaaggactctgggaagcaaagagctgtgcaggaaacaagaggctggaagacataagggagcagattagtccgttttaaaactagcctgatttacagaaagacatgatgaatgctttcatcatgttctcatatcaaggtgaagtcctgttatgaacttctgcccctgacattatatctctaaactagtagtaccataaacaactagcaaatttccctcctttcagacttgtgatggtggtaaaaagtcactgtagcacctaaacacgcaactaaattctacttcatttaggtacctgacatatacctctagaacagcaccagccaacagaaatataatgcaagcaatgtggataattttagcttttccaggaagtacaataaaaagtaaaaagaaacaaagg

SEQ ID NO: 188670 - DNA, 548 bp, Homo sapiens
taatagccccaaattggaacagcccacgtgtccaatgggagacgacacaaactgtggtatattcgtacaaaggaacactatttagcaacagtaaaatgaacagatatacaacaacaggaatgaatttcagaagtatttcattaaacaaaataaatcagacccaagaatactcctgtatgattccatttctatgaagttcaacggacacaactcatccatggtgacagaaatcagaacgtggttgccgcaggaagtgttacttgaaagggcagagagaactctgggcaggaggcttgtggaatttggatgtggtttctaagatgtaagcatttgtcaaaatcattggatggaacactgaagatctgtgcagttttctaaatttaatctcacctctatttatttattgagaaatggagtctgtgcagtggcgccatctcggctcactgcaatctccgcctcccgggttcacgctattctcctgccgcagcctccctagtagctgggactacaggcccccgccaccaagcccggctaattttttgtatttt

SEQ ID NO: 188671 - DNA, 437 bp, Homo sapiens
aggcacacatggcttccacttatgttccattctcttggattgaatgacatggttacacataagtgcaaagggggctagggagtagtttagctgcattccccaaaaatcagatttgagagacaacacttggtccattccacaactatccttcagtagtctaagtgaagttttgttcaattaaacattaaacagaggcacagaaaagttaaataactttccctaatttacacagttagcaagtagccaagttaggatttaagcccagagcccatacttttaaccactgtatatattaactctaaaagtattaacatctaaaagtattggcatctataggccgggcgcggtggctcacgcctgtaatcccagcactttgggaggccgaggcgggcagatcacgaggtcaggagattgagaccatcctggctaacatggta

SEQ ID NO: 188672 - DNA, 827 bp, Homo sapiens
cgtgaccaacaactcaatgagctctgattactctaaaagaactcatgtcactgactcatatgccttccagcactttaccctaaggagtccatagcattttctggctgctcgagaatagtgaggttgctgaatgtgttggtgtacgacgtatcggagaccgatacgtcatcctggtcataatctattgccaggaaacatagatgcttccagagtacggacctcttgtgtgctctagaactccccattgcctgtgagggtgagattagagactctgggccacgagctttaggaaaagggaaaagaggcctactgagtagagcattagtttgttccttttaggttgtattctgaaacaaatttaaaaataggagattcaaacaaaattattactcaagtcttgggcaaagatactggggattattttttaaataagacagacatcatttacaaaaagtttctgaaacaaaaaagttctgtcctgactatatctaggcttctgtatccttctcttctttatcataatgacatgtagaaattgaatgagtattttcttttactttgattttcccactaatttctgaaaattttaaactcttgccctaggaattcaactcctgcagaaaactcacatactcctggctgacactgaacaattcagggttattctttcttagtcccactgctgaattcttcatgctagtactttatgagatagcctgtgtccctggtcgcggctgtgcctgtcatgtggctcaggactgctttatgctaaatcatcagaggcactcacatacgttgctatatcgcttgatgcatgtagctccata

SEQ ID NO: 188673 - DNA, 552 bp, Homo sapiens
gtctcgaactcctgacttcaggtgatccacctgccttggcttcccagacagagtgttgggattacaggcgtgagccactgcgcccagcctcttggcctattgtttatgactatccttgatgtttcataggtgaaaaatactcttactttgaagagtccacagactcaccagggaaatagtaaaatttaaaaattaaaatgcacttttaagggccacaatagttaagtttgggaaaaacagatgagggggcatgtgttaatatttcagacaggatgtagacatgggggctttgggaggtgatgctggggctgatcctgaagcataggagtttgccagatgaaaaaagacatttcaggcagacaagtgcaaaggcagaaggtgaacatggtcatggtgtccccagggagctgtaagatacaattagggtgagggtacctatgagatgataactcgatgatgttggagatgtctggggccagatcatgaaaatcaagaaatctacaccagctaggagaaccattgatggctttaagcagaggagaggcactagtg

SEQ ID NO: 188674 - DNA, 208 bp, Homo sapiens
ctttatcagaaaatgctaatttagcttatgctttatgctctttatagtgcagaaaaaatgatttttaacttttggtgtgtcatagagataagtgggattaaccttttggtaactttagcgtcgagtgcctaactcttcctaaaccctgattttccaatgcagtcttttattgttattgggggtggtggtatatgcttttacttagagg

SEQ ID NO: 188675 - DNA, 523 bp, Homo sapiens
agaacatcacaacttatctgatgcttcacagtcctcagggctaagtcttaaagcatttccacagagagtggaacaaaacaaagggagcttttgttccttaaaaacacatctttctctacttcgatcatagctatttattccaacattccaggcacttaatacttttttatcacttgcaaaaaattacctgtttcctaaaccttttcatactccttaagaaaaaaaaaccttgtatttccttaatcttggccaataactcaggaatgttcatatttatttcccttgagccacatgaattggtgattgtgtatttggttcctactgttatctcagcagcccttcacattgctacacaaatgttagtattttatctttgctcaacctcacactcataatgtatccttattgaaaactcatttgtttgtaaatgttaatttattctggaagggtattctgggacaatattacaaattaagaagatgggctaagaaaataatttgtatttgctttgaattattctgta

SEQ ID NO: 188676 - DNA, 435 bp, Homo sapiens
tcaacaataatcaactcttgactacatccacatgtagattgctttgaaacaaatcacaggcatcatatcattttatctgtgtatatttcagtatagaatatataaagattaggacttcaaagcatattcacagtactgtttttacacctatacaaatcgatagtaaacagtctctatcttcataacattgctgagtcccagtcattactagaagcttgtctttctgtttggctgtgggcgcctgttgtggatttcttcttatctgtcctactcccaccaggtgacagggacattctacaatgattctgtcttattttggatttgtgaatccacatctgtgtcacatcgagtgctttctgcaagggggttttgcagtgcattttgtgtgggttttagatgcaaaaaagcgtatgtgcaaatggtatgcaaactctg

SEQ ID NO: 188677 - DNA, 411 bp, Homo sapiens
tgctcaaacctaagatacctgcatcatctctcaaatgtgtatgtgtgtatacatatttacatacatacatgctcatagtcacaaatatatatacatgttatatatatacattttatatacatatgtataaacagagtaaatattttagtggcttttcatatttttcaactgcataaaataggaacccagtaaatgttcactgaattaattaatttaattaattatttaagaagtatttagcataagcaactttcttcagaataaatttcaaatcactgatgccgtgcctacctagatatttggctatataacccttggttatcagtgattgcaattctttcctattccttggtggcctcctctcctttctttgtgtgtctctgattgtgatatgctataacccacacataa

SEQ ID NO: 188678 - DNA, 451 bp, Homo sapiens
aggtgccagagcgtgtgagtgtggatggagaagaggcagctttgatgatgacttcatttgctggccaaggcacggaggaagcagtgcttttctcttcgtctcttattttggtactccctttccaagctgcctcctgagctctttataaacactggcattctggctgagaaagactcgccaacatccaagagtggcaaaggggaacaggagacacatcgttggcttgggaaccgctcccgctcgcaggaagtctgctcacaggagatttttctctgtcagtgtcctcgtgtggtttctagtctggggagaacacatcagcacactaacggaagaaaggggagcccgcaaagaccaaagctgctgtgctgggggcgtggattcgagggctcttctccaggctgacagctgggaccctcattttgtcagccctgtggagttcctactagagtgc

SEQ ID NO: 188679 - DNA, 527 bp, Homo sapiens
aagagtgatgccctgtatggggagcattacactgaatacaccaatcaccgacagcacggataggaaatgttggtagctttaggatgatataattggccagtacttgattaaaaaaaattgttagaacaattgttagaataaaaccggccactttggggtcaaaatttgcatatgtatgcacatatttttagttgctaaatcacctatgattcatgatagtaatttaacgctttgacttaccttagtattaagcagatgctgttaaaccatataagaaattttgatctttaacgtatctttaaaaacattttaattcagaagtttgtagggtgtaaataaatggcatttttaggtggactttaacatttttgaaatataattttgggtttatttaaatcaacaataagctacttgtcaagaaagtaatacacttttgtatgttaacagtgccctaaaataaagatccccactctgctggctgtcattaaccattatttatttgctgaaataatgctatgtccagaagt

SEQ ID NO: 188680 - DNA, 322 bp, Homo sapiens
cagcattctacttacaggtccctgagggagctgggaagagaatagcataaaacaaagcacttcaatggcggataaaccgcttttcctcaaatttgctaccactcatcctgaggcttcttttgaacctaacagtgcagggaccagccccacagggtcggtgggcttctccctgtgtgcggcgacgagagagtgtagaaataaagatacaagacaaagagataaaagaaaagacagctgggcccgggggattactaccaccaatgcgcggagaccagtagtggccccgaatgtctggctgcgctgatatttactggatacaaag

SEQ ID NO: 188681 - DNA, 214 bp, Homo sapiens
tggaagccagcctgggcatgacatgaatgcatttttagctgggatgcctgattttcttttttctgacagagtgagattccatctgaaagaaagaaataaaaggaaagaagaaagagagagagagaaagaaagagagaaagaaagaaagaaagaaagaaagaaagaaagaaagaaagaaagaaagaaagagaaagaaagaaagaaagaaagaaag

SEQ ID NO: 188682 - DNA, 367 bp, Homo sapiens
tagaggctgaaagtcatggatccctcttttccagtcaggatgtgctgggccaacttcaccttggacaagttccccttggtgatgatcataaggagtgatagttgtcaatatagtatcttcctcagcagagatggccaagaagccctgcaatatgctaggctagctactaggcttgtggtcaaggtgacccaggataggcttaaaattagggaaagttgatgagaaattgggtccaaattatccaaaatgaaaattattcctaggctaccaaactgatctttctgctgaagtcaaaacacaattccagacaaaattcaaattaaaaaactagttaaattaaaatggaaaagcagaagaaagaaagaac

SEQ ID NO: 188683 - DNA, 4964 bp, Homo sapiens
gcggcggtcgcagctcgggtccccctcgggcgcccccgccgccgtccgcgcgcggccatggagctggaggtaccggacgaggcggagagcgctgaggcgggggccgtgccctcggaggcggcgtgggcggcagagagcggggcggcggcaggtttggctcagaagaaggcggccccaacagaggttctgtccatgacggcacagccgggccctggccatgggaagaagttgggccatcgaggtgtggacgcatccggcgaaaccacctacaagaagaccacctcctccaccctgaagggtgccatccagctgggcatcggctacaccgtgggccacctgagctccaagcccgaacgcgacgtgctcatgcaggacttctacgtggtggagagcatcttcttccccagcgaaggcagcaacctcacccccgcccaccacttccaggacttccgcttcaagacctatgcacctgtcgccttccgctacttccgggagctctttgggatccggccagatgattacttgtactccctgtgcaatgagccgctgatcgagctgtccaacccgggcgccagtggctccctcttctacgtcaccagcgacgacgagttcatcatcaagaccgtcatgcacaaggaggccgagttcctgcagaagctgctccctggctactacatgaacctcaaccagaacccgcggacgctgctgcccaagttctatgggctgtactgcgtgcagtcagggggcaagaacatccgcgtcgtggtcatgaacaacatcctgccccgcgtggtcaagatgcacctcaagttcgacctcaagggctccacctacaagcggcgcgccagcaagaaggagaaggagaagagcttccccacctacaaggacctggacttcatgcaggacatgcccgaggggctcctgctggacgccgacaccttcagcgccctggtcaagacgctgcagcgggactgcctggtcctggaaagtttcaagatcatggactacagcctgctgctgggcgtgcacaacatcgaccagcacgagcgcgagcggcaggcgcagggcgcccagagcacctcagatgagaagcggcctgtgggccagaaggcgctctactccacggccatggagtccatccagggtggcgccgcgcgcggggaggccatcgaatcggatgacacgatgggcgggatccccgctgtgaacggccgcggggagcggctgctgctgcacattggcatcatcgacatcctgcagtcctacaggttcatcaagaaactggagcacacctggaaggccctcgtccacgatggggacacggtgtccgtccaccgccccagcttctatgccgagcgctttttcaagttcatgagcaacacggtctttcggaagaactcctccctgaagtcctcgccctccaagaaggggcgcggcggagccttgctagctgtgaaaccgctggggcccaccgctgccttctcggccagccagatccctagcgagcgggaggaggcccagtacgacctgcggggggcccgcagctaccccacgctggaggacgaaggccggcccgacctcctgccctgcacgccaccttctttcgaagaagccactacagcctccattgccacgactctgtcatccacatccctctccattcctgagcggtccccctcggagacgtcggagcagccgcggtacaggcggcgcacacagtcgtctggacaggatggcaggccgcaggaggagccacccgcggaagaggatctgcagcagattacagtgcaggtggagcctgcgtgcagcgtggagattgtggtccccaaagaggaggacgcaggggtggaggcttccccggccggtgcctctgctgctgttgaagtagaaactgccagccaggcctcagacgaggagggcgcacctgccagccaggcctcggacgaggaggacgcgcccgccaccgacatctacttttaatttctatgcagcccccgacccagagccgagctccacttctgctccggctgcccccgaaggcgctgcccaccccgctgaggcccagagctcgggagatgcccgcctcgccgccccaccggacctcgtcctccccctgcacggatgccgacggccgggcccctccccgacaagcctcccagggccccggcaccccggtcggcagcctgcccctgtgagacccaccctcccgagcggccaatcgcatttgagtccttatttggcacagagacggaagcacgtgtgtgccgttttaggaaaagaacaaaaaagacacaaacaaaccaaccagagggagaagagcccctgcccactgcactctttggttctctgctgtgcctgcctgtgtcctgaggaagaagccaggctgttcgcggtggcctctggggacctgagccccgggggccccatcggcctgcagaggggacggctggggtcccgagcaactctgcctccatccacgtgggaagcggaccctcctgccctcagcttgggtttgggggcctcagtgcaggacatctggcctgaacatcgactgtggggacagccctcgccctgccaagcactgcggccactcagcagctatgttcccgccgcagtggggccctgacgcccacctcccaggtgcccctcgagcaaaaacctctggcgcctccaatccagacccaccacagctggagggccaggcctcctcttccccaggctgccacccacgctggcggagctcagggctggggacttgtccttctcttccaacgtaggccactcagcaactggcatggagggcccaggcaacggagacgttttctccatggcaggacagagcgggaggccgggccttgggccacaggagaccagctcagggcggaaggtcaggctccccgccccctccacgtggagacatggcctagggggccaggcccggctccacaggagtctccttcaggactggtgtggatgtccgccgcctctttcttgtttaagtgatgtgatgtctccgaggaggggagagaagactttgtttccgactcatcaccctccaagagggcagcgctcccagtggtgggactcagcccagactgccctggggcagcttcctgggcccgctgcgctcagagggtgctggttggaggccagagctcggcagagtcacccaccctgcccttccccaggacccctgagaggggcttattggtgatggctgtgggaatcccccacttccaagatgtgcccaggatgtgaggagctggagtggaagctgcacctttgggaagaattcctctccagacctggcagagcctggtgtggggtctgagacggccggagaacctcccaggcagggctctgtgttttgtctgttacaacctccgtatgacgccacgccacccgctgttcacgtcccgtcggcctcctgcacagcccacacgctgcgcccggaaggcccctgctgtggagaagccggacccatccccgaggtccccagcgaggacacacactccacgagagcagcccctccactctgcccaggagaggggccgaccctcctcgggaaccggccagccgcgtggctcccagcatccatcaggacaagcccacgtggggtcctccctgcgtgctcagagggtctgtccagccctgggaagcgaccttggcctcagttcacagcctggtgctcatctgctggcaccgggcatccacccatcagcccccgccctgtccctccgaaggacacccagcaggcaccccccggggaggcaggggcagaggtcagaaggggtgtctgggacctggatggccagcagggacaggggcattgtcatctcaaaggcccaacccccagaggccacaccagtcctcccagggagtcctcgagtcgccctgcccagagccctggcaccagagacgccaagagcctgtggggtgactcggagcagcaggtgtggccccgggcgggcggcaccgcgtccagggcagcctccctccgctgagtgacacgggacaccagtgcccggccgacgcgcctttgcaggagaaatgtgcaaacctctgtggataccatttcatttccattcttgtgttgtctccaaggcccctttggagatatacttggtgttggttgtgttttttggttccttttcagagaactgtaaaccgaggctgacgtgctccactgactgtgccgaggggcgggggcaggaggacggcaagacctatttataatatttagcgaactcggtctccctcagatcccccgcgagggaggctgctggacccaccccgctgtcccccatgatagaagtctgtaaataccttggtgaccaatgcccacttcccctcctgggtcacctctgatggctgctgtccactgagaacgtgggcagtgtccaaattcctgtactgtaaagactaaaaggcgtttgctctgagactgacaaggcggaaacttccatgtgtctcctgccaggctctgtccccctacgccatcccgacacgtccccgttcccccgaaacctggctcagtgcaatactcccattgccatggggtccttcaccatggtactgtctccacagccctcagtccccaccccaggagaggcgcctgccacctcctcctcatctccggtggttcaatcgctccgcctgtccccaacccagtcccatttttatggccaaactgattctgaaacaaaatgaaactgcaaacctcgtgtgtcttaactccccccagggatgccactccattcctccgccccgtggtctggtgcgtgacaatccaaagcgccgagacgagggtgctgtgtccctcaaacccagagtggtgggcgcctctgaaaccatacagccactcctggccccaaacactggtttgcatcccaggttcctcgcccacctacccccgccacaccccgtctttttagagatctctctaataaatcgggtaataagca

SEQ ID NO: 188684 - DNA, 5211 bp, Homo sapiens
gcggcggtcgcagctcgggtccccctcgggcgcccccgccgccgtccgcgcgcggccatggagctggaggtaccggacgaggcggagagcgctgaggcgggggccgtgccctcggaggcggcgtgggcggcagagagcggggcggcggcaggtttggctcagaagaaggcggccccaacagaggttctgtccatgacggcacagccgggccctggccatgggaagaagttgggccatcgaggtgtggacgcatccggcgaaaccacctacaagaagaccacctcctccaccctgaagggtgccatccagctgggcatcggctacaccgtgggccacctgagctccaagcccgaacgcgacgtgctcatgcaggacttctacgtggtggagagcatcttcttccccagcgaaggcagcaacctcacccccgcccaccacttccaggacttccgcttcaagacctatgcacctgtcgccttccgctacttccgggagctctttgggatccggccagatgattacttgtactccctgtgcaatgagccgctgatcgagctgtccaacccgggcgccagtggctccctcttctacgtcaccagcgacgacgagttcatcatcaagaccgtcatgcacaaggaggccgagttcctgcagaagctgctccctggctactacatgaacctcaaccagaacccgcggacgctgctgcccaagttctatgggctgtactgcgtgcagtcagggggcaagaacatccgcgtcgtggtcatgaacaacatcctgccccgcgtggtcaagatgcacctcaagttcgacctcaagggctccacctacaagcggcgcgccagcaagaaggagaaggagaagagcttccccacctacaaggacctggacttcatgcaggacatgcccgaggggctcctgctggacgccgacaccttcagcgccctggtcaagacgctgcagcgggactgcctggtcctggaaagtttcaagatcatggactacagcctgctgctgggcgtgcacaacatcgaccagcacgagcgcgagcggcaggcgcagggcgcccagagcacctcagatgagaagcggcctgtgggccagaaggcgctctactccacggccatggagtccatccagggtggcgccgcgcgcggggaggccatcgaatcggatgacacgatgggcgggatccccgctgtgaacggccgcggggagcggctgctgctgcacattggcatcatcgacatcctgcagtcctacaggttcatcaagaaactggagcacacctggaaggccctcgtccacgatggggacacggtgtccgtccaccgccccagcttctatgccgagcgctttttcaagttcatgagcaacacggtctttcggaagaactcctccctgaagtcctcgccctccaagaaggggcgcggcggagccttgctagctgtgaaaccgctggggcccaccgctgccttctcggccagccagatccctagcgagcgggaggaggcccagtacgacctgcggggggcccgcagctaccccacgctggaggacgaaggccggcccgacctcctgccctgcacgccaccttctttcgaagaagccactacagcctccattgccacgactctgtcatccacatccctctccattcctgagcggtccccctcggagacgtcggagcagccgcggtacaggcggcgcacacagtcgtctggacaggatggcaggccgcaggaggagccacccgcggaagaggatctgcagcagattacagtgcaggtggagcctgcgtgcagcgtggagattgtggtccccaaagaggaggacgcaggggtggaggcttccccggccggtgcctctgctgctgttgaagtagaaactgccagccaggcctcagacgaggagggcgcacctgccagccaggcctcggacgaggaggacgcgcccgccaccgacatctacttttaatttctatgcagcccccgacccagagccgagctccacttctgctccggctgcccccgaaggcgctgcccaccccgctgaggcccagagctcgggagatgcccgcctcgccgccccaccggacctcgtcctccccctgcacggatgccgacggccgggcccctccccgacaagcctcccagggccccggcaccccggtcggcagcctgcccctgtgagacccaccctcccgagcggccaatcgcatttgagtccttatttggcacagagacggaagcacgtgtgtgccgttttaggaaaagaacaaaaaagacacaaacaaaccaaccagagggagaagagcccctgcccactgcactctttggttctctgctgtgcctgcctgtgtcctgaggaagaagccaggctgttcgcggtggcctctggggacctgagccccgggggccccatcggcctgcagaggggacggctggggtcccgagcaactctgcctccatccacgtgggaagcggaccctcctgccctcagcttgggtttgggggcctcagtgcaggacatctggcctgaacatcgactgtggggacagccctcgccctgccaagcactgcggccactcagcagctatgttcccgccgcagtggggccctgacgcccacctcccaggtgcccctcgagcaaaaacctctggcgcctccaatccagacccaccacagctggagggccaggcctcctcttccccaggctgccacccacgctggcggagctcagggctggggacttgtccttctcttccaacgtaggccactcagcaactggcatggagggcccaggcaacggagacgttttctccatggcaggacagagcgggaggccgggccttgggccacaggagaccagctcagggcggaaggtcaggctccccgccccctccacgtggagacatggcctagggggccaggcccggctccacaggagtctccttcaggactggtgtggatgtccgccgcctctttcttgtttaagtgatgtgatgtctccgaggaggggagagaagactttgtttccgactcatcaccctccaagagggcagcgctcccagtggtgggactcagcccagactgccctggggcagcttcctgggcccgctgcgctcagagggtgctggttggaggccagagctcggcagagtcacccaccctgcccttccccaggacccctgagaggggcttattggtgatggctgtgggaatcccccacttccaagatgtgcccaggatgtgaggagctggagtggaagctgcacctttgggaagaattcctctccagacctggcagagcctggtgtggggtctgagacggccggagaacctcccaggcagggctctgtgttttgtctgttacaacctccgtatgacgccacgccacccgctgttcacgtcccgtcggcctcctgcacagcccacacgctgcgcccggaaggcccctgctgtggagaagccggacccatccccgaggtccccagcgaggacacacactccacgagagcagcccctccactctgcccaggagaggggccgaccctcctcgggaaccggccagccgcgtggctcccagcatccatcaggacaagcccacgtggggtcctccctgcgtgctcagagggtctgtccagccctgggaagcgaccttggcctcagttcacagcctggtgctcatctgctggcaccgggcatccacccatcagcccccgccctgtccctccgaaggacacccagcaggcaccccccggggaggcaggggcagaggtcagaaggggtgtctgggacctggatggccagcagggacaggggcattgtcatctcaaaggcccaacccccagaggccacaccagtcctcccagggagtcctcgagtcgccctgcccagagccctggcaccagagacgccaagagcctgtggggtgactcggagcagcaggtgtggccccgggcgggcggcaccgcgtccagggcagcctccctccgctgagtgacacgggacaccagtgcccggccgacgcgcctttgcaggagaaatgtgcaaacctctgtggataccatttcatttccattcttgtgttgtctccaaggcccctttggagatatacttggtgttggttgtgttttttggttccttttcagagaactgtaaaccgaggctgacgtgctccactgactgtgccgaggggcgggggcaggaggacggcaagacctatttataatatttagcgaactcggtctccctcagatcccccgcgagggaggctgctggacccaccccgctgtcccccatgatagaagtctgtaaataccttggtgaccaatgcccacttcccctcctgggtcacctctgatggctgctgtccactgagaacgtgggcagtgtccaaattcctgtactgtaaagactaaaaggcgtttgctctgagactgacaaggcggaaacttccatgtgtctcctgccaggctctgtccccctacgccatcccgacacgtccccgttcccccgaaacctggctcagtgcaatactcccattgccatggggtccttcaccatggtactgtctccacagccctcagtccccaccccaggagaggcgcctgccacctcctcctcatctccggtggttcaatcgctccgcctgtccccaacccagtcccatttttatggccaaactgattctgaaacaaaatgaaactgcaaacctcgtgtgtcttaactccccccagggatgccactccattcctccgccccgtggtctggtgcgtgacaatccaaagcgccgagacgagggtgctgtgtccctcaaacccagagtggtgggcgcctctgaaaccatacagccactcctggccccaaacactggtttgcatcccaggttcctcgcccacctacccccgccacaccccgtctttttagagatctctctaataaatcgggtaataagcaaaaaaaaaaaaaaaaaaaaaaaaaaaaaaaaaaaaaaaaaaagggggggggggcaaaatttcccccgggggggcccgacgcgaatccccagccttccggtcggcaaaggggggccgccgcaatactgaggacggtcagaatcaaaataaacgcacaggcgcaagggggcgcgggcgtgttaaaaacaagcgtcgggaacgtggggaaacacgggcaaacctggggaaactttggtggaagagagacc

SEQ ID NO: 188685 - DNA, 1175 bp, Homo sapiens
gcggcggtcgcagctcgggtccccctcgggcgcccccgccgccgtccgcgcgcggccatggagctggaggtaccggacgaggcggagagcgctgaggcgggggccgtgccctcggaggcggcgtgggcggcagagagcggggcggcggcaggtttggctcagaagaaggcggccccaacagaggttctgtccatgacggcacagccgggccctggccatgggaagaagttgggccatcgaggtgtggacgcatccggcgaaaccacctacaagaagaccacctcctccaccctgaagggtgccatccagctgggcatcggctacaccgtgggccacctgagctccaagcccgaacgcgacgtgctcatgcaggacttctacgtggtggagagcatcttcttccccagcgaaggcagcaacctcacccccgcccaccacttccaggacttccgcttcaagacctatgcacctgtcgccttccgctacttccgggagctctttgggatccggccagatgattacttgtactccctgtgcaatgagccgctgatcgagctgtccaacccgggcgccagtggctccctcttctacgtcaccagcgacgacgagttcatcatcaagaccgtcatgcacaaggaggccgagttcctgcagaagctgctccctggctactacatgaacctcaaccagaacccgcggacgctgctgcccaagttctatgggctgtactgcgtgcagtcagggggcaagaacatccgcgtcgtggtcatgaacaacatcctgccccgcgtggtcaagatgcacctcaagttcgacctcaagggctccacctacaagcggcgcgccagcaagaaggagaaggagaagagcttccccacccagtcccatttttatggccaaactgattctgaaacaaaatgaaactgcaaacctcgtgtgtcttaactccccccagggatgccactccattcctccgccccgtggtctggtgcgtgacaatccaaagcgccgagacgagggtgctgtgtccctcaaacccagagtggtgggcgcctctgaaaccatacagccactcctggccccaaacactggtttgcatcccaggttcctcgcccacctacccccgccacaccccgtctttttagagatctctctaataaatcgggtaataagca

SEQ ID NO: 188686 - DNA, 417 bp, Homo sapiens
ctggcctcagggaccggtaggggtctggtgggccacagggacgtggggtatatgtgggcggcggccctgtctgggctttgctatgagcccccagcaaccccaagcaccaacccccacccttccctgcagccctgaagtcctcgccctccaagaaggggcgcggcggagccttgctagctgtgaaaccgctggggcccaccgctgccttctcggccagccagatccctagcgagcgggaggaggcccagtacgacctgcggggggcccgcagctaccccacgctggaggacgaaggtgaggggcagagggcagagtgcgcttgtgggcgctacagggggtgccagcagcagccccgtgggtggggtgccgcctcatcctgagtgcccatcgctcagccaccccctccggatctgcagg

SEQ ID NO: 188687 - DNA, 5048 bp, Homo sapiens
gcggcggtcgcagctcgggtccccctcgggcgcccccgccgccgtccgcgcgcggccatggagctggaggtaccggacgaggcggagagcgctgaggcgggggccgtgccctcggaggcggcgtgggcggcagagagcggggcggcggcaggtttggctcagaagaaggcggccccaacagaggttctgtccatgacggcacagccgggccctggccatgggaagaagttgggccatcgaggtgtggacgcatccggcgaaaccacctacaagaagaccacctcctccaccctgaagggtgccatccagctgggcatcggctacaccgtgggccacctgagctccaagcccgaacgcgacgtgctcatgcaggacttctacgtggtggagagcatcttcttccccagcgaaggcagcaacctcacccccgcccaccacttccaggacttccgcttcaagacctatgcacctgtcgccttccgctacttccgggagctctttgggatccggccagatgattacttgtactccctgtgcaatgagccgctgatcgagctgtccaacccgggcgccagtggctccctcttctacgtcaccagcgacgacgagttcatcatcaagaccgtcatgcacaaggaggccgagttcctgcagaagctgctccctggctactacatgaacctcaaccagaacccgcggacgctgctgcccaagttctatgggctgtactgcgtgcagtcagggggcaagaacatccgcgtcgtggtcatgaacaacatcctgccccgcgtggtcaagatgcacctcaagttcgacctcaagggctccacctacaagcggcgcgccagcaagaaggagaaggagaagagcttccccacctacaaggacctggacttcatgcaggacatgcccgaggggctcctgctggacgccgacaccttcagcgccctggtcaagacgctgcagcgggactgcctggtcctggaaagtttcaagatcatggactacagcctgctgctgggcgtgcacaacatcgaccagcacgagcgcgagcggcaggcgcagggcgcccagagcacctcagatgagaagcggcctgtgggccagaaggcgctctactccacggccatggagtccatccagggtggcgccgcgcgcggggaggccatcgaatcggatgacacgatgggcgggatccccgctgtgaacggccgcggggagcggctgctgctgcacattggcatcatcgacatcctgcagtcctacaggttcatcaagaaactggagcacacctggaaggccctcgtccacgatggggacacggtgtccgtccaccgccccagcttctatgccgagcgctttttcaagttcatgagcaacacggtctttcggaagaactcctccctgaagtcctcgccctccaagaaggggcgcggcggagccttgctagctgtgaaaccgctggggcccaccgctgccttctcggccagccagatccctagcgagcgggaggaggcccagtacgacctgcggggggcccgcagctaccccacgctggaggacgaaggccggcccgacctcctgccctgcacgccaccttctttcgaagaagccactacagcctccattgccacgactctgtcatccacatccctctccattcctgagcggtccccctcggagacgtcggagcagccgcggtacaggcggcgcacacagtcgtctggacaggatggcaggccgcaggaggagccacccgcggaagaggatctgcagcagattacagtgcaggtggagcctgcgtgcagcgtggagattgtggtccccaaagaggaggacgcaggggtggaggcttccccggccggtgcctctgctgctgttgaagtagaaactgccagccaggcctcagacgaggagggcgcacctgccagccaggcctcggacgaggaggacgcgcccgccaccgacatctactttcccaccgatgagaggagctgggtgtactccccgctccactatagcgcccaggcccccccggcctccgacggcgagagcgacacataatttctatgcagcccccgacccagagccgagctccacttctgctccggctgcccccgaaggcgctgcccaccccgctgaggcccagagctcgggagatgcccgcctcgccgccccaccggacctcgtcctccccctgcacggatgccgacggccgggcccctccccgacaagcctcccagggccccggcaccccggtcggcagcctgcccctgtgagacccaccctcccgagcggccaatcgcatttgagtccttatttggcacagagacggaagcacgtgtgtgccgttttaggaaaagaacaaaaaagacacaaacaaaccaaccagagggagaagagcccctgcccactgcactctttggttctctgctgtgcctgcctgtgtcctgaggaagaagccaggctgttcgcggtggcctctggggacctgagccccgggggccccatcggcctgcagaggggacggctggggtcccgagcaactctgcctccatccacgtgggaagcggaccctcctgccctcagcttgggtttgggggcctcagtgcaggacatctggcctgaacatcgactgtggggacagccctcgccctgccaagcactgcggccactcagcagctatgttcccgccgcagtggggccctgacgcccacctcccaggtgcccctcgagcaaaaacctctggcgcctccaatccagacccaccacagctggagggccaggcctcctcttccccaggctgccacccacgctggcggagctcagggctggggacttgtccttctcttccaacgtaggccactcagcaactggcatggagggcccaggcaacggagacgttttctccatggcaggacagagcgggaggccgggccttgggccacaggagaccagctcagggcggaaggtcaggctccccgccccctccacgtggagacatggcctagggggccaggcccggctccacaggagtctccttcaggactggtgtggatgtccgccgcctctttcttgtttaagtgatgtgatgtctccgaggaggggagagaagactttgtttccgactcatcaccctccaagagggcagcgctcccagtggtgggactcagcccagactgccctggggcagcttcctgggcccgctgcgctcagagggtgctggttggaggccagagctcggcagagtcacccaccctgcccttccccaggacccctgagaggggcttattggtgatggctgtgggaatcccccacttccaagatgtgcccaggatgtgaggagctggagtggaagctgcacctttgggaagaattcctctccagacctggcagagcctggtgtggggtctgagacggccggagaacctcccaggcagggctctgtgttttgtctgttacaacctccgtatgacgccacgccacccgctgttcacgtcccgtcggcctcctgcacagcccacacgctgcgcccggaaggcccctgctgtggagaagccggacccatccccgaggtccccagcgaggacacacactccacgagagcagcccctccactctgcccaggagaggggccgaccctcctcgggaaccggccagccgcgtggctcccagcatccatcaggacaagcccacgtggggtcctccctgcgtgctcagagggtctgtccagccctgggaagcgaccttggcctcagttcacagcctggtgctcatctgctggcaccgggcatccacccatcagcccccgccctgtccctccgaaggacacccagcaggcaccccccggggaggcaggggcagaggtcagaaggggtgtctgggacctggatggccagcagggacaggggcattgtcatctcaaaggcccaacccccagaggccacaccagtcctcccagggagtcctcgagtcgccctgcccagagccctggcaccagagacgccaagagcctgtggggtgactcggagcagcaggtgtggccccgggcgggcggcaccgcgtccagggcagcctccctccgctgagtgacacgggacaccagtgcccggccgacgcgcctttgcaggagaaatgtgcaaacctctgtggataccatttcatttccattcttgtgttgtctccaaggcccctttggagatatacttggtgttggttgtgttttttggttccttttcagagaactgtaaaccgaggctgacgtgctccactgactgtgccgaggggcgggggcaggaggacggcaagacctatttataatatttagcgaactcggtctccctcagatcccccgcgagggaggctgctggacccaccccgctgtcccccatgatagaagtctgtaaataccttggtgaccaatgcccacttcccctcctgggtcacctctgatggctgctgtccactgagaacgtgggcagtgtccaaattcctgtactgtaaagactaaaaggcgtttgctctgagactgacaaggcggaaacttccatgtgtctcctgccaggctctgtccccctacgccatcccgacacgtccccgttcccccgaaacctggctcagtgcaatactcccattgccatggggtccttcaccatggtactgtctccacagccctcagtccccaccccaggagaggcgcctgccacctcctcctcatctccggtggttcaatcgctccgcctgtccccaacccagtcccatttttatggccaaactgattctgaaacaaaatgaaactgcaaacctcgtgtgtcttaactccccccagggatgccactccattcctccgccccgtggtctggtgcgtgacaatccaaagcgccgagacgagggtgctgtgtccctcaaacccagagtggtgggcgcctctgaaaccatacagccactcctggccccaaacactggtttgcatcccaggttcctcgcccacctacccccgccacaccccgtctttttagagatctctctaataaatcgggtaataagca

SEQ ID NO: 188688 - DNA, 3031 bp, Homo sapiens
agcggggggagtttggatgccgccgctgccgcgggctggaacggcgcggcgcgggggctgcaggctatttcgggaagggggcgtgaggaggcggctgcccccgaaggcgctgcccaccccgctgaggcccagagctcgggagatgcccgcctcgccgccccaccggacctcgtcctccccctgcacggatgccgacggccgggcccctccccgacaagcctcccagggccccggcaccccggtcggcagcctgcccctgtgagacccaccctcccgagcggccaatcgcatttgagtccttatttggcacagagacggaagcacgtgtgtgccgttttaggaaaagaacaaaaaagacacaaacaaaccaaccagagggagaagagcccctgcccactgcactctttggttctctgctgtgcctgcctgtgtcctgaggaagaagccaggctgttcgcggtggcctctggggacctgagccccgggggccccatcggcctgcagaggggacggctggggtcccgagcaactctgcctccatccacgtgggaagcggaccctcctgccctcagcttgggtttgggggcctcagtgcaggacatctggcctgaacatcgactgtggggacagccctcgccctgccaagcactgcggccactcagcagctatgttcccgccgcagtggggccctgacgcccacctcccaggtgcccctcgagcaaaaacctctggcgcctccaatccagacccaccacagctggagggccaggcctcctcttccccaggctgccacccacgctggcggagctcagggctggggacttgtccttctcttccaacgtaggccactcagcaactggcatggagggcccaggcaacggagacgttttctccatggcaggacagagcgggaggccgggccttgggccacaggagaccagctcagggcggaaggtcaggctccccgccccctccacgtggagacatggcctagggggccaggcccggctccacaggagtctccttcaggactggtgtggatgtccgccgcctctttcttgtttaagtgatgtgatgtctccgaggaggggagagaagactttgtttccgactcatcaccctccaagagggcagcgctcccagtggtgggactcagcccagactgccctggggcagcttcctgggcccgctgcgctcagagggtgctggttggaggccagagctcggcagagtcacccaccctgcccttccccaggacccctgagaggggcttattggtgatggctgtgggaatcccccacttccaagatgtgcccaggatgtgaggagctggagtggaagctgcacctttgggaagaattcctctccagacctggcagagcctggtgtggggtctgagacggccggagaacctcccaggcagggctctgtgttttgtctgttacaacctccgtatgacgccacgccacccgctgttcacgtcccgtcggcctcctgcacagcccacacgctgcgcccggaaggcccctgctgtggagaagccggacccatccccgaggtccccagcgaggacacacactccacgagagcagcccctccactctgcccaggagaggggccgaccctcctcgggaaccggccagccgcgtggctcccagcatccatcaggacaagcccacgtggggtcctccctgcgtgctcagagggtctgtccagccctgggaagcgaccttggcctcagttcacagcctggtgctcatctgctggcaccgggcatccacccatcagcccccgccctgtccctccgaaggacacccagcaggcaccccccggggaggcaggggcagaggtcagaaggggtgtctgggacctggatggccagcagggacaggggcattgtcatctcaaaggcccaacccccagaggccacaccagtcctcccagggagtcctcgagtcgccctgcccagagccctggcaccagagacgccaagagcctgtggggtgactcggagcagcaggtgtggccccgggcgggcggcaccgcgtccagggcagcctccctccgctgagtgacacgggacaccagtgcccggccgacgcgcctttgcaggagaaatgtgcaaacctctgtggataccatttcatttccattcttgtgttgtctccaaggcccctttggagatatacttggtgttggttgtgttttttggttccttttcagagaactgtaaaccgaggctgacgtgctccactgactgtgccgaggggcgggggcaggaggacggcaagacctatttataatatttagcgaactcggtctccctcagatcccccgcgagggaggctgctggacccaccccgctgtcccccatgatagaagtctgtaaataccttggtgaccaatgcccacttcccctcctgggtcacctctgatggctgctgtccactgagaacgtgggcagtgtccaaattcctgtactgtaaagactaaaaggcgtttgctctgagactgacaaggcggaaacttccatgtgtctcctgccaggctctgtccccctacgccatcccgacacgtccccgttcccccgaaacctggctcagtgcaatactcccattgccatggggtccttcaccatggtactgtctccacagccctcagtccccaccccaggagaggcgcctgccacctcctcctcatctccggtggttcaatcgctccgcctgtccccaacccagtcccatttttatggccaaactgattctgaaacaaaatgaaactgcaaacctcgtgtgtcttaactccccccagggatgccactccattcctccgccccgtggtctggtgcgtgacaatccaaagcgccgagacgagggtgctgtgtccctcaaacccagagtggtgggcgcctctgaaaccatacagccactcctggccccaaacactggtttgcatcccaggttcctcgcccacctacccccgccacaccccgtctttttagagatctctctaataaatcgggtaataagca

SEQ ID NO: 188689 - DNA, 1299 bp, Homo sapiens
gcggcggtcgcagctcgggtccccctcgggcgcccccgccgccgtccgcgcgcggccatggagctggaggtaccggacgaggcggagagcgctgaggcgggggccgtgccctcggaggcggcgtgggcggcagagagcggggcggcggcaggtttggctcagaagaaggcggccccaacagaggttctgtccatgacggcacagccgggccctggccatgggaagaagttgggccatcgaggtgtggacgcatccggcgaaaccacctacaagaagaccacctcctccaccctgaagggtgccatccagctgggcatcggctacaccgtgggccacctgagctccaagcccgaacgcgacgtgctcatgcaggacttctacgtggtggagagcatcttcttccccagcgaaggcagcaacctcacccccgcccaccacttccaggacttccgcttcaagacctatgcacctgtcgccttccgctacttccgggagctctttgggatccggccagatgattacttgtactccctgtgcaatgagccgctgatcgagctgtccaacccgggcgccagtggctccctcttctacgtcaccagcgacgacgagttcatcatcaagaccgtcatgcacaaggaggccgagttcctgcagaagctgctccctggctactacatgaacctcaaccagaacccgcggacgctgctgcccaagttctatgggctgtactgcgtgcagtcagggggcaagaacatccgcgtcgtggtcatgaacaacatcctgccccgcgtggtcaagatgcacctcaagttcgacctcaagggctccacctacaagcggcgcgccagcaagaaggagaaggagaagagcttccccacctacaaggacctggacttcatgcaggacatgcccgaggggctcctgctggacgccgacaccttcagcgccctggtcaagacgctgcagcgggactgcctggtcctggaaagtttcaagatcatggactacagcctgctgctgggcgtgcacaacatcgaccagcacgagcgcgagcggcaggcgcagggcgcccagagcacctcagatgagaagcggcctgtgggccagaaggcgctctactccacggccatggagtccatccagggtggcgccgcgcgcggggaggccatcgaatcggatgacacggtcttcgctggcctggcgggggagcaggtgagcgtaccagcctgtggcgtgagcagagcgtgcagggcgccagcccagcgggtctgggtcccagtggcttcaggatgactgctg

SEQ ID NO: 188690 - DNA, 355 bp, Homo sapiens
tgtcacatacaagctcctggaaaactccatcatatgcttgtaagagaatgagagtattaaccttgtagacttctgtaaggggctaagagaaacactgagctaaataattgaggggatatactatgttcatggcttgaaagactgtaagtattgtaaagatgttcttccgaaaccaatcacagatttaatacaagtccaaacaaaatcccagatatgtgtgcattgtctgtttgtgtatgcatgtgtgaaaaatggtaaattgatataaagatgaaaaagaccaggcacagccaagtcaatctttaggaacaagaaagtgagaggactgaccgactctgatggacattaagactta

SEQ ID NO: 188691 - DNA, 455 bp, Homo sapiens
ttaataatactgaatgaggacaaaaagcactcgaaacagcagagttccagaagaacaccaaatttatatttaatttaaaaaggacagcctcttaattaggcaaatttcacatttttttataaaaaagaaacaattagaattgtttagtgtgaataaaattagtgtgaaatttctcactatcccaaattctatcacagcaaacacagagacatacaacagctggtcaatttaacttacatatcctgttattaaacattacctcaggtccattaaactcactttcttccccaactccttccccacaaaaaagactataaattgtatactgcatgtcataatgggaagatgattacctttttctggggcatgatacatgcagaagctgtaactacaagaaactgaagtaaaagtaacccatattatacatcttcaatgtaagtctcagagacacacca

SEQ ID NO: 188692 - DNA, 366 bp, Homo sapiens
tctctccctattccatgttaattcaaatttgtctatgtggtttaataaggcagaccctgccttcttatgatgagcttgtaacctggacctggtccgagtacttcacccatctgaccatagtaattgttcaggtatagaaatgtggctcaaatcagactaatcatcatcctccctaagactggtattataagaaaggatatactctcaatttctagatagaagcctataaggaccagacagcttgaaactgaagggggtatcttgcctctgagtagagagacttctgaaaataaggccaagcagagcagaaggactggggaagagagaatccagatgacatctctgaccttctggatgtggctctca

SEQ ID NO: 188693 - DNA, 587 bp, Homo sapiens
gtctcaccttggaatagattatatatacttcggtgagcctgaataatttaactttgcaatgctatgtgtgccttttgctgcaatatcccagagcatttattaagggcctttatgagggtgtcatcctaaatgccacactggtctaggctggtgtgcatggcacaaagaggctaaatggtacaaaacattagagatgaagcccagatacaataaagatggagcagcaagagcagagctgagaagcccagatggcctcaaatcccaagataagacgaaaatccccaaactaaagctgtcagacattgaaagataaacatgactctgaaagatgagtaaaaggaagatgaagacacatgggtgtaggaatctgtgaccacattcacagagagctgctagaggtcaagggcacgaacacttggctctgcaaagtggcaaatgggattgttttctggttttgtttgggttttgtattttaagataatagccaactttagcaaaagtacaaggaaacaggcactgtcttattcagagtgggagtaaagacaacacaacccttctggaaacaaatttagctccatgtaacgaga

SEQ ID NO: 188694 - DNA, 272 bp, Homo sapiens
tgaacatacacagattgggcatctaaatctgaggtgggatgtgaaatggaaggggcaagaagcccttcctgggcagtatcttcaatgtggtactttgaggataaaagaatgttaaacagacctgtttgggagacaaggatggcatgggaacattagagatgtggaactatggcaatacctcgcacactcgaaatatgatgagttaggcagagaaggagccaaggtgcatttatggatgcgagtgatgggagataagggtggagaaatggcta

SEQ ID NO: 188695 - DNA, 292 bp, Homo sapiens
accataagaaatgaacccccaagatgatgcttttttgtgctatagtaattttttttaagaaatgaaaaagaaagttttaaaatatctacccagatatttacaagttctaaccttcattgttttctgaagattcaactttccatctggtatcatttccctacagcctgaagaacttcttttagcatttcttatagtgcagatctactagcaatgaattatctgacaatgtctttatttcatattctttctgtttttttttttgttgttttttttttttttttttgagacagag

SEQ ID NO: 188696 - DNA, 350 bp, Homo sapiens
tcttctccctgacatgagaaactgtaagtccaataaacctttttcttttataaattgcccagtctcaggtatgtctttatcagtagcatgaaaatggactaatacatagacagcatgaaaatggactaatacatagacacacacacacacacacacacacacacgcacacacacatacacacaaacaccctagatatacaaataggaagatgattttttctagtcatctgattatctcaggctacaattgtaataactataggtattataggtgtattggtcatggtttcctgattagtattcagccagtttgaccaatatgaaaatctcatttgcaattaaagaaattt

SEQ ID NO: 188697 - DNA, 384 bp, Homo sapiens
agccctgggaagccggaaccacttagagaccatcttttgccagtgtgctgacctctgctccacctcccccaaatggatcttcagttcaaatggatgataaacaccttttcattaaaaaggccagttctgggatggttaaagcaccatcagtcatttacacatccatttgtattaaaaggaaatccagagactcacactgacgcctaggggagattagcagctctttgtgatgtaagtgaaaggaaggtctgtaactttggcctaaggagtgcattggagaaaattggtaggttcctgaggaaattcagtttttagagcaagctcactttttagggcaagctcaccttggtagatgagagttgagtgctggaagtggtaaaataa

SEQ ID NO: 188698 - DNA, 153 bp, Homo sapiens
cttccagggggatcgtaggacgagaagaagaatattctttctggttgtgttgcgtgtgtacgtgtatgtgtgtgctggggttgagggtgtttatgggggcgaggtgtgcaaaggattctggagagctggtgcatgtgtgggagttgtgtggag

SEQ ID NO: 188699 - DNA, 665 bp, Homo sapiens
  misc_feature (660)..(660): n is a, c, g, or t
tcttgccccctgcctagtccgagatgagattgtggaatccagagcctccactgtggccaaccaagccaactgcccttagggctgttccccaggctgtgccttcagtggctctgacatccatatttttctagctggccttcagaatctagaacttccttccccagcacaccctccccgcagatcatgtctgtctgtctgtgtaacagctgcttctctaccctaccacagtcgaaccacataacatagcatttcgtaaggataagatggtgacgcacttgctaggagctcagcactgggttaggtcctccgcacgcctcatgcgattctcacaccaccgtgccaggaaggctcccaactggagtaactggctgggagtggagcccaggaaggctgaactccaggctctttctaccacctgacaatggccccagtgacaccacacaagctttcagctacgtacaaaattgcctttcctgcttgcctctagaatgaagctactgactagaggtgaggggtgacgtatgtgggaccctctccatgacgttagtggtcaggacactggttctgttggtgaggttcctcaggaagcatcctgtagctgaaaaaacaataagcattatccagcaaggggactgagatgaagggaaggcagcagcatgnagaac

SEQ ID NO: 188700 - DNA, 397 bp, Homo sapiens
aagggttctgagggtatgaatatgctggctagtgcctggcaaacagtaggcactcaaatattacttatattttacttatacaaatattaccttttatattttacctatacaaatgatatatatcagaggtactaaaaccataagaagagaaagagaaatcttatcttccttttccccattgagatgacagagtggcatacaaattagagacccatcataaatgcatctctgggttatctactaaccacaggagtactggtggtagtaacagtactaataggattactatcagcagctaacattatgggttacattcataacctcatttattcttcacaaaaccctgatacaattagatatgttcagttattatcccacttcacagatgaagaaactg

SEQ ID NO: 188701 - DNA, 150 bp, Homo sapiens
gctgccctgcgttgctattcagtattagtccggctggttgggttggggaggaatgggcagagaaatcagcccaatgagcctcccctcctctttccctaaaagtaacagccacgggctctggagaacacggtgtgaaaaccacaggaggga

SEQ ID NO: 188702 - DNA, 348 bp, Homo sapiens
agatgagttaggaatgggaggggcaggaaaggaaaaaaaattggcattgagttttttgctagggcaagggggaggattatgggtggcattttagaggaacaggcccacaagccagttactggggaggagacagaagggcaaatgttatattctgaaactattagatagctgaatggtggtgtcagtgaacatgcaagtctggaactcaagagagaagtcagggctaaatatataaacttgagtggccagaataaatatgaatttcaagcaatgggaacaaatgggattacctagaaaagcgcagagatctgccttttataatttaaaatggctcaccaggcgattctc

SEQ ID NO: 188703 - DNA, 445 bp, Homo sapiens
acaccctgcacccagatcttggcatctaaataccatttgctacaagagaacaagagctccttggagagagggctgatgccagggctgggacagggaaagtctaagatgagcctggaacatcttgaaccagaaagcaatggaataatgaggaagatgggccaaggggacagagaagcttgctggaattcaccccatctgtccaaaaggggacaatgtaagcatcaaaagaaataatgatagcattgaatataataggaaaccataagtccatgtagatacaaataaataaatgaacaagtggcaggtttgatggtgaatgagatgttgcatggtttcaaaatccctcttcataaaatgcttaactataaagggcaaaagagtaacttctctgtggagaagcctggcagtcaccaccttaagtgatcagagtgaatgtcatcaataa

SEQ ID NO: 188704 - DNA, 330 bp, Homo sapiens
gaaaatacatgtagactatgacccagtaattccttttctggatatctatctttcctcatattaagtcctgtatgcaccaaaatacatgtacaagagtattcatgccagtcccaaactggaaataacccataaactgtagaatgaatgaacagtcatctatatggtgaaatactatacaggaattaaaatggataaaccatagctaagttcaaaacaaataaatctttcaaatattgttgggtgagacaagttatataccgtattcagtatggatgcttccatttatataaggtacaaaaacaggcaaaactatagtgttgggatgtttag

SEQ ID NO: 188705 - DNA, 271 bp, Homo sapiens
ctttgtaatttttgaaactgaaactaagagaaaatatgtcttgctcacaaaagagcctcatgaataaagcaggttaaaaagaaaacttttaaccaatatatagaagataaagaaacaagggacattgttccaggccctagatccagctgtcatttatgccacagcaccctcctcacctaactttcagtttgctcatggaaagtgaggttctatcacttgcaaaaaaaattacccatattctttttttttttttttttttttttttttttgg

SEQ ID NO: 188706 - DNA, 370 bp, Homo sapiens
aacaaattacctacaccctcccatggcccccagccacagccttggagcctcctctcttccagtcaagcctctgaacagaatagtctctaccagcagttcccaaatgtgtgttacaagaacaccctggtccgtgaaaaagggttcacaggttagcaacaaaagtagaaaatgaaggcacaattgcagcaagctcttcttagaattaaacttattccacttacaggaccatccttcattctgatgagccattacaacatttttgtattaaaacataatttattttagaaaataatgattggataattagagagtgatttggttttcattattctcatctgatcaaataaaagcgggtgactcaacatcaaga

SEQ ID NO: 188707 - DNA, 509 bp, Homo sapiens
atatcaaaatgccatcctgtgattatttgagggctgcaagagagtaatctaacctagcagtgggacatagggtgggacagtcctgctgccaggatgcagtaggaaggtatcctaccaaagccatatgactggatttgaacgcagccttggcactcaatgtccagtgtccagaggcccttgggaatagatgacaccacaaggaagcaacctgcctgacccagaaaggggctgttccatagagcaacgggtcccgtatcctctgcaaatcagtgtcatggggggagaaaggagactggggagagaggctgttctagatgaaaagagatttacggggtccaacacccaactgcaagaggggtcgtcaatgagatgctggcgtaaatgagagagtcgtcaaagggattagggatcattgggagagggtgattatggggtggccctcggaaggaagtaggggatcataactgctcatgtgttggatggatagtggcactgggtcatggaagaaa

SEQ ID NO: 188708 - DNA, 606 bp, Homo sapiens
ggggttgtccattggacagctcaaagctgggctagtgagcaacaaccagctacaaggaagtggaccaaagggcaagctggcttaatgattgctgctgcaagcccggttggattttattgttttgtttttctcttgctcaattttatacaattttcttgggatggttttagtgctagcctattcctggcccatgcagaactcctctattaggcaacttttgctggaagactccccatattcgtgtccaagattttctcagaactgtataacactgaggatcttgctactcaatcctctttccttcggtcctttcatagaatgaaagttgtcagactcaaaatgaggtcacttgtgtcaaacacgtggagctggggccatgaagggaagattctcatgcacatatgcctcataacaagaactctcacaaaaggctctgcaaaaactacaactttgcacaaaagctacaaccttacacaaaaagtacttctgcaaggacatctgcctagcaactgtctgtccagccttggactgattctacccttgttgatttttgtagccaaggatatttgtctcaaacaacttgtatcaccctcctttcctcacttt

SEQ ID NO: 188709 - DNA, 488 bp, Homo sapiens
cattctgtaatttcccaggcaagctatttaaggtgactatctctctacatatttgagatgaaaaacaataacatgacaatccatcccttcttaggtttttgtaagcagacttactacctgtgactcagttttgttctcacagggtactaattaatccttcacgataataacttgtcaaattccattacttctgtaaaggcaatactttatatttgtttgtattcaaattttaaactgatgttaaatgccgtgggtgcaactgcaggttaaaaatatgtgtttgaatctcttattctttttgcttggcaatgtatgaaataactgctctttctagaaatcttgatgatgaagtggcctgttgttttgtcacctaaaaatgcaataatgttcaaattaagcttttctttattaacatcacttgattgtgtgccatatttagagcttagtgaaattttaatctacacattgattaaatacattttatttat

SEQ ID NO: 188710 - DNA, 245 bp, Homo sapiens
cgactctttgaggacccctgaccttccgtgccctgagatgggtgcggggagatgagactaggctgtgggcgtccatgatgatctgggcaggcttgtgtcagagaaggagtcaactgtggatgggacaggcagccccagggattcaggagtgatgccccagcctcttagataggagatggagtgtccacgtcaaaaacgttgtatatatttttactcacttttcacattaatgggccaaaagttaa

SEQ ID NO: 188711 - DNA, 630 bp, Homo sapiens
gagtgaccgtgcccaggcagaattttttcttttaggtttctgcaaatacataaaagtaaatctcaagcagcttaaattaatcaaggaaaaatgtgaggctctgggatcttgaacaaaaagagactgaaaaaaatttggatccactacaaactagtcagtctgtagtacaaaaggcaggacaaaagaagacagccacactaagtccacctgttgtctactacagccgagtggctgttcttcttttgttctgaatattggcatggcaggctgcctcctatggagagctgttatcttagtatgaaaggctaatagaatacttgcttagaatactaccacagcccatttgtgaatattaatgacccaggctttgatatcttgcctttgccaatagactttttaccaaaatcaaaaggattgtatgcccagggctgtcttggtttctaagaattgtccaaaagacatatgacatgttttctgtccccatgttcattacagttggaaccacaaaacagtctcattatgtaacacctggggttcattcagtacatttggtgattgacactgtcacatggtaagatttatgtggaccggcatgtatagccctttcaagaagtagtaattaagtcaaaa

SEQ ID NO: 188712 - DNA, 758 bp, Homo sapiens
ggaatgttgtgactgttttgatcttctatacaaaccactaaaactttctccagatcagcaataaggctgttttgctttcttataatttgtgttcactggaatggcatttttaatttccttcaagaactttccctttgcattcacaacttggctgactggcataagaggcctagcttttggacaatctgggctttatacatgccttcctcactaagctgaatcatttctagcctttgatttacagtgagtgagatcagatggtgtgactcttccttttatttgaacatgtagaagccattgtgggggttttaatggcctaatctcaatattgttttgtctcagggatagggaaccctgaagagggggagacagatggggaatggcaggttggtggagcagtgagaacaaacatttatcagttaagtttgcagtcttatatgggtattagaattttttttaataaaaagctcctcaagtgagtctaattccactctctaaaactcatcccttgagaaaggctgaataacaatccacatatacctccaaggcagagagaccttgctcacccatctcaaaactgcccccactcacctacctagtcagtacctgaaatgtaaatattatttggggctgggcatggtggctcacacctgtaatcctagcactttgggaggtcaaggtaggcatatggcttgagcccaggagttcaagaccagcctgggcaacatggagaaattctatctccacaaaaaatgcaa

SEQ ID NO: 188713 - DNA, 460 bp, Homo sapiens
ccggggccccctttttttctgcccctccaacctgggggaaaaaataaactttttttcccaaaaaaaaaaaaaaaaaaaaagagagagagaaatatacacacagagagacagaaagaaacaaaggcaaagagaaattgaggcagaaaaaattagaggagagacagacagacaaggctcaagaaagggtctgcagaggaatgagagaagacaggcaagtgagacccagagagaggctgcactaacctgacattcttgggtgctcacagaccaccctccctccagctggggccagtgctgagcctggtgtatacaggtatcacttaacaagtgcagaataatgcccggatgactggagagccctagatgtagaaagaagagattatgggggagtaacaggtgggggtagaaagatggttttttatttgttttaaattagggacagggtctcactctgtaccca

SEQ ID NO: 188714 - DNA, 589 bp, Homo sapiens
gcctcaaatgcaagaaagatgaaaggcagcaaattactattaaaattactacacaaatcccttgaatatgtaaatgttttaatattagcagctaatgaaaaacaatggtgacaacaaaagatggctcacatgctgtgtcgctaacattactgaaatgctactaattactaatcattataaaaagttactaattactaatcagaaacagtatatcctatttcctctataattatgatttcctcgattattaaataatacctgaaatcacggtggttcacacccgtaatcccagcactttgaggggcgaagggaggaggatcacttgagcccaggagttcaagaccagcctggtcaacataatgagaacgcatctctattagaaaaaagaaatctgagccaggcacggtggctcacgcctataatcccagcactttgggaggccgaggcgtgcggatcacaaggccaggagattgagaccatcctggctaacatggtgaaaccccgtctcccctaaaaatacaaaaaattagttgggcgtggtggtgggcgcctgtagtcccagctactctggaggctgaggcaggagaat

SEQ ID NO: 188715 - DNA, 385 bp, Homo sapiens
gccataggtgaaagcttacagtcttctcaggatgtttctgagtgtgtatctttcctaggcatactgtgactttctaaattcccccccccccccacagctgcctttgaacgtcctaatttcccaaagcgtcaaaaacaattctattttaagactaaataatacttttcaatccttttatgtatgtaacagacgtttattcttctcttgctaacctgaagtcttctttgcattaaatttgacatgtcagagttgatcaacaatgatgaaagagtgagattaacactgtaaatggaatgttccaggggaagatagaatgaatcatagttcaggttctcattattatccacagatgatatagttttctaaagattctttctgcccagtc

SEQ ID NO: 188716 - DNA, 532 bp, Homo sapiens
ctggattcagtttgctgtcattttgataggatttttacatccttgttcatgaatgtgttagacagtaattatgtattttttagatgcggcttattttttcccaaactatttaaaatagttttttattttgtagtataaatcagattaaatgttaagccttcagagttggctggtcacatagacaactatggctgagggccttgactcaaagttttagttataaaattataaaattacacagcgtagttagccgtaaaacctaccttgggtaaatgatacatactttattatatgacttactattttctatcttcttccattatcgttttataaatttctaaattcttatagttataaaaagaaaaaatatatagaattattccaaaaaaattatttttccattttttattgtggtaaaatacatgtaacttaaaatttaccaccttaagcatttttaattatacagttcagtgatattaagtacattcacattgttttacaaccatcaccaccatctatttccagaacattt

SEQ ID NO: 188717 - DNA, 1362 bp, Homo sapiens
gtaccattttgtatcttttatactatattgttcttgtagtttttctatgtttagatatacaaatatcattgtgtgcagttgcctacaatattcaacacagtaacagtgctgtacaggtttgtagcctaggagcaataggctatatcatatagcccaggtgtgtagtaggctataccatctaggtttgtgagtacactctgtgatgtttgcacaaggacaaaatcacctaacgacacatttctcagaacatgtcctcatcattaagcgacgtgactacacacacaatttgtgcatttgccttaactatttccttaagtggaattacagaatcaaaacatttaattgtttttttctttttttgtgagatgaagtctcactctgtgtcccaagctggaatgcaatggcaggatcgcggctcactgcaacctctgccttccaggttcaagcaattctcttgcctcagcctcccgagtaactgggattataggcgtgtgccaccatgtccaccttaatttttgtgtttttaatagagatggggctttaccatgttggccaggctggtctcaaattcctcacctcagatgatctacctgcttcggcctcccaaagtgctgggattacaggcgcaagccactgcatccggccagcatttaattctttaagactttagaatttctctctactcaatagaagtttattcctactctgtggcagtactattctaggcactgagaatacgagaggaggctcagtgaaccaaacagttcctgctcttaagaaggttggtgggaggtcaggattaataagacaataaataagtaaacaaataaagaattaatttcaggtagttacaagtgctatgaagtaagacaagttgaagtagtttctggggtgaaaatgtggagtaggtggtcagataagcagccttcattgtagaagttaggtttgagttaacatatggaagaaagaaaaagcatggaaggatctgtggttaaagcatttcaggctgagtaaactgatatgcaaagacttaaggcaggaacaagtttgacatgtttgaggaataaagtcccagtgttgtgggaattcagccatgggaagagtaatagggatgagatcgaagagctaaaggaccacagtcagaagcttagattttatccgaggtgcataagagaggtatcagagattttatgtaataggatgacatctaatttacatatttagaaaatcatttggctgctgtgtgaggaatggattagagataggagtatttgaaaagacaaaatggaaacagagagacaaattgaagttctgccctaattcggaaattgatggttgttctttgtgctaaggtagtatcat

SEQ ID NO: 188718 - DNA, 200 bp, Homo sapiens
tctgttttcccagctgtaaaagggagctaataatagctcttgcggctagcgttggatcacccaataaaccttgtaagcatatgctgagggcacacccacacaggcatgcacgagaaggaagaatgccatagttgccatttcataagcaccacgaagataaacatcatgggaaaaatagcaactttaggctgggcacggtg

SEQ ID NO: 188719 - DNA, 405 bp, Homo sapiens
cctgcctcagcctcctgaatagctgggattacaggcgtgtaccaccacaccaatttttgtatttttagtagagacagggtttctccatgttggccaggctggactcggactcctgacctcaagtgatctgcccgcctctgcctcgcaaagtgctgggattacaggcatgagccaccacacttggccatgagatgagctttatctgtgcaaagtctctctgtggtcagctggggctggggccgtgggtcagttctgaagggcatttccatgagggtttgaggcctgagattgtgtcctgggccctctggccccagtggtgagccgcatgctcatgtggcaggaaggatctggttcctctgataacctgcttaggctgacccctctttttcctggaggacggctgtc

SEQ ID NO: 188720 - DNA, 348 bp, Homo sapiens
tacagtagtgcatgttttctgcagtagaagaaagaaagaagcagtctatttctagtggctgggggtagggaggtgctggggaagagcaggaacctaggaagagtcagcagagggtagccacaccccagccccatggacgagactcctgaggaatccataaaactgcgaagtactaagttctggcaacagatctcaaacctgctccttagcaagagagctaaaaagagagtgtttcttatgtactctgttaatttgactcttaaggcatataaacaatagggagaccctgtctctacaaaaataaaaaacttagccagatgtggtggcatatgcctatggtcccagcta

SEQ ID NO: 188721 - DNA, 600 bp, Homo sapiens
ttcattctgtcaagtaggaggggaccagccctgtggggaagtaaaacagtgtttggaagctcttgctgtagacatggcctgaactaagacagtggaaatgggaatggagaggaggcatcagatgtgagcaatattaagaagatagaatccatagaattggaggctgattatgggaatgaagaggtaagaatagcgcgattgcctggctttctggcttagggaactgaatgggtagtaccattcagatagagagtatgagaggtaaattagggaagtgacatgggaaaaaatgcattttgaatgtttttagtttgaggtgtttgtagcacatccaggcaaagatgtctaataaggtgggtcagctaaaggaaagagcaagagtaaagatacggaggcaggagagggcctaaattgttcagtgatactggggcctggagttttgcagaagaccagactgcaaaaaaggttagatgtcggccaagttgtgaagggctttttgtttgtttgtttgttttgagacggagtcttgctctgttgcccaggctggtgtgcagtggcacaatctcgggtcactgaaacctccacctcccaggttcaagg

SEQ ID NO: 188722 - DNA, 311 bp, Homo sapiens
tcatctctctaacatttttgatatttagtgtttaatctcttttcacatgttttttcttttcatttagggagagctttggaagtttgtcctctacatcactgagttgattctccgcagtgttgtctgttattctattcatggaaatttaagcctgttgtttatttgtatggtggtctggcttattgaggcttggtctatttcacttcagactgcttctcagtctgctttctcattttgataggaagtattatgaaataagttttaaatactttaaacttttgagactgagtgcacggacttaaattctagct

SEQ ID NO: 188723 - DNA, 267 bp, Homo sapiens
gtgggagggcctagaggccccaaaatgggaagccacagcagtggcatccagggctaaggctggggccacggagctggtggtggcaaggccaaggccaaggagtaggtccccatcatcaaactgggcagcatagtcaaggacatgaagattaagtccctgaagctctatctcctctccctgcccatcaaggaggctgagatcatcgactttttcctgggggcaaccctcaagaatgagtttaagattatgccagtaaaaatggagact

SEQ ID NO: 188724 - DNA, 357 bp, Homo sapiens
cagggcagctctatgctgcctatggctgagccccagggcacacagtacaggggtagtggggagaaagataaagaaagagagaaagagagagaactggggggatgaattggggggtcagttgttgactgactgagggacactacaggtggtctgaggtccaagtataatggtgggggaaaagccaccatggttagaggctgggcagacaggctggggccagagtgggaaggaaaggctgtgaacaccacagaagggagcaaggatgtaagccccagggccatgaatagctgtggacaactatggacaactgtggtcagctgtggagactcttgaaagccagggagtaacacgatcaac

SEQ ID NO: 188725 - DNA, 581 bp, Homo sapiens
acacaaaaaaacctctatttgcatttgcacttaaattcctccaggtgttaagttacatttttagtgaaacacactaaattgtaggtagcactgtttgtagacaccatcattgcaacactgatcaacaaaatagccactaggcacctactagatgaaactgatcagtcagatctggacttggcctcagattctttctctgcaagaagattagaaacatacatggaataactataatcccacacagaaagcagtaagtgccttgggagttatatatagtacttggtataattaaaaaagggagcattcaaaaagggagcgcttatccttaggttgtaagggaagggggtaggggctggagagggaaatacagatgtagagagatgccaaaacaaagtcagaaaccccctctgcccagccatgaatgttctaccatgtgctaagccatagtcccaaatccccaaaccctttggacagaagcaaggagacaacagcaaatacgtggtggtggcaaagtacagcgcaggcacaaggtgtttctgttgggctggaatctagggtgtgtgtaagactgtgaaggaaga

SEQ ID NO: 188726 - DNA, 299 bp, Homo sapiens
ttgaagtattcatgagacacctcaatagctttctctacaggcaattggatatatgaatttggcaatcagtgatgtgggtggaattagagatacggtattattagcatataggagttggttgatacattgggaattgatgagctcactcaaggacagtgtataatttacttgaagcaaaaaagaaagtgagggacagagtgctatccttatatttaagttgtacagaataaagtaaatgagccaagatgggccagagatcagaaggatgggtctcagccagatcaccctcatatccagct

SEQ ID NO: 188727 - DNA, 507 bp, Homo sapiens
ttggaaatgtgagagaacatttcacaagcaatccagacccacttcagaataaatcggaatgtggcaaaaatattatgagattttgaacttgggtaactgagaaagcagtggaagtattactattcattgctcaccctaagtgcgctgtgaaagacctgactgacagtaaagatggtttgtgacgttaatgctggggctggttatggactttttcatttggtcaatgtgtaggaaagatttttttcttttttctttttcttttgtctttttgtcagttgcatcggggcttgcaaaagctgctgttttcaatacaagactgttaagtgctgaaatacaaatcatttctaccttcaacagatttggccagtataattaaataaaaaggaggtgctttctaaaaaatcctaagaggataaaagcttttatatagtgctagccgtagataatgatttcaacccgtattctagcaatgagggtgaatgttgatggatcaaatatctttctgtg

SEQ ID NO: 188728 - DNA, 317 bp, Homo sapiens
gatgtttatcaagacaccattaatagagaaagaaggcaagctagaagaaggcaagtagaagaagatatttaaaatacatacacctccaacaggacttaaaaacataaataggcactttacaatagaggatatgcagatggccaatacacatgagaaggtgctcgacctcattgatcatcagggaaatacaaattgaagccacaatgagatgtgtatacctttaccagaatggttacaatctaaaagaaagtaatactacaatagactcaaaaacaccaaatacctagcaatacattacacaaaaaatatagaatact

SEQ ID NO: 188729 - DNA, 508 bp, Homo sapiens
ctggcagcatcttcagaagataaatgacacactgctcctatttgagcaccatcaagaagagtcttgtataaatttgttcagtcctgtcacattctcatgagaaaacaagataagattatcttattttaaaatgacatattggatttaaataatggcagccagccttcattatttcaatttcataaaacaatgcaacaaattccttttcttaatgattctttaatatggtgtcccaatttctctcaaatcactagtgtgaatgtcaagtggatgctggctttggcactactctaagagatgtatctaagaacctaacagaggactaagcaatcttgatgtgtgtaccacggatgtcttagagataatggcagggaattccataggaagttggcagatggtcttttattcctataacactccttggtctttcataatatcttaggtactaactcataatgtcaaattttagaggcttaaatccttgtctttcaccttagaggaaaagctt

SEQ ID NO: 188730 - DNA, 1034 bp, Homo sapiens
tactttttgaaatatccgccatcaattcatcttgttgagaatgtttagatttctcttcttttaagtctttttctagacagaggatttcatcctcaagttcagaattggacctgttcagcttttcacaggttgcctccaaacttcgtgcttcttctgctgccgccttctcaaagctggcatcctctaaagatgactctacttcatagccttcatactctttttgaataaggctaaacttttcaagtagtttacatttttcttcaattagtccagaaagcgttgcaccaagtttttgctctcttcccacgtaaagccgactcctaaccgatctaaaacttctccacaaaaaaaggagaacaacaaaaaatccaataacagctgcacataccaccagttccgatggaaaaccataaggattctcatctggtctcatactctcaggtagtgctgccacaactctgcgtagctcctccaggaccagccccaggtagggctgaggggtagcaccaggctcctccatagcgtcgaggctgctctggcggtcaccgcagtaacactggccacaacaagcggtggagaacacgcagccttgggtctggaacccgaatgcgcacgtgacaaccaaccggagcggaccactgtggagcgggctgcggggggagctggggaacgcgggcacccacaggcctcacaggcccatgttgtcccccaccacctcccctggccctcttgttacacttcacatcctgaggcagcgctggtctgagcccggcccgccttagttctggcagttttcacatcacatattttgaagctttattttttggtgaatacacttttaaaattgctgtcttcttcatggattaaacctttgatcattatataatctctggttttggtagttttctttgctttatctgatatgcacacagacactcttgctttcctttcattaatgtttgtgtaatatatcttttttcatcctgttaatttggcctgccctgtattggtaaaattcaagtgagtttcttgta

SEQ ID NO: 188731 - DNA, 266 bp, Homo sapiens
gaccatgcccgactaatttttgtatttttagtagagacgggatctcaccatgttggccaggatggccttgatctcttgacctcgtgaccccgtgacccacccaccttggcctcccaaggtgttgggattacaagcatgagccactaaggatttgtttttaaaatttttttgctttatttttttcttctctttttttgtactagagatggtgtcttgctatgttgcccagacagatcttgtactcctgggctcaagttgtcctcctg

SEQ ID NO: 188732 - DNA, 530 bp, Homo sapiens
atatttgaacccgggcaagtctgactccaacatctgtgttcctaaatattccccacgtggccgtggggaaggtcaacgcaatgaataacgagaaagaagacacacagcttagacagattttatgaatcagaattaagcaacataagttgcccgtctcccccttcttccctcctcccttcttccttcccctgcgggcatcgtcggcccttgcattcgcatcctttgcaggtgaaggaatggcatggaatctcgcgtgagaacttcatggttccaatgtcagaattatgtagggataattagaattcttaggccctggtgtgatgtagtaggaagaaaagaggttatggagttggccatagataaaatagaatctctgctctgctaacttctaattatgtgctttcaaaaaatacatttcccttcctggatattcagtttcctgatgtggataacccatcctgatgggcaattatacaagaaaattgatgttaagttcctagcacggtgcctggcacattgtcaatgttcaa

SEQ ID NO: 188733 - DNA, 111 bp, Homo sapiens
aaggtcctttggaggggaagcccaaaaagacaatcactgacttcctgggagggcagaggatgaggatggagaatgcacttcctactaggacatgaaaccagttaaaacact

SEQ ID NO: 188734 - DNA, 314 bp, Homo sapiens
gccccacccctatctcccttcgctgactctcttttctgattcagcccgcctgcacccaggtgattaaaagctttattgctcacacaaagcctgtttggtggtctcttcacacggacacacatgaaactccctattgcaattgtttccccacaatcacccagcttcctcccttcctcccatccagcctgctctcatcaccatagccagaaaccatccttttaaagcacaattcggatcctgaccctctactgctcaaacatttccgaagcttcaggtcactcagagtcagggccaaagtcctgatacagcctgca

SEQ ID NO: 188735 - DNA, 461 bp, Homo sapiens
ctctttagcttttttcaattagtgtgtgtatggcatatcttttcccagcctttcacttttaaactatttatgtctttatatttaaagtgggtttcttatagacagcatagactgagtcttgcttttttgttttttgacgctaacctgacaattctgctttttactttaatttttaattttttttttttgacagagtctcactctgtcacacaggctgaagtgcagtggtgtggtaatagctcactgcagcctcaaactcctgggctcagtggctcctcctgccttagcctcctgagtatttgggactacaggtacgtgcctctgtgccaacctaattgttgctttttaattggaatgtttagaccatttatttgatgtaattcttgatacaactgggttccatctactatcctgcatttgtaccccaaccccatgtttgtcccatcttctttcttttctcg

SEQ ID NO: 188736 - DNA, 395 bp, Homo sapiens
ccacaggtatcctgttaaggacgttcaagagatgtgtagtattccgtgtgggaaatatcattagtctatttaccaggacataaaattaccagcgtatttattagaaaattagactcagtcagttgtcttccttttttccctgagagtgttccctggtaaagtgagtgaatgtatctgtctagctgctttagctcctaccttcctagtgattcacccttatttttgtacgtagcaatagtttgttccttttcattcatatagtattccattgtggtgcatcctgcacagtattttatccaatcatcactggtggacatttgttttccagtttggggctattacaaataatactgctataaatattattattgtacttatcttttggttggtacata

SEQ ID NO: 188737 - DNA, 417 bp, Homo sapiens
actttattcatttcgctgttccaccagtacccaggtagaaagccttccgctcttgtgagaggctgaagctgctgaagtttgtttttggtttggcctatttaatgtgtgttcactgaatggacactacagcaacaatgaacaaataacctgttttcttcgtctgtggggagttagaaaaacccttcctggtttaacactgcctttcaattagagtctgtgtaggggaaacgcagtagttcatcatacgtgcttactaggttttttataattagaatcacattttggtgtttcttatcagaaaagatattcatgggtttgaggataggctaatgtgaaatcaaaaggtggtttgggcttctttgtttttgcctcacaaaaatgcctaatggaacttttaggcttttgtgtttgtacata

SEQ ID NO: 188738 - DNA, 386 bp, Homo sapiens
aggcctatggtgaaaaaggaaatatcttcgcataaaaactagatggaagcattctcctaaacttgtttggaatgtgtgtactcagctaacagagttgcacctgtcttttgatagagcagttttgaaacactctttttgtagaatatgcaaggggatatttggatagctttgaggatttcattggaaacgggaatatcttcatataaaatctggacagaagcattctcagaaacatctctgtgaggattgcattgaagtcacacagttgagcattcccgttcacagagcaagtttgaaacaatgattttgtagtatgtggaactggacatttggagcgctttgtggactattgtgaaaaaggaaatgtcttcccataaaaactaggc

SEQ ID NO: 188739 - DNA, 431 bp, Homo sapiens
ggaaaaaaaagagtttcagtctttgaggcatgcagggttattaaatatctgctctacttcccaggcgctaatgagcaacaagatccgcaaccaagagaaacaaggcctggactaatccagaagagtcgctgaaggacacagcccagagctccaacctctgcccatccatgctaaaggctcatccggctcgaacacttgatgaccaccggatgtcactctcaaaagacctacagctgagggaaagcccagggagtatggctcaaccattgctcatcaccacgggagtccatctgggtaacctggaacaatgacagtggtcagaggttttgatctaattacacatatgtcaggttttgcatatgcaaaagcagaagggggaagaaagaaggtacagcaccaggccccaactgccacttcctcttatgccaggc

SEQ ID NO: 188740 - DNA, 577 bp, Homo sapiens
ccaaatgtaatgaaaaatataaacccacagacctgaagctcaatgtcaagtacaagaaatacaaagaaaactgtaacaaatcacataatcaaattgctcaaaaccaatgatatagatcaaatcctgaaggcagctgggaaaatagtacatgttattttacacaggaacaaagataagaatgataccaaatttcttgccagaaatagtgcaagtgagagacaacagcagtgcaacttgatctttaaagtgctgaaggcaaaaactgcaaacctagaattttatgcccaatgaaaatatattttaagaaagttaaataaacatattttcagacacataaaagctgggagacactttgagaggctgagctgggcagattgcttgagccccagagttcgagaacagcctgggcgacagagcaagactccatctcaaaatataaaataaaataaaataaaaatctctttgttctgggattcagcagagacagagtcttgctagagacataaacaaatatgacagtctctgcgctcgaggagcatatagtctagtgaagccgatcgccataaaaacgcatggc

SEQ ID NO: 188741 - DNA, 723 bp, Homo sapiens
ccaaatgtaatgaaaaatataaacccacagacctgaagctcaatgtcaagtacaagaaatacaaagaaaactgtaacaaatcacataatcaaattgctcaaaaccaatgatatagatcaaatcctgaaggcagctgggaaaatagtacatgttattttacacaggaacaaagataagaatgataccaaatttcttgccagaaatagtgcaagtgagagacaacagcagtgcaacttgatctttaaagtgctgaaggcaaaaactgcaaacctagaattttatgcccaatgaaaatatattttaagaaagttaaataaacatattttcagacacataaaagctgggagacactttgagaggctgagctgggcagattgcttgagccccagagttcgagaacagcctgggcgacatagtgagaccctgtctctaaaaaaaaaaacaaaaattaggccaggagcagtggctcacgcctgtaatcccagcactttgggaggccgaggcaggcggatcacgaggtcaggagatcgagaccatcctggctaacacggtgaaaccccgtctctactaaaaatacaaaaaaattaaccaggcgtggtggcaggcgcctgtagtcccagctgctcgggaggctgaggctggaaaagtggtgagcattgctcaaaaacattgcaaggcaaacaatctacacaggactggggcaaaacctgacagttgagactc

SEQ ID NO: 188742 - DNA, 279 bp, Homo sapiens
taaagcagtgcttctcaatctttaatgattttgccacttacttgtgatctagttaaaatgcagattctgattcagtaagtaggtccaggatggggtctgagattctgcattactaataagcacccagatcatgccaaaagtttctggtgtgcagatcacactttgggtagcaaagatctaaagtacctttctaaggggaccttcacacactgttggtgggaatgtaaattagtatagctgctatggagaacagtaaggaggttcctcgaaaaatcaaaa

SEQ ID NO: 188743 - DNA, 470 bp, Homo sapiens
agcatgggaaatgggaaagaactggtcaagcaacttggaaaaaggggtcagggttggagagtgttgcactctcatctgtgaggcagtgcagcatcaggataaaaacatagggtgtcaaggaaaaaaggggtgacagaatcagatggggagaagttattgctgcagaccaggccttcaagaaagtgagtgccccatgcacaggctccatgtggacactgaggtcacctagggtgatgtcatgaattgcggtagaagacactctggagcaggcaccccagtcttccatgaatgagaggaatgaccaggagaaggcgaacaacagcaaccaggagggctcccgctgggcaggaaggatctccatggaatgagatggggggaaacacacaggaggacacaaagctcaaacccctgatcctgagatacacaagggatgagaaggaggagccacaggagagggcttcaagaacggg

SEQ ID NO: 188744 - DNA, 463 bp, Homo sapiens
gagctaggactacaggtgtgtgccaccacgcctggctaatttttgtatttttggtagaggcggggtttcgccatgtggcctaggctgatctcgaactcctgacctcaagtgatttgcctgcctcagcctcccaaagtgctgggattataggcgtgagccactgctcctggcctcacagagtgttttgaggatagaagcttacacccgatttaagttccttgtctacccagacaactaaatttacaactctttccaaacagtttttcttgtcattatactttccttaaccttagggaactatgaaaacaaattctggttttataagaagtttctttacatgttcctggaaactcaatcctccacgttctttctttgcctggacgtagagtatttcatgagtaccccattggtccggaggtcggatttctggtacccccagccctccagaacgtggctgctaacc

SEQ ID NO: 188745 - DNA, 277 bp, Homo sapiens
cctgaccacggctaactttcctggtcacaactactgaccacttattctagtacctaattaacagaaattctggataaacaagtagaaaaggcatactggagagtcttttgtaaatacaaagagaagggaactagccagagttaaccatatactctgtaatacacagtagcaaaaaaaacaaaaacaaacaaaaaaaaaaaacactacgctttcagaggctcttagtaagtatgatcagataagaacaccgttataaacgcatgaattctacaatgta

SEQ ID NO: 188746 - DNA, 524 bp, Homo sapiens
gagctcggtacccgtgaagcggcttgtgtatgtgttgggggaggggcgcacacactcttacatgtgtctaaaatatttctggagggaggataccttctggaaggtgaactagaaggctagtatggatgggagatttattcttcactccgtttttgtactgcttggatttttaaattttttaaggagtgtgtgtattaaataattactgtttctaaacttttaaaaaccaatgtaaatcctatcctcactactccactgcctcattgaaggtggagaaatgtatcccccatggtggcgccctctgcactgccagccttccaacaggaacggcagtggcattgcctgaccctcctcactttgccaagcgcccccactcacatcagtctttctcatttaagcctcataccacctgtggaatgggtgctgtctcatctgatgtgaatgagcctgaggctcagggcgaatgcctggccaaggtacagccagtgagtgggagagtgagggctcatacacaagccgcttga

SEQ ID NO: 188747 - DNA, 176 bp, Homo sapiens
taaaaaatagtgcaaacaaatgagtgtaggtctttgtgaagtctagaaagaataagaatgtgtcttggcgcctcctgcattttctagggaaagttctggctagtagctagaagaggttaaagaaaatacccgcttggggcaatcatcaggaaaaagaaggttgtatccttacccca

SEQ ID NO: 188748 - DNA, 350 bp, Homo sapiens
tggacattggggttgtttccactttttcatcattatgaatagtgctgctatggacattcagatacaaggttttgtgtggacattctccacctcctgtcaacacttgctattatctgtgttcttattttagccaccctcatgggtatgaggatggcctagctgtcatctgcatgtacagcctcttgttcaccagttgccttacctccaggcactctccttgcccccatctttcccactgtggctgagagggaacttgctttttttcttttgagacaggtctcactctgtcacccaggctgcagctcagtggcatcatgacagctcactttggcttcaacctcctgggctta

SEQ ID NO: 188749 - DNA, 332 bp, Homo sapiens
cagacttaaccttcagatcggagaaacctctgctaattgccagctgctgccatcatgcttgagagtgatttgtatttgggtttgcctagcccgctcctttacacgcttgggatttaaccacctgacaactgatcctgaatcatgagcaagcagctttccatcgctcccaatctcccctccatctaatcagtttgctgcgagctcacagctttcaatgcatgccattggaatgacgcacctgaccgctagctgcttctaacccagctccacctgagttcaaatctctgcaacggaaaactaaacctgatatcacctttgcaagtcaagttgat

SEQ ID NO: 188750 - DNA, 280 bp, Homo sapiens
atttcacagctttctttccttttcattaatatactagtaccacacttttaattaatatagctttatgtagcatatacatattaatatgtgcctagcaaatcctccctaaattttctctctatttttttgtcagaattttctagtctattgttccttgatgatgtttccatatgaatcttagagtcaactagtctaattaaaaagaattctgggtttttttttttatcttaaatttatggattaactagagaaatgtcagttttgtaatagtaagacttcc

SEQ ID NO: 188751 - DNA, 673 bp, Homo sapiens
gcaggcagttgaagggcctcgacttcctgcatgtcaaatcaacatctcagcgtccgctgcagtgaagggcgggcagccaccggtcaggcaaacgcttgacttgggcattcatacagtaaacagacacattatactccaaaaagccagctcttctgggcaactgctgtccctctggggtcctcagaggtggaattctgccttttcactcaagtcctggctgtgatcataaaggcagcttttaaccctttttaaggaaaagaatggtgagtgaagaaagaaaacaaatgactgtgggtggcaaaatgcagccttcattttaagaagtgttgaattagaacacttcactatgctctggccttgaaagctgccagccacatcgcaagctcccttagcctccaggggcctgggctctagcccctccacctaatgcaattcactatggaaaaggtctgtccgcaaggtatctttgatcatgaagccatccagcttttgggatatatgttaatgtgctcataggatgtttctctagaggttaactaaaatcttaccttttacatctcatctctcccactcccgccatcttaccactttctcacggctttcatataaagcaagcttgtccaacctgagacttgcatggcccaggatggctttgaatgtggcccaacacaaa

SEQ ID NO: 188752 - DNA, 335 bp, Homo sapiens
ttttcattctgcatagccaagtggaaagcacaagttggtttctcccaaggcaacaaaaataaaagttgatttctccctatacacttaggtatataaagaaatggctttttaaatctatataccttttaaatattcaatattgattttgatctactgggaagagctgaaacatcattcttgattctggatgcttaatcaattccttgttccaattagatcaagagacacttcccaaacttttctgctggatctttaaggtttcatccctgggaaaggcagtttcctctggctctaaagaagcatgttctgatttgtgggatcagatgggaagctgg

SEQ ID NO: 188753 - DNA, 259 bp, Homo sapiens
tgttcactatacacccaaatgtacaagaagtacacagggaggacacatgcacacagactacagatctagaaatgcctgtatgcaccagtacttggagaaaggggtatggacatacccagagacatctctttcaaagtagagaggtctcctgaggagggattccctggagtgaggagctggccctttaagagagtggttctccctcctagtccttttcagggcacctgagcttctacccacctaccttcccacccaccca

SEQ ID NO: 188754 - DNA, 403 bp, Homo sapiens
ttttactctgagcagctatcataagcacacactttaacactgtaatttcacatatacatgaacatataaatcaaaattattaggatgcaatgaaggttcagaaattacagatagtaaacatagtttctcaggacctagagttgactcaccaaggttgcgatttaaattagaatatattttaacttaaaaaattgtgttttataagcacttacaatttagtagggctaatatttaatcagccaaggcaatttactgttataatgccataacattactacctcattttttatttgtgttaaaaatgttacagttgtatatttttataaaatgttggcattccacacggaagcagagagctgaacttgaaccacacaagacagccaaagaatataattgagaattg

SEQ ID NO: 188755 - DNA, 158 bp, Homo sapiens
aatttaaaaccgaaaagtgcaataaccgaaattttaaactcaatggatggtctccaaagtagaataaagggaacaaaagaaagaattgttgaacttaaaaacataataatagaaattaaacaactgaaccacaatgaaaaaaatgcaaacaaacaaac

SEQ ID NO: 188756 - DNA, 520 bp, Homo sapiens
ggatagtcctatttcaaggagtgacaggccaacaggaccaaatactgttgaaaggtccaagaataggactgatgtggtttctttggattttgttatctggatgtcattgttgaatcggcaagagcagttgatattttatggtggtattgaagccaggttgcagaggattgagtgataagtgggaagtgaacaaaaggagagaaaaggcagaaggctcatgtagtcctacaggttttcagggcttactcacttttgaacattagtggctgatacagatactgacaagaaagtactaagtgaatgtgcactgaattgaccgaaaggtgttttggaaaatacccttctcatggactcttcttatccctttaactcctcatcaaaacttacctgaccagacatctgtgctccagatacttactaggtgactctccagagaacaagaattaattttcttgtgatgctagtatttgagaaagaattagtataattcctcttctaccaaagaactattgcatattat

SEQ ID NO: 188757 - DNA, 301 bp, Homo sapiens
tgtccacaatatccttcttttacagatgagaaaactaaagctcaaagaggttaagtaacatacacaaggccactctaatagaaaacaatggctctgggatctaagctgagttcttactccatggtttatacacttgtctctagtatgcactgccttaaattaaaaaataaaaagtcttagacgagatcaagctcctttaataagtataacatattcattacataaatcatctgtgctaggcactgtgctaagtactagaaacaaaattatgagcaagacagaggaggccttttctcttacg

SEQ ID NO: 188758 - DNA, 221 bp, Homo sapiens
acaggttctggtcagataagtgctgtactttatttgcaaaacaaaacgttcccagctccaaagcttggctgttccacccaaagagtgtcaaataactaaccgcactatatgatcagattttggggttaacagcaagactcctctggcacaacccaatctctcccattctgaagaacctctaccttctgtccatcccttcaatgcccaatgtcctcttctct

SEQ ID NO: 188759 - DNA, 1800 bp, Homo sapiens
caatcacattcaatttgtgtgacaataacagcatagccacctgaaggacagtacaacaagggcacaggtatatgataccttttagaagaaaagcattaacaggtgggtttatttatttctggaaaacaaaaaactccagcaagaatgtagtacatttttggctcttgtccatttggttcttgggattaagctggttctattaccagaactagcatcacaacaccctgacattttgggcagaaatttgagtggctaagaaaacaactatttttaactttatgtgtatagctacaagtggaaaaaagaataaattggcattgttattgctgtctgggctgtccttgatttttggacacaagcttatttttccagagctctcattttagtcagtagtccatcagtacctaatggaaacatctactgtgtagatatgagaatttctaagactttggagtagttgaaagacagcagagaaatttatcctatcataatttctgtattttaagcacatactagatttatcagggctgaaggacaaatggcctggtgttataattcatttataaattcaacagatacttatagatggcccccaaaataccagttaccctgcttggctttggtgattcattgtttagcagagtgtatatagttcctgcccctcctgtggtttgtgatctgtgcttctgggagatttacattgaataaataattagaaatgtgatgagtgttttgaaatgtaaagtgctatgaaagcctataaaaggggcatttaatttaatctggtgggaagtgattttgagcccagtttaaaagatgaaggctgagaaggatttaatatgctcacagtactaagtgtttcactttatgcatttattccccaagttgggagttttctctcaattttaggtctttattacgtttgtattttatacacagttttattacaagcacaggaataaacaggtttatcagggtttttttggttttttttttggaattggggttttgttctgtcacccaggctggagtgtagtggcgtgatcatagctcactgtcaactttgaacacttgggctcaagctatcctccctcagcctcccaggtgggagtacaggtgagtactccatccacctctgaccttggccctgtgctctcattcaaccaattctgttggtactgcctcttactacaagatttgcttacccgggagttagatagcaagcatgggaaatgcctggcacacagaatatatggaattagtgttaggattttagtaacttcacagtcggaaagaggaaaataggaagagctgttcgtatagggtagactataggagagaatgcaaattttgaaagctacatcatcaaggattaaaattttgctgctagctttgtctctataataatgtggtcatctagtcttaatgcttattccttcaaaaagttcattcttttcatttttctccctttgtgcctaatgctcaatctcttgcactagtttcggaagtggtcttcttttatgtctgccctatatgctgttgttaaaactggtattgaaatgcacttttattcatggtactttattgctccaaaatttgtaatggcatcctgcttccccaggaaactatgacactgaatgtagatcatacttggagcccctgggattggcaaattttttttttttaagaagccagatagaaaatattttaggtttccaagccatatgatatcttaactactcaactctgcccttgtgggaaagcagccttagataatacctgtagaaatcagggtggcta

SEQ ID NO: 188760 - DNA, 641 bp, Homo sapiens
aggatctcttatttgatctggcatgtatcctttgccctctctcctgactacaaatctagggagagctccctcagtctttctttgtatttcatttaattggcacattagagaaatactagaccataattcggtacactagtcctcaatttggatttgtccgatatttttattattagattaaggttatgcacttttgacaaaagataacacagtagtaacagtgtgcccttttcagtggatcatctggagtacatgaagttaatgtcttatttctgctgatactaaatatgacgcctttattaaggtagtgtctgccaggtttatccactgcaaagttactgttttcctttctttgtaattaatattttatgagaaaataatttgagactatgcaaatattttatttcatctaatttcagtattaattgaagattcttgcctgcagcaattatgattatggtgtttacctagtaatggtttctatttccatgatactttctctacttactagaatttgactgtaaggaagatctgtccttcttccccatttatttgtactcagttgttattttacatcagtatggatttgtggatatcttattttatggattgttatatattgcaatcattgtttgtgtttg

SEQ ID NO: 188761 - DNA, 508 bp, Homo sapiens
agtataatgctgaaatatttctggatgaaagataggatatctaggatttctttcaatgtaattgagtgggacagaaatctaaaagttggtgttttaaagagaaattggtaagccacagctgtgaaaatggaggcttaggtggtttgcatattggctgccttgaactgtaaattccacctgaagcagaggtaaacgacagtgcttttagccagggggggacggggtgcgggggggcacgttcattgacaatattattgcaaggtatgttggttcttttttttttcatgactggaacaatgaccagcttcacttcgtcaccttctttctcttctatgaaatgccttccctccttaaacctaaatccaatgcatccctgaagacctagctcaattatcccctccccctggaagcctctaaggtcttccaaattttattaatacttctccactgaactcctgcagtgatgcatcttttgcatgttttaagaaattgaggtctagttcacata

SEQ ID NO: 188762 - DNA, 566 bp, Homo sapiens
gataaaatagatacaaaagttgaaaaaaatagatacattagaccttcctcattttagaaaaattagacatgtcaattgggaaaaatacaaaacagtacctaagtggggaaaaaaagacaatagaaacgaagcaggtgagaaaaatctagaaaactgaaaccatcacaagaaatccctgtatataacagactttcaactccatcaatgtgtctttccaattactgtaccaaggaatagcagctttaaatgaccgatctgaagaaaacacggcactgttaagcttatgaggtaaatatctaacatctatttctttaacagaatgaatgaaaagtatgctgactcacattaatggtgaaaattagaagcatacatctgaatatataagaattaataccttattaaaatggataaaatcacttttctatgatctccaaagagtattattctgtttaatgaaattttactaaaattaacgtagtacttcatcgtatctcattctcagtcttcatggccaacataaaaataaagttgaaaggaggtgcctttcagtaaaagggaaagaagct

SEQ ID NO: 188763 - DNA, 216 bp, Homo sapiens
tggttctctttccctccaaggcctgaccatactgtcccaacctgttgctctggtggttttacattccccgggcggcactaggaaggcttcctcgccactcccaactttaaaatgcatccagctgggtcttgactggaatgaaaggttatttttaaaggtcctcttggttaaagggttccaagttttagttgatcttttttagacaccaggtttcat

SEQ ID NO: 188764 - DNA, 129 bp, Homo sapiens
gcatcaatacttgatggtttagcaggaatagtgttcttcacaaagagcaagaatcagtttttaccctcttgatgctgtggctgacgggaagctacggcttgctgctgctgcccagcattgcaagattga

SEQ ID NO: 188765 - DNA, 263 bp, Homo sapiens
tgcgcagcgtgtttactgaagtgcgcatgctcacttgaggcattcttcctttaccagtcaaatgctcccaggtcatatgccagttaaactccaccatgttgcctcttagtgcacatgcttgagcccactcgcccagctcctgagatcttatcgggaagctgctgatcaccagttccaggtgctttctatctattgggattacaggcgtgagccaccgtgcccggccgatggtagtcctttaaagcaagaaaggagcaggtaga

SEQ ID NO: 188766 - DNA, 545 bp, Homo sapiens
gatcagtgcaacttccgactgtggtgcaataaacctatggcttacaagaactcatcagtttatttactatttaaatttctttcacgacatactgcccatagcctgaaggattttggaagaacttggaaattctaaaataacaattggtgttgagccatgctaagagaagttagaaacttctgcagactcaaaccagttggaaagtggaagaggtctcccctccttgagttacgggcccccaggaagaagtgccctgacttcttcccaggtgcaaacaaatctgtgaaaatttagtagttccaacaaaataaataaactggaatcaaatgagaaaaatcacaaataaatctcaaagaaggcaagtgagagggtgaggggaggagtgtctcaagaaatagaaatcaggctacatttaaattttggttcttatttctttcttactgaagatgcagtccccttagactgccagcaactcccaataacacaaaggtccatttcagctcttatccaatatttacggtaaaagaatcatctcaaccaagctc

SEQ ID NO: 188767 - DNA, 224 bp, Homo sapiens
ggtcctacttatggctgtgagccacacacgcccacagaggtcagcctctgatatgtgtgtcttgaactgtgtcctctgagttctgtgtctgggtgcatgctcgcctcttagcgtgggtctccttcccctgtgtagcacttcacaatgttaggcatttgtctgtgatagcagctgttcagtaatttcctacttgcccaaattcctggactcaagcagtcctcgag

SEQ ID NO: 188768 - DNA, 575 bp, Homo sapiens
agattttcctctttttgctgactctgccctggcatattctgagatacaggggtcaagacttcaacatatgaatttgggagtcacagttcaacccagcatactctgtctcaaaaaaataataaaaattttaaaagatatgttaaagcctcaacccctggtacctatgaatgcaaccgttttggaaatagggcctttgcagatataatcaagtgaagtcgcagtcacacctgattggagtgggccctgattcaatacaactcacctccttataagaagacaaaaaaggcctggtgtggtggctcatgcctgtaatcccagcactttgggaggccaaggtgagtggagcacttgaggtcaggagttcgagaccagcctggccaacatggtgaaatcccatctctactaaaaacacaaaaattagccagtcatggtggcgggcacttgtaatcccagctctttgggaggctgaggcaggagaatggcgtgaacccgggaggcggagcatgcagtgagcagagatcatgccactgcactccagcctgggcgacggggcaagactctgtctcaaaaaaaat

SEQ ID NO: 188769 - DNA, 1087 bp, Homo sapiens
ttaacccctaggctatagtaactagagtgccaaatctctgacaagtttgagctgaaaacagggcagtattgctattttttcctccgcacgctagcagagtagacctgtgtgaatttccttttgattagattccaatgaaattctctaggggacttgacgttttcttgcccccaaataatttctccagtcttgtgaggaagcagcaaaagcaataggaaaaggcagatttgcagttaggtggattgttttcttcttagactcttcttggttgcaaaggaacgccataaaagtataaattactcagtacaaaataatcatggagcttaagcacgcgtacaccagtcattgaaagcacagggtcagtgaagctgaacataagctcgtttttgtttacatgattgctaatttcagccatatgtcaggaggcagatatcttaacaacctttgttattgatcactactttgattcatgaattaaagagccaatacacgaaaggaggaaaataagagcgacatccccagaaacaacgtggaattccaggaaaaatctaaacgaggccagccaacttcgtgcaaagggattaaaataggagaagagagtgttatgacaaatagattttcatcagagagcttacaggcaaggttgtcataaaacatggagaacgcacacgcagcctccctttgcccgctccttcctcccgcacaggagctgttccggagagtgtgttctctctcatcttcagagcctgggctcctcctgccgcactccctgagactcttgctttttcctcatagagtgctctatgttgttctttgtattctgttcccctgataggaattgctaccttttattgtgttcttgttgtatgccagtcactgtgacttttacctagattattttccttagtttttatggtaattctatgagttgtctctgatcatcatccttattttacagacggagaaaatactgggccagagaaatgaaaatcttgtttgttgtccttaagttataggtagcatagatctaggagaggtcaatccagctagaaatgattctaaggccatgtttgcctcttattccact

SEQ ID NO: 188770 - DNA, 654 bp, Homo sapiens
aaaaagtcacattccccaaaccagaaatcaaaaggacttcaaactcttcaacagtagtgggcaaagtgccaaaatattggagcaatacctttaaaattcacaggcaacattattttcaatctagaattctatactcaaccaaactacaaattaagtgtctaggtcgcaagacattttcagatgtgcaccgcttcaaaatatttacctcctgtgagtcttctgtaattccttctgtgagtctaatgtactccactgaaatggagtacattaagaaatatgaagatgtgagatcctagaagcagggaatactactcaaaggggacgtgaaaggagtatcaggggaaaggagatgatagctgcacagcatcctggttggagaaaatcaggaagcccgccgtacgtggcccactttaatagtgtcattggcaacacaaaagtatttaattttgtttaattcaaagttatctatttccatttttgttgtacttttggtgtcatatctaagaaaccattgtttaatccaaagtcatgcttatttctgaaccaatcattatgtccaggaagacaggatactcagattggcttgacttgaatcacattctcctccatgggccacaggggccaacaacatttaagccacatggatggggtttt

SEQ ID NO: 188771 - DNA, 665 bp, Homo sapiens
aaaaagtcacattccccaaaccagaaatcaaaaggacttcaaactcttcaacagtagtgggcaaagtgccaaaatattggagcaatacctttaaaattcacaggcaacattattttcaatctagaattctatactcaaccaaactacaaattaagtgtctaggtcgcaagacattttcagatgtgcaccgcttcaaaatatttacctcctgtgagtcttctgtaattccttctgtgagtctaatgtactccactgaaatggagtacattaagaaatatgaagatgtgagatcctagaagcagggaatactactcaaaggggacgtgaaaggagtatcaggggaaaggagatgatagctgcacagcatcctggttggagaaaatcaggaagcccgccgggcgcggtggctcacgtctgtaatcccagcactttgggaggccaaagtgggtggatcacgaggtcaggagatcaagaccatcctagctaacacagtgaaactccatctctactaaaaatacaaaaaattagccaggtgtggtggcacgcgcctgtagtcccagctatttcccgaggctgaggcaggagaattgcttgaacctgggaggcggaggttgcagtgagccaagattgcgccattgcgctccagcctgggtgacagagcaaga

SEQ ID NO: 188772 - DNA, 838 bp, Homo sapiens
ttttgtattattagtagagatggggtttcaccatgttggccaggctggtctggaactcctgacctcagatgatccacccactacggcctcccagaatgctgggattataggcgtgagccaccacgcctagtctgcaagaagtgaactctaattgctttctccagctgggttcagtggctctcacctataatcccaacactctgggaggctgtatacacacacacacacagacacacacacacagacacacacatagtcttcaactctcccatttcattcttttagtagtcttttgataaacatatttttataaacaaaatagtatttgtattattactcttttttgagacagagtctcattctgttgccccgactggggtgaaggagcatgattatagctcacagtagccttgaactcctgggctcgggcggtcctttcaccttagcctccagagtagctgggactataggtatgtcccaccaggcttggctatattttattttttatagagacatggtctccctgtactgcccaggctggtcttgaacccctgagctcaagtgatcctccttcttctgccccctgagtagctgggactgtaggtgcatactatcacacctagctaattttcaattttttgtagagacaggctatttaggaaaagctctgaatccatgcttttccgttctcacaccactgccacaacaatgacagcacagaagacttctgtgaccaaatgtttaggtttttttaaccccacacaccaagcaacggacaccagctggatgtcctccaattcaagtctaaaaccatctacctggaaatagtttatgctgt

SEQ ID NO: 188773 - DNA, 172 bp, Homo sapiens
gtctagaggatcccgtttcattttctacacctcagccttgcaaaattgaagggattatttctttgaagaccaacaggcgatagggggcagtagtgtcccaggatccagtttcccgcttcaggtttcaagaaacaggagcagctgcagtgatgaagttttcccgactatgaca

SEQ ID NO: 188774 - DNA, 695 bp, Homo sapiens
agcagaggagccttctacaggctgatgcagccgttctctgtgcagaggtgagccatcctaggagcagctgtggggtgaaagtgtccttccttaaactcagtgctcctgctcattctctcagtatggctaatagctcatttaaatatactatggtggtttttaatttttgtgactcattccctcccctcctcacctgtgtttttcctgtgtgtcagggacattttagggggaccaaaaggatctctgtctctgctctgtgcttgctctgaggttgaatagagaatgttcagggctgttcttatttgagtcactggagctgttgtgagctctgacggcctgggagccccactactgtcacatgaggacagggcgtggggtggctcaagcatggccgcttggggttgggtcctagtgctgtcatgttggaggtgtctgacctttgcactaagtttccccacttacactaaatggggataatcaaagctttgtgtggggattaagtgagttaatgtaaccagaacacttagaatggtgtgctgcatacagtgataatgcagaactactcactgctgctggagtgcgctgttatattctttattaggtcctcagactttttctatgcctaagccttgagggtctctctcagctgtgtttttctgtttttataattatttggtgcctcaaaaaaattttct

SEQ ID NO: 188775 - DNA, 592 bp, Homo sapiens
cacagcaaggaaggccatgggatgatgaaaggagagactggagccatgcttccataagccaaggagcatcaggagccaccaggagctggaagagatgacgaaggatcttcccgtagtcttttgagtggagaggaacccagaaccctgctgatgccttgatttcagacttctggcctccagaaccacaagagaatacattttgttgtagtaagccgtcaagtttgtcctaattggtcatggtaaccacaggaagcacatacagatggtgacttgtgccttcactgtaagcacctggccacactctaggtctttattcatctttgctacattttcttacaggcccagagctgtgccaaacaccgaacagataccccaggtaggtttgctaagctaggtctctcagagatggtgtcaagggacttataagcttgggctggccccagggctagggatgggaaggacacaggacttgctgaatggaagtgctggagaatggggttcataaatctactcacagtgctagttcctggctgggtgctgtaggaacagggctatctacccacatgctgtaaattcactgacagcaagacag

SEQ ID NO: 188776 - DNA, 257 bp, Homo sapiens
gatcgagccggcccctatatggctgtaggaagaacctgagagtcacagatatgaagtgatttgcttgaggtcaatgactcagtgactgggccaggagtcaaccccagctcatgagattccaagtgggatgttccttctgctgatacacactaacgtgctattttgttttgtattgtgcaaaaataggttctggtcctttaagatgtaacaatggggttcacagttctggcataacttattcccttttacaaatatgg

SEQ ID NO: 188777 - DNA, 260 bp, Homo sapiens
atgcaggggacagccgctctggaaaacagttagacagtttcttatttaacatatgacttagtaatcccgctcctgggtatttacccaagagaaatcatatgcacagatgaatgattatagtaaatgtttatagtggctttattcataatatcaaaaactagaaaatccctaaatggctttcacttggcaagtgaataaacacacttgggcacatccacactggaacactagtcagcagagaaaaggaacaaataccaata

SEQ ID NO: 188778 - DNA, 421 bp, Homo sapiens
tgtgagccatgggtaatttttaatgccatccagtgaaaccatcccctgccttccaaggctacttcatgctttagtatccagtggtggcctccacagacaagattaatgctgggagggcaccagtgccccttgcttgtagtgggaggatggaagatagataggtaggtaggtaggtaggtaggtaggtaggtaggtaggtaggtagataattgacagatgatagataataaatagacgaacgtgaagaaaattaagtgagatatcaccaggtatcaagtcattatttggtagtgggggcacagtgtgactattcatggcccccagacccctcccacccaacttgctgacagttgcctgacgggccacagtcatagagccaaaagatatgaaggcatccaggcctatactctcagtttactgg

SEQ ID NO: 188779 - DNA, 658 bp, Homo sapiens
attcatagtaaacagctgcttcttcctctaagtatctagaaggcaaagagcttattccatgcagtgaagggcaataaacagcaaccaagccctgagtcctctgtaactggaaggagaggaggccttaagaagctttgtttaagttaccacaaaggacagccccctcccctagcagcaatatatcagcacaacatgagtggctttgctcctgtgtctcctagatagggtagctatagcggctactcagcacaaaagaattcttcccctcctcccctccatcatcctcagtgcttcagaattctcctaaagtccagcttctccaatcctgtaactactcagatcaaaaagcataaataccttccaggactttagggcctataacctaactctatagcatgacattctctgcttccaccatcaagctcaattctcatttttctctcatcattcactcaacatacccaaagattctgttcaattggactatttgctgttccctgaatatgtccattagcattacttcaacttcagccctttgcggccctagtttcatttacctggaatatatatacatatcctctctcagcctctcttgaaatcacctcaaggatatctacctcacacatgaacttaagttcagtatttttttttcttttct

SEQ ID NO: 188780 - DNA, 256 bp, Homo sapiens
tgttttttctgttcacttagtcttgaacatgcccacctcataccctcatgtctatattgcttaatatcatacctccttactcagatgtcaccttctcagtgaggccttcccttaccatttaatgtaaaactgcaaacccctctgtttcccccttccctgctttctatttctctagagcatttatcgccttctattatgtttaatattttacttatctgtttgctgtctgtctccccttactagagtatatgctgtc

SEQ ID NO: 188781 - DNA, 300 bp, Homo sapiens
agataaatgaagataagaaccatctttaagactttttcagtggggttttacgtgtacactgttacaattcaactttcccaggcctcattttatttttatatgcctacctgttttaaaactcataggcagttatttttggggaatcctgattactctgtaatagggcccaaacatatagaacatatgcaaaaagaaaataatggtggtttccttatttgactattgctctttttcctccaatggccttttgttgtttacagtatgcaacccaacaaaaggtttttcctttcagcaatcaat

SEQ ID NO: 188782 - DNA, 311 bp, Homo sapiens
caggtgctataggagatgcagagagagccaggagaaggcctggacgcaaggcccggcccagatctccatccaggtggacagtgtcatgtgccatggccacccatgggcacatatcaaattccctaacctggtaacagacagcagtagggacaggactgagaaacactctaggtttaaaagcaaatagcctacactatggcacttccacaaaaagttgaaaatagaatcaccatatgatccagcaattccacttctggggatacacccaaaacaaatggaagctggatcttgaagaggtatttgtgcactcg

SEQ ID NO: 188783 - DNA, 574 bp, Homo sapiens
ctcaggttgggctgtggtgtgagcagctgccttggcctcgcctctccccggggcaggcctgtgcctcagctcccactggccacctccctacttcctcatggaggctcctttgcacatctaatcccatcttggacgacccagtgcagactttaaagtaattgtcttctgtattcagaagagtattgcttcaatagagaccttgaaactagaaaagaatccccttcgggagaccgagacgggtggatcacttgaggtcaggagttcgagaccagcctgggttacatgatgaaactccgtctcctaaaaatacaaaaattagctgggcagggtggcatttgcctgtagtcccagctactcaggaggctgaggtaggagaatcacttgaacccaggaagtagaggttgcagtgagccaagatcgtgccactgcactccagcctgggcgacagagtgagactccatctcaaaaaaaaaaaatacaaaaattagttaggcatggtggtgtgcacctatagtcccagctactcaggaaactgagacagaaaatcatttgaacctgggagacagaggttgca

SEQ ID NO: 188784 - DNA, 189 bp, Homo sapiens
gctcagtgaagtgggtcctataattagagtcagagcagttaagcagtctgcctaaggtcacacagctagtaggtagcagtgtcctggagctgtgggattcccaagtctatgttcttttttttttttttttttttttggaaaaggaatatttggccacaggtgcccaaactgtgaagtccagcaacacaa

SEQ ID NO: 188785 - DNA, 315 bp, Homo sapiens
ggagggaaacagttttgtgggaaatattcatatatattttcttctccctttttccatttttaggccatgttttaaactcattttagtgcatgtatatgaagggctgggcagaaaatgaaaaagcaatacattccttgatgcatttgcatgaaggttgttcaactttgtttgaggtagttgtccgtttgagtcatgggcaaatgaaggactttggtcattttggacacttaagtaatgtttggtgtctgtttcttaggagtgactgggggagggaagattattttagctatttatttgtaatattttaacccttta

SEQ ID NO: 188786 - DNA, 140 bp, Homo sapiens
aaccataaacccttctggttgtttaacagagggaggtcaatctgtttcatgaaaccacatgtggccttccagaaagtcaaagggtctgcaggaactagattttacagacaaagaaaagaaaagaagaaagaaagaacaga

SEQ ID NO: 188787 - DNA, 451 bp, Homo sapiens
ctgtgcttcagcagatctattactgccacccattatcaacccataggtatgcacgtggtgactcattagctccttaagaacaccaaaagtttgcatggctagttctctagtaggtgagagaataaggacccctgttccattcctgggcatgaaatttaacttaacaatgagttcagctgcaggatgagaaaagctggggttttaccactgacggtttttgtagctgcaagaagatccctgccttccagaggtggtctgatacttttatgctgaatttcagtcacgtttgtaaaacccatttcttttattgccttcagagtgttttcattgacaagattacataagaagcaaatgaagtatcctcaaaagctcctgtcagtcccaggggcaggctgggcatctcactgtcatcttcatcatctggcttctcaacattattttctgtttcttt

SEQ ID NO: 188788 - DNA, 228 bp, Homo sapiens
gatcaatccatacacccactaggcattcaaccatgagaccgtcaacatcaaagccaactagaacacgttccccaaagcaaaaaaaaaaaaaaaaaagtaattgtaagttagacttctgcttgtggctatcagaaatgttaccttaatttggccttaatgacccataatcacttttagcatatgccttttaagactgctattattcagcttgatctatgatataatgga

SEQ ID NO: 188789 - DNA, 326 bp, Homo sapiens
ctggttccattatcacccctccctcctcactctagcccgccttccatgtggggcttccagaaggatcctctaagacacaccccaacaactgaaccatccctcttcagtttaaaaatcggggctaggcatggcagctcaggcctggaatcccagcactttcggaggctaaggcaggaggatcgcctgaggccaggagttcaagaccagcctgggcaacacagtgagaccccccctatctctacaaaaaatacaaaaaagttagcctggcatggtggcgcatgcctgtaattccagctactcgggaacctgaggtgggaggatagctt

SEQ ID NO: 188790 - DNA, 220 bp, Homo sapiens
atatttactaaattccttccatgttccaggcacttttccagaaactggggtacagaattgagcaaaattcaaagtcccgtcctcttggaacatccaggatggaggaaacagataaaaaaaggaagagtaaatatatcagggattgtcaaataatataaagaaaaataaagtaagatacgaataaaggtgctagtggaattctaaaagtggtcaggattct

SEQ ID NO: 188791 - DNA, 406 bp, Homo sapiens
ttggggactctagaccatccccacctcctaccccacgtctacatttccctattatcaagggaattattgttatttttacaattggcttgttcaaaacagaatccaaacaaggtccatacattgtatttgattcataatccaagacttctttaataacatggttctgtggtttctggatcatcaggaggaagagcacctagcagcgttttagaaatgcaaattcatgggccctaacccagggctaatgaatgagaaactacgggatgaagccagcaatctgtgttttgacaagccctcccagtgacttttgattcatgccagcgctctgaggaccactgttttaatacacaggttcccccttggttttttctttgtcatttatttgtcaaagaaactgtgtcatttg

SEQ ID NO: 188792 - DNA, 547 bp, Homo sapiens
tacaggaggatcctgacttgagcttgaggggtgcaggggaggcaacaggtgtgtcttcagtcctggactgagaatcagaaagcgtggccttcggtctgccctgatcagctgtgtgacacatcacttcgcttcttaggctttggcattctcaaccacaaagtggtaatggtaactcctgcctgactccacaaccagaaaatgctgtgcaaatgtccagtgagcccagcatgtcatggtccccaccatttcattcataatcattcttagaccagcatttcatggcttgagtgggagctatcagatggcaggttttgggcccagagactctgtagtctctttggccatttgagctggtgagctgcagctaaacctgtctgacttcccatttcagcctctggtcttagcaagttaaagaaacatcatcctaagccaccatctgaatttccctaactaacccagttattttgtatttggctaagtttatgagattggaactaccaggaaactttgttctgcttcactcctggctcaaatgataggattatat

SEQ ID NO: 188793 - DNA, 517 bp, Homo sapiens
aagtaatacatgtgtatgttgcattctgtccccatttgttttagtgtaattatttttctcccaagtcttttaataaaactatccttccaggaataagcaccacattgacatagtgacttgccgcagcttcagcgaccttattagagcagcttagccttagtccatctgatcccaaatcccgctctgccagggtttcaggaggctggagcgaggactgtcccatcccctgctgaggtggctgatcagccagaccggcaggacatctgctcccagcctgtctctcaatggaggaaggtgggccttgatgttgatgtcagccccaaaggctatggagggcctgcaaaccccaccacagacacacaccagccctcccacaactgacggtgtgagctgtcatcaacctcaagtcactctcatgacagccaaggccacctcacgtcactcctgacccagaatttcatcacccccgtccagaggtcacaaactaaactgaaggcccgagggacttgttcacctg

SEQ ID NO: 188794 - DNA, 372 bp, Homo sapiens
cattggtaaaattaatcttagtgtgataagcccaggaagatgcctatttcggacttgaccccctgttcacctgttttcttcaacaatttggcatgcttatttccagttacctaaatctgtctactggatggtaccataaaaatagaatggcctgttgactatgtacccatagttcaaaatgttttaatatttttacatgaaagagtctatcttactttcaaagtaagttacaagattctacttctagtatttggtcaccataaaagtacttaaacattataaccaaagtaaaatgaacttttaaataaacaacaacaaagtgactggcattttttagcctttatttaataagggaagtctaacggaactatt

SEQ ID NO: 188795 - DNA, 457 bp, Homo sapiens
tgtctcccacaaaacagagagcctttctccttggtcagttcagtggaggggggctctgtagtcagaggccactatcctgcccataccgcccttccccaaatagtccggcagggaaaatttttttgacatcacgaagtgtctaaaagaaaaaaagtagttgagtggggagaattacctaatgaggtgggaccctagctatttttccctttgacataattaaaaaggggggaaaaaaaagaaatataggctgggcatggtggctgttgtctgtaatcccagcacttcgggaggccaaggtgggcagattgcttgaggctaggagttcaagaccagcctggccaacatagtgaaatcctgtctctacaaaaaatacaaaaattagccaggtgtggtggcgagcacctatagtcccagacactcgagaggctgaggtgggaagatggcttgggcccaggag

SEQ ID NO: 188796 - DNA, 258 bp, Homo sapiens
gaccggcccaggtcagcttaatagactgtgtacggctgtgtagatcataaattgagaaagcatgatatttgagcaagaaaaatttactgaggtttgttaagatttgagaagagagatggaaaatcttcctgttcagttggagaagaagctgaggaataagtctttgtgcatatgaagagtgttttgtaggctgtgtataggtattttctgtttcttcagaatgtagcaaaaaacagtgtgaacttaagactggtcctg

SEQ ID NO: 188797 - DNA, 295 bp, Homo sapiens
aatgctagttatccataatttatcttttagaaaatctctctagataatttacaagaaatcttatgttattacttaattgttacttaagaaatctaaagtgagctgggcacggtggctcatgcctgtaatcccaccactttgggaggcgaaggtgggtggatcatgaagtcaggagatcaagacgatcctgaccaacatggtgaaaccccatctctactaaaaacacaaaattagccaggcctggtgctgcgcacctgtatcccagctacttgggaggctgaggcaggagaatggc

SEQ ID NO: 188798 - DNA, 521 bp, Homo sapiens
ctagagttcccgcgtaatccgtacaactggagttaagaacattattctaagtgaagtaactaaaaaatgaaaaaaacaaatatgtatgttctcacttataagtgggaactaagctatgagaatgcaatggataagaattatataatggactgtgggtactcagtggcaagggtaggagaagagtgacggataaaagactacatattgggtacagtgcacactgcttgggagatgggtgctcctaaatattagaaatcactacaaaagaacttatccatgtatccaaacatcttctgtaccttaaaaactttggaaataataataataataataaacaaaaaataatcccaaaccccgtaagtttaactttctatgctttggctgtttttggtttattttttattttttagaaagggtctcgctctgtcacccagaatagagtgcagtggcttaatcagggctcattgcagcctcgacctccttggttcaggcaatcctcctccctccgcctcctgaacagc

SEQ ID NO: 188799 - DNA, 335 bp, Homo sapiens
tctaagtaaaattatgttttcaagggatttgccacattagaaacttgggtcaaaaatcatgttttcctagagtttattgcctaggttttattagtggggatttactttctgtggaagggccttctgcacatcgaggtagtttgaccttgctgcttgtgaatacgctgtgttgtgttcagtttctaagtgttctgccacggaaagaagtcatggagttgtagactgaccgagggaaaatgttgacttgtggacatgagtacttgagcttaagctgtcttttctggatttttctctttctgtggattttcagtcatttttctggctctgaagcccac

SEQ ID NO: 188800 - DNA, 243 bp, Homo sapiens
ctttcagacttccctagaatgttaacactcatgctagtccacacatagtcttaaaaagttatagaaaatattcagctggtttctcctcgttcctaataatgtcaacttcttcctttttcactgttctgcccagggaaaaaaagcagcagtgggtctcttctgccctagaaggggatcattttctggattttaatttgtttaagtttgtttaaattcttaaagctttcagaaatttaaatacaa

SEQ ID NO: 188801 - DNA, 352 bp, Homo sapiens
ataaaatatcaatagaacatcatatatactgaaaatgcaccaatacatcttcagatattacacacgatcaaaacattttccatttgtctttttatttaagaaaacaagaaattacttatcaaggacaatatgctccaaatttctacggcacttccaaaattttagggaaaatatcagactcccattaaaaaaaaaaatcaaacaagattctgatttcactttgacttttaaggtttaaagctacttaattgtggctactccccctaaggatctcaaacaggaaataactaaagttaatggtaaatatacacttagcataacactaaggttaaaaattacgtgcattcatttg

SEQ ID NO: 188802 - DNA, 454 bp, Homo sapiens
ccagctgctctggaggataaggtgggaggatcacttgaaccctggaggttgaggctgcagtgagccagtgcactccagtctgggtgacagagcaagaccctgtctcagaaaaaaagtaatttgggtctccttcaacccccttaaaattaaaaatattttttaaaaacttagaacaggttgggcacagtggctcacacccataatgccaatactttgggaggctgaggcaggcaggcagatagcttgagcccaagagttcgagaccagcctgggcaacatggtgaaaccctgtctctacaaatacaaagccgggtgtggtggcacacacgtgtaatcccagttacttgggaagctgaggtaggaagattgcttgagcctgggacagcaaaactacagtgagccgtgattgcaccactgcactccagcctgggcaacagagtgagaccttgtctca

SEQ ID NO: 188803 - DNA, 169 bp, Homo sapiens
ttttcctctcgaaaatattactatgtgttttttccaaaaacgatctttccactaccaaagttcgaaaaagcatttaaaataagctcaaaatttcgaagatactttaggcaatcactgtaattaacatatggtagcaaagcatgcaaatcactcagagctcctttctaac

SEQ ID NO: 188804 - DNA, 256 bp, Homo sapiens
acctgctcatagacccatggctaccgcctcatccaacctgcctgcccctgggcccacgcctgctgcaggaggcggccagctgggactggagggcctgggcttccagggagaaacaaatgtttccaggccccagagctttcacctgagctggccttgtccatctcatcccaccccaccctccatcatctcccaactcctgaggctttccagctctgctcactggtgtagcccccccgcaccctaggtcaccactaat

SEQ ID NO: 188805 - DNA, 822 bp, Homo sapiens
  misc_feature (488)..(488): n is a, c, g, or t
  misc_feature (496)..(496): n is a, c, g, or t
  misc_feature (510)..(510): n is a, c, g, or t
aattgcaaaatgcttggcccaggctggcctgcagagtgatacagaatgtacctcagctgttgatctgtggagcctaggaatcattttactggaaatgttctcaggaatgaaactgaaacatacagtcagatctcaggaatggaaggcaaacagttctgctattatgatcacatatttgccagtaaagcagtggtgaatgccgcaattccagcctatcacctaagagaccttatcaaaagcatgcttcatgatgatccaagcagaagaattcctgctgaaatggcattgtgcagcccattctttagcattccttttgcccctcatattgaagatctggtcatgcttcccactccagtgctaagactgctgaatgtgctggatgatgattatcttgagaatgaagaggaatatgaagatgttgtagaagatgtaaaagaggagtgtcaaaaatatggaccagtggtatctctacttgttccaaaggaaantcctggcngaggacaagtcttngttgagtatgcaaatgctggtgattccaaagctgcgcagaaattactgactggaggatgtttgtgcgaagttgtgtggctacattctaccgctgagtgctacaggggcggttctggtcaacttgcttatcagtacctagatggttcttttctactctcattcttgggtatcccatttgatgcgggatacccttccttacgaggttttacttattactctagggcgctgccagcgggggtgcacttggccggggggcccgctcagggggacactggccctggggggggtcctttgccatttgtcgggcttgcc

SEQ ID NO: 188806 - DNA, 942 bp, Homo sapiens
ctcttagattaagattttattacttttaagatacttctatgaattatagaggacatccaaaagtaaacatccgggacttaaaaacaataaccaatattataagataaattattgctgtaaattatttcatgaaggcacaattaaaaaaaaaataaaataaacagccaaagcctgttttgttgagttttcttcgttgcgcaggatcgggagcttgctgggatctgaactcaggaagccctcacctcaccctgacttggtcattgaggagatgtaattgcaggggtgcttatttgctataggctttgaaagtcacaaaagcccagtagatacatgaattcgaagcagttctccaagggcatctccaacttggcagtcaccgcccgcaccgcgcacacaggtagtggacgcccgcccacctgcccgtctgctgggcgcagggcgctcctggggtggggagggcgctcctgtggggggaaaaggggcgctcctgcctcggagggggaaaggacgcccctgtggaaggaagggggggctcttgaagcggtgtggtgagaggacgcttccgaggaaggaagggggtgctcctgcagcggtggggggagaggacgcccctgcggaaggaaggcggcgctcctgcgggggctggagagacgcccgcgcggtctcccggctcagggaccgctggctcgcgggtccgccctctccccggcgctatggaaaccgcactttctccgcctgccgtccccgatctctttctcctattacctcccaaacgcgatttcaacttcccgacaagctgacaagtgaatggcgcagaggacgccccgtaaagcgcccgcgagcgggtgggacacaggcgccccctccgcgcccctctgtcctccacggaagggcgcgcgccgctctcgatctggagcgcggtgctcgcgaacccgcggccgc

SEQ ID NO: 188807 - DNA, 470 bp, Homo sapiens
aatcagctcgcacccttagcaacttcctgtaccctacaaccttctcctaggcaaccttccttacttactttattcataaaataatctctgttcctcaaacagttctgactaaatccttaatgccaataaagggctacgaaccaattatggctcaaatagtcagcctctgtacccacaggttccacatccacatggattcgaccaaccttgggtcaaaaaatatttgaaagcactgcatctgtacagacttttttggtcattattccctaaataatatagtgtaacaggtatttgcatggcatttacactgtacttggtattaagtaatccagagatgatataaagtacagtcatgtgttgcttaacaacagggatatgttcctagaaatgcgtcgttaggtgatttcttcattgtatgaacatcatatagtgtgcacacacaaacctagatggtacagcctattacacac

SEQ ID NO: 188808 - DNA, 432 bp, Homo sapiens
tcttgcttgccaccatgtaagacatgcctttactcctcctttgctttctgccatgattgtgaggcctccccagccatgtacaactgtgagtccattaaacctgtttcctttataaattacccagtcttgggtatgccatgagaaaagactaatacaggcatgctgcgaataagcaatagagaaggctgactgcaggtgctgaaagagcaggagcttgctgaaaaaggagatcatgcttgttgggccagtcaattaagaagagtctgggaaagtgataatctttggcattggccttagaggaaggtagaattttagtaggcaaagaggcagttgagaagaagtggagaaggaagaggcattccagacaaggggatgctgagttaaatgacagtgctgaaaccatattgggtatatttggagggctgtcaacta

SEQ ID NO: 188809 - DNA, 219 bp, Homo sapiens
cctgggcaagagtgtaagactccgtctcaaaaaaaagaaaagaaaagaaaagaaaattgagtggggttaatgagggaaagcttcctaaaggtgagccttgaaatttaaaggagaggaaggctggggtatattgatgggagctaagctagcaacaagctcagtgctgtgattttggcctcactgagaccactgacaaaacaccgccccccccaccccggt

SEQ ID NO: 188810 - DNA, 151 bp, Homo sapiens
gttgggtctgtgggtagacatgctgtttcagtcctcaggtgggctgacctgaatcctgggtcagttggcaggcaaacctggtttctgggttcacaagggcttggctggtgctttgttccagtgaggatggcctggcactagggcgggcctg

SEQ ID NO: 188811 - DNA, 442 bp, Homo sapiens
tgccaactttaaccataataatgttaagtgacctacaatactgatagtacagctgaagtcctaagttcttaaagcaggaagtcactacacacaggaatgaaaagaatttccttccctttctttgaatatgttaaactagaataaaattttgaaaaaggccgaatttgtctttggtgtccttcgatttccattctgagactttctaaatccccagttctgatagtctaaccctgaagtgactcagtttaatggcttctagcttttgaaagttcttgtccttttttattacttatattctgaatccagttgtgcaaaaaatacaaagctttgtagtttttattttcctccaaagaaacactatggtatccgcaacaaggctctttgtaggagaggtttatcaggaaaagagaaagacccctaaatgcatagatcatttgtaagc

SEQ ID NO: 188812 - DNA, 107 bp, Homo sapiens
atcacagatgacacaatccagcatccctttatgattaaatacatcccacactcgtggatgggtagaatcaatattgtgaaaatgaccatactgggcctggcatggtg

SEQ ID NO: 188813 - DNA, 377 bp, Homo sapiens
aatcactccacacccgactgaacattttctaaccttatcactgtggcagaaactggctactcttcctcctgggtagacagccaggctgtatttccccgctgcccctgcagtgagaggtagccattggagccggcgcaggccaatggactctgcactggagtgacacatgctgcttccaggcctgtccctcaaacctcccacatgtcctctgtctgctcttctcacttccaaggagtgtgaccatcgtggaagccccaggttagcaatggcagattgggaggcatcgatgggaggaacctgggtccctgacttaaagcatcatggatttggactttccgttattgagaaataaacttccattgtgtttaagcctttat

SEQ ID NO: 188814 - DNA, 223 bp, Homo sapiens
tccaagaatgtcacaattcaaatatgtttaaacccaaatacaatataaaaagtacacaaaaccagttaggtattataggaatttacaaatcttttcaaaaatattttctttttttttttggaatttttaagagccagggcctccctcagaaccccggccgggggggaagaaccgggacttggcctcacattccctttgaccggtaccggacctgaattccgaa

SEQ ID NO: 188815 - DNA, 406 bp, Homo sapiens
tgaggaccccagggctggtggtgaatgggactggagaagccgtgacttgctgttgtgttgcgattgataacactttcactggcactaaactgggatagtgttaccacaggaaggaaattccttgccattagccttttgaaaacagattgggaaatggtcgttataagaactaaggtgttagctgttgctgggcatgaactcttgggaggaaggcaatgagaaactaagagtgattcatcatgagttaaagttcagctggaagccagaggacttcttggcagcactgcagattcttatttcttggagccacagggcagaaggaatagagaattgggtcctgggcatcatagaagagtagcagaatcacagcggagcatgaatctcagtttcaatggctgctatgctg

SEQ ID NO: 188816 - DNA, 165 bp, Homo sapiens
taggcatttcaggcctattctcttctctatgctttaaataagctaactcagtggccctcaactggaagtgatatagccccctagatacatctatcaatatctggagacatttttcattgccacaactgggtgaccctgtactaccggcacctagtaagtcgaggc

SEQ ID NO: 188817 - DNA, 198 bp, Homo sapiens
tccaaatcttctacgcacacacacaaacacaaacattgattactactttcaaagaaaagaggtcattctatgtacagctgtcccttagtactccccgtagataccaaaatccgctgatgctcaagttccttatgtcaaatagtgcagaattcgcatataacctatacacatcctcccgtatgctttaagtcatctcca

SEQ ID NO: 188818 - DNA, 133 bp, Homo sapiens
tctgtggagatatatatatatatatatatctctttagagagagacatatatgtaatatagatatgtatctttatatatatctctctctccacagaaatagtaaatatttaaactcaatgtgttttgggggatg

SEQ ID NO: 188819 - DNA, 422 bp, Homo sapiens
aggaacaaatgagacttgtttatcacactgtgaaagtaaataaacaacccaggagaaaagcatatgtatacaggacctttcttttttcaagatgactgctagagtgccaaacctacccaagaaaattacaggaaccccaaggtgcactgttttacactgaacttattcctggcactattttttgctcactcctactttcatttttcctttctccttctcatgtatttattattcctggcattattttttgcccactcctactttcatttttcctttctccctcttatgtatttataattcacattatcttgctctatgtgacataaatgaatatatcaataatacaactaaaaagcaaaaaatcaagcacataagattccattcttaaggacgcatactatatgctcaggtccaatatcatt

SEQ ID NO: 188820 - DNA, 533 bp, Homo sapiens
cgccctcccaccctccagattcccaccagggcgaacccagcaccgcctgtataccagactctgtgccaggcactgaacgtaaataaaaggtttgtgcccttctcctccacattccacacgtagggaaactgagtcacagtgaagtgtggggaatgcttactctgtgccaggcctgtgctgagtacttaatgtgattctcttctttcagccttaccacagccctctgcaggcaggccacagagccagtgcaagacagagcagagcaggactgcaccccatactttgtatccccaggttagcccaggggttcagatctgggttctgacccaccccagcctctgggctccttccccctcagcctgctcactggctcttctagctcggcatagctgggctctctaccaagagtgccttttctgccttctcccccaaatcagcccatacccgcccaggtcggcactgggcatggagcaggcagctcgtggtggggaaagggctgggtaataggatctgcatggcaccatgaatgctga

SEQ ID NO: 188821 - DNA, 451 bp, Homo sapiens
tacagcacaaatgttgcacagaattttccaggtggagggacagaggaagatagaaaaagttggcatcgtgggcaggaacacaatgtagcttccctgggagaagaagggacagttgctaggctcaattctgctcagcctttactgaaccccaccaggctgggcaccatgcttggcaaagggcataaaacaaggaagtcagcagagggggcagcttggtacagttagtgagaacataggctttggaggtaaatattctgtatcaacccattttcatactgctttgaagaaatacccaagactggataatttataaagaaaaagaggtttaatggactcacagttccacatggctggaaaggcctcaaaatcatggagaaaggcaaaggaggagcaaaggcacatcttacatggcagcaggcaagagagagtgtgcaggaaactgccctttata

SEQ ID NO: 188822 - DNA, 562 bp, Homo sapiens
caggcctcctccctttcccacacatcaagctcaaggatttgtccctgcccaagactggcaaattgactttacttacatgccccaagtcagaaaactaaaatacctcttagtctaagtagacactttcactggatgggtagaggcctttcctacagggtctgagaaggccaccacggtcatttcttcccttctgtcagacataattactcagtttgggcttcccacctctacgcagtctgatagtggaccggcctttattagtcaaatcagccaagcagtttttcaggctcttagtattcagtgaaacctttatatcccttacagtcctcagtcttcaggaaaggtagaacggactaatagtcttttaaaaacacacctcaccaagctcagccaccaacttaaaaaggactggacaatacttttacctctttcttttctcagaattcaggcctgtccttggaatgctacgggtacagcccatttgagctcctgtataggcgctcctttttattaagcgccagtctcattccagacaccacaccaacttagactgtgccccaaa

SEQ ID NO: 188823 - DNA, 334 bp, Homo sapiens
tgttcctgagggtacaagagtgaagagggagctggaataatggctgaagctgaagcaaaagctgcaggctgctgggatgttgctggtctctgacctggaggctgtttcaatggccacatgtggtggaggcaggggatcagtatttgggttctcagtttgcaggaaaagggagcaagacccagacacacacctggcagtctcagagcaggactctttcttttctttcctttccttcccttccttcccttctctttttttctttctttccttctttctttttttctttctttctctttctttctttctttctttctttctttctttctttctttct

SEQ ID NO: 188824 - DNA, 282 bp, Homo sapiens
taggattgtagggaataattaaatggttaatacatggaatgtacttagaacgactgtaagcacagatatgcactcaggttacctcttattatcagatgtactataatcttaaatttattcaaaattgctactgactgaaaaatacgtgattttggtgggtgtggggaggaagtagcgaaaaataaaaagtcctagctggaaaagcaaatataactgttcaagggctattaaaatgcaatgatcaagagacaaggaatgagagacacatttacccaggggaag

SEQ ID NO: 188825 - DNA, 629 bp, Homo sapiens
ttggcaagtgaacagacagtgatgcagaccaggatttggaaagggatggtcagtgccctgtgggtcctaattaattaatgttacatccccagggaaaactgctttgagtccctaagttaaggtaagcagcctctggtatacactttcatggcatcttgtacttttttctttatcacagttttaagacattattggtatgattatccacctaggggctgataggggatgaaaggcaccctatctatttggtgcactgtccacagtgcctgaaacagagtggatgctcaaacccatttggtgagtggacggacgcattcaacaaagaggtatgaggagaccttgtgtcgccaggaccttcgtaaatgaatgaatgaaggaaggaaggaaaagaaggaaagaaggaaggaaggaaggaaggaggaaagagagggaaggaaggaactctcctgacttatctggctgctctttttttgtgtcctatcctggctctttctactttgcttgatgtctaattgtatttagagtattttagatgtgaaagttaggagtagaaatggcagattatcacatgtgattctaggtctggagaactgtcttattgcttgattacatgaccattctagagtctg

SEQ ID NO: 188826 - DNA, 285 bp, Homo sapiens
ttaattgtccccaccgtatggacaaagaaacagatacagagaggttaagtaacctgcctggggtcacatagctagtcttttccacttcctataaggccttgcagggcagtagccaggatagggcagtttaactcaagctgcgtccaaacgctgggttggctagcaacaaaaccagaggcaaataaccccatcactacctaccttctacctgaaagggaggagtttagagtatttgatttctctaagcctgttgtctcactggccattttgagtgttgaaatgaga

SEQ ID NO: 188827 - DNA, 242 bp, Homo sapiens
ggagtctttctttgagtgtaacctgcaaggctggaactgccaggccaaaccccattagccactgaagaagggtcataggcccatggagggagggggctcccctcttaggggggatggggaatggagatagatggtgtctttctaggtgtggaaggcctctaggcccaagaaggggtatctatgtggtcactgtttccatggagcaacatgggatgaattaggggtgagagataccgcgtgaa

SEQ ID NO: 188828 - DNA, 533 bp, Homo sapiens
ggttagggccatggtgaaagcaaaagaggatgttaaaagtcatctgtttctacatatatttttaacatagagccaataggatttgtattcacattgggtataggttgtgaaagaaagaggagtcagggataactttagaatctgttggcttgggcaattgaaaggaaggagctactgaggtaagaaagactgagaagcaggtttgggatggggtaaggagaagtttgggtttggacttagtatgtggtgggtatgtcgagtgtgcagttgtgcaaatgagtggatttcatgggcaaagtctggcttgaagataggattcctttttttgggaattatttgtacatgctatttaaaatagtgagactggctgagctcaccaaaggaatgactgtagagaagtcctaggactaagtgagtcttagagccacagtgcttagggcactggggagaagaggaaacaccatcagaaggatatgagaaggagcagcctgtatggtaggaggggagtcagaagagagagttcccttggaagc

SEQ ID NO: 188829 - DNA, 168 bp, Homo sapiens
gccccaatatagagtagtgtgaataaatatcaccgagtataaattgatgctatctctgtcatcaaaacttttcttcagaattattctggtgttcttgaggtataacatggcttttgctttctaaacaccaaatgctccacattccacacatcttatactctgttatct

SEQ ID NO: 188830 - DNA, 498 bp, Homo sapiens
tgcatgtcctcccccaccatcagcaagcctggagagctgggcaggtggtctttacccagcaccttcaaggccgccttctctggccacagggagcagcccggaactggggcagggagcactgttggaagtgggtcaggcttcccaaagggaaggatgcctccaacagggctgtgtgaactggcgactccatggcccttggagtagaaactcactgcatgcacctgggccttgtcagtctggttgttttctgtcaagctcttgaggtggacatttccctccaagggcctgggattgtaccaggaggaagtgaggtttccctgagtctccaggggcctagaggtggaagctgcttccccattgctacaggggccccttttattgtcctcctgcccctgggtctctacctggtctttcacctccgttgcttctttgggctcttctgccctcacctccatcttcgggagcctggctgggatcacctgctcatctaatgaagga

SEQ ID NO: 188831 - DNA, 365 bp, Homo sapiens
tacttagaaagttgttctatttaaaataaaactagtggtatacaatacgagttctgaaaaaaagacagacctaccgttctccagaagatgcttagctgtaaattgaatcctcgtcattgaaggtcaaacattttgagaaatctgtatttcatgaagaaagatgctgtattatgtaagcgtaatagttaactgcagtgaaggctttttggattgttctttgttgctggtttggcatggcactttttggctagtcattgaaatggaaccttagtttaacttctgttacatatgtaatttttaaccttggcatggcagtcatagaatttaattgatatttatgaaatgctttatattcattggtggca

SEQ ID NO: 188832 - DNA, 451 bp, Homo sapiens
  misc_feature (82)..(82): n is a, c, g, or t
  misc_feature (85)..(85): n is a, c, g, or t
  misc_feature (89)..(89): n is a, c, g, or t
  misc_feature (101)..(101): n is a, c, g, or t
  misc_feature (106)..(107): n is a, c, g, or t
  misc_feature (118)..(118): n is a, c, g, or t
tccctaagatagagagatacatttaactgttactgtcccaaagacagttcttctttcaaagacatgtctgcatcagatcaanatnactntgtcctctcacnaaccnnaaactaaaaanataggaaagttattttttaatatttgaaacaccttaattttgttaaattttgttaattctcttttccatttctcttgctgctaccaactggttttctagtgactggtgttttctcccttctgttccttcttcagcttctgtttactcataacattaggccatcaccagttgctactctgacctccatctcattgaccctgttagcttttgcttctgctaaggacctgactcactctctgtttcccaatcccaagagtgaggaactggccggctgcccctgggtcctattcatttcttctcttttcagctggggctgggaagagcttcctaagt

SEQ ID NO: 188833 - DNA, 667 bp, Homo sapiens
cctcatcagacttttcagtgtgaatttcacctctacatttaaaagacttactggaggaattagctgaggcctggccctagtttagtgctatctttcccacaagtagaaggcccaagtttgtattaggcttccattttgaaaaatgccctcatcactttggctaggtaggttccttgcattttaagggacagaaagtcaccaaagccagctcaagaagtgcagggtcacttgagggagtgagtcctagaaactccaggctacagagaggctggaattagaagtccattctggattcagagcagttctggaccacatagtttggccctttgaatatccgtgcatctgtgggtgtcccatcgttaatgtttctcaggtactccctttctgtaattctcttttccatttctcttgctgctaccaactggttttctagtgactggtgttttctcccttctgttccttcttcagcttctgtttactcataacattaggccatcaccagttgctactctgacctccatctcattgaccctgttagcttttgcttctgctaaggacctgactcactctctgtttcccaatcccaagagtgaggaactggccggctgcccctgggtcctattcatttcttctcttttcagctggggctgggaagagcttcctaagt

SEQ ID NO: 188834 - DNA, 816 bp, Homo sapiens
gctgcctgaggctgaagggctagggggttggcccactgtcacttagacattcaagggaaggacaaccccctcacccctaaggctgccaagttctgcaacatcttaatccgatgagcttgggatatgcagatacaaagggccattcttttctaagtgtttactatctaagttcccagagtcgtaatgtgtcagaaaacaaatgccatcataacatgaaaatactcactaagaatctgcccttttgtaaaaataatgctccacttatagattcttccctcacttaaaaagcgtctatcccacctggctcaggtcagtttggatgactgtccgatataacaggacaataccatttcaatgcaaatcaactgcaaagttcatgaagtcaaagaaaacagtgatggagaattttacatgcaaggtctttgaccaaggagatcagatagagcttatcaattaagtgaagaaaatacgacgaggatgatgctcaaataggttcttcaaaagggaataatttgaatatcgagggactgaaagagatccttggggaaatggatgaagcccttaagtattaaacagacgtagactcttaattaggtgctgtaaagtaaaatgtgaagagcgagttactatgtgaacagatcactttgctggtataataaataaatatacccacaccaaaatcaacattttattctttcttcaatctgaaaattagcacataacctatattttgtaatctgtatagctaaaaatagcttgttttgaatgcctcatttgtacaataaaaatcttgatgtctctttaaattaatctgct

SEQ ID NO: 188835 - DNA, 440 bp, Homo sapiens
tgattaatgctagcatggtatagctttctctatctccttttaatctatatttatctttatatttaaagtgagtttcttgctagacagcatataattgagtctaattttttgatccactctgacaatttctgtttcttagttggtgcatttaaaccattgacagtcaaaatgattattgatatagttaatacctaccatatttgttactgttttttatttgttaccgttgttctttgtttttatttttgttttctactctttttcatttctcccctgctccctcactcctaccatcagaaacatgagaggtttttgtgtgtgtgtgtgtgtctctaataactactatgagaaatcagttgaactcttggaggtaaaactcacaaaagagtgggtgggcacacccctatgacttggttcccctggaatttttaacacagtct

SEQ ID NO: 188836 - DNA, 809 bp, Homo sapiens
ttattgttaatagttttaccctctgcattggagagaggagtgctttactccaagaagctttcctcatggttaccgttctctccatcatgccagccttctcaacctttgcagaaattactagagaggatttgaatgtgggacacaaaggtcccatttgcagttagaaaatttgtgtccacaaggacaagaacaaagtatgagctttaaaactccataggaaacttgttaatcaacaaagaagtgttaatgctgcaagtaatctcttttttaaaactttttgaagctacttattttcagccaaataggaatattagagagggactggtagtgagaatatcagctctgtttggatggtggaaggtctcattttattgagatttttaagatacatgcaaaggtgtagaaattgaactgttcaatttatgatttcctggtgcgtgtgtgatgcctgggaggcccaggctacgttcctttagccactgaaggactctgacagctgcctcctgggggtgtgggagccaagaggcgggaagtcaaacttcagatgtgtctattgaatggcaggatgaagagcctggtagcagtgcttgcggaagggctgggaagccgaattctttgagagtaatgaagccacttccgggcaggtagcacagggagctgatgaagcccagtgtttgaatcagacctcttttagctccagtcctggttcagtactctctaggtgtgtgatcttggacaagatgttcaagccccaagcctatgagtctctaactaaggttgtgtagaataaatgagacagtgtacctcag

SEQ ID NO: 188837 - DNA, 182 bp, Homo sapiens
accagataatatatggaaagtacttagtacaaggcccatgctaacaacttcaatgttttaagccaatatcaataagaaagaaaactttgttgaggtgtatatgaattcagttttcattcctgttgttttctttttttagccagctacgaaagacatccaataaatgtcatttttaacctgca

SEQ ID NO: 188838 - DNA, 469 bp, Homo sapiens
tcttgattcccagatatcttaacacatctggagtcatactctattaccttcctcctcaaattctgttcttcctatacattccctatcttaaaggcatcatcatcacccaataaccacactataatctttaactctttactcaattgtcactcaaatctgacaactgtgaagtaaaaattatccccagaatcgatgtccttttacatcacaattcaatactctcacaagtctctagtcaaatctttacatgtcatctttttaaaaaccatagtggatgtcctactcaaacctcttatggtccctaaatgcctatagaataaagttcacactcatgagcatggaattacaaactcttcccaatatggccacaaccttatcagtttcactttccactattctccaagtcgagcaaaatccacttgctagttctcaaatcagactactgatgcccttcctctcagcccctctt

SEQ ID NO: 188839 - DNA, 314 bp, Homo sapiens
accattttcacatgaccatagtattttctctcaacagaatttcaggcaaaagtattattagagagccagctgaaaccattattaagcaagtgtcaatttgaagagcattcagatctggtactgctaaaactataggcaggaaaaggactagtacaggatagagaaggccaaagtggaataaccagtaaatgtaaaccacttcacacccacactgtggggatggggtgtgcaaatgggagaaatgggaaagatgggagaaatgcaaaaaatctgacacagttcctcctcccatctatacattcttacactaggga

SEQ ID NO: 188840 - DNA, 272 bp, Homo sapiens
taacagatatagaatgtacaaataagaagcaaaagggactgttcagtcacacataccataggtcaagatctgttggatctgcttgttcccatgcaggtttctaaagatggcaaatattgccttaagacttattaaagctactatggccatatgggatacaggaacaactaagcatcagtgtgtgaccatgtgaaccaaagatttcatggagtgtccttttttttttttttaatagaaacacaatctggctctgtcacccaggctggagttca

SEQ ID NO: 188841 - DNA, 305 bp, Homo sapiens
gtatttatttcagtcttatgaattgaaatggattatggtaatagttttggacaaagtaatataaaacctaaacttaaaaaaatattgttcaaggctgggcccagtggctcacgcctgtaatcccaacactttggaggctgagaagggcagatcacttgagtccagaagttagagatcagcctgggcaacacagtgaaacgctgactctacaaaaaaatacaaaagctagccaggcatggtggcacatacctgtggtcccagctactcaggagactgatgtgggaggactgcttgagcacaggggt

SEQ ID NO: 188842 - DNA, 448 bp, Homo sapiens
aatatcaaacataatctgcatggtgaagatttttctattcctccctcggcttagtgatcccactctggggaggaggaccaaccttattatctgaaccatctatcctatctctactcagggaagtttctgaatgccctataacttggatcctgccaactatgataatcagtttagcttatttcctatcatgcaatgtgttacgttatatgctagccagtttgctgattatgtcctgtataaagcttgccttttctttctaactagattataagcttcttatgaagaaagatgctgtcattatacttctttatcaaagctttaatgcattctctagtcctaggcatgtggtagtgctcatacattcattaatgattatcttccaaaaacagcgtgtacccagtatgattctaatacaataaagacaccattcgatcatctaatcggatct

SEQ ID NO: 188843 - DNA, 290 bp, Homo sapiens
agtgccaggccttgttctaaacccattacaagaattaaatcactggatgtaaaaacaagcctatgagataagtactattctccccatttcacagatgaggaaatagagacacaaacaggcaaagtctcttgctgggggtcatgagtgagctagaacttgatctccagggttttttgtttttttgttttttgtttttgtttttgagacagagtcttgctctgtggttcagactgaagtgtagtggcacaatctcggctcactacagcctccatctcccgggttccagcgat

SEQ ID NO: 188844 - DNA, 634 bp, Homo sapiens
gtccgcttctgtgggtgagttaggggccctgtggggagcgagcactggacatagagcttggaggccaagtgctcaccctgcccttaactggctttggcctttgccaagtgctaagtggggaatatggtacttgtactgtgaaggtacagaagagtatctttagtatgttaccatttgtgtagagagagggaacgtgtgtgtgtgtgtgtgtgtctacatacatactatgatcatatacataaaacatatctgcaaggattcataaactcaggagggtgttagtgggaaaggggcgggagagcattaggacaaatacctaatgcatgcggggcataaaacctagatgacgggttgataggtgcagcaaaccaccatggcacatgtatacctatgtaacaaacctgcacattcagcacatgtatcccagaacttaaagtaaaataataaataaataaaacacaaaaaactcaggagagaggaacagggtggctgggcgatatttcccttctgtaccttctgagctttggactatgtgaatgcatcatcctttcaaaaagtgaacaagaaattgatttccccattcctgtctgtgcccccacccccagtgaacaaatgggcttggagaatcagatat

SEQ ID NO: 188845 - DNA, 216 bp, Homo sapiens
ccctgcatgaagctccgtcattttccatagtttctgagcaaattaactttggcatctagctgggttgctcatttgctagtcgtgcctgttaggaaaggcttgttaaagctgtgttattggtggcgttttaaaaatgtgttactctctttgtgcgccttttgcctgttaaagtgatgactctatcctcccccgtcctcgtcatattgaaggccatga

SEQ ID NO: 188846 - DNA, 489 bp, Homo sapiens
ggctgagccagaaagacccctactgaagtccagaggcacttttctgaaaggtatttttgtcttgttttgttgaggggaccgggaaagatagtatatattggctgtcacctggagtatttgcccaaagtatatatatgctcaatttgtaatatctatttaatatctaaactatactcatccgtctcctcaaaaacaagaatttggtgagtttatttgggcattttctctttgatcatgaggcccatattatgtctcatattatactccaaaccaaaagtatttgttgaggcaagtaaattcagaggcttcttccaaggagaaaaggcatattgtgagttgctttcctctgagaaggctacagtgcttcactgtgatttatctttctgaatttgcagctttagaaaacatgttgtttttttcttcccatgcactaaacaaaaatattaatcctgtttgtccccaaccacccatcattggatatatgttttc

SEQ ID NO: 188847 - DNA, 225 bp, Homo sapiens
aggcctggattgaagtccatgatgttggacacagaaagactgttgtgccatcacttacatgaccaatctcttattgatggacatttaagttgttttcaaatttctgtttaaggttcttcaacagataaatttggaataattatcattttctttagaaaacaaataagcaaactaaaaacacctgaaggtcaaaatgacaaatctctgacatcatattagtcgagg

SEQ ID NO: 188848 - DNA, 887 bp, Homo sapiens
atacaatcgagctcggtaccgttttgggctgtcgtgctgcaggaggattcttatgattccattcccaacatcctccttgtcgcatgttcggcaatagcgtgaggttgaaggaagtgtcatcacagagatttccgtccggcttatttctcaacaaaaatgtttggctgctatgcaaccagtgttttaatagatgacgggacctttcgtgaaaggccaggtttctattagcaacaacaaaggacaggagctatggggcagatgcaaataaaatcatacctctgcatcctatttgaaattcctcaactcattttcagctatcataaaggcagccaaaagattccaaatggggaaacaatgagacaaaattagaggtgccagacttcaccaataaaaatgcagaacaactagttaaatttaaggtaaactacaattatattgggacatatttattctgaaaatttttcattatttatctgaagttcaaattttactgggtgtcccatattttatctggcaacactagatttaattggcatctcagatcactattttatttcccaaacacaagacacaatgtactttcagttcaattaaccattctttcaccagaagaaactatgcagaccagaaagataaggttcccatactttatgacagtctgcgcatgaggctggattaaggggtatctccccgccactacacactggaacttcagttggccctgcatggccccaaaacacttaatatggactagaggcttactgaatccttgaatgagccctatggggtaggcccaagtattattttctctactttacaggtgaggaaactgaggtttggagaggatgaaatctaactcaggtttgggcctcctaatttaaacaaac

SEQ ID NO: 188849 - DNA, 421 bp, Homo sapiens
tggcatttgcatgcctttttaagcatcatggttcgtttcacctgtgatgtaatatctgtgtctagcaaaaacatgattttttgtttcaaagaaagagtatgtcaagttgaaagtcagcttggcaaacatgaacttaaaaattcacttcagttatggtagagacactctaaagactcatttcaagttttgcagaaggtttttaatattgtggccttaaagttgagggttgaaatcctggagagagactgatatatcactcttatttacctgagggatcgagaggaatttagtaacattacttcgtagttaaatagtacaggaagccaggtccctccgttagattccttttgctttctgttgtttttgttttgaagactttttaaaagaacagttttgggttcacagaaaaactgaggggaag

SEQ ID NO: 188850 - DNA, 341 bp, Homo sapiens
aattggttagaggcatgcattccttcagctggtatctttcttcctctaacatggtgattctcaatttgtgggccacggaccctgagggagccttgaagttgttaaaaaggtttagtaaattcatgcacataccaagcattgtctgtaaacagaataatgtcatggacacacatgcagataaatatacctactaaaattctttgaatgtatgaaatgctattgtggttaatgaaatgcacattcacttaaacaagcattttttcagttcctataggttttttttattcatgtgtatcattcctccatctgtagaagctaaaaatacaataactctcttatag

SEQ ID NO: 188851 - DNA, 260 bp, Homo sapiens
ttatggagaccgtgggatgtgggtgggatctgggattctaagacaggcttcacccacaaggtagagcccaggtccctttgttgtgagacctcaaaccctttcaagacttagtcaagggcctagcttcattccagttggagttagagcagaagaaaatgaaattacatgaatgttcatagcagtaccatttcacagtagccaaaagagaagcaatccatgcagtgatggatggatgcatgaataaagatgatgtgtgtaca

SEQ ID NO: 188852 - DNA, 317 bp, Homo sapiens
ggtctcaaacttctgacctcaagtgatccacccacctcggcctcccaaagtgctgggattataggtgtgagccaccatgtcttgccagactactgaaaatcttgaatgaaaaataattctaatttttgtttattcaccctgcatcttagcaggtatagtgtaaaagttaggagcaaaaactctagagccagactccctaattctgatttcccgctctttgatgtgtccagtgaacttgggcaagttacttaacctccctatacctcagttttgtcatctgttaaggtaaatataggcccaactttgtggagttatta

SEQ ID NO: 188853 - DNA, 596 bp, Homo sapiens
attctggtaggcattcgttttattcttatgagcatggttgtctactgttacacataacatctagaaggtagaatctgtgacttacgaatagtacagggcatggtaggcaggataggaggcgaacctgcttagtccacaagcgtctgtgcagttgactcaaataaatctggcagtcaacacagtgcttttctttcttgcacacatctgatgttcagaaaacaaatctttagatgtggacgagtagttcccaaaggtgttacttctgttgccttcaggttacagcatggatgatccaaaagtaaaaacatttatgaagtcatcttagtgtataaatggaaacatttattttcttcatggataggagtcctaaagtcttttttttccctaaaatatcatttaattctaaagcttctatttacttttcttacaatttaagaaatacaggcagagcattacctctgtaatactgggtgtgctgtgctatgggttagtagtggttgtaatttaagttctctggaggttgtcagctaccttctcagaaaaatctgagtgcttagtgccttatagaactagggcttataggatatatctacttt

SEQ ID NO: 188854 - DNA, 601 bp, Homo sapiens
ctgagtgaaagaagccagacacaagaatatatattgtttaatccaatgtatatgaaatagaacacaagcaaatctaatttatagtgacagaagtcaaaataatggttgcctttgagacagcagtaactgaaagccggcacaaggggacattttgggcctctggaaatggtattttgatctaggtggtggtaatgtgtgcgtgtgtgtataaatatttatacacatatatacacgtttaagcataagtatgtaaacatacatcaagttatacacttaaaatcagtgcactttatgaaggttatgcctcaatagaaaacaggaagaaatcgtttcggccaggatgacaagtgcatagtgggcaagctaccattctcccctccccggcccgcggcagatgtcgctaattaatcaccacactcctttcctttgagctcggcttcagaaccatctcaatccagtgctccagccagctgtgctttgaggcaaaactctcagctttccctcatgtatacacaagtatgttgattaagataattaattaatcatcttaccatcttaattattaattatcatcttcaatttgttaagccacactctgagg

SEQ ID NO: 188855 - DNA, 284 bp, Homo sapiens
tagagggtagaggaatagaacgcaacgtgtcacatcctgcacactgcgacctggccgctgactctgtatcctcgggagaaagttctggttccttagttcagccttcaggtggtcaggccccagcataggcttgtacgccatccctctcccctaacacacacacacacacccctcatgcttcctgctccatctgaactcctgaaatttgccctttgcgtatgtgcttccctctgccaggatcacctgtccctttcacttgctaactacctccttggtgcgtctgg

SEQ ID NO: 188856 - DNA, 329 bp, Homo sapiens
tatttttagtagagatggggtttcatcacgttggtcaagctgatcttgaactcctgatctcaggtaatctgcccccttcggcctcccaaagtgctgggattacacgcatgagccaccatgcccggccgagatattctttactgttactgcttcacagtacttcattacgtggatatactacagttgattcaaacagcttcttgtttagggacatttggctgtttctagtcttttgcagtaacaaacattactgcaaagaacagtattatgcttacatgaatttctgttaagtgtatccttggaatagatctctcgatgtaggactggtg

SEQ ID NO: 188857 - DNA, 481 bp, Homo sapiens
ctcaattggaacggttttctgagttttgtttttagattgttaattgctagtatagagaaatttaaaatattttatatattttatatactgcaaatttctttgaactcgtctttaaattctaaacatatttgattagaattctttggacgttttgtacatacgatcatgtcatttgcaaacagtcagagtttgacttcctttccatattagaaacattatatttatttttctaagccaattgccctgtctacattctccagtacaatgttgcaaactagtgtcaacagtggaaatatttgacttgtttctaatatcagagaaattagtgaacctttcagattacttatgatgatatgtgagcttttcatagatgccctttgaaatgcagaaagttctcttatctgcctaatttgctgcatgtttttataatatggaatctgggaattttcaagtgcttgttgcataccttctgagatgattg

SEQ ID NO: 188858 - DNA, 371 bp, Homo sapiens
ggacacagtttgctacagcacttatgtgaataaaccaaatctcaccctgtatacaattatttatggaagcagtgactagtagtccaccatgaaggtagtgaaaatgctgtgacaaaaattgagtcagtgcatcacatttaacaaaaagaaaattttttctaaaactgtttcagaacttactcaatattggatggtccgagcggaccggtccgctcggacgacaagcagcagtagcctaactatttccaaaagtgactgcgaccatgtgaatatctcccactgaattcactcgaatatgttcccaaagctaatttggcccgtagccactccatgccgcctggccagagaggaagtgggatggtccgagcgga

SEQ ID NO: 188859 - DNA, 333 bp, Homo sapiens
ccacagtgcgcgctccgagaaaaggcagctctgggggacctgacaccgccaccaccgccgccgccacagcagcagcagcagcagctcacggcattcctgcagcagctccaggcgctcaaaccccccagaggcggggaccagaacctgctcccgacgatgagccggtccttgtcggtgccagattcgggccgcctctgggacgtacatacctcagcctcatcacagtcaggtggtgaggccagtctttgggacataccaattaactcttcgactcagggtccaattctagaacaactccagctgcaacataaattccaggagcgcagagaagtg

SEQ ID NO: 188860 - DNA, 270 bp, Homo sapiens
ggatgttccaatagactcggtcaaacaactgaagtcagcatctgctggccttcaacacctcagctgagagtactctcattaactaaccaatcacaacggctttgtgatttaggatttctgcctggccaatgaactacttccgaaaataactttttatgacaatcctctattttaaaaattctctcctgcagcctgccttatagggcactcttcagggctgccctgatccggtgtaccccagctgccatttttgcttcccaaataagtgcc

SEQ ID NO: 188861 - DNA, 474 bp, Homo sapiens
cttgaaggcaacaacatttaaattccaccactttgcttcagcaagccgtgacgcttaaaaacaagggtgtcagaaaaattctggatgaaaagatcagttcatgaaagtaaggaaggaatagtgttgtgcagctatagaaataacaagagctgaatgacactcaaagtttatgtgtggcattttcaaaatgcagtaaaattcattttttaaaataagcacagatttacatatgttaaacacaatttgaatacaaattcagaatgcaggaagcagtcaatatgggaacttgagtgtgggtacattacaaagaagaaaggtaagaactggtaagagacactttagccatagcaggccagaaggctgcacaggtgtgaaaccctcctggtgagagggtgagcagtgagctccaccaccacttctcaaaccacgtgactctgggtgagtcactttctcagtcttagtttcctcaccata

SEQ ID NO: 188862 - DNA, 629 bp, Homo sapiens
tttttaatggggttgtttcttgtttgttgaatgtttaagttccctatagattctgaatgttagaactttgtgagatgcgtagtttgcaaatattttctcccattctgtaggttgtctccttattctgttgattgttttgctgtgcagaagctctttaattagttctcacttgtcaacttttgcttttgttgcaattgcttttgaggacttagtcataaattccttgccaaggccgatgtccaggatatttcctaggttaaaacactttagacaggtattttaatatagatagtaccttctttttttaacaggcaaaagacactttttatgaagatactattgataaatcattgattttcaaatgatcttcatgtaagtacaagcatcaggtagcttaaagcctacctagagaaatatttttctttattcagccatagagaagtaccttcttttaagaaatagaaagttaaatctggctagtgactgtgactgccctctagttccttcacgttttaggtatttacatggagtctgatacattcgctctcaatcttctcatctgtgagcccacccctatctagctgctctttgtattagacacaatagtcccagctttcaggtcagacaaa

SEQ ID NO: 188863 - DNA, 824 bp, Homo sapiens
agcacgtaggtaatttttaattttctgccagctactttaatagcaaaaagaaattaatttttttgctattaaaattaaggtggaatttttttgtttgtttttttgagatagagtctcactctgttgcccaggctggagtgcaatggtgccatctcagctcactgcaacctctgccttctgggatcaagcaattctcttgtctcagcctcccaagtagctgggattacaggcacccgccaccatgcctggctaatttttgaccatattggtcaggctggccttgagctcctcaggtgatccgcccgcctcggcctcccaaagtgctgggattgtaaccatgagtcaccgtgcctggctagaattgattttaaatatgcatcttgtttagcccaatatatccaaagtattatttcaacaagtaatcaattttctttttttttttttttttgagacgaagtctcactctgtagcccaggctggagtgcagtggcgcgatctcggctcgctgcaagctccgcctcccgggcttacgccattctcctgcctcagcctcccgagtagctgggactacaggcgcccgccgccacgcccggagaattttttgtatttttagtagagacggagtttcaccgtgttagccaggatggtcttgatctcctgacctcatgatccacctgcctcagcctcccaaagtgctgggattacaggcgtgagccaccgcgcccggccagtatttttaaatcattgagagttttacatttttttcatactaagcatttgaagtctcgtgtgtattttatatgatcagcacatctcgcttggac

SEQ ID NO: 188864 - DNA, 406 bp, Homo sapiens
ctgtgcagcaacatttgagtgttgtgctaaaattctgttcctcagcagccttttacctgaaaggttttggcatccagtgatctttgcctggtcagttatctcattaatgggttaaaatgttggaacctctcatggcacatgctgagcagccagtagtcttcaggacaatggattctctaggtaaacttgtcaccacactgttccaagtgaggctggaagacagtttgtcaacaccatatttcaggctggaggtggaaagaagctgttgaggaaactccctttgcaagccctactcccagctcccagctggtgagacaatttacatggaaaaaccatgaatacaacacaagatctgaagtgtctccaccctctaggcacctagggaaagcttggatttgctttggta

SEQ ID NO: 188865 - DNA, 155 bp, Homo sapiens
attgaagggagcagttaggaggctcctgcagccggccagggtgcaaagaggacagaggccattacctgggaagagacccctgaagcaaaaagggtttatgctagtcccctgacagttgctaggcctgcccttccctgcagatgtcacatgcaggg

SEQ ID NO: 188866 - DNA, 366 bp, Homo sapiens
atttctcggccgccccatctgggaagtgaggagcacctttctctggctgccaatcatctgggaggtgagaagcgcctcttcacggatgacacaccatctgggaagtgaggagcgcctctgcctggctgccccatctgggaagtgaggagcacctcttcctggtctccccgtctgggaggtgaggagcgccgctgcccggccaccccatctaggaggtgaggagcgcctctgcccagccaccccatgtgggaggcgaggagcgcctctgcctggccgcccagtctgggaggtgaggagcgcctttgcccagctgcccatcatctgggaggtgaggagcgcctctgccagcccgccccatctgggagg

SEQ ID NO: 188867 - DNA, 370 bp, Homo sapiens
caacaggacagaagagatctgatcatgtcttattaatttttccatttcctgccgtgcctaggacagtgcttggcacaaaataagcattccataaatagttgtggaatttttgagctaaattaaatattcacagtggaaaaacaggaatgaaatagtccatgaaaaggcagaaagtaatctgtagcatcacagtgccaatgatttataagatttgatgcctccttttcattaggcaaataatatatgtccatggtagaaaaatgagaaaatatagataagcaaagaagaaaatgttgaaattgccaatgattccgttgttaacaccttagtttctttctttctacttctctttaatgataggcaaactctt

SEQ ID NO: 188868 - DNA, 661 bp, Homo sapiens
catgtactcttcagagtagtcacactggaaggatatttatccaaacattattgccactgcttaaaatatttttgaaacttcccttaaaaatacgtttctaatttgaaccattccaggaaagcaatcttattaatttatggtcaccctttaattttgaaccaaattggtgttatccaatttgggggcctatattattcaccatacaggacaatgaagtccttttattgttttccaaaatccagaaccaagatacctaccaaagatttgccatcactgagtttgtaacaaaataatctgtccctgaacacaggaggtattttccaagtgttttgagtggtagcattgaagtagagagcactgaaatataaaaatcattctcttggcatgagagcccttgggatttatctttgattcagacattcttcgatggcctcacggtcagtggatcgtctgtgacatggtgtctcatgtattaacgtagcattattgttgttatttataatgaggataataagactagtaattggttacaataaatcctattattcagaaaccttggctgtcacttgcattttgttagagctttactcggtaattcagtgatggtttcacaaatggccatgttggcaaacattacctttggactaggtgtggatggact

SEQ ID NO: 188869 - DNA, 368 bp, Homo sapiens
aaacaaacaaaattagcttggtgtggtggtgggcacctgtaatcccagctactcgggaggctgaggcaggaaaatcgcctgaacctgggaggtggaggttacagtgagccgagatcatgccactgcactccagcctgggcaacaaagctagtctccatctcaaaaagtaaaataaaataaaatgtttatttccaagttagtcttagcatttgtttcaaacgctttaccatcttggtagttctctttggtacccagattgaatgcagttatgtaaatggagtctggttgtcattctagacattttttgtcttctgacagtctatggaaatttctttggcagtcttaattactctaccagctaaaactac

SEQ ID NO: 188870 - DNA, 239 bp, Homo sapiens
cactgaaatgaaattgttggatcatatggtatttctgtttaatttttggaggaaccaccataccattttccaaaccactgcagcattatttacaatagccaaaaggaggaagaaatccaagtgttcatgaacagatgaacaaaagtgatatatccataaaatggagtattattcagtcttaaaggggaagaaaattctgacgtgatacaacatgatatatcttgagctctgccaggggg

SEQ ID NO: 188871 - DNA, 470 bp, Homo sapiens
agccattaaaagtgcaaggaaaaagaggtacatggttccataagagaatgcagtctggcaattcagcctgagaggtgagggcaggcatcccaatggatgttatagccaggctgaaatctgaagtactagccagaatttaccacagagaggggaagagacgagggccattccaggtaaaggcatggcatgtgttacgctgagaggccagtgagatggcacagcatcttagggactagcagaaggcgggcatgatcacagcacagagggtgaggaaggagcttgggcaagcaggtgctggagaaggggtgagaggctggttgctgtccccgacctcatctcccggtcactttattattaatattgaaaaccattggttttcaccatctgaccataaccagagaaaagccccttgctgtccctcagtatgcttctcagaggaggtaaagaggatgttgatttcacaagcatta

SEQ ID NO: 188872 - DNA, 352 bp, Homo sapiens
aaattgctaaagctgaacaatatttaattatgacaatatttatgctcactaatgatttggatggctacagagagacaaaagattcaatgctataacatcagatagaagcaataagagtagttagaaaggtgtggggagaaggtacaaagaagaaagccaaaacgggtgtgcagataaaagtctttttcctaattaattgacagtgtaatatttttgttaactgcttacagtttatagataaaatggagctgctaataaaatcattttgttgacaggatcacatttgccaagatacaatatactaataaaagctaaaaatatatggtttgcattgccataattatctacctat

SEQ ID NO: 188873 - DNA, 520 bp, Homo sapiens
tgctagttaattatatcactgtattaaattacaatcaacttccaagaaacacctaatttttacatagattaagaaataagatttttgaaataaaacctaatagtttggatgctattaccagataattcctagagcttactaacacattttctggaatcaaaataattgttaaaagtagagcacaggaaaaagtgaaaataatcttagaaggattgattgctattacaggtccaaaatgtaacttacagaaaaactaaatctgccattgtgcttttagaagtcttgaatgaacaatgacatttaaacaattttaaaaagatcttttcttataattttcttaggaaaaaatcagaaagcagagaaagcaaaacaaaattattttatggaatttcaagtccattcacaaaaatatatagtaaacagaaaacatatacagggtaaagtcaatcaaaaacatcagatcttgtattataaaatcatcacaataacattcagtcacatcatggatgagatctctgac

SEQ ID NO: 188874 - DNA, 311 bp, Homo sapiens
tctctatccctgtatacgtcttcacaatactgaaacaccttcctggttgctgaagagttgtgtatctgaccctgtgaaccgagaattgctgttacccccttttgattgaataagacttagaaagactggtcatttgacagagcttgcacaggaattatttatctgtttttaaatcactctgtgtgtggcactttatacaagaaatcacacgtagcttcccatattcagcaaatacatatgaggtgcctgttatgtgccaggcactcttcgggcagctttggctacagcaataggtaaagcaaagaacctgc

SEQ ID NO: 188875 - DNA, 380 bp, Homo sapiens
aaaagattataaaaaggggagatgtagtaatggacaggatccagcttgtgcagcaattatggttggtctaggttgggggcattctgggtagccatgtgaaatactgattatagctggaccttctcatctttgctctgtgataccacctgaattatttgaataaaaatcaaatctttcctccttaagaatccttgatggctttctgttgcatgtggagtaaagttcaaacatcttagcacgaagaattcgtcagttaaaggctggcccctacttttccttatcttctactacctccttctccatcccctcatcatgtctaagatgtgtgaagctttcttccaccttgcctacctagccaacccttacttgtattttaagac

SEQ ID NO: 188876 - DNA, 665 bp, Homo sapiens
accaggcagggggaggccacctccggtttcaagtgcaattggctgaacttcacgattttcctctctccactatttacaaaaatgttcactgagatggacacgaaatcaggctcttgtcatagcttcaaaaaccaagagaaaaagggtcaagcagttgtaggaatctagggggataccgccatccacagactacagtttagataaagctgcattgacaaggtaaagtctttgtcccaaacagaggagcacaagtccctggagccagatgggaagggcctcactccctccatttccacccttgccagctctgcaccaaccagaaaacctggaggccaccccttcgctggacagggcttgttagcctctgtcccagggagaacctcttcttctgtatccaggcagaacggtaccctgagggccagcacagcaggaagaaagacaaggacatgtgtactgccctgcattccaggctggaggagtcctcttaaataagagcccagaagtgtcctggggcagcagctggaggctgatatatttcagaggctgaaattaggggaaaggagaactgtactgtgctttagattctttaaaacataacttcccttcttcatagccagagaccaggaagggagggcagagaagactccatttggggagaccaaatg

SEQ ID NO: 188877 - DNA, 434 bp, Homo sapiens
ttcgcggtatataaactccaaccccgtctctactaaaaatacaaaaattagccgggcgtggtggcgagggtctgtaatcccagctactcgggaggctgaggcaggagaatcactagaacctgggaggcggagattgcagtgagctgagattgcaccactgcactccagcctggaggacagggcaaaactccgtctaaaaaaaaaaggacaggggaacacatagcatcacagatttgtagagtttgattatctagtgtaagtctttccttcaataaaggagttaagtgagcctcgtgaggttagccagttgagtcaagtagctaatcacgcagcatgtctggtgatataggttgttggccttacctctattggagcatggaacccagcctttgatcatgtcaagcttctattaataccttatggaaagagtgtaa

SEQ ID NO: 188878 - DNA, 353 bp, Homo sapiens
gtacttctgaccaaggactatacttttctaatgcttagctttcacatctatatcatgaagagacgtagtagattccactttaaaaagttgttgagcataggcttgacacaagaattaaacactataatagtggcaaggaattcaagtgcaatgtcagcctagagcagacttacccagtacttggtgtactggcctcctggtacagctccttggtcaacagccatttaggtaacagccatttaggtagcagccatttaggtcacagccatttaggtaacagccatttaggtaacagccatttaggtaacagccatttaggtcacacccatttaggtaacagccatttaggtaac

SEQ ID NO: 188879 - DNA, 270 bp, Homo sapiens
ggtaatgtgtctatgacagagtggcctcagacattcaggacacattaaagagtttaccaacttgttagaatcctgaagccacagaaaacggtttgcaaagaacgtctacgtctccttcttattatgtctcttgtttatgtctattataaagataatggcgccgggcgtggtggctcacgcctgtaatctcagctactcaggaggctgagcacaataattgcttgaacccaagaggcagacattgcagtgagccaagatcgcaccattgca

SEQ ID NO: 188880 - DNA, 640 bp, Homo sapiens
agttgaagtaaaaatacagggaggcttaactcttccttgaaacttgcgctcagcattatactcagatgattgtaggggccttattttatcctgggacatgttcatcctgggttatgtagattcattcttggagatgttagtttattctgcaggccagtttcactagaattaaagctctgtttcagagtgtagccttcatgtgcccccacaccatcattgagtgatggagagcccagcagatactgaggtgactaaaccagccacccccatgcccactgcttgcacaaaaggaaggtgctttgatatgactgatttttcttagggttgttttcttttttgttgtttttttctaagtctttctcattatttgtgaaaaaatcttggccctcaatagcttcaaaacgttaacatgctgggaagaaccactcgtgaaccaacactccttctccatgatactgttgtcattcccattttgccagtcatgtgggaaggaatccatgtcccggagacatgtgttgcagcagttctgacatgtttttgaatcagcgatggtgtcacgatgcagcttttgagaatgtcaagtttcagttgcattgggaagttcttgtttgggagatatcctatagtgtttcaaggttaa

SEQ ID NO: 188881 - DNA, 205 bp, Homo sapiens
tcacctcctgtgtccaaccacccccaggcttcgagtcctttcagcgaaggctccagacactgtggagaaaagacgaagaccccacagtaccatccaaattcctgacaatctgtcagcagaataaactggctgtgcctcatgtctgtcagtctggtgtggtttgttactagaacaactgaaatcagagatgtcaatgtgaactcat

SEQ ID NO: 188882 - DNA, 607 bp, Homo sapiens
cttcctgccatctcctgtcaccggatccttgagatttccttccaccagctgtggccatcccaaaaaactcagaacttccagatactacagccattctgaggggctgagaacagggaggctccccaggaagagctggtctggcatcctgtttagttcctattgcccctcctctgcaaatcccaaggagatgctaagtctcttttgaagcttccctcaaggaaggcagcaggttttgtaacacacataaccagtgtgtccatcagtgcccaagtctgagtgccttagcagcacagtggaggacaccatccctgctctcaaaaagttcatggtttcttttttttttttttgggtggggatgggttataatatttaatgggggagcccatctccggggggggtagaagcttcctcaagagctgggtttccaagtttaaggggttatcacttctgagtagtttcactttggccctcgtgcaaggatctgggggtgtgggtcagtctcgggaccaattgggggtagtgtttaagctaatagttccagggggtgagccagggttccgtggccccgtgtttggtgcaggggctcagagacatattctcgtgcctc

SEQ ID NO: 188883 - DNA, 329 bp, Homo sapiens
tagctggaattacagatatgtaccaccatgcccggctaattttttgtatttttagtaaagatgaggttttgacatgttggccaggctgatcttgaactcctgacctcaagtgatctgcctgctttggcctcccagaatgctgggattacaggcgtgagccgctgcacccagccggccgaagttccaggtttttaaaaagctcaccaggtcgtttggatgcaaagtaggagtggggatgaggaagaattttgcagctttaaatatggagggaaagaaaggcctccttgggaaaatgacattgagctctcgtaccattataccttcagagc

SEQ ID NO: 188884 - DNA, 519 bp, Homo sapiens
caagaatggaaactgtggcatatcgagcatttttccattgctgtctttcacactgggctatctaagtttatacaattccccagactagctgcatattaagcttgctgtgtacagctttattatggtgtggtggtggaagaagcattaatattccagctccgcatctgacagggcatttacatgcgcccatctgagcggcacctgagagctcctccaaggtgcagtaactgtgcgcctattgtaaaggcaaatgaagctcacctattccctgctgggatcagaagtgacctcaccaccccccatgcctcaaatccttcccttgccaacctaactcaatgccattgcagaatgacgaatgagctcagaaatagaccccaagttactaaccctgctaagaacagcaaaagcctttgctgaaatgttttaaaaatgcatagggagtgcagctggccagtaaaaagcagggagacaaattccaatgaacccaatatggaataagttacattttaaaactgatta

SEQ ID NO: 188885 - DNA, 620 bp, Homo sapiens
gacagtcctctcctgaactagccactctcacaaaatcactttttaaagattcaaagtgatacaaattcctaaacatttcttaaatcatcaagatgaacattcagatgatgagggtaaagctgtgccttttgagttccaaatgtaataaaataaagattttgcttttctgggcctaattgattttgtaaatattaattatctctacctcctcaaactggctcctttccctgtatcccctacaagtggggtacccattcaccccagtttgcccaggacagacttgcttttcacctattcttgcatggttatgaacagtgccctctgtcattctcaaaagtgccccagtttgaaggatgaattacacactgtctatgtgtggtcttctccatgccccatgcctcacaagtcacttcctggaagccagtcatgactctcctccccctggtcctcacagccaaccaacctccccatctgctcagcatgacctcccaatgtctctccatctgtgcgtctgtccagcacccatagatcacgcccaggaaactgctgtgctcttaacagtcccactcccacctcacccttccaatctgccttacgctctgatccacaaggctcttccc

SEQ ID NO: 188886 - DNA, 826 bp, Homo sapiens
catggtgcagcctacactgaggtgtctaaagtcaatccttaaacagaaccagtgagaactctagccatctggatgaccccagtctaacacacacaatcatcttctgcataactggtttccaggaagcccagggtcccaaaagataacaggcatgtttgccaaaaataagagggagcatcctacactatttggtgaaggaaggaaatcagaagacaagtatgcattaaatgaaaactccccaaaagctggttttaccacaagctgtgtggatcatttataattagattagctgagcaaataagatactgtaacttctcatgatttctcccagccagccctctgggagggataatgctgatacagaattgaaaatgttgatcccaaagaaactttaacaatctcaaaccatacattgcttttcatgccaatctgcacgcccaagtaatcctccagtggaatgggatacttaacaaaggaaagcagggactgctggcacagttatcacagtaaactacagcaaagccaaccagccatgttctcgatgccaccacagtaacccaaagggaaaggttgtcacagtggatctgtgggccatttgtggtcagtcttgagtgggagacaatgaagcacagggcctggtgaggctggaacacataactacagcactggacactgctcaaatacataactacagcgctggacaccactccttgctgtaatgtgacaacaattgctaaagcaaaccttgtgctcacagcaaagaggttttgccaaacacttagcaacaaagaaataaataagaagcaaatgctactatatctggtaa

SEQ ID NO: 188887 - DNA, 336 bp, Homo sapiens
aaatacctaaatttaggtattttaccaatttaggtatacctaaaattggacatttttaatgtgaggagtgtttagttcaatggggacatttctcagagagatttactactttttaatggtgcctctgagagtccttcagtagctgtcctccatcggagaacatctcagaattactttttttctgtccacttgcccataattttcatttactttactggatttgctcacatttattacccccattcatatttccttccattctcgatacactggaagaaaaatttatttatatatatatatgtgtatagcatatatacacatgtgcatatgttggaa

SEQ ID NO: 188888 - DNA, 315 bp, Homo sapiens
tccgtcctacatagtgtttcttactcatcactggcaatagccacctgaagggtctccttgctggtcccaggaaacagctaaaacttgtccatgtgaaggtggaggttgcagtgagctgagattgcgccactgtactccagcctgggtgacagagtgagactccgtctcgaaaaaaaaaaaaaaaaaggcttgtccttggggaaaaaacataaaaccccattcctgaggggccctcaaggtccccgtgatttgtgtaaacccagaaacgggggattgatccttgtaaccccgagcagggtgactgatgaattgacc

SEQ ID NO: 188889 - DNA, 654 bp, Homo sapiens
attaaatgttaaatcagataccttgttaaaatattatttaataaaagccagacgtggtggctcatgcctgtaatcctagcactttaggaggctatggtgggcagatcacctgaggttgggagttcgagaccagcctggccaacacggtgaaaacccgtctctactaaaaatacaaaaattagccaggcatggtggtgggcacctgtaatcccagctgttcgggaggctgaggcaggagaatcccttaaaccccagaagcagaggttgcagttagccaagatcatgccattgcaatccaccctaggtgataagaatgaaactccgtctcaaaaaaaaaaaaaaaaaagaaaagaaaaaaattacttaatatgtatttacctgattacttttcttcaaaagaaggattaaccttaaagatacaagggtatgttattttgttaaatgccagttataaatgtcttttgaatttctgggataagaaaacagtagaaataataataaagttctttaatgtttgaaaactgaaaatgtgtttctttgaactgtgggatattcccttcacagcaattttacaaagtatatgtactgtttttaaaaataaaacaactgatatggaccacgtttaactaaaatgagtcataggaaattagattt

SEQ ID NO: 188890 - DNA, 405 bp, Homo sapiens
cttgaacctgggaggcagagtttgcagtgagctgagatgaccaccactgcactccagcctgggcaacagagcaagactccatctcaaaaaaaaaaaagaaaagaaaaaaattacttaatatgtatttacctgattacttttcttcaaaagaaggattaaccttaaagatacaagggtatgttattttgttaaatgccagttataaatgtcttttgaatttctgggataagaaaacagtagaaataataataaagttctttaatgtttgaaaactgaaaatgtgtttctttgaactgtgggatattcccttcacagcaattttacaaagtatatgtactgtttttaaaaataaaacaactgatatggaccacgtttaactaaaatgagtcataggaaattagattt

SEQ ID NO: 188891 - DNA, 702 bp, Homo sapiens
gagacatgcatggcctgtttgatgtggagatctctctgaccgtccaagagaacgccgggagcatatcctgttccatgcggcatgctcatctgagccgagaggtggaatccagggtacagataggagtgtaagcgagagagagaagcatgggccggtgccttattcatggttccagcagggacaggatcagagatgctcccacatccagctgcttctcttcttctagtcctagcctccaggggcccaggcccaaaaaaggaaaatccaggcggaactggactggagaagaaagcacggacaggcagaattgagagacgcccggaaacacgcaggtaccaacgcctgagagggtgacagtgggacagaatctcaggtggacatgagagggggaactgaacagggacagatacgggaacacagagtgatgctgagacccatcctgcctgcagatggagaaactggatgcttgatcgcccccaagggttcagtgcccccagacacacttctttcccttggtctagaaggggagaagacaggggctgggtaaacgggagacgggggggtctttggcacagtttcaggcaattgagggcactagtgactggtcaggggtctgagctgaggggaaggaagtaaagtcaggcagaaaattctgagtgggaggaagttagatagtggggtccctccagctcttatgaatca

SEQ ID NO: 188892 - DNA, 815 bp, Homo sapiens
gagacatgcatggcctgtttgatgtggagatctctctgaccgtccaagagaacgccgggagcatatcctgttccatgcggcatgctcatctgagccgagaggtggaatccagggtacagataggagatacctttttcgagcctatatcgtggcacctggctaccaaagtactgggaatactctgctgtggcctattttttggcattgttggactgaagattttcttctccaaattccagtgtaagcgagagagagaagcatgggccggtgccttattcatggttccagcagggacaggatcagagatgctcccacatccagctgcttctcttcttctagtcctagcctccaggggcccaggcccaaaaaaggaaaatccaggcggaactggactggagaagaaagcacggacaggcagaattgagagacgcccggaaacacgcaggtaccaacgcctgagagggtgacagtgggacagaatctcaggtggacatgagagggggaactgaacagggacagatacgggaacacagagtgatgctgagacccatcctgcctgcagatggagaaactggatgcttgatcgcccccaagggttcagtgcccccagacacacttctttcccttggtctagaaggggagaagacaggggctgggtaaacgggagacgggggggtctttggcacagtttcaggcaattgagggcactagtgactggtcaggggtctgagctgaggggaaggaagtaaagtcaggcagaaaattctgagtgggaggaagttagatagtggggtccctccagctcttatgaatca

SEQ ID NO: 188893 - DNA, 312 bp, Homo sapiens
aatattttaagagtgagcagatgaaaccattacttcaaataaagctttttgaattatgtttaattttatttatctctggggacaaggaccaatgaagaagggactgcaattagcattagcctctcctgcatgagaggaaaaggtgacgcccaaagaaaggtcaaagaaagaaaactagagatcaaattggaaagaagagcgcagtaaaacacacgaatcaaattaacaacctccactgtattttctctgtaaaactagcatgccattgtggtgattaccattttagtgaaatgaatgaaaacagtcatttcc

SEQ ID NO: 188894 - DNA, 593 bp, Homo sapiens
atggtgctatcgtttccagaggatcccctgtggaggtacgatgaaatgatgagatgagatgacatgaaataatgaaatgaaattgaaatgagataagatacgagatgagatgaaatgatgagatgaaatgatgaaatgatgagataagatgaaaagggttgagatgatgagatgaaatgagatgaaaagatgaaatgatgagatgaaatgaaatgatgagatgaaatgaggtgaaatgaaattagatgaaatgtaatgagatgaaatgaaatgacataaatgaaatgaaataatgaaatgagatgaaataaaataatgaaatgatgaaataatgaaatgaaaatgaaatggaaatgatgagatgagaagaaatgatgagatgaaatgatgaaatgatgagatgagataaaatgagatgaaatgatgagatgagatgaaatatgagatgaaatgacataatgaatgaaatgatgaaatggaataatgaaatggaaatgatgagctgagatgcaatgagttgaaatgagatgaaatgatgaaatgatgagatgaaatgatgagatgagatgtgatgaaatgacatgaaatgatga

SEQ ID NO: 188895 - DNA, 270 bp, Homo sapiens
tctgtggcacagctggctcctccctcacattcccagagcacccagggcattgttcttttgaagcacttaacctggtgccttcgaaggttctttaccagagttttcaaccttggtacccctggcatttggggctggacagttctttgtggaaggacggccatgtaccttgtcggatgtttggccacaaccctgacttcagataccagtggcacaaaaatgtctgcaaacgttgccagatatccctcaggggaatgaggtgggggaaattac

SEQ ID NO: 188896 - DNA, 196 bp, Homo sapiens
tactctaactgtccacccatacagagtactcactcactactctatctgtccacccatccatctactcactcactactctaactgtccacccatccatctactcactcactactctaactgttcacccatccatcttctcactcactactctgtccacacatccatcttctcactcactactctgtccacccatcca

SEQ ID NO: 188897 - DNA, 293 bp, Homo sapiens
ataatgggcatcctctgatgtgtacttttctctcaacagtaaacaccttatatgatgtttttcagtatctcctgagtataaggtgctgggctcttctctctttctgaacagttctggttctttagtcctagtgcagagacagcctttgtgattaaaagacaaaaaaatgtactagtaataataagattttccaaggcagtcacccagtcctctcttctggtttgtttttctgtctttccctcacctcctcactcctgccttgggaccagttgtgcttttgctcaattcattca

SEQ ID NO: 188898 - DNA, 364 bp, Homo sapiens
tataacactgccaaggagcggattatctcatcttcatcctgtaattccagtgtttgtcacgtggttgttgaataaatgaataaagaatgagaaaaccagaagctctgatacataatcataatgataattatttcaatgcacaactacgggtggtgctgaactagaattctatattttctgaaactggctcctctaggatctactaatgatttaaatctaaaagatgaagttagtaaagcatcagaaaaaaaagtgggtattcctacaagtcaggacattctacgtgactacaatataatctcacagaaatttaacattaatacattctaagatttaattcttagattcttggtaaatttattac

SEQ ID NO: 188899 - DNA, 228 bp, Homo sapiens
aaacaaaaaacaacatctgaggcgtatctttttacaagagattctagggagtgatgatttgaccaacacaatggggatccacaacaacatgaaaagtccctcaacactagcaagtggtgctgatgttggctggccaggctcaaaagaataactcaaaggctaacagagagtagccctgccacagcctacattctcaacgtatctgtcaaaatcttgggtttatatgtg

SEQ ID NO: 188900 - DNA, 504 bp, Homo sapiens
actctataggatctcgttcccctgcggaactgaggaaggaaggggtcggggcagaggagcccaggaggccgcgtgataccagtaaaggccctgaggctggaggccaatattgagagaagtcccctgaggctgggatggggcagccaggtatggagaggggcagccacagctctgggtgaggctgaagggttgacatgggaccagccaaggaacttgggaggctacaaaagagattcaagcaggggaggagcgtgtcagatgggagtttctctttgtttctttttctgtattgatgagacatgcagtatcccctgcagtcaggaagatggtgccttgtgttggggggctacaaggcccccaaaactatgcttatgtcctaaaagggctggcgtgtcaggctgaggagctctgtattaggccattcttacattactataaatacctgaggctcagtaacttataaagaaaagaggtttaatgggttcacagttccacaggctgtat

SEQ ID NO: 188901 - DNA, 455 bp, Homo sapiens
gtgagttttctcttggaattccatcttgcccccatgccaatcctaaagtgtatttctgtgttgcatgttgcttgctgtgcagacactatcccctagtaaggaagaggaaggcagagccagccttcatcccataagtcagcattgactttcaaaagtaagattttttagtcaaagcaggtacagcagtctgaaatccatagtgcttttgatttgccaaggccaatcattggaaggagataatttctttttaagttatccaaaagtttgcttacaatgtaagaatagcttctcgatcctccttatcctcccaggcaagcccatggaattttcggaaaagggagagtcatcagacgggagaggactgggtgctggtgagcatcctggaaagtgcccagcacaacttatgcctggctgagcgcctgtgtgtgtgtgcctgtatgtgtgtgtgcatgttg

SEQ ID NO: 188902 - DNA, 557 bp, Homo sapiens
tacctagtcatatgatcttgcaagtgccggagtaagatctgcaggaaacgtgggaacacagcacacataaaagggactcgggactgagctgacagctggaattgtactacgcaactgtacaatgtgctacaccactcacaccctcgacttccccgccactccaatcctattctagctatgttagtttggtgcaaaagtaactgcggttttaacagaagactagaatctatgagacaatgttattctattccatgctgttcaaatatgggaacttttattatcaaagggaatgtcttgttaccagagatgttcagtttagagctgtctctcaagtggacacactggttttcaaatattttaggagttgcaatatggaagaggacagacttgttctaaaacacgacctacagctcaaaacaaaggattccttaatgagaaacatttctggcttaatataatccttatatttgagactatgcaaagatcagccgtccccaaccttttcgacaccagggaccagtctcgtggaaaacagtttttccaaagatggggtggag

SEQ ID NO: 188903 - DNA, 358 bp, Homo sapiens
tagatatcgctagatagcctgttgctcaggctggtctgaactcctggactcaaacgatcctccctccttggtctcccaacagaggctggatttgtgccacctgcatctattctactcccatccactccagtgtctgggtcccctgctgatgacaattagccagggtttgaccacgccctccatgtaggtcccctccccaggccctggtccccctcagcatctgcatctgaaatagataaggagtggctagttcctgagatgatataaaggtctctgttgcacctgatcttcagataacactttgaaatgagtccagggtctcactctcttcttttttttttttttttttttttttttt

SEQ ID NO: 188904 - DNA, 490 bp, Homo sapiens
ttgatcccaaactgatgcacactgaacagtgcggagaggtagaaattactgaaatttgcctttttctactctcttccttgatattattcaaaggaatatgcctgtagattatttttctttgttaaagcttcactgaatttaagacccaaagcattggctaaaaggaatgtaataaagaagaattaaccaatattttcataacatattcaattccattagccacttctggaagctctattacttacatttaaaaagtgaccaatttatcactgtgtaagaaagggcaatattactaaaaatctacagtctaaatgtaatttcagaggaggaaaagtccagacacctaaaaatataattactgtctctcacttcctcaaacttcagataagaaatgtaatttttctagctgaccttcaaaaacaagaaagaaagaaatgatcatttctgggtctttggtttttttttgttttttttttttttttttttttgg

SEQ ID NO: 188905 - DNA, 111 bp, Homo sapiens
gcagacctagaccagttaaccacacaactacctgaccctccacactgcatgtcccccagatctgtagacatagctggcactgtttcctggtcaccagtggatgttaagggt

SEQ ID NO: 188906 - DNA, 502 bp, Homo sapiens
ttagcctcatcctattcctataagtgacaggcactgtaactattgaaagtactgattacaagtagtgtttgattattctgtcaacaaagtaatacttagtataaaaaaaaagtgctgggattacaagcgtgagccaccgccccctgccggatttatcttacccatgtgtctctgacaggatatattgtcaaattcccaaactgtatttttaggggggttgcaaattttgcttccaaatgatcttctaagagcaggatattctctgcctggagtgatgagggtaccatttctaaaagaggtacattgtagttcaaactcctgcaggtaaggagccgtgacttactaactttcaactttgacacattcgcaggtaagagcagagctacgcactacagcaaaatccaggctgtccgtcagcagctgatgtgcccggtaccttttgtcttggccatcctgttgttcattaatctgatgtatactcactgtgtttgcgtttattttc

SEQ ID NO: 188907 - DNA, 856 bp, Homo sapiens
ctcgggaggctgaggcaggagaatcacttgatcccaggaggcagaggttgcagtgagccgagatcacgccactgcactccagcctgggtgacagagtgagactgtctcaaaaaagcaaacaaacaaacaaaaagcataataaacaatagcaaatcctgtaagcccttcaaagtctatcttgaatctgtccccccctttctgtctctgttgccaccacccttgtccaggtcaccaccatctctttcctggattattgcaatagtttcctcaatgttcttttttccagctcctattcttgcctcttttccatctgctctccacccagagtgaccttttaaaaagcttattcagttgaatcatgagacattgggaaaagatactaaaaacttccagagaaagaaaacaaaagagagagagagaaaaaaaaaaaacaacaaatgaaacaaacaaaaagctaggttaattataaaagaaatttaaaagaacatggagtggtatcagacttcataggaaaaactctagtaaccagaagacagtagaaaaatgctttccaatttctaagggaaaaaatgattttcaacttagatttccatacacagccaaactatgattaattaagtgacagcatagaataaaagacatgaggcaaaacacaaaataaaaccatcaccaccacaacaaaaacctcacctcccacacaccctttcttaggagacgaccatgataacaaatctgtacaaaacatttgctatttccaggcactgttctaagcatttgacatacagtagctcgttcagtccttacagccatcctgtgaagttggtattgtcatgaagaagttgaggcacagagaggt

SEQ ID NO: 188908 - DNA, 159 bp, Homo sapiens
agccagaccagtgatcatacatgagtgaagtgagccaggcaaattgtacaaactggagaacacaagccctatctaatggggcatccactgttcagcaacagctgattattgccaagtggttatataggcccagaatttcccactcctacgtttttcaag

SEQ ID NO: 188909 - DNA, 945 bp, Homo sapiens
aaggcgcgcccggcgtagggaggtcagagctcatgttagctatgaacacaggtcacaggggcgtacggcgatgggaaacactgagatgctcaatatattgattatttaatagtgtttagcaaaatggtctttttttattccttaaatcaactgaaactcacttcacgtctctttccttgtagagcatcatgcttatttctggctcactcacatctttgtctcgggagttctctgccgagccattgccccctacagcagagagcacagctggctgcactagtgctgaaggagccagccccagagcagggcatttccaggggctcttgtcccagagcggcaggcgttgtgtgcagagaacgcccctcccacgcagcacagagaacgcggggtgggtgtgtggctccgggcctgtggggcttaggctgcctgaaccaccgccgactggcaccatgactcggcattcctggaagtgccttaccaagttgttgttgttgttttgttgttttttaagagacgggcttgctctatcatccaggctcgagtgcaatggcacagtcacagctcactgcagccttgaactcgtgggctcaagccatcctcctgtgtcagcctccccagtacctgggactgtgggcatgagcactgcgcctggcagctgtatcagtgttgactccacattttaatagttgcttcttgaaattaaaatgctttgattcagccttcaagccatcaggaaagtttgcccctctgagtcacacctggtggtctccagggttcctgcccctccctcctgagccagctcctcagagcggatagaggcaggacccccacccaggtcttgagacccccctgccccgcactcccccggagacgggctacccctgcagatgcagatagtcaaagctcaggtttcttccaaagcttttaaaaagatattgtaccttg

SEQ ID NO: 188910 - DNA, 772 bp, Homo sapiens
cacgccgctccgccggttcaaactcaaaatgggcatacagtcatcttaaaataggttcagctatctctagcaattataaactctttccatgaataaactttttctaagcacctaaaatcacatgaatatatctgcctgacaaaaatttgggaagtccagcatctctgatttaaaaagaagaaactatttgtaattttagtctcttgttcttaatgcaggatctgaccattggttagtaatgcaacagctgcgattagcaatgaaggaaaactattttcagagtcttctcatgacctagccacattagcaatctaaaaataaaaaaggaaaagtttttaaaagcttaaccttttataaagtgactaaacttcatcaagccatcacaaacagatttctaggactttttttgagaagaagaaaataggatcattagtttaatgacagtaacatttgtgcgggtatacaaacaacatatatgtcagaacaatttaaaaattatatactgaatatgctttatggctttttatagtattttgttgaatctatatttgtttgtggggagtttggttttaggttctatgtgtgagtgtgagtgtgtttgtgtgttctcgattttaaaactatttcttgagttctttagaccataagaacataatgtataatagtaaagacttatttcaatttatttgaacttttttcaaaagtaacatagattggccaggtgcagtggctcacacctgtagtcccacactttgggaggcagaggcgggtg

SEQ ID NO: 188911 - DNA, 397 bp, Homo sapiens
ctcaagtctgactacttctcccccaacattctgcctccaccagagtccaggatgttgtcatctctcaactggttacacccccaatctccttgttagtttccctgcttctaccctgactgacaattaaatctccacctggccgtcaaagggtacttttcaaacatgaatttggccacgacattgccctgcttaaaacaaacagctacccgttaataacctggagtcaatgccaaacttcttagtggcccataaggtcccacaccatgtggctctgattggtctctccaacttctccttcccctaccctggctcactaagcttcaggcactctggtgtgcttcctgctctgcaattcctcattggttcccttgtgagtatgttgaggaaggagtgaaac

SEQ ID NO: 188912 - DNA, 385 bp, Homo sapiens
cttactcgatatctaagtttgggtttagtccttccctctaggaatctcttcacaatcttattgtagaatgttatcatattgtgtttaattgcctgttgccgtttcctagactgaaaacaccttagatatgaagtctctggtatctaattctgcaatttgtgttcttctcattcttgatgacttagtttctctaaagcaaatttacatttccactactaccaggaatcctaaggcaccaccaacccaagatcacttttaggacattttatgcttgaggtttcacaaactacacagcatagtttcaaattccaaacctccttgaggtatggcctatagttacaaattctcaggtacattttttttctctaccctgagagccaatgcc

SEQ ID NO: 188913 - DNA, 100 bp, Homo sapiens
ggaaaggtgtaccctggagggatttcttatggcatcttttactggcttcagaaacacaggtcatggccagacgcagtggctcacacctgtaatcctagca

SEQ ID NO: 188914 - DNA, 487 bp, Homo sapiens
cttgtaattccagcactttgggaggcccaggagggaggattgcttgaggccaggagttcgaggttgcaataatctatggtcatgccattgcactccagcctggactaccaagccagaccctgtctcttaaaaaatttaaaaatgaaaaagataatgaacatatcagttacctccaagagtttcctcatgcctttttgtaatgccttcttcctgccccccacctcctcaggagactactgatctgcttttgtcactataaattagtttgcattttctagaattatctggtatttctgttgtatctttcttttaatattgggtatacaaaattgagtaactcagactctagtttatggcatattgtgattgttgacctgttcaaggccctcatttgttttctccatttagcctgtacagttctattctttttctattctttattctttacataggcacccactcttgtatttaacaggtagccttctgg

SEQ ID NO: 188915 - DNA, 721 bp, Homo sapiens
gctatgggaggaaggtctagtggactggaaccattgtatctgtcgattagtggaggcaatcatatttgtgatccttgagctaatggtctagtaagactataaacttgttcataattaaagctggcaagagggttcttaccccaggtaatgagacaagagtgaaccacaggaggaagccagcacagagaccgtatgtaatgagtcccttcatgggaaagggatggaaaacagtcctcaggctagcagcagagggagtgctgtctgttgtgggtcttgacctgcttaagaggtctgacttgaggtgaggctgaaagacagccccgctgggggcttcaagataacgatggacggatagggttctctcaccgctgaatatctcctaaggcattagtaaaacactatttaaatatttcctctgtaactcagttgtgctattaaagctctgtttctcaaagtaggtctgtagatgttcttgagagagtgagtgtttcatgagaattttcaaattttctgctttcgttttgaagataatcttaaagaaataaaatcaaaatgttctactacattatttttagtgctgaaggctgagtttggtgccaaatgaagaacaaataacatcacggcatgctatggaaatgtcgattttgcattaagtttgaatagagaaagatgtgggaaaattgatcaattttgtggcccaaaggtagtacagacatcatta

SEQ ID NO: 188916 - DNA, 628 bp, Homo sapiens
caaaacaccttcctccccatgcctctctactactcactcccaacacatactagagaacttccccatctgcctaattcaaacaccaagatcattccttttcctctctctcctattcttcatatagttatatgagtaagattgcatcaataagatatcatttcctgagagcctctcccaaagccttgtttgtacacatgactctgccacaaggccacagttaatctggcccaagctgggctaagactacggaactgaacccaagacaggtcagtctcagtctagactgttcatctaaaaacgacacataaatggaaagatgatgatcttacgaagaaagtaatcagacaaaaggaaagctaagaacaatatatagcccccaaaagagtgaagcagactaccagctacttggcccttgctgtcattccaatacctgctaccatctaccattcctttatgactccaggttataccccttgcccttgggttttaaagacagccgtgtgtccttaaaataattttcactcctctatcaaatataggtttctgttacttgcaacctaaagagtgctaagtaaaacaccacattttggtcagctgggaaatgccttcaaacacaatggtgttcttc

SEQ ID NO: 188917 - DNA, 215 bp, Homo sapiens
cctataaatgagcactgcaataaatacagatactccatcttacacgaatattctttatctggtgtacaaagttgactggcaaaacaaaaactgtcatcatataaaaacattcattagtaattatccacctacaaaaattaatcccctgactcatccctcccaaatgaataattaacatcagctcctaacagactctcacagataatccaacaaca

SEQ ID NO: 188918 - DNA, 505 bp, Homo sapiens
agtcacccttgtggccaggtgtggccacgtgacagtggaatgtaagtggaagtgatgtatgcacttgggttcattggtttaaaaaaaaatatgaccgccctccatttccactctttgtcttatctgtgaatgggaacatggctgtgtctgcagcccgactttgtgcagcaaaggacaaggccctaggggaaggtggagaaacaagatggaacaacttggacccaacaacttggatccctatgtggccatgtggagtcatctcacccacctgggccactcaccccgaagactgttgtgtgagggtgaaataaacttctgtatcactagcccctgcatttcagaaattctttgttatggcagttttgcctttatcctaacacagacagcaaagtatcttctgtggccccatgactaatttcgttgtttaaactcattataaaaactatataaataaaatattaaaaatcaaataaaatagcaagataacactgtgtaactatccagt

SEQ ID NO: 188919 - DNA, 337 bp, Homo sapiens
ttctggaactagagttgatggttgtgtaaaatatttaagtactcattttctctgcattctggaactagagttgatggtttgtgtaaaatatttaagtactcagaagggtcaagaaagagctggctttctgaataatgtaggagttacttccatgaaggtgcatttcagttaacaaatgcacatcatgccctttctcttcctccagcttcagcaaagcaaaacttcctcaaatctctttcttggctccagtccaacagcatctttaactggtaatgtattagtatgttaagctaagggcactttctgtctctgttctctaacattgttccaagatggc

SEQ ID NO: 188920 - DNA, 290 bp, Homo sapiens
tagctgggattacaggcatgcaccaccatacccagctaatttttgtatttttagtagagatgggctttcaccatgttggccaggctggtctcgaactccggtgatccaccagcctcagggtcccaaagtgctgagattataggcgtgagccaccacgcctggccaaagatatctttaatacatatggaaagtaattatttactatgatggaggtaaggaatgtaatggtggttcaaagaagggaagagcacattcagttctggggatctgggagggacatgtgatgcagc

SEQ ID NO: 188921 - DNA, 650 bp, Homo sapiens
caggagaatcccttgagcctgaggagtttgagactgtagtgtgtgatgatggtgcctgtgaatagccactgcactccagcctaggcaacacagaaagaccctgtctcttaaaaaaaaaaaaaaagtattttttcttttttaggaataatgatagtactttgtttgtttgttttttaatgtctttatcttttggagatacatacagaaatatttatggaggaaatgacttggtctctgatatttgttgcaaaataatgagggatgaggaatgggtaagagtataaatgaaacaagattggccattgttgctaatttttgataacaagatgctgattctttttgtttgtttaacctgagagcatagattcaagtcctgcatatatattccgaagttgataatcgttgaagttgggtgatgggtacctagagatttgtaataccattctatatttttgtacacgttagaaaatttctataatgaaaaacctttataaaaagaaagaaaaagaaggggcaaaggaacattgaattggtagttcaaatagaaagcctgggctcatgcctgtaatcacaacactttgagaggccaaggcaggaagatcacttgagcccaggagtttgagatcagcctaggcaacatagtgagaccc

SEQ ID NO: 188922 - DNA, 692 bp, Homo sapiens
ttgtagaaggatcagacaccagagagggttggactggatgaccttcagttcccctcctgggtgaccacagctcttcaaagcccctcactgctgcccgcttctgcaggattcagggttgaatgtcagaagtctgctggaatgctgtcgattgaggcacggtgacctggccaagcctttcctggtggctgctctggtatctggaatgagctatgggtgagggccgtcctctgagtgaccgtgcccccctcacagctgaggttcccctcggcctggatcagcgtgggttctgagaaagcctgcttgccctgactggaggcacctggaggtggttttcaaagtgtcactgtcaccgtgacccagacatgcttgagccccaggctgggaaagctttttttctttgctttaaaaaagcagaaacagtgaagcaagcataaatttgcctttgaaataagaggctgaatgtctgccaaatgcaaatggattgaaacggccggtggtctgaccttgggatgttccattggtagtttcagaggggctctgagcccccaggccggctgtaacagtggacatgctggcgctggccagtttgatccccttgaaagcccccgatattcacctccaagagagaaggcctggcaggtcctccagcatgcggatgaggcgctgcctgtgaggcacggctctgtggagag

SEQ ID NO: 188923 - DNA, 330 bp, Homo sapiens
ccagcttggaatcagttcggacctgtgtctgctgcacagctgaatccctgggaaactcttttagtgtagcatggcagaaagaacaatggctatgcccacacaaatacctgctgatggagatacatagagaccgggtttcaccacgctggccagactggtcttgaactcctgacctctggtgatctgcccacctcaacctcccaaagtgctgcgattacaggcgtgagccactgtacctggccatcaaaaagaaaataatattcgttgtttaactacgattggacattttggttttgaatgtttgcccaatcagttggtgagcagatctat

SEQ ID NO: 188924 - DNA, 556 bp, Homo sapiens
gtacctgttggccatttgtgtgtcttcttttgagaactgtctattcagatcttttgtccatttttaaatcggattttttttctatttgtttgagctccttgtatattctggtcactaactccttgttagatgggtagtttgcaaatattttctcctattctgtgggttgtctctttagtctgctgattgtttcctttactgtgccgcttcttagcttgatgtaagctcacttgtctactttcgctttggttgcctgtgccgttgaggtcttacacaaaaaatttgcccagatcactgtcctgaagaagaaactgtctccagtttcttctaacagtttcacattagagttaagtcttttttttttttctttaagacagaatctcgccctgttgcccaggctggagtccaatggtgcgatctcggctcactgcaaccacagcctgtgggttcacgccattctcctgcctcagcctcccgagtagctgggactacaggtgtacgccatcatgcctggataattttttgtattttcagtagagatgggttttcaccatgc

SEQ ID NO: 188925 - DNA, 492 bp, Homo sapiens
aagaaacagactcatgagctgaagcaaagttttttttctttttcaagaatcaagtagaaaactaggttgttttatattcagacctatgtttttattaccaccgtcgaacagaaacaaaaccaaagtctgaaaaccctccaaagtaaacaaatcacaccattatttggtttgacttgagtttctgatacagctatcacctttattcagtgaagataaatagtcaaactgcagaaggaagccatgttgaatcgtaaagaacttagaagagagaaactgaaagcccaggttgcatttccaaatctcatgtattattttttgtttgttgtgtttttttttgttttgttttgtttttgagacagctggaattacaggtgtgcaccaccatgcccggctaatttttgtatttgtagtagagatgggatttcaccatgttggccaggctggtctcaaactcctaacctcaagtgatctgccagccttggcctcccaaaa

SEQ ID NO: 188926 - DNA, 382 bp, Homo sapiens
tcagtcggtaccttcctctcctcccacttctcttggcccagctcaagccccacacctaccagatcttaccagactgaaacagtctcatctgcctaattctacagtaccatactgcctgccttgaacccacatttaaactattattaccttttcaacttatcataagatgaagggctgcaaatcaaacctcttttcatctcagcactggtaacaatgcatttagggagtcctttccctaaagcagtatcatcttgcataaatatacccaagtagaagcaaatattttagaacttttatagatttttcttaggagattttccttaggaaaagagatcatacaagcctgggcaacatggtgaaaccctgtctctacaaaaaaaaa

SEQ ID NO: 188927 - DNA, 356 bp, Homo sapiens
acacacaccaacaaccacaacaacaatcacaaccaccaccaccaaaaaaaaaaaggaaagtgagtatgaccagacactgttgtttgttaagccaagtgccattcccacattgcccattcccctccttcctttctcatagaaccttaattctgttcagtattttgagaccctgtactttacaggcgaagattctctcagccccagggagttacatattcactagtctaggtatgtacttctcagacactaagtacaatcaggtcagctgaaaaaccttgtttaaatgccaactacagttgagcaggtgccaggatatctaactgccaaagaggcaaaggtctacagatagtctatgt

SEQ ID NO: 188928 - DNA, 834 bp, Homo sapiens
cctaaaaaggggaatcacgatgcttatctcatgcagttattgtgaggttacaagagttactgcttatgaagggccctgtccagcatctggcacgtggcaggtcctccgtgaatgacagcgccttcctgggcagcctggcgagcgcacacgcgtgtgcacacacacacactcctgtgtttaatatagccctgtctgttgtgagccacttgaggagaggtgtccctagaagaaacttttttcccagaaaatgaggcctggctggtgctcatcctgagttcctggaaggcagtgttttcttgtaaccatctgagattcctggggctgggtatagtgcctgatgctctcaatatatgcgtgttgaatcaaaccagaagaagcaggctgaggcactgagtgaaaacctatgtggatgtcctgctgccttttccttgtggagggtagatcattcccaactctgcctgaaactttgatgccttattggaggaagagaaaggtaactcccttgttgagccatagagctcttagtttttctttcttaaaaaaaaaatcactcttctttcaaacaccattaaattagtccagttatgtacactgggcttgtattgcatggtttatataaaagctaagttctttctttaagattggagccctccgtgtgagtgatttcaggataaaaggccttagaggattagacacattattcgtttgtaaaactgattgctcaagtgatacagccctagggctgcccccttattgtagcttcttgaacactgtcaaactgtcagacttgggttggtggttattttatctcgcaaacaaccaaaaccagattta

SEQ ID NO: 188929 - DNA, 274 bp, Homo sapiens
tagcccctgatctggtcttttttcctctatcaataatgtcattacaatcttctgtattcctcaggccaaagccagaaaccctaaacccctgcccttctggagactctttcatggtgccctctgagattcccttaataaactcccttaatatcctcaactatttccctgaacatttcctttcattaatttaaacttggctgttccctgggaaggaaaaaacacctacctgacaacaatcacatcacaagggggcttattctcatgtattccacat

SEQ ID NO: 188930 - DNA, 404 bp, Homo sapiens
acctccacagtgattttccacttccaggctgaaggcaaggagcaaatgaacccaagctggctcctacctcttcctcctgccctcctcccatttttttcccccaaatcctcaaatcaccttccatgtgtccagagcatgcaatccaccctccaacctcctctcctctatctgtaggaaatgcagcttcttgggtttttattttttggaaatgaataatctggaagcattggaagcagagacatgagctgggctgtatctcagatatgatgaaaggctgggttgctaggcccttgggctggctgggcactgtgttgccaagccagggggctgaggagcatgagggtggtgtcatgctcactcattcattcaacaaatatttatccagcacctacaacatgccaacc

SEQ ID NO: 188931 - DNA, 384 bp, Homo sapiens
tcccacccttacacacaactccttttcatttcagtaaagcttcctgtcagaacacattcatcaatgtaatttgccaacaaagtttaagagattaaatccccctccccacaagaatgtaaaaataaaaaaacaaaataaaacctacaatcaaaaatcaacagctatgctgaaattgtagttaggtcatcaggtaatgcttcaaaggaagtaaaggacatcataagattcctgaatacagttaacaccactttgaacctgagattaattttcgtttgatttttaacagaggatacagaaggtagatgcatcaggaggaggggcaggtgcctttaatcattacctctagaattatcacttttaacctcaaagcagtttttatttaat

SEQ ID NO: 188932 - DNA, 539 bp, Homo sapiens
taacacttgaaaattagcatggtgtattttacttgcttttcttttcaatataactttttaaaaaagtacacaagtactaaatatcagaattctttgtcagaaaatacagaaaagggaagggaataaaaataaacaataccctaattgcaccacccagaaaatcatagtttaaatttagtatatagccttccagatttatgaatgtgttggattatgtataaatataaataagaaatagaaatatttttaaattgggtcataaggtacatactgtttggaaagtgctttttcttgtaaatataaattgtatgtacggttatagctgctatagcttttcgtaaatatagttaactctggttgctagtttcagttatgtttgtatggtatgctcctgtcttttaaaaaatgtgtgacatattacttcacagtaacatgtaagtaattcattttactttgtgaataaatattattctgatgcagaccactgtatatttgatgtgtaccacaaagaataaatatttaccatagcagaattagct

SEQ ID NO: 188933 - DNA, 102 bp, Homo sapiens
tgctgtaccaggaagagtaagatatatattaatagatgccactccagagggctggctgaaaacaaccaagaactactgtgatgggtagatgctgtccttatg

SEQ ID NO: 188934 - DNA, 147 bp, Homo sapiens
ccccaggtaccttttacaaaaaattaaaatatgctacggcttgagagatttaccaagacggatgaaatctttgtatcttgttttaagaggatccacagctggttcccgagactccttctggggtaccttgttacgtgggtgactgta

SEQ ID NO: 188935 - DNA, 403 bp, Homo sapiens
acacacacacacacacacgcacatgcacacacacacacacacacacacacacatacatcttcctggctttgtcttttctgatctctccctcaacttgctccagccacacaggcctcctagttgtcttgccctgccccacagactttgtcctgacaatcctgtctgcctgtaatgcatttacctagcttccctcaggtctctgctcaaaaatcacctcaacagagaggactttcctgaccacatcttgtaaaattgcatacctccctctcccaggctccttacctttcccaggctccttaaccaccccccatctttgtttttctccacagaacttattatcacctgataaaatatgtatattaatttgttgtctattgtctactttaaggatgacagggatttt

SEQ ID NO: 188936 - DNA, 456 bp, Homo sapiens
cctgtgagtactacttaacccatgcataaagaatttttttcaaaccatattaagtaaaaatctaatctgtggctgggtgtggtagttcgcgcctgtaatcccagcactttgggagaccaagtttggaggattgcttgagtccaggagttcgagaccagcctggacgacatgacaaaaccccatctttgcaaaaaaaaaaaaaaaaaagaaaagaaaagaaaagaaaaagccaggcttggtgacacatccctgtggtcccagctactcaagaggctgaggtgggaggatgtcttgagcctgggaagtcaaggctgcagtgagccgtgaacatgccagtgcgctccagcctgggcaacaaaaccaagaccctgtctcaaaaaaaagtctctggtatgagcaagtatattttcaaagaaattttcattaacagtccttttctctttttggcaaaaaagt

SEQ ID NO: 188937 - DNA, 219 bp, Homo sapiens
gctcagatcaagtagttatccagactaatggtcaggaatttatggtctataattatggtaatcacgccaatttgccttagtaattaagtactctaatttctgtcaacctaggatcttcacattctcactgaaattaagggtgccctcaagaggcattcctaattcatttgttttctactttttctttcttttttttttcttttttctttttttttcttt

SEQ ID NO: 188938 - DNA, 403 bp, Homo sapiens
cagtgagctgagatcgatcactgtactccagcctgggcacagagcaagactctgtctcaaaaaaaaagaaaaatcctagaaggcagcagtgtcttaccctttaacatagaatcctgttttggggtaaatgatagaataactctgacatttgaaagattgaaaggtaggggaaggcatagagtctcaactatcttttcttgtctcaaaatcaacaaaggcaggtgagcctctcattttcttatctactacctcttcaaagaaaagtcttcatatttataagatcctatctcaataaaacacatagaaaaatatttaaggggataacatggccaccattcattttatttatttatttaatttgtcacccaccagcaaagtacagtgatcgaccagggtaccgagc

SEQ ID NO: 188939 - DNA, 439 bp, Homo sapiens
gcaactgctcgatgctgccattgtagcactaatgtgaccatagacagtagataattagttggccagacctgaccccaggatgcggcttgctgggccccactccaggcctggctgcccacagtgtgagtttgctgttgcaactttggaggccacagaaggttgtctggtctgggaggaatctaaggctgtatccaatgtggtagccactggccacatgtcgctattttcagtttaaattaatttaaagtaaataaaatttaaaattcagttcccttggtcacattagtcacacttcaagtacttactacccacatgtggctaatggctgccctgttagacaacacagagaacattccacgtctatggaaagttctcttgaacagcactgatttagaatgtcccatagtctgcgtccctctctgctgtcatccctgggcag

SEQ ID NO: 188940 - DNA, 248 bp, Homo sapiens
ttcaatttcttcaccacaaccaccatcatcgtcatggagaggctaatagactttatgaggggctaactcctcagaggaggaagaaattacagaggtggcatttgagctgagcctttaaaaataagagaagatttgcattagagattggtattttctgttcttgggagggtattccagatacaggaaaacttgagcaaagacaacaggcatgtttgaaaaacagtaggctttgcttccatgaggccaaa

SEQ ID NO: 188941 - DNA, 943 bp, Homo sapiens
atgaggttcctttatggcaggtgagctgagtgtcccatggggagaaaaggggttttgctgggtaaggcaagagtataaggaaccgtggatatgtggaaagaatgctaagatggagaggacagagctggtgggcaggcctgccctccttatcccatccccaaagcgggtgaagggatggccacacagcagagcctggcttatccaaaggcacccaacgctgtgttaagactctcaacctggctcaactgtgccattgcctcaccttcatggctgggacattgctgcctcgatgaggcctcaccaatgggcttaggcaaggcccaggcattgttaagatagctcacccggaagtgctaaatctggccagttcctgagggtgcttttttgttctagtaaagccccacgtttgggaatcaccattttgttggaaatctctctctcttctttttgcagttatgtcatgtgatagtcatcttgtatagttagggaccatctagcattcacctcatcacctcgaagaggggcaatgggtcatggccagaggtgcagactcctgtgggtttttataacaacatatcaatccaatataggacttgaccttgggggccactgtgcctgtgaatggagcccttggaagagaatcagaaagattgataagaacttctcctgtctcaaggctggctgggagagaacacagtctgatttgctccatttggctctaagtgaagcttcctccaagaagtggcttgaaatatgttttatgcatgataaatgacaagggcttatatagttcccgcagaggttattgtgtcatctgagtttgcagatgaaattccaggaggtagttgtcactgcattatcatggcttttgtccaagaactccacagccccagcagctctctatgttcatagcaccttgatgagaaggtagcacataggaatg

SEQ ID NO: 188942 - DNA, 472 bp, Homo sapiens
tggctaatagtgatcagttgatgaatacacctcatgtttcacgcatataaaattttacaccatgtctagtccataggcattagtgtaggagtcagaatacaacctgaattctgttcgcagctttgtgccttgtcgataaagcagtggacatctctccacagggagatatgtttcctcccgtgatatagaggatgttgattcacttgtctcctctctatttcgaaaagatgctctgaagattagtgagacaatggctgtaaagctctttgcactgtttacaacataaatcatacacagacatactggcatgagaaacgctatcatcatctcttttatacatgagaacaaccataaggaaaacaaacctcagagacagtcctgtattataaaaatgttgggtagagatgccaaaagttgtagggtaggaaacagcaacaacaacaacaagacggaatccaaagaatatttgcat

SEQ ID NO: 188943 - DNA, 730 bp, Homo sapiens
ctcccgagtagctgggactataggtgcccgccactgcgcctggctattttttttgtttttagtagagccggggtttcaccgtgttagccaggatcgtctcgatctcctgagctcgtgatctgcccgcctcggcctcccgaagtgctgagattacaggtgtgagccaccatgcctggctctatttttatttttttgagacagagtcatgctctgtcacccaggctggagtgcagtggtgaaatcttggctcactgaaacctccacctttcgggttcaggtgattatcccacctcagcgtcctgagtagctgggattacaggtcccaacactacgcccggctaattgttgaatctttagtagaggcggggtttcaccatgttgtccaggctggtcttgaactcctgacctcaagtgatctgcttgccttggcctcccaaagtgctgggattataagcatgagccacagcgctcagcctaaactgcacactttaaagtagttaagatggcacattccatgttgtgggtattttaccacaatgttaaaaaaaaaaaaggaaggccaggcacagtggctcacacctgtaaccccagcagtttgggaggccgaggcaggcagatcacctgaggtcaagagttgagaccagcctgaccaacatggagaaacccgtctctattaaaaacacaaaattagccgggcatggtggcacacgcctgtaatctcagctactcg

SEQ ID NO: 188944 - DNA, 230 bp, Homo sapiens
tttctggtagagcccacaacaggccaatcctctatcttcactttaccctctgttccttacctttctaaagtttttatccttctgtttaatgttaaggttatatctcacattgtgctatggttgttggcaagtattcacccatttactgcccatgacaagcaccatcgcaggaactagggattaaaggttaatatggctgggtgcagtggcttacatctgtaaacccagca

SEQ ID NO: 188945 - DNA, 936 bp, Homo sapiens
ctctctgggctgcattttgcagcccagagaggctgaaagcctggctgagcttcaagtcaagaacagcctgggtgtatccaagggagctcctgaaagagatgatgtcatcctggaagcactaagcctggaaagggacagtcaccatctgtgttcctggctggaaggctgcacagtgtgcatgcgtgtgtgtgtgtatgtggcaggcacctgtaaagcttatcttatctccccatcaatctcaccagcagcacctagactcctaccaaggaccactccccaccaacaggcgggtggcagaggcaacaggtcagaacgcgctgggccgctccagtgacaagattgacattggccacccagctcttatgatcacttctctgcagaaagggatcattttgtgatttacgggctgagtaaagcaaggccgagttgaaatctcatctgagagatttctctcatcctgggcagcttgggccagatatagggagattgctgtggctcctctgtattttcctagcacccattacttacttttggaacagtggtgctttcatttcactttgtaccaccactaaaaatttcatcacccagagattactttagggcaataaagaatcacctaagaaggaggttaagggattgctgctggtccctcaaacaactgtatgaaacagacttcttccccttaactcctaaggaataaaggcatcagccataccaagggaatcaagagatttcatttaaagggataaagaaagaaatgtgggaagccagagccccttgaagggaaaaactgtctgaggaaggccacctcagggcaacataaaagccctggcaggtatgagaagagaggaagggagtaggacaagcttttccaggcagaccccagagattcccctttgatacacagccgcttcagcagcacggaatttgactgca

SEQ ID NO: 188946 - DNA, 974 bp, Homo sapiens
ctctctgggctgcattttgcagcccagagaggctgaaagcctggctgagcttcaagtcaagaacagcctgggtgtatccaagggagctcctgaaagagatgatgtcatcctggaagcactaagcctggaaagggacagtcaccatctgtgttcctggctggaaggctgcacagtgtgcatgcggttgtgtgtgtgtgtgtgtgtgcgtgcatgtgtgtgtgtgtgtgtgtgtatgtggcaggcacctgtaaagcttatcttatctccccatcaatctcaccagcagcacctagactcctaccaaggaccactccccaccaacaggcgggtggcagaggcaacaggtcagaacgcgctgggccgctccagtgacaagattgacattggccacccagctcttatgatcacttctctgcagaaagggatcattttgtgatttacgggctgagtaaagcaaggccgagttgaaatctcatctgagagatttctctcatcctgggcagcttgggccagatatagggagattgctgtggctcctctgtattttcctagcacccattacttacttttggaacagtggtgctttcatttcactttgtaccaccactaaaaatttcatcacccagagattactttagggcaataaagaatcacctaagaaggaggttaagggattgctgctggtccctcaaacaactgtatgaaacagacttcttccccttaactcctaaggaataaaggcatcagccataccaagggaatcaagagatttcatttaaagggataaagaaagaaatgtgggaagccagagccccttgaagggaaaaactgtctgaggaaggccacctcagggcaacataaaagccctggcaggtatgagaagagaggaagggagtaggacaagcttttccaggcagaccccagagattcccctttgatacacagccgcttcagcagcacggaatttgactgca

SEQ ID NO: 188947 - DNA, 352 bp, Homo sapiens
gtatttaatcctgacaacaactatatagatagttactgttagtacactctctttacagatgagaaaatggaggcaaaaatggtaaagtaacttttcccaggtcaatggttagtaattatcagagctgggattcaaacccatgcagtttgctccagtatccaagttccattacttctacgctagacaaattggggaataaagacatgcccatcttatccaatagcatctgatggcatagtacatactacaatacggtttctcaggaaatggagcccctggggtcttatgaaataattttcttggcactcaaagaacattaaatagcatcgcctcatatgatggcaagtgcatt

SEQ ID NO: 188948 - DNA, 253 bp, Homo sapiens
caattgtcactgcgtaggagcataaaatgtgtgatattaacatatcactactgtgttcctctgtattctgggatttccttgccgattctcctgttatctgggctaatatgtgagcttggcatttcctatttaagctctgtaatgcccaccttaaggaagatatattcattgttaatgtttgttgaagctattgagtgggtatggctggcatcaaaaactagttggttccttttaacctggcttatcttaaata

SEQ ID NO: 188949 - DNA, 204 bp, Homo sapiens
ttgttaactactcaggaatcaggccggagcgggctattaaactactggtggcttgaagtcagccctggtgggagtagctactccatgagaactgctgcacactatggatcaaggcatttcttccgagagctgattttttcccagcacgctgcccactgcttggtggtctgtatcgattcccgcggcgcatggcggcggagctga

SEQ ID NO: 188950 - DNA, 254 bp, Homo sapiens
tcgtcacaggatcttgatcggtacatggctgtggaggtggggatgctgatggtggggaggctgtgcatgtgtggggacaggaggtagatagtaactctgtaccttctgctcagttttgctgtgaatttagaacttctccaaaaaataaagtttattaataaaaaaaaataagatgactttatctccaacaatatctactagctacctttagctcagtaatctcatgttgagtgcatcaaccaagttaccgatca

SEQ ID NO: 188951 - DNA, 212 bp, Homo sapiens
catgttctgcacagcacatcatgcagaaggataggcttttgtggtgttcacctggaacagagtaggtataataaacagagacagtgtgctttacttggcttaaaatgttgatcatgtattaccacagatttctgggttggctaaaaactgtctgatctagaggggctcatctgcaccagtctgtctctcatccccctcctgagactgggagg

SEQ ID NO: 188952 - DNA, 435 bp, Homo sapiens
cacgctgcctgcctaagaatcccagtttatgtaaaggaatttgttgtgtgtatttccactaaaatcaactgaatgtcttatcaaatcaaaagggaaaaggtatcttcaaacacacacagacgcatatccacagaagatttgcgacagaggcagagcgtatttagttttcattggaaaggctaaaatgtataattgtgtaaacataatttggaagaaatttcacctcagctgtcctcattaaataatttacattccaacactcatggacccattgacttcagaacatatcaagaaactcgacaatgaggtgaagtgtaagcatgcccatccaatttttaatttagtaagttagagactccatcttccccaatgatctggctggccctgaagtactcagtaatgaggtctcctagttagtcagctgctctctgaagt

SEQ ID NO: 188953 - DNA, 265 bp, Homo sapiens
agagaagatatcatcctttcatgctccccagccccactccaccaaactgctctcacaagtcagcaacatctccttactggcaaacctacgagatactcttcagctctcaaactactggatgtgattacagaggactattggtagctataatttatctttccaaccctttatctctttctcttcttttgataacagaatccctatttcctgtggggaatctattccatgtagctgaccctctcctaaccctacccctataacaagt

SEQ ID NO: 188954 - DNA, 458 bp, Homo sapiens
attatataaaggtcttgcactttactttggaaagaagtgaatgagagatcacaaggagcttattaatgagtcttttacaggaaaaacaaaaaaactaaaaacctttgttatctggtctttcagatttcttgaggttaaaaagttagattggaaaaaggactgtactactgggtgtggtggctcatgcctataatcccagcaatttgggaggccagggcgggaggactgcttgagcccaggagatcgacaccatcctgcctaacacacggtgaaatctcatctctactaaaaatacaaaaaattagccaggcatggtagcatgcgcctataatccccagctactcaggaggctgaggcaggagaattgcttgaacccgggagtcagaggttgcagtgagccaagatcgtgccattgcattccagcctgggcaacaagagtgaaactccatctcaaaaaa

SEQ ID NO: 188955 - DNA, 212 bp, Homo sapiens
cgagcaactccactactacaagaaaatatatcgtctttctggatttaagaaagcttccttcctaccctcccaacttcctttggaattctgcaaacattatttgaacttattttctccaaaagtctccctgagatcctgctcattaccctctcattccctcatccacacaagtgaaaaccatgacagagaagaacatgacttggtcaaaggcc

SEQ ID NO: 188956 - DNA, 539 bp, Homo sapiens
aacctcttgcccattatgacacctcatatataccactaagcaagaaaaggtgggctgacaattctggccaaggagaattctctgaagcagcaacaacaataagtgttacctggactcttacttaaaacgtatagacagtacttcctcatgcttggtgacctgtgatcctttggtaataaatagttgaagagagtaaacaaaatctagagagattatacaagacataaagaatgcctgggcacttcccccaccccccaccccgccatttccaggtttcaataaattctgctgacagccctgcatcctactagagcctactatggacaacagaggcatgctgatgtgtgtcacaagaaggggtggctaagtatcagaaggtacagtcacttttgctgttactactggtcacagcaggcctttgtgccatgaacacagtgctgtcccttagagccagcccatggagcttatgtggcaccatcaaaggtgacctcacacgctgcttgtgaggctgggaaaagggcacagggaggaagacagca

SEQ ID NO: 188957 - DNA, 103 bp, Homo sapiens
gcctgcaaggcagcagtaggcctagccctactagtctcaatctctaacacatatggcctagactacgtacataacctaagcctactccaatgctaaaactaat

SEQ ID NO: 188958 - DNA, 251 bp, Homo sapiens
aagtaagttgctagaaacacaattttgaaggagaaatgaacaaaatagcaaacaaataaattcattaaaggttatagcaaaaagcccaaagcctgtctagaccagaaccttataagccattgttttatagaagattttggagtaactgagctggttgtagatgctataatagaagggaaaaattccagtttgcctcttcataagcagagattttgcccagatctcttttttttcctctttataattgggtt

SEQ ID NO: 188959 - DNA, 460 bp, Homo sapiens
aagtatagacactccaaaatggtcaaagcaattgcgttctaaactaagttttaaacctcaaagcaacaggttgctatacaaactcattctgttgctgccacacagttctcctggacaactgacagttcaaggcccccaaggacgcctgggcatgagcagaagtggaggagctcagagcccagcccccaagaggctcaggttaaagcccagcatgagctctggaggcctcagcctgatggcagtctgtgtctcgctcacagcttccagctacaactgctcggcaaacatttccagctgaaataataaatgctggctgtgaatggaggtcctcgtgaccctttgactccagctcagtttgtcatgtggtgaggccacctcacctgaaacacagcccatgctcctgtgagctcagtctggcccaccctggggctgtgcaccccacagggaatccctcgaggaa

SEQ ID NO: 188960 - DNA, 251 bp, Homo sapiens
tgccaatgggtatggagtttcagtttggtgtgatgaaattgtgctaaaattgattgtatcgatgggtgaacaactttgtgaatatactaaaaatgattgaattgtaggcttttgttggctgaattgcacggcatgtaaattatatcaataaagctattaaagagaatcagtattacttgccataaatagaatggaaactaaaaatgacttttttttttttttttgagatggggtcttgctctgtccccagg

SEQ ID NO: 188961 - DNA, 268 bp, Homo sapiens
tgccaatgggtatggagtttcagtttggtgtgatgaaattgtgctaaaattgattgtatcgatgggtgaacaactttgtgaatatactaaaaatgattgaattgtaggcttttgttggctgaattgcacggcatgtaaattatatcaataaagctattaaagagaatcagtattacttgccataaatagaatggaaactaaaaatgactttttttttttccattctatttatggcaagtaatactgattctcttaaataccttattgg

SEQ ID NO: 188962 - DNA, 159 bp, Homo sapiens
tacacacacacagattattgatttgatttggaaagaatgataggagaaggtgaatgtctgaggccaaccatttgcaattctaaatctgtggcccccttcttgttcagagctgttagctgctctgaccatcttctcctctttagttagggtgctaccagg

SEQ ID NO: 188963 - DNA, 386 bp, Homo sapiens
agtcacataaatacacatacagaattaagaagctagagggaataaaagggaatgttttaaaaacagggagagaattagcttctctttacaattatgagtaaatttatctttattcctttcttatttcaacttttccataactaagcatgcattcattttatattcagaataaacatttaaaaacctaactcagatttaaaaaaaattctttaaacattcaacttgaatctttttttttgcctcttaatttgctttgaaacattacacacgagttccaaactcacttaatcactagcgcatgtactaactcacaccattttttaaaactgtgcagaaacttaatgacaagatttgacatatatgattcttcccccttatccctaaga

SEQ ID NO: 188964 - DNA, 460 bp, Homo sapiens
ttaaaacaatgagctaccatttttcactatcaaatcaataaagatgattatagttattacgattcacaatattggcaaagatgcagtgaaataaacatttaaacactattggtcagaaatataaattggtattttctttcaggaatttaatttggcaataatatgaagtcttttaaaaataccatgtgaccaaacaatttcatttctaggtatgtgtcctgagaaaaaagtatagttggatgaaaatttatataaaaaagataaccattgcagcattatatgtaatagtaaaaaatttgaattaacctaaatgtccaacaatagtagaatggttaaataatttatattagatccaccttagatttttttagtcattaaaaatactgttttagaagaatatttagtggcattgaatattactatatagtgctaagcaaaaaaataaagatttagtacacag

SEQ ID NO: 188965 - DNA, 199 bp, Homo sapiens
aacaaataaaaagtttcagcaaaaaaatagaagacatatagaagaaccaaatggaaatgtcagaattgatgtgtacactaactgaagttaaaaacttattggatgggctcaacagcagaatgaagcaaacagggaaaagaatcagtgaatctgaggatagaaaaacataaagtgcccaatctgaaaaacaaagtagaca

SEQ ID NO: 188966 - DNA, 460 bp, Homo sapiens
gctagtgatccagtaagattagggtgttctgggaaggaatgagtcaacagacatgatttgagcgctgccccatgccaggctcaatgctaggtaccctcacattcaagatctgtaatctaagcctttcaaaaaatcttggcaggtagatatgttcatgtcaagcacctctcatcacagtcgagttccaaggaaaaattccagcgttttctgcattgggtgctgtgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtca

SEQ ID NO: 188967 - DNA, 304 bp, Homo sapiens
gctagtgatccagtaagattagggtgttctgggaaggaatgagtcaacagacatgatttgagcgctgccccatgccaggctcaatgctaggtaccctcacattcaagatctgtaatctaagcctttcaaaaaatcttggcaggtagatattataatatccccactacagacagaaggatcccggaattcagaaaagcggagtttagtatcccacagctaaaagtaacaaagttaggccttagatctagtttactctcttcaaatcctagcctaccccccatcccctgaaaaaattaagcccacc

SEQ ID NO: 188968 - DNA, 428 bp, Homo sapiens
gtagaacacacacagagtaaccagacacctggcaacaggcattcctctgagccccagcaggagggctggagccctgagacagaggtgtgctagctacacaccaccaccgcaggccatacaagccgggtcctcagcacaggctggagggctgtggttaaggaggctggaggcacgacctcctgcacagccttcccttctgaggacagcctcatgggaatccccccctttaggacccaaatgaaagagaggatatgcaaaggctaaaccgatacagggaagctctcttggaaggattaaagaggggaacccggcaggccacaaacgttaactaggtttctgaggtcattcagagaaaagaagaaagtccagcacaattctaggagagactgtgtgaggcctatggtatgtatactccctttcgtcccccg

SEQ ID NO: 188969 - DNA, 390 bp, Homo sapiens
taacaaaaagccgagaacagtattttcagtgacaataccaagactcaaaaagatttcgacaagctgattcaaccagctgaaatcaaaagaaaaagtctaacagaaacaagtgtcaatttccacattcaacttcaaacaatcaattgtgcaaatagagaacagggtgcctagcttctctggagtgttttaatacagtgaatcctcctgagatataaacaactgtgttcaagtctacactaaacagtgccagacagctactctttttcacttcctgcatttctttctgtcttctgtcagctgtcacttcttaggttatcagtttgttttgtcccacttccaagtcactgcttctaatctactgtcagctctaggaaaaccagataactgagc

SEQ ID NO: 188970 - DNA, 450 bp, Homo sapiens
gggcaccctaaataaagactgtatttcccagcctgtcatgtgaccatggatttatttctggccaatagaatgtaagcaacttctcagtcatgtctttaagaggagactgttcatcccttcccttttctggctttccattggctggtaggggacccctgggctgtggggatgcgaggaataccccatgaatggcacagtgaaaaactaagaacctgcagccctcttggcctgtagaatagaaccttactaccagctgggactttaaccaatagagaaatcagcttccctctggtctaagtcactgatatctagttccaattcaaccaaacctaataatctcactaatgctccccagtgtccagccatgctccctgttcttcctaacatccaccttcaggccttcaagctgctacaattgaaataatttttcttctcgtcttcagtgaaatg

SEQ ID NO: 188971 - DNA, 509 bp, Homo sapiens
tgcaggggctgtggggcaggagtttcatcagaaggtggttgtggtcactgcagacactaaaataacctaagaaaatgcataatgatcctttaaagggaccagagagaattaggatagcctttattgtggagatggtccttgaggtttcttaaactgcagataattatttttccgtttcatttttcttttactaataactaagtagttaggatgtgtattacttgttggagtcagttgaaaaatattatttactgaagtagacgccagctgaagattattttctctttagattataggctaccaaagaagactcagtaagctttgagttattagtcaattggtaaatggttcttgataacttaatgattttaccaatcttttggagataactttaaaccaaaaactttttttacctaatgtaaatattactcaatgctcccagctttcccccttgtttcattattaaagtttgtgaactgtttctttttgttttgctttttgtcttttaa

SEQ ID NO: 188972 - DNA, 189 bp, Homo sapiens
taaacgaagacgatccctgcaaattgactcctccgtgctatagcgctgcaaaatgctgagattacaggcatgagccaccatgcctggctataaacaattttaattcaaggatcaattatatttatatgcattatgcaatgtacagtatagtttagttggaccttaagttttcaatataaccttatctaa

SEQ ID NO: 188973 - DNA, 552 bp, Homo sapiens
tccactagtgtaggccatggtgaaagtttgactccacaaagatgtgacactcttcttgagataacagtcaaggagagagagactttcctacctacaagctttcaggatgaaggagaagtgggtgctggtagttaccgcccatgacttcacaaggctagagaattaagtctccgcctttcacaggagtgattatttcacactctattgataacggacttaatatccccgcatacatgagactagtaggactgtgttttcaatacaaaaagggagcagactttagttctggtagtttctggtgctggagcacaatggaccaaattctcatattaacccaagacaccatctctgcttttaccattcaacacacttggagtctatgttgtcatttgtcataaaatcaacaatagattttaaagcatttcttctaattgacgagctagaaaaaaaacgtccccatgggcttgtctattcagctcatgcctgacaaagcaaaggattagctgagttcagagtatcagtgggctcatcagtctctagtgaacagaacca

SEQ ID NO: 188974 - DNA, 476 bp, Homo sapiens
gctgaggttaaaaagataaactagaaggtacgaattattaccatatcactgagtctggacacaaatataattattaaattgtatactcttgaataaataaatgaagtctgcaatttgtccctgctaaataggagaatgtaaagcaggaaaaataacgcaccataattaagttgtttttaaaagaaaaataaaggctgggtgtggtgactcacacctgtaatcccagcactttgggagaccgaggcaggcggatcacttgaggccaggagttcgagaccagcctggccaacatggtaaaacacccctctctactaaaaacacacaaaaattagttgggtatggtggtgcaccacagtggtgcgcctgtcatctcagctactcggatggctgaggcatgagaatcacttgaacccaggaggcaaaggttgcagtgagccgagatcatgccactgcactccagcctgcgtgacaggaaa

SEQ ID NO: 188975 - DNA, 634 bp, Homo sapiens
taagcagatccagaaactgcctgaccctttactgtaccttcccactccaaaagtggggaggggaactcctgtgcgggagtgctcagctctcaagggaagacagtcattaacctgtctaaactctatgttaatagaaccttctcgataattgctttcattaagtgtggttaatgtgaacagtacaagttatagcaagatttgcagaagaacaaagtaaatatttaagactttatttcaggatgcagttgggtcgaggcaaggagaagattagtagaagctgtatctgatggtatctgaggttgaaacacagtgaacctcttggcagaagtgccagtcatttctcatcagtggttcacagaatcctaactctggggaggcagatgggtgtctcctggagatggttgtgtgttcaggttttctcctttcgcttctggcctctgtcagacatgaatgacatggtgatgaagataaactgccttccctgtactgcccaggaatgcaatgaggattaagaaggtggcttttagcctgtgtctatgccacatggggaggatggttgctccctgagggcagaaggcattattagcaactgagttggcaggagtgtgtgccatgcgggctgggtgtacggagc

SEQ ID NO: 188976 - DNA, 1468 bp, Homo sapiens
agtatgtgtgacctttatttcaatatctatagttagcttgtatacaaagcatgtagcactccattctaaatactgaaaactagtagctgcatttttggtatcatgattatgaagatatttactgcagaattaagtaataatgagaatgggtttataaagaaggcaatatgtgtgtccataacctctacactcacaggtgagtttcttatattcccagtcatttctcaaaatggcgccacattttcattttcataagtaggtagattatggttttcttgtatggtttagggtttgtatcttgttgaaagggggaaaaatgacagtcttcatgttactgtgatcatctgtgtaacttaattactatttgttgaatggagtctcctttcagagctattcttgtgactcttttctaaatttagggtcatttgctttgtcgaccaattatatacacctttggttttctttcattgtttttctgagtcatgtctgttttttcttggattctgtcacgtcacaggtggtttttctgtttgctagagtacattctcaagtattttttttaccccagaaagtatgtggaggcagtacattttctgaaattctgcatgtttgaaactgactttattttgctcttacgtatttcattgattgattgtctagatgtaaaattctgtgcttaggctatttttcctttgattgtttttagcatccagaatccagtattattgaggagaagtctgatttagatcaaaactattttgttcctctgaaaggttttaggatttatattattaattctttaaactagtttgtttttctgtttgtttgttttaaagacgaagtcttaactctgtcacctgggctggagtgccatggttcaatcatggcccacatgatttaaaccttaactcctgggcttaagcgcagtcctgctcacttcagcctccagagtagactataggggcatgccaccatgcccggctaactttattttatttgatttttgattttttttgtgtgtgtgtgtgtgtagatggggtctcattgtgttgcccaggctggtctcaaacttctggcctgaagtgctcctccaccctgggccttccaaagtgttggagttacaggtgtgaaccactgtgcttggccctaaactaatatttatctaattccttttctctatgctaacactattttaggtattagaataccatgatgagcattgtttcaatgtcctagttctcaaggattatattttagtggaggagatagactataaacagatataaaagtggtaaaaagactgtgaataaataaattgagataaaaagagaatgattaatgtggggaatgtgtatcttaaagtggtcagtgatagtccctcagcagaagagttatttgagagacctgatggaagagagcaagctctaagaaaatttcaaggggagatttttaggcagaagaaccagat

SEQ ID NO: 188977 - DNA, 320 bp, Homo sapiens
ccttcccatctgagctcctacctacaggactttacttactgggcctataactcagaaggaaccaacctacccctgattcttggcaatttgtttttgcataatgctgtttctgttcagagacagaaaaatgcacggaggggttgtggatgtcgtagtggaggtggtggtgctatcggagaacagaaggcaagctgccaggagaaagggattggtatctacaactaagagggatgactcccattgtcaggttaatatgaaccctagatatctgtgttaagggcgagcaatgggggatataacaggtctttttactcttttct

SEQ ID NO: 188978 - DNA, 464 bp, Homo sapiens
gaggacatgatgcgaagtgagataagccactcacaaaaggataaatatggtatgatcccacttggatgaggtcccttcagtaatcagattattacagacagaaagtaaaatggaggacaccagaggatgacaggcaagagccaccatgccttgcaaaaattacaaattttatgtgacagatatttttttgagacagggtctcactccagtgcccaggatggcgtacagtggcacaatcatggcttagtgatagagtgagaccctgtctcaaaaaaaaaaaaaaaattctgttcaagctcatttttcagtaaggtggtaatgagcagcaataagaccaaagcttagatctatataaaaaattaaactttgtcattaaaaattggacagatgtgattaatcttatattgggccatttaagtatgagcacctctgttttttccctaagatgactttgtggtgtgtgt

SEQ ID NO: 188979 - DNA, 120 bp, Homo sapiens
aggactcctgattcttcacaatcatgtgccgggctagcagcttatgtgatgcagcgtttgctctgagagtttcctgtagtttggaattttagttataagtttgccatagttctgagtctc

SEQ ID NO: 188980 - DNA, 974 bp, Homo sapiens
agtaatgagcttggggaggagtgttcatgccgcacagtgaagtcggctgagcatgacacacatctatcagcagagatgggctggagcgcggagccgagccaatgacaataaacagtgtttgccaaagcaattcagagaggtcggcgaaagatgaagcagaagcctgtggaaagtccgtccttcccaaaacagacccgcgccatttcgcaggcacggagtctgcgaaaacaaaacggggtctttgcccttcgtggcatcatctcaattccagttgtccgcgtgcctctcacacacgtttggccgtttttatgtatcatttggaccgctgcatacttagtaatttccttcaaatcacttcatttggtgtcaaatcagcacttcacaccggcctcttgattttcgccctgtgatccatacatccgtcaatgccagtgggtcaaggctacgcaccatggaggggacttcagctcctctgtcctccctcacatatgtcccagcagcttcaccctcaggacacatccaggtctgaccacttcccatcatccgcctgtcaccatcttggtccaagccaccactgcctctgcctggaccttgctggaacctcgtccctggtcctcctgcctccaccttcagcccatcttccacagcagccagaaggatcccattaaatcacaaatttgatcaagccccccactctgtgcaaagcccttcagtggctccacatccacctcaactaaaatccaaagtccttgccatgccctacaaagtcctataactgtctcctgtcctgctccgtgactgcatctgcccccactttccccccagcctcctgtcctggggtctccctctatcctaccagcaccccaaccccaaagctcatacctgccccagggcctttgcccttgctgttacctgaaagaaatcaccttcctcagatacctgcatgggctgcttcctcacctttcccagctatt

SEQ ID NO: 188981 - DNA, 464 bp, Homo sapiens
agtctgtttgtcactcctaagatctctgttttaatgttaatgctggtcagttgtgcctgaattccaaagggaggagggtataatgaggcatgtttgacacttccttcccatcatggcctgaactagtttttcaggtttactatggaatcccctggctgacaggagggatctattccgttggttagggggcttagaattttatttttggtttacagatatattgtagaattttcaatgtgggtgatgtggaaaaatgtttgtaatatatggttaattgaaaaaagcagataataaaattccatgtattgtgtgatcctattaaaatacattaccacacacacacatacacacacacacacacacacacacacacacacacacatgaaaagttatctgactctgtgctaaatgaaacagctatggtagttttaatttttccctggattagcctgggcgtggtggct

SEQ ID NO: 188982 - DNA, 257 bp, Homo sapiens
cctcttcattcaagtccacggtcatgcaaaatgttgctttacagcctcttttgcattctttcactctttttatttcctgtcacaaccattccaattcaagatttcagggtttcttcttagacaagtgcagatgtctgctaactagtattcttaactcctggttggtcttcccagagtcttgccagattcatttttgtaaaaagaaaaactctcacaatgtctctcccctgctcagaaatacacaatggctccccatc

SEQ ID NO: 188983 - DNA, 616 bp, Homo sapiens
atgagaattgcctgaacccaggaggcagaggttgcagtgatctgagatcacgccactgcactccagcctgggtgacaaagcaaggccctgtctcaaaaaaatgaaacaaaacaaaacaaaaaagaggatgttaaatgacttttcaggtcatgtccacctaggatattctactattctatggcttgaaactggagaaggatcttaattaattaattgattgatttatacaaggctcaatatggtattgattccacgtggagccctgtgccatgtgatggacagttaatgaacaagctcgacctaggcctttcctgaattgagcttgtatctattgcagtgctacttgtctagggtcagttcccattcagtgctttcatctggaacatagagggcatgttaattccacttgtaggatgttcagatctggtagtgttgaccaagacattgtatgacagaatcaggttaaaaaacaaaattaaaaaaaaaaaattctagagtttggaaagatgggccaaggctcacaagataaatacataaggtataactcagtacacacagaaggaaagtcttcaactcaggtttaaaaggcacaggataagaaacatagaatggtagc

SEQ ID NO: 188984 - DNA, 472 bp, Homo sapiens
aaggagcaagagtgagcagcatggtgataaagttttataattaaacaaaaatgaagactaggttcgaccacagaatgccggtgctattgttatttgaaaaccatgctctccagggctgaaatcttcaaggtagttgaggcttctagggtgatatgagatgatcaaggacacgttgggagagttctagctttgccactctctgtgtggccttgccccatctatttaacctctgtctgtaaaatgaggggtgggataggtgagctctgagatccctttgcctgaaccagtctttagatgtaaccacttctttcctaggttggagacggattcttacaagtcccgcgtcacggagcctatactcgaggccgtgcttggtaattctttcccacctgttgccccatcagtgtccagctacctctctgaaggaaccacagctttcccagggggcaggggccctctgggaggcctcatg

SEQ ID NO: 188985 - DNA, 429 bp, Homo sapiens
gcccggcgtactagaggatcccgtcaatttctacacgtcataacgatattttgtgagcctaaatacctgtacttacactatttttatactttgcgatggctttcacagaaggcaaatatattcctaaattattagaggtagttttaccaagcaagtttaaatccattgtattcagtactttgactagagttcatttaaagtgtgatttggagttacccatgaccttctaccccattaccttgattaacctagtgttagattaatgctagaggtgaggaatgggtgaaggagaggacttgtgaacataattagatcttcattttggaaggtgaataattttggcttagaacacttctgactgcagcatgaagaatagtttgtgagtagataaaggcacagaagccatttaaaagcccatagtaatgtaat

SEQ ID NO: 188986 - DNA, 276 bp, Homo sapiens
agttcacagagaaccaagtcatttaagtgaagtattaagaaaaagaagttgttccagaaactatacatctggccacctgggtcctttgcatcacttgattgtatctaatattttaaaaaaatgaaccaggcacagtggcatacatctgtaatcccagcactttggaggccaaggcagagaatggctcgaacctgggagacggagcttgcagcgagccgagatgccgagatggtgccactacactccagcctgggagacagggtgagactccgtctc

SEQ ID NO: 188987 - DNA, 555 bp, Homo sapiens
gttttgccatgttggccaggctagttttgaactcctgacctcaagtgatctgcctcagcctcccaaagtgctgagattacaggcatgagccactgtgcctggcctatgattgttgataaatacattctcaagattctctcagactttctgaatcaaaatctccagccatgtctctgtgactggcccccagtaaaaaccctggacaccaaggcatggaaacagtaattcgtttgatctggactgtgtggcccgaaccctgtatgtaatatactgtcccactgacttccctcatggttacaacgtggctgccagcaacattaggggcaacatactcccttgcgtaccatattatctttctgaaaccaaaaacatggtaagttcttttttttttttttgaaacggagtctcactctgtcacccaggctggagtgagtgtgatcttggctcacggcaacctttgcctcctgggttcaagcaattctcctgccctagcctcccgagtagcagagactacaggcacccaccgggtgtgtgccaccatgccgggctaaattt

SEQ ID NO: 188988 - DNA, 119 bp, Homo sapiens
cctttaggtagccagtcaacaccatctgcctttgcaaataaggccagaattactcttgatcttaaattttacaagccaagtttttagacagtggataagttcttccacgtcttctcaaa

SEQ ID NO: 188989 - DNA, 551 bp, Homo sapiens
tacactttgtaattacatatgttctagcaggctttgatttttaatttgtttagctttatatggtcatatctgtacgttaggtttgcattagctaacttttaaacatttttgctcgctcttgtactgttgggcacaagcagtgcctccaggcaaattgatgcctaaactagagagaacagcaggcattctctccttactcttccacttcccctttacttccatttcctgatcctcatgtctgaagtcacaccacctttagccatttgaaggggctgcttcttccattttacgctttctttcacttgtatgccataaagtgcagtgcctgctagctccagtgtgctctgtatgaggtttgcaccagtgtgttaggaagaaaggaggcactgaaattaaaaaaaaaccatattttgggggtttccaagtcactaaacaattgaaccacaataatagaggaaactgacttaaacagtattaaactggtattgcttcaaacattatcaaaggatttctgaggtgaatgcctactttataaaaatgtattttttcgg

SEQ ID NO: 188990 - DNA, 159 bp, Homo sapiens
tagaatcgagctcggtaccagattccctttccatccagaaaaaaaaagccaggtatggtggtgcatgctacctggaggttgaggctacagtgatccgagaccacgccaatgcacttcacttcagcctgggcaaagggagtgagaccctgtctccaaaaa

SEQ ID NO: 188991 - DNA, 160 bp, Homo sapiens
attttaagtatcctgaccattcctatccattctcctgtctgatcatcctttacctggcctcctacttggatgtgctcaaccaacctctggttgtgttttgtgctgattaacttcgagtagtctcccaggcttcctagagttgtttctctttttttttttt

SEQ ID NO: 188992 - DNA, 340 bp, Homo sapiens
tgtttcaatacacgcaagtataattttagcccccatcgtcactcaacagctagtttgggccaggccgcattacagacctgtagagtcctaggcctgcagcagtgtgtaataaaacaggaagaatgcctgcatcccagaggacacaaacagtcgacagatagagtctggtagtgtgtgtgtgttgactattggtgtggaacaaattactacggagctcagtggcttaaaacagtgaacatttcgtagttcacagctcctgtgagcacaggagcagcagagcaggatagtcccggctcaatctggcaaggctggagccacagaaagacccaactggggcagg

SEQ ID NO: 188993 - DNA, 365 bp, Homo sapiens
aatcaaataactcatctttatctttattacttgtccatccgacggtcagcatatatagaatgtgatgttctgacttgtgaaacccatgctgtatttttttagtggattttatataaaccttttagcatatcaataaatgaagttactttttcccctattattttaaaagttgagtattttatcccagttagtaaatatttattgtacctttcctatgagcatcccctaccactgtgttaaaccctgcaaaggacatagtttagcaaggtactcgccacccctaaagatcctgcactgaaatgggggatgcactgaaagtggggatgtgggaccagatgtgtggagtgggaagtgcaagcatactt

SEQ ID NO: 188994 - DNA, 345 bp, Homo sapiens
tgctgtgcagggtggggagggatacaaggctcaacgtgacccttttccctatctgaccccatgacctgctgctctcccctctctcactccactcaggccacaccagccacctcggggccttggcacctgttgttccctctccctcaaccactttcccccagatagccacagggctcacttcctcacctccctcaagtcttactcaaaagccacctctacagtggggctgtccttggccaccctctataaaatagcacagcaaggccgggtgcagtggctcacgcctgtaatcccagcactctgggaggccgagacgggtggatcacgaggtcaggagatcaagac

SEQ ID NO: 188995 - DNA, 493 bp, Homo sapiens
cagagtccgtgtcctgaaccacaagaggccatcatacaccatcagatttggtgctagcatttctggtggtgcctggtggtgatggatccatcacaggggtcctccaggtactggtgctggcccagaacagagctgacactcctcaggcactaccacattccaggcactgtgcttggggtcagtccctctcttttttttcccccccaattataacagtatctacaaagtaggtgctgttatttttcccctttcacaggtgagatagactcaaagaagtgaacttgcccaaggaacagaactaatgagtggggaaaatggaactggaaaccatgtctgtttactccaaaacctgtgtttcttgccctctttctctgatgccagccccctacacttcaaggcctgtgttgtccagacccacactcgggcctgccagtgtgtgcctggcagggatgctccatggccacaccatatccatcctacacatcccccctca

SEQ ID NO: 188996 - DNA, 320 bp, Homo sapiens
caacatgctgtcactgaactgaaggaagttttgggaggagacgtacactaccataccattatataatatttccactgtacagataacaatagaagtaaattatctctgaccatacatgacagtacaatgtagtaaaacaatcaggaagtgattattttggaggattccttacctttgtttttaatataatttatttattgtaagcagataatgtagttttttgaaacaattgctgtgtttaaccaccaggttgcaaaattcctgaaaacgcaacaatctgtgttaagccagttccagctctccactgggtgtatgcctcg

SEQ ID NO: 188997 - DNA, 254 bp, Homo sapiens
ctttagccgaattaaattttagggactttaattgagcaatggacgattcttgagttgggcagccccccagaatcacagcagattcagagagactccaggggtgcctcgtggtcagaacaaattggtagacaataagtgacataaagaaatcagaagtgaggtacagaaatactggttgaagtatggctgctgggattggccaagactcagcgattgtaacaggcacatactcctaagttaggttttcaatcttg

SEQ ID NO: 188998 - DNA, 587 bp, Homo sapiens
tgacctcaactgatctgcccccctcggcttctcaaagtgctgggattacaggcatgagccaccacactcggccactaggtgcataatcttaaatatcaaaaaaaccatatatattaatttgctcaccacaaggctatttataatcatggagaattagaagcaatttaaatgttcagaagtagaagagcagatgattaacatttgtatgtcaactcaataaaatattttgcaatgattcaaaattatagttatgaagattatataataaaatagaaaatatttgacaagttatattttaagtgcttttcatatattctcaattttaatcctcccaataatccataggtagatattattattcccattctaatcatgaggacaattaggcataggagattaaacaactaggtcacacgtaagtggtggagctgggattccactgtaccgcccttcaatataaaaataggttatgaagcaatatctacagtgcatgcatatgtatgtatgatatattcattcctaggaagaaaggctaaaaggatatatagctaaaagtgattgtgtgattgcattatggtggtggcagt

SEQ ID NO: 188999 - DNA, 542 bp, Homo sapiens
tttacatgttatcaataaaagtagcattttaacaattatcctttccacattatttgataaatgctattggttttgtctgttatttttataaatatataatttgctttaattacttaaatgttccttgagccttagaacttaaatcctgatgagggttttactttttaaaatactgaagtttattatttatgcatgttttacagaaaaatgagtggcttttaaaagatcaaaattaaaggcttaaacatggaatctctaggacatataaaatatgagtagaactgtgtatttataagatgttaatgtaagacttcaggccttgtaatatcttaaaggaaccacttcactgtaagggagcagtttgtctttctacctttccaattgtattgagattttgcccagtatgtctttttacttaaacaccttggtgaaagctatccagcatcctgttttaaatctcctttgttgcacttaccataattactttcagatctgtttccattctcagaaactgaaactgtaagctcatgtgagtggggaat

SEQ ID NO: 189000 - DNA, 232 bp, Homo sapiens
cctcccgtctctttttctcccccttgtagtttgtttgttgaagaaactggagtgttgatcccatactgtttcccagtctgaattttgacagttatatcctcataaggtggtttaacatgtcctgctgccttctgtattttatagtaaattggtgaatgaacagttgttttcaactgttggcaatgtatggaaacatttttggttgttacactaggtggggcggtgcttctgg

SEQ ID NO: 189001 - DNA, 472 bp, Homo sapiens
ttccatcagccccagcgatgggctccggggaatatcaattttccttttgcttccccggtcacatgggtttcacctcaaccatccccttttgctcttccatcactgctaacactctgaaacacctagagtggtttctgttttcctaactgggcactgattgataatgtctcttcataactagtactgccattcagtgtcacatgtctgtgtctgattttgtgacctcctaagtgacagaattcggttattaatggggtagtttttacatggagaccttgaaatccaatgatatactgctggaacctgtggatatagttttgagtctgtgagctcttaaatgggagggaatgttgttgtagtcctttggcttctgatggttgtgtgaatgaaacagtcattcgctgagtatcttctgctcatattgcttcacttgtcatgtctggcatttctcctttgtggttgactttcatcg

SEQ ID NO: 189002 - DNA, 246 bp, Homo sapiens
tgagacctaaagggagaaggaaggatgtatggaaaatggagcctttaagggcagatggttttcaccaacctttgagggtcggttaggtgactcattactcatttgacaatttaaaaatggataaaaatatggaaaatcttttttaatgccgtaactatttaaatgcattcttctaaactaagggcctacaaataaagaaagccttcacatgggcaaacttcagggcactaccctcctccaaaaata

SEQ ID NO: 189003 - DNA, 431 bp, Homo sapiens
agtgtttgcaagccaatttcctccacttcgtcagctttatcgtctgtgtgagttttgtatcctgaccactgaggtcaatgtatgccactgagaaacctcacccagatcttaggaagaaattcctattttcataaagacatgatttttagtttacattcttctcatcggtcctatgtctgcttcagctctgtattagtaaagcagaaagttatgttcataaatccttttaagaaagcagctactaataaattaagagatttattattgtgcaggatctggattttatgaaaaaattttaaaaaacaaaacaagagatgtactaatttgcccaaatattccctggtacctgagttagttaaatcagaaatactttattcctataatctgccaataggaaagaaaagaaatttttgtgatggaatcactgcatt

SEQ ID NO: 189004 - DNA, 131 bp, Homo sapiens
tccatcccatcgttccaccatgcttttgttctccatctcccctgagactattaataccttgatagctttattccctgcaggaaaaaaaatatggagcagagcctcatgcaacccatggggaacatataatg

SEQ ID NO: 189005 - DNA, 547 bp, Homo sapiens
gatatgattaagtaattaattgttaaaaaaagatattctgggcactttcacccacaagtgtgtttaaaaatacaaatttcatcacaaattattttgagtgttcaagatcacaagcaaagaaaaagctacaaggcctgatgacctaaaaatgtgacatcattactttaggtcaaaagagatctaaattaagtataaagcatattttaatccttctcaaatttcttctttgtgcatgaatataaattatggtaaatttgtataagtaaataccataactgttcttaactaataaagtttaagggttaaaacaaagaattcccaagaaatgtgaataatggcaatcatgtagcagtagtacatcctttcacatggtattttgggaacattcttttattcaataagcctagacattacagtatgcttcaaaaatagtccaagctggtgaaccaatccaagttttgacttcaagcagactgtcagagcagcactaaggcagaaagtgacaacactgtccagttcgaaatgaaagctgtcatttgcctgccaa

SEQ ID NO: 189006 - DNA, 475 bp, Homo sapiens
atcatgcctcctcccagtcaaaaagagccaagcattttgagctggtaaaggagaagggagaggtgaaacaatgaagtaagtgaaacaaagtaatagatgcaacttctctgaacccagagggggcacttgaattgtccctcaatacattttctcagtgcctactatgagcagaattccctgcttgacttggatgatagtattctgaagaatctactgagaggagagacgctgaggccaatggagagttggtgaaatgagacagatgtttatcctggaaagcaaaaagagatggagagagagagagaaataaacagatctgttcagagtcagccaaggcttaaacaaacaaacaaacaaaaacccttgctggtaaaagtttgagagattcctggcctcacagattatcagcctgcctttgtcaatggaacagtacctctgtctcctctgtgtgaagccaaattcattcattcccaga

SEQ ID NO: 189007 - DNA, 437 bp, Homo sapiens
tttcaaatgagcagcaggatgtaaagcaaatgagaaatttaagctgtgctcccagaaggcaattattattaaatatatgtaccacagcattatcatcatcatacacatgaaatcaattatcaccctaagcaaccacaatttcagttaccttattttccttaggaagtctaccatcacttaccagatttttacctaaatgaattattattcatgtcaaagaacaatagtttattataccaacatttgtagctatcatagctttacttagtttatatttttatgtctgactgatttactctacaccacttaaaatattgccaacaaccaacaacataaaaacaaaatgccaggtgaagaatacaaacaaaatagcctttctatctccacttaggatattatcaatcttttctttcccccttgcacgaatatttttagca

SEQ ID NO: 189008 - DNA, 604 bp, Homo sapiens
atgcacctatgtagctttcttctctactccctgccttcccttcccttcaggccccagcttaagaccttggtataccatagcttgcacttttatgctactttgagcaaatatgaatcttcttttacctgtgtcttatttccccaaccagatcaactaggctatccttctctgaatgcctaagattaagcttggactccatacacaagtgttatctataatacaatctatcctatcagaaaaatgagggtactatacagataatctttggactccttgaaggtagttctgaaaaacttcatatctacccttcatattgtggaagagtaatttaatataaacaagaaagaatgtgtacaatattaaaaaatttctgaaatttaaggctagatttttctctagcctatctctcttttctaaattactgggataatcacaaaaattactctcctctcaagaatgtttgactactaaagaacagggaaaggaagagattaaaatataaatgtgaaaatgcacatatcaaaatgctggctgtggtttttaatctaggtggtatagcaatgggtaatttatatttttatctttgcatctttgtatattttcc

SEQ ID NO: 189009 - DNA, 827 bp, Homo sapiens
cattaaacgtttccagtcgatgtagctaacaatagattcataagatcatttaaaacttaaaaaaaaaaaaaatcaaccagacacagtggctcacgcctgtaatcccagcactttgggaggccaaggcaggtggatcacatgaggtcaggagttcgagaccagcctggccaacatggtgaaaccccgtctctaccaaaaatataaagaattagctgggtatggtggcatgcacctataatcccagctacttgggaggctaaggcaggacaatcgcttgaacccagggggctgaggttgcactgagccaaaatcatgccactgcacttccagcctgggtgacagagtgagattccatttcaaaaaaaaaaaaaaaattggtcatgacccagcaatttcacccttaggtatgtcctcaatgcaaatgcacagatacatgctcaccatgtagtaaaaggataataaataatagtagcacagttcctaatagttcttttattgattgtactgtttgattgtactcagttttggaactgagaaccattgagatgtccatcaacaatacaaacaataaaaaagttgtggtcatcacaaaatggaatactatacagcaatgagaatggcagatcctaacaacacacacatttatgaatgaatctcacaaacataatattcaatgaaagccacaagacaatacatttcatacaatgccacttatataaagtacaaaagcagacagaactaatatatgctgttaaagttaggctagtgattatcctttagcaggataaggtaatgacctgaaggacgcatgaagaaggtgactgggg

SEQ ID NO: 189010 - DNA, 553 bp, Homo sapiens
ccgaataggaacagctccggtctacagctcccagcgtgagcgacgcagaagacgggtgatttctgcatttccatctgagatgataaaacatcagttgaagaagttcattcgggtaaagagatggataatatttggatatacatgaactcttggaccatcatcaatagcttgttctatattaaggcataaggacagatgctgataccatctcctttacaagactcgaaatttctacctttgaaccatgcaggtcataactgttactgtcagtggtccagccatatctacgtgcgatgtgtgaaccaggatgacgtatgttcaggcaatatatccactgttgaagacgaaacacgtcgctgctgctcgcttgatgtggctgcacacaccaacagctgtttgactactctaggacttgaagctgctattccctcatgatcctgacacctggaatttgcacctcacaggaccccagccttgctgctctgcccattgacctctgccaccctccataccgggtgtgagttaccaccagaagaagtctgtggcagcagca

SEQ ID NO: 189011 - DNA, 398 bp, Homo sapiens
ccctctaatcctctacaggagagacacgtggactgccaaaactgacgccgcatacaggactggggaacgcagagtgcagcgacctcatccctgacctgcgctcactgacctgaatagggctgactcttgagaaactgtgacgagactgtcagtcacctgtctgccccccaaagccagcagtggtgtgctttcaatcccagcttctgaatctgtaatttagtgagaccttacattcgtgtggcacttcagagttcagaaaacatgcttataacctaaacttactcctccaaccacccaacagaagggacgctggggctctgcctgcccagtgctcaaggtccctcggtggggacgccacacctgtttctcccactttctcgaaggtgggtgcacctgct

SEQ ID NO: 189012 - DNA, 220 bp, Homo sapiens
gattaccaattcaaaggattatagtttaaatccaattagattatgcatgtgaaagtgctttgtaaaatataaaatactatattaatataaagtatgaatggatgaataattaacaaataatccaatcaattatacattttataaatttcattttggaaacttggcttcaatgtgccacggaggaaattctgttcttgtaccataagcctgtggtttcttc

SEQ ID NO: 189013 - DNA, 1019 bp, Homo sapiens
cactgaagtttttcaaaccacattagttatctttctcctccctttctccttttaagcagctcctgaaacacactcctgcagaaagcctccgccctactaggattacatccatttcgcgtcttcttaactataatgggatatttttggaggactgggctaagtaccctaatttttttttttgtttcagaaaacacacagcatttaacagttttctgcttgcagtgagtgcttaatataggcttatttgatgaatggttgaaattaattatctctaaaagagaacaaatgtggagcctcaggtcaaagtccttgggtctcaggatttcagacactaactgccactaaaggattactagagtgttctcctatctgaacccatagtggattgatataatagaagtataataacctctttgatatgtacagagcattacggtttccaaagcacttccacatttatcatcttatttgagcctcacaacaaacctttgagttactcaggcagctactactacagagaaaccttaggcctggaaaaatataagcagctgacccaaggctgccaggccaggcatcggacacaatactggtaccagtcaaccgttttttgagcacaagcattgtgccaggtacacaaagtacattattttcttcagtcctcagaagacccttgattcagttcctactgccactttaaaaactatgctgaggccaggcttggtggctcacatctgtaatcccagccgaggtgggtggatcacctgaggtcaggagttcaagaccagctgggccaacatggcaaaaccccgtctctactaaaaatacaaaaaaattagttgagtgtggtggcaggcacctgtaatcccagctacttgggaggctgaggcaggagaattgcttgaacccgggaagcggagtttgcagtgagctgagatcacactactgcacttcagcctgggtgacagagtgagactctgtctcaataaatgaataaataaataaaacaaacaaataaataa

SEQ ID NO: 189014 - DNA, 305 bp, Homo sapiens
tcctgctccttcttcaaagccacccctccccaagatgctgcctctgaagctccaacagtccatctccctgacagttgtgtcctctccttctctcgtatgtggtagtatcactgtcttccccctaaagcagtgggcaccttgagggcagaaccttgccgcgggcatctctggcccctggggtccgagcactgagcgggaatcctgatgataagtgttgcatgagctgggcacagtggctcacgcctgtaatcccagcaggaggatcacttgagaccaggagttcgagaccagcctgagcaacatag

SEQ ID NO: 189015 - DNA, 481 bp, Homo sapiens
ctaatttaataccctcaagttgtatatataccaggaaataaactcataatctccatcctaatcagtttgtaatataaaaggaagaacaaaattcccaaactttaaccctatggccttttcagtgtttattgatgagtatattgcaaacacctgggtagccagagcacctctgcttcactcctctgcttagaagcagcttctgccacacatccaggattatgtaatacatatctgtcacggtccacaggaccagcggactttaaaaaataatggtgacataaaaactcacagtggtagctataccacggaaccctaggtgagaaggcacctccacccgcacacaggtgtatggacgcaaggatgaacgttccggccgcacgcgtcccacacacggacgtgcacacgggcgcctccgaataggctcgcggttcccgaagccggctccgcggacgcctgctctggctccgtgggaaaggcgcct

SEQ ID NO: 189016 - DNA, 434 bp, Homo sapiens
tcaaattcatagacatagagtaggatggtggtggccaggggctgagggaggagggagtagagagttgtttactggctataaatgggtacagaccttcagtctggggaagatgaaaaagttctggagatggatagtggtgatggttgcccaacaccatcaatgtagttaatgtcatgcatcgatcgtatgcttaaaaatggctgaagtggtaaattttacattatgtatagttcatcataatttaaaaagaaaaagtaaaaacaaagcccagcctactttgaccccttccaaatgcaggtttggacaatgcacgctcacaaacgccgactctgtttctctgctctgagaaggaaatggtgccaggttccctgcctagccaactccacctaaaagaagacatggacaacacagggagccgatccctacatgagcat

SEQ ID NO: 189017 - DNA, 736 bp, Homo sapiens
gtattaagacctgaaactgtaaacctactagaggaaaagcttcatgacactggtctaggtaacaattttttggatatgaccccgaaaacaaaggttaacaacagacaaatgagatggcatcaaactaaaaagcttctgcataacaaaggaaaaaattccaaagagacaaccctcagaatgggagaaaacatctgtaaatcatccatctgataaagagttaatatccaaaatatgtaaggaacacaagaaactcaacagcaagaaaacaaataacccaactgaaaaatgggtaaggcacttgtactgacttcaaaacttaccgaaaagctatagtaattaaaacaatatgatactgggtcaaggacagacatgtacactgatgaaacagaaacggaaccaggaaataagcccatacatataagatcaaacaatcttcaagatagtcttttcaacaaatggtggtggaaaatctcaatatctatattcaaaagaaagaagctggaccaattccttacactatatgaaaatattaattcaaaatggatcaaaaacctaaacttaagagtaaaaactgggctgggtgcggtggctcacacctgtaatcccagcactttggagaggccgaggcaggtggatcatgaggtcaggagattgagaccatcctggctaacacggtgaaaccccgtctgcactccagcctgggcgacaaagcaagactccatctcaaaaaaaaaaa

SEQ ID NO: 189018 - DNA, 400 bp, Homo sapiens
ccggagcatcatgcttttaaggtggccatggaccggatggccaaggggccaccacactgccattcctgaactagataatctgagagagttgatggagcacctgtgaattctgggaattctgcacatctagaattcccagattctaatgttctagagtctgacattccaagatcaagggggcacaaaaaaaagtcaggcaagcagagaatggtctctgcctacgggggctggcagcaacaggaacacatttgcaaaggcaacctgacgggtaagtcgtatttccaaggcaaaaaggagatggcattccagacggaaagaccactataacgaaaggcccaaagcaagtgagtaggtgactgtcctaaaatcaggactggattccattggggggggtaccgag

SEQ ID NO: 189019 - DNA, 277 bp, Homo sapiens
agttgtcctgcagtgacgatcagatcatggttctctatggcaggttggaagtttgtccttaaactatgatatgggcgcagggggcggtgggggaaccagacccctctcacaaaggggctgggttcctcctgaccaccttgtcaaagataaataagaggggccccacagttaagctgaacagttggagcaaattaccagagtgtcagcccacgttatccaaagcccagggttatgcttcccaaaataattactgagtaggttttatgtaggaccccgg

SEQ ID NO: 189020 - DNA, 576 bp, Homo sapiens
gaaacaggttaaactcatagaaacaggataaacatcaggaattctgcagagagttatgccatatttaaactatagaaagccaaagacagtgagataatcttgaaagaagacagaaaaaaaaaatacacactttatcaatcgaggaataaggataagaatttcattagacttcacatcagaaaccatgtaaaaagaaaaaactatttaaagcattgaaatataaacaaaacactaagctagaaatctatgtctagcaaaattatccttcaaaatcagaagaatcaagacatcttcacacaaagaaaaattaaggacaaaagttaccagcagacatgttccataagaaaaattaaaataattctttggagaaattgaaaatgatataggtcagaattctaatctacctaaaatgaaagggcataagagaaggaataaaggtaaaataaaatattttattttccttatttttggtttaaataaaggctaacattttctttaagttaataataataataatgtactggatgtgacagtcatgttataaggaactaaagagaggacttgggaatactctta

SEQ ID NO: 189021 - DNA, 374 bp, Homo sapiens
tgacttttaagtataacaatgtaaatgaaaaaagcaattgataattttcatctctaattcctgtgattctaccatcctactgaaaaggccaagagattaaaaactagctgaatcactgcataataaaagcatccggcaacagtgggtgtaagtaccattttaaaagaaggaatgtgagtgggagagcagtgtaatttcactgaagatgaagtagtcttcagagctgcacctgtcaacagaatctgttttaaaatgtgcttgcagacagagtttatatggtttagccagtaccaagagaggtgttattaacagtggataatggaaaataatctctgaaaagtatttgctcttctacttgatatgcattttgtgca

SEQ ID NO: 189022 - DNA, 316 bp, Homo sapiens
taagtttgattactgtggaccctttttgcatgtgaagtggtttgactttggccttgttatctaccagtaagcactaccccagttatgagggtgctgcccggcagcactcatcctccaaactccaaagaaatggatttggggacaagagtatgttaaagctaaccgtgatctcagtgctgaaacataaggcgatcggacctttgaattctgtgatgttgagggaatacagcaaaaccacgaactatactatacatgtacaacacacctgtacatatgcacatacacactggcatacaacgtacgtgcacacacaaca

SEQ ID NO: 189023 - DNA, 305 bp, Homo sapiens
aggccagcttctaaaggtttggaggatctcttgacggagttttagctagaactgatatgatttacactgaaaagctcttgacagtcctgtggtttagagaagagtagagaagaggtttattggtggtagtaaggtgttgatgcaattccaagtcagagaagttgattgcctaaccgggtcagtgctgttaaaaggcggcatgatggaaattcaggaagtcaagtcaggagtatcttaacttgccccaaagagatggagaccatagaattgtgggcttagtgactggttcaggcagcctttaacat

SEQ ID NO: 189024 - DNA, 802 bp, Homo sapiens
ttcctttatcaccacaagttagttgagggctcttgggttgcacgcaacagacaaagttagtgactggttaacttggagaggattttattatgagctacacagcgtagctcatagaattgcagggaaaactataaagaactaagtcttggacaaaagtaatatcttggcatgggcctgtagccccagctactaaggaggctgaggtgcaaggattgcttgagccccggagtctgagcctggcttgggcaacagagagagataaagagaccctgactctaaacaataagtaaatacataaaagaggacccaggccctccttaggaactggatggcaggagcccctggacaacctcttactgatttggtgctggatgaggcagccgcagctagccagtgttctttgtgttgatctcctctgccttcatattccagggggagagggtctgacaggccagactggcccccaccctcttggccactggtgggctgggcatgtttttgggtagttctacctagccagattaaagtgggggtggggtggggagtccagccagcctgggcaacagggcaagactccatctctacaaaaaaattttaaaattaggctggcacggtggctcacgcctgtaatcccagcactttgcgggggtcaaggcaggtggatcacttgaggtcaggagtttgagaccagcctggccaacatggtgaaaccctgtctctactaaaaatacaaaaaattagccaggtgttgtggtgcacacctgaaatccccgctacttgggaggctgaggcccgagaatca

SEQ ID NO: 189025 - DNA, 195 bp, Homo sapiens
aaatggaaaggtaaaatcagtgccgtatctgactgtaggtgagtaaaattataataaccaggtgacaatctattaatttacgattaggaattaaactgtgaagttgactgttctgactagcacgttggctgtctacagataacaaactaaggagccagattatggcatcgtagtggacttaagaagtgttgcttt

SEQ ID NO: 189026 - DNA, 490 bp, Homo sapiens
ggcttagagaattgcaaacccgtattgtgaagtcctaccaaacctttcctgaagctcgcaagagctgaccctggactctgcgttagcatgaggcagtaaatccactctatcgcctaatactttaagattaattttcttgacttgcaaccacaagcatcctggctgatacaaccaatgaaatggaagaggaatagggagagagaaaggatacaatctgaatctctaagttctgcttccgttcattgctgtcagttctatgatgtttctttgaatacttgaacacaaccaagttgggtctgaatggatgtatcttagtttcacttccccattctctggaattagagtggggataattacattttttaatattcttttttttttttttttacctttagacaatgttttctctctggattgaatgatacatagtttctttgaagaatacattatgacattttatttctcttccaccataatggaatcatatgga

SEQ ID NO: 189027 - DNA, 1413 bp, Homo sapiens
aaaacttacaaattactgctggacttttccatttactatttttggactgtagtggatatgggtagatgaaacctcggatacgtgggagctaccgtgggtgtattaggctctctgatgttggatgaacagggacctgggttaatcttgccctactctctctaattcaggtaccagccagacgagaatttcagcaagaacgagaagccgaaggaggaagtagttgagatgaattctgtacccaaagcagaatccccagcatgtgttcctgaagcgtccagcactccggcgagtctgtggagccctgtcagcaccatccccaccccgagatggggccgcatcgtctatggatgtgcctttctgcttgttgtcctgctgtccatgctatgcctggtattggcccattggcccaaacgcctgttctctggagagctgatctacatcgcagcggctgtgttgctgctggtgctcattgtgggattcactttcaccgtctggagacagccccagagcaacactcctctttacttcaaggtccccctgttgcctgttctcctctggtcagcatctctgcacatgtttacctgatgatgcagatgaccactgagacctgggcccaatgtggagtctggatgttgattggatttgctatgtattttggatatgggatcccacacagcttggagaacaatcaacagccaccagcgtcaagctcccaaactcctcatgaaaacatccctagtcccttgctgaattagtttaaccacggaaaagggatggtccagtccactggaggtgtcctctggatgacagggaaagtgtgaagctctgtggagcatgaaggtgggatacacttaaagccccttgtgcattgccagtgagcaaacactttttaaaaaactttatttgttgtttgtttgtttgttgttgtttgtttgttatagaggtgaggacttgctctgttgcccaggcggaacttgaactcctgggctcaagtgatcctcctgcctcagtcttccaagcagctgggactacaggtaccccatcatacccagcttaacaaaatatctttatttgatttgattttttttctttttgagacagagtctcgctctattgcccagtctggagtgcagtggcatgatcttggctcactgcaacctccgcctcccgggttcaagtgattcccctgtgtgagcctccagagtagctggaattacaggcacatgacactgtgcccagctaatttttctttattagtagagaccaggtttcaccatgttggccaggctggtcttgaactcctgacctcaagtgatccacctgcctcggcctcccaaagtgctgagattacaggcctgagccaccgtgcccagccaaaataactttaaaaacttacatttttaaaaattgaca

SEQ ID NO: 189028 - DNA, 409 bp, Homo sapiens
gatattctcgattccccaaagacagaactgattgcctgtactctttctgtcataataccttctatttacacaaataagcacttttcatattatttgtaattgactgtcaaaaattgtgccctgctcaccattgtggtggtcgagtgccaagcacattgcctggcatgtaaaagtgctctgtaaatatttgccaaataaataaatgaatgaaagttggagcttaaggagaaagaacaatcatagagagggatatgtgagcaagcagagagcaatagagatgcaacataatcaccacagataatttctcctaaagggtgtttgtgttagaagttaatctggcagataaccatgaggaaaccttgtataaacttgcccatatatggcaatataataagtggcaatcaagctt

SEQ ID NO: 189029 - DNA, 582 bp, Homo sapiens
ctcaaagacagactccaatctcgtttaagaacctttaagagtataaagacaagggaaaaatgtcactctcaaattagtacagcggtttacagttaaaaacaaaaagaatgttcaatgctcctgaattgtctacacaaaaactaaggattaaggacatacactctaaatgctattatacagtatataattaaaatcaatggttcaacaacttgcagaatgttatacagctagtaaaatgatcattaggaatccaaggaatcaacatgggagaatgtttaattcattaagtgaaataagcaaaatagaaacttaattattttatcattctaactatataaaacatacatatgagacatgaactagttagaaaggaatataaccaatggggcacagcagctcatgcctgtgatcccagcactttgggagactgaggcaggcacatcacctgaggtcaggagttcgagaccagcctggccaacatggcgaaaccccgtctctactgaaaatacaaaaattagctaagcatggtggcaggtgcctgtaattctagctacttgagaggccgaggcacagattgcagtc

SEQ ID NO: 189030 - DNA, 298 bp, Homo sapiens
tggaagagatgtacaaggtgaggtatgggaggagggtgtatagaacttccatagcctttcaagacacaccgcattccagtgcttctgtgtgttcagcaacctcaagctctccaagcctcaccgtttaaggtgatttatggaagttccattacatacgcatgactgactaaatcatggtcattggtgcttgagcttaatctccagtccctctctcctcactggaagtcaaaggtggagctgaaagtcccaaccttctaattatagcttggtctttctggttgctagcccccattctgaa

SEQ ID NO: 189031 - DNA, 352 bp, Homo sapiens
agaatacttacaacaaattagcgaaatagaaagacatacgaataaataaataggcagataggtatgaacagacagatgtacagaaaaagttcctagaaggaagtattctaaaatgccaaatggtttattaacaagggtaggattatcagagattcaatagcttgtcaaaaatcacagctattaagtgaaagaggtgggattcaaaaccagacccttgctctatgctatactccggatgactatttttttttttatttattatggaaatcttaaacatacataagagagactagcataaggaacctccaagttcccatcacccagcttcaacattctgtgtcttgttttagct

SEQ ID NO: 189032 - DNA, 346 bp, Homo sapiens
catattctcaaccctttcttttgagtgtcctttaccttttctgtcaaaaacttgctctttcctgatttccctgtttttcctgccaagcctcaggagaagcttttcccacatgctgcttatctttgggccttagtgccgagacgtggggggtggtgcttccttcttacttcctatttctttcaaaccattctccctccctccctcctgcctaaaacaccagctttggatctcacatcaccagagccactcactactcctgagctatttctctgtgattttatctcctaccttattgtctctttctttccagtatcactgcttcctttagttcttggcaatcaagctt

SEQ ID NO: 189033 - DNA, 1128 bp, Homo sapiens
cagcatgagaaggatgaagctaaatgccttaatcctctcatctttccaaaaccacctgctcagcagcaggcagttatctttcctccctgttgctcaaccaaaagaacaggtcaccccatgattttaaaggtggtttttttcatagattctaaggggatttaatggtcagaaaaactgggaatgaataatttacaagcagctgagatttttcccttgctctaccaatcttagttggttttcctgaaatcacaaaccaagccctccaaaattacatgtatacaaacatacatacataagagcgtgtatttatacagttgattttcattacttgtagattccacatttgtgactgcctacttgctaagattcatttgtaatccttaatacttgaggcacttctttcgcagttattagcagacatgtgcagagcggtgaaagttgagttgcccggtatgcacattcccagctgaggctgaacaaggcaatactctgccttcttgtttcagctctcagactgtaaataagtatactcgaagtatatttagtgccacgtttttcacatttttgtgcattttgtgggtgattttgctgcttaaaatggctcccaagcatagtgctgcagtgctgtctagagtccctaagtgcaagaaggttgcaaactgcctgaccagagaaaatgttcattagagaagcttcattcaggcatagggatagagctattggccatgaattcaatattaaggaatcaacaatatatattaaatacggtgtatttacacagaaacacacgaaacaagcttatgtgttgataggttgctgaaaatgatgtgaccagaggctcacagaaacctagccatgtatttcccctaggagcagtggtccagcattcgctaattcattgcttgaggtgactttatggaacacagctaccctgtatgagtgactatataaatgtatgtatatgtgcatatctccacttgtaaattaatatcccttggcaaagaaatgggtaatgcctcacgtgagcattgcatctgtctgcgactgaagtcatgaagctaagtgctcagtgcaacaaggtaatatgctaggcctagttgataggtgttgataccctcttttctttcc

SEQ ID NO: 189034 - DNA, 662 bp, Homo sapiens
agcttttagtgtgctcagcaaccctcccttccctgcccacttctcagttgattcactgtttcttaccagctcatgccagtccattaaagaggagagataggcaacagaaaaaaattaaaagatgaacaggacttctggatgatgattaactggattactggataagcaggcagtctggtgagccagtttgtgtaggtgtctgtttgtggagccctgctcattgatagttacttctggtattatcactgaatttctgctgtgaaagttgtcattatgttaaccttgaggctttaggaatataaacaatgcttcctaaattctagagatcacatttaagaaagattcatatatatagctaaactttttaaaaaggaatactgtggccgggcacggtggctcaagcctgtaatcccagcactttgggaggccgaggtgggtggatcacgaggtcaggagattgagaccagcctggccaacatgatgaaaccctgcctctactaaaaataaaaaaattagccaggtgtggtggcatacacctgtaatcctagttacttgggaggctgaggcaggagaattgcttgaacctgggaggcggaggttgcagtgagccgagatcccaccattgcactccagcctgggtgacagagcaagactcagtctca

SEQ ID NO: 189035 - DNA, 318 bp, Homo sapiens
tggagattttgtaagaaattgagacaagttggaaaacacaaacattgtgagggtttgtagaacgggtgggtgcttgctgaaagtttatattcattccatatttagttgtctttattctgttcaaacattttcttgtttacttgttgaagcaggttcagaaatagttattctgtagtgtctcagttttattaaaatgcagttaatattggaaaatatggttagaattaggtgactgccaaacatggctttcgtcagtgttagcctgtgtaatgacactgtttttctccttcgtgtgactatttataataaaaatgtgac

SEQ ID NO: 189036 - DNA, 285 bp, Homo sapiens
ttcaagctcccaacaagattaaattgttacaaaagtttagttttaaaaaagatttctcttctttcattatttataagtcaaagctatttgggaatgtgtgttaaacaacgactgaaccaaaattggttgtaataaaaatggctaccatagtaaaggaatatgaacataaaatatcaaactatttgagaacttctggtcaagattttttttgttcccagattcaagttctgaatcctttggtatggttcacagttgatagccaccttggaaccttcttgtggggag

SEQ ID NO: 189037 - DNA, 346 bp, Homo sapiens
gagctcggtacccaatcagtttacacaaaaagaatgaagaattttcagcaaaacagaatttaaatacttcaggatgcctggaatctaaaagaaaatgtcaagtagttcagcagcaggtgggaacagaaaggggctcattaccttcctcatgaaactcacccataaccactgcactgatggtcatctctccacggtaggaagagaggagcaggctaaatgcaatctacaggcccccctccagtccccgcttttactgttctgcatgcaccatatactttcctccatcactctgacttgttgagtttattgggatcagtcttgtgtaaactgattggtaccgagctcg

SEQ ID NO: 189038 - DNA, 498 bp, Homo sapiens
gagctcggtacccaatcagtttacacaaaaagaatgaagaattttcagcaaaacagaatttaaatacttcaggatgcctggaatctaaaagaaaatgtcaagtagttcagcagcaggtgggaacagaaaggggctcattaccttcctcatgaaactcacccataaccactgcactgatggtcatctctccacggtaggaagagaggagcaggctaaatgcaatctacaggcccccctccagtccccgcttttactgttctgcatgcaccatatactttcctccatcactctgacttgttgagtttattgggatcagtcttgtgtttaagtgccttgtaaataaatacaaaacatttcaccagttcactcaaatgttttactgcctgacctcctgcttggaggttacacatggagctgatgaaaagaatgtcataagcattcttttctacccacctggactaaattgttatttaccccaggccagtgtctctttaaaga

SEQ ID NO: 189039 - DNA, 431 bp, Homo sapiens
cttcagcacatctggcatgcagaggagtatgggcgcagactggcggcccgcctgaagattgcatttatcattaccttcctcatgaaactcacccataaccactgcactgatggtcatctctccacggtaggaagagaggagcaggctaaatgcaatctacaggcccccctccagtccccgcttttactgttctgcatgcaccatatactttcctccatcactctgacttgttgagtttattgggatcagtcttgtgtttaagtgccttgtaaataaatacaaaacatttcaccagttcactcaaatgttttactgcctgacctcctgcttggaggttacacatggagctgatgaaaagaatgtcataagcattcttttctacccacctggactaaattgttatttaccccaggccagtgtctctttaaaga

SEQ ID NO: 189040 - DNA, 524 bp, Homo sapiens
ctcaatcaaaacaggaattgagctgtttaggggctgtactctgttacctgtgtcttcgggtttctggatggtatatttattgcaggctcctctctactggtactttgtttctggagcaccttgaggctgcgggagactcagtctgccattccagcccagcctgcagcttcttgcactgaccagcactcaacagatgtcccatggggaaaactcactgtccactggggcacatcaaaaccttcactggtttctctttcccctagaatagtcctctgtctgggccgagcccttccttcactgttctcaagctgagcaaatggcccagcgaggtaacagccagcaattttagctcacccaagaggagctcttttctctcgcaattttagtttgtttagtcctccttccttccacaggtctctggtgttttaaaaaagataagagtatttagaattttctagttgtagcagtagtagtccaagcatatgattttattttacattattgagagttagaattattaggtg

SEQ ID NO: 189041 - DNA, 326 bp, Homo sapiens
tcaaaaaaaagtgagatggctttcgcctcaaaatgtaacagattacagactgtaagaagactgtatcttatcttcaaacacaataacatatcttcctcataaggttattctgaagatgaaatttgatactgtgtataaagcacttcccacaatgtctggcaataaagatggctcagcaactgaaagccatcattatgcgccaaaaacactaagttgtgaggaattgatgatagctcctaccatccccaacgccccccatgcacatacatacaaaatgagatattcttctaaaaagaatgccaatcaaattttagtgtacacaggag

SEQ ID NO: 189042 - DNA, 496 bp, Homo sapiens
gtgtcctgtggctctgggatcagagtgatgctgtagagagagattcttaaaggtggagagagatgttctgacaatcctgtgatggatacctcttcctgcaaacgtcaatagtcatgctgaggttggtgtgaaaacgaagaatccccagtcaaggaactggaggtgatagaaccatgaggctggcaagccagtggccagtgagccagcatgttagactgggaagaagttttgacatcacccagcttgacagccttgtttatgtgcagcccgtgatgttctcatgctcccatccgtcatagataagatgaccttgtgttatgcaaaattcccagtgcactccacataaccccatccctgtctttcctacttaggaaggcaatgtgaatttaagcgactggaattaatcttattgtagaaacaaccttgactttttttctgtttcatgcgaaatagcacatcactcatgagtttcagatcaatgatcagtgacaggtta

SEQ ID NO: 189043 - DNA, 331 bp, Homo sapiens
tccatctctacaacaacaacaacaacaacaacaacaacaacaaaagtagcagggcatggaggtgtgtgcctgtaaccctagctactcatcaggccgaagtgggaggatcacttgagcccaggaggtcgaggctgtagtaagccatgattgcaccactgcacaccagcctgggtctcagaacaaaaaaaaagagagaaaatgcaattatcgtccccagataagaaggattacctttgtcacaactgcgaagtaattgctttgttacagaaacagcacacagagccataaagcaggttaaaaaacacttctgtgacttcctaaatcctctctt

SEQ ID NO: 189044 - DNA, 363 bp, Homo sapiens
cttcagctgatgccctggggagctctggagctgggatggccattcagcaattgagaagactgggcctttttaccctgtatcggccaggcgctggatgcagtcttcccctagcaagtaggtgtgaccttgggtaaggtcatttccttccacaggagcagtgcctggagaggcactcagctgtgatcctttagcggctaactctcctagcagctggagaatctggtgctgccgtcccataggaagacctggcagtaatcaccttactcatctttctgcttccctagtggctgcatatcagattcacctggggaatctcaaacaaacgtcccaccccaggcacttctgatttggtagtgggagtgc

SEQ ID NO: 189045 - DNA, 256 bp, Homo sapiens
caacaaaaccgtatagagtcaccaaagactcagagaattagaacttcagaggttaaggctctgaaacatggattttatataaacttccaaggcagttctggttcatttaagttctgagaacccccgaggtagccaccagtcattaaggcttcactgagcagcattcgaaccccagcctccaggcccccctcctgcctccatatctaacagtgggtccagtgttttcacccctcaggctccgtatgcctccctgaag

SEQ ID NO: 189046 - DNA, 370 bp, Homo sapiens
tgaatttggcatggtatatgggcctttttggaaagaccttaaaaccccatctgttctatttattttaaagatcccgctgcagtttttaaaagagtaggcatttattctgaggcaaatgtgggacaccatatgagaactcaaggctgatagctgtggggctagtgacactgatgttataacaatgacggatgcttaccaccactactgtcatcactaccaccactaacaccaccaccaccttagcatgcttaaaattaaaaaggaaaagaagagaaaaaaatcaataaggaaaaacaaatgggagaaagagaaaaaaaccctcttagatgtgataagacatgacccaaaataaaatcaaacctaaaactct

SEQ ID NO: 189047 - DNA, 422 bp, Homo sapiens
atgccggagcaggaacactgcaagctgcgaaagccccaggcagaaatggtatttggtaacgggggctgcctctccttcactctcagggagtcagctcatcctagcccaagttgcttccttttcctcccttgaatttcctgttgccaggggtttgtctcgactggactctgttaattcaggggctaagtaggcaatgctcggtttaggtcttcattccatctgttctacaaaaaccaggtttttccaaatccagtacttcataactctgttataatcaagtagccaaatgctcctcttctactgttcactcctatatactagtatgtatcacaatcaaaatccccttctcttcacgggcaaagtgttactgcaagattgtcctgtcgttttgctacacacagcctcaaggcccatcagccagt

SEQ ID NO: 189048 - DNA, 368 bp, Homo sapiens
tactttttgcagtatttacaggttcccccgtgccgcccagcttctcatcatgtgcatcattctttctattactaacacgtccgatcgggcgccgtcagctcagtttgacggtcaggagtttgaggccggccttgtgcccagcattgtcaaccccgtctctactgaacatacgacaattggccaggccttgtggctcatgcctgtaatcccagcactttgggaggctgaggcgggcagatcacgaggtcaggagatcgagaccatcttggccaatatggtgaaactctgtctctataaaaatacaaaaattagctgagcgtggtgacgcatgcctgtaatcccagctactcgggaggctgaggcaggag

SEQ ID NO: 189049 - DNA, 599 bp, Homo sapiens
tagtctcttattcacctgtattatcaataagctctaaataacacaaaatattagagcacataaaggaatggctttatttattcattcattcattttttgagacagagtctcactgtcacccaggctggaatgtagtggtgcgatctcagctcactgcaacctctgcctccagggggaatgcagtggtgcgatagctcactgcaacctccacctcccaggttcaagcggttctcctgcctcagcctcctgagtagctgggactataggtgcgtgcccaccacgcccagctaatttttgtatttttagtagagacggggttttaccatattggccaggctgggctcgaactcctgatgtcatgatccacccgccttggcctcctgaagtgctgggattacagatgtgagccaccgcacctggcctgtctattccttttcaattgaaatattaaaatacttggtaaagttaatgtgagaaaccaaggcttttgattttaagtagctaggaacatgttcatagtaaatgaaaaacatctatatcataatctgtgaaacagaatcttacattctgaaaagttacataattaattttcaacgaaa

SEQ ID NO: 189050 - DNA, 692 bp, Homo sapiens
ccctgtggagtcagctggaacagtttgctgctcatttctgaatgcaaactgtgtctctaaagttcttgactatggtcaacttcaaagaaaggcaagtcctaaataccccatacaaaaagaaatcggccttctaaccccaagcatggtcattgtaagtaccttttggcatcagataacttatgtgtctgattgcattatgttctgagctgatgtatttctactagcagtgaataaaaactgaagatggctaagtgtatgcatcacaaaatattaagagaaattttcaagttatcatgtcctttattttccgtggataatgacacatgaaattaatcaagtagcctaaggaatcacaaatgcagaaagttgtggagctaagaaacaggtcttctttctttgtcctccttaacatcataaaagttcttatttcaacaagcaatgtacctgaagttagcagtttgtttcatctataatttgcgctgtataacaatgagaatgatattctcgttattcttggtataacaggctgttcctatccttgcccccattaacaataaaaacccatgcagttttcagccattatcatttttctcctgataaaccatctgtgacatggagaccttgaagccgggagttctggccacaatgctcaatagactatgcatacagctttttcagaggtaatcactgta

SEQ ID NO: 189051 - DNA, 394 bp, Homo sapiens
tccttgaaataaaaaggcagtcatgtaattaatagttatgtactacttgacagcataattactcattaccaatatgcaggaacaaaatgacttctaattttatcttcagagtctttaaaggtaaaaaagtacttgaaaggaagtaaactagaaagagaagatggcttttgtgagtgcttgagattcttcttgacttggaattaaaaaaaactaaaggttaaattacagatgatgttatgctgcatttactgaagcaggtgaatcatgaaaaccacttgtatatctcaataaaaataaattaaacatatatatatatgtagaaggcagtctaacacaggtttctcctactgttgtgttagctaaagatttttcttttaactgtctggggaaatgt

SEQ ID NO: 189052 - DNA, 396 bp, Homo sapiens
agaaaatgacaaggaattaaagaaaatggttcaatgagcttcttcagtctccctcaatccttcagcaaagttctcctgcaacacagaaatggccccagtgcttcattcacaatgttctacttcctgctccatttcctggtggtctttgtggcagttatgctggttggattaggtgacagtcatcatttctctgagagggaaggaaaaggtgggccaggacaaacatttgttgaagtcctactaggtgccatctactctgtacaggatttccaatttaccccacagaacagttctgtgaggaaggcattgtgagttccttttacagatgaccaagaacaggctgacagaggctaagaaaggattccagtgtcatacatcaagtaagggacaggaatg

SEQ ID NO: 189053 - DNA, 273 bp, Homo sapiens
atgtccaaaggatacattttgaaactgcgagagagttgaactccatgtgctcacggaggtagtgatggctgtggtagtgggcggccagtatccttctgtgcttaggcctgtgtagtggaatgtagagctgctactagcctgggatcaagtcacacctcttagtctgtctctgctgtaggataccccagatctatttgggattaattggatctattctttactgtttagtgcagtatccttgttatatcctgaaactgttctcataatttcaga

SEQ ID NO: 189054 - DNA, 187 bp, Homo sapiens
ttaaaattcaacaacaggacatgtgctttgttgcaagggtagatttaggttagtcatgatgaccttcctcagtctactacaggcaagttctttaaactctgagtttctttatgaaatgaggatgatgatagtgcttacttatacagttgctctaggattaagtgaaatactacaagtaaagcatttg

SEQ ID NO: 189055 - DNA, 323 bp, Homo sapiens
cgcaggcctccctcacggatcctcaacggtgggtatgtccagaggatgaggtgccagaaggggctgtgatcagctctatcttgcaagggacgaagtacttgaatgggcttttgagggatgtgcaggagttgactgggtgggtgagagataaagggcgatccaggtagcaggaacagcacaggcagggcccaggaggcatgagagtgtggcgagcatgggaaagtgtaagcagctgggcagtctcttgggagagcagcggggaggttcttgcaggttggggctggatgccgggtggttgggtcacttgagggaaacattgaggg

SEQ ID NO: 189056 - DNA, 713 bp, Homo sapiens
gaatcgagctcgtaccatatggttggacgaatttagattaaaaaagaaatagatgcttagaatatgttaaataaaaaacatgtttcaagtacttttttagcatatgcaaaatttctggaaggttttgcagaatacttttggctacctctgcggtagttggagggaaagagggtttcattttccttttgtgccctcatgtactgttggaattttttgttgtttctcatcagtaaatactaattttatatttttaaaactgactttaaaaaaacccaagttctcgatcggttcagaataaaaaattaaattaaaaaaataaaataccatgctttgggtgggctttttgttttttactttaggtataatgacctaggataactatgcctttacttaaatatagctaatattcaagttttctgaagaaaaacttgctgctttgagatgttggaattgctacaacctctatccctttctttctccccttcttaacttgcccctgggaacagtctttctactttagtagcattaacatttgtagcctccccaagttccatgcctcaaaccctactccctcttatattaccctcaaagtgaccggagcatttatcccagaagatggtaacaaccatgagtcaactgctactgctcttcctctctctcttttgatcctaatgtacttttgcacactcttgtcaaccagttccagcaaatcc

SEQ ID NO: 189057 - DNA, 360 bp, Homo sapiens
attggaaaaaaagaaaaaaccaaacccagagaatgttccttgaacattcctgaagtgggggggcaggcgatgtcacttgcagtgacagctggcctctctagctcacccccacatctgtgccaaccagagaagctgggccctttgtagcacaagcctcaggagcagagaatggagggacattctcaactgagaggagagggactaggaggctagatgggaaatgaggtgactctacagaaaatcgaatatgggatggtataaaaggatgagaaagatggcagggggtccacgatcgctcttgtatttagacctgggggatgcactgatagataccacctggagagagaaagaggatttctg

SEQ ID NO: 189058 - DNA, 449 bp, Homo sapiens
acctccacgtgttcagcaatccagaagttctctaaaccctgtcttcgggattttatggaggcttcattacataggcatgattgattaccattggtgatcaactcaacctctgggccctctcccctccctggaggttggagtgaggtggggctgtaagttccagtgctctaatcacatggttggtttccccggcaaccagcccccatcctaaggctctccaggagcccaccatgagtcatctcattagaacaaaagatgctcctatcacccaggaaattataaggaatttaggagctctgcgtcaggaactcggggttcagagaccaaattttagaacaaatgatgctcctagcatctctatctacaagggctttaggagcttcaactcaggaaccaggggcagagaccaaatatgtttttttttgtttgtttttttttttgttttgaga

SEQ ID NO: 189059 - DNA, 439 bp, Homo sapiens
caagatcgctaaggtaaactggtgaaactccagactactcaagacaaaaggcaagaaataacaaggagctcaccttagtcagtagtagtaggaatacagaggaggggacagatatgggagatgctacagtagcttaaagcaatagtattttatgcttggcaaaatgaggggaaatacaagtaaactgttgtaaggttcttacaccatatgtgatgtggtataatattgttggaaagtagactgattgattaaagatttacattacaagccctagatcaaccacaaacaaaacaaaacaaaacacgaagaggtaaaactaatgctgcgggtcgtattgtgttccccaaaacaatatctcgaagcctttactccaggtctacgtgaatgtgacgttatttggaaataaggtctttgcaaatgtaatgaagtaacatgaggc

SEQ ID NO: 189060 - DNA, 700 bp, Homo sapiens
tttgtgttttgattttagtagagatggggtttcaccacattgcccagggtggcctgtctcgaactcctggactctagttatcctcccatctcggcctcccaaagttctgggattacatggcatgaaccactgctcccagcctgaaccattttagaatatgtggttgatctgatgccccaaacacctccaaattattaatgtgtatttcctacgaacaaggacattctcttgtataaccacaatacagtcatcaaaatcaggaaatgaatattgatatatgatgatctcatgccgagatcccattccagtttttccagctatcccagtagtgtcctttgtatttaagatttgggtctcatgcagaatcatttgctgcgttgagctgttatatacatttagtctccttcagcctggaacagttcgtccatctttctttgacttccatcaccttgacactttaagatattaccaatcagcgattctgtagaatgttctcacttttggtgtatgtgatgtgtcctcatgattagattcagttttgaacatttttggcaggaatgtcacaaaagtgaggctgagtccttctctttgtgtctatcaggtggcccacaatctctagttgtaccattgccggtgatggttatttcaccatttgattaagatggtgtttgcttccctctactgtaaagctactccttgt

SEQ ID NO: 189061 - DNA, 397 bp, Homo sapiens
ctggctgtgcttttggcctgtgatggatttgactcttcaaggcttctgacaaagcttggttggttagaggaaaaatgtagtgaaaacctacaggcaacaccatggcttgccctaaccctctcgtcttcctgttctagcttttcccatatatcaggttgcagacatgctgaattcccaccctcctggagccaagctgccaatttctcattcctgtaaccagtggttttgtgtagataaaaggcccagaaggaagatggtcgctgagcagggagccttcggagttagaccttctttagccagggccagtggacactcatctcatgaatcaatactcatgtaacagtccaggggataccgagactacgaaattcgataatcattggatcatagctgattt

SEQ ID NO: 189062 - DNA, 276 bp, Homo sapiens
tcgacgtggcttcacatgaggagggtctgagctagagccacagagcggcatggagaagaggaaaatgtttgcagtacagatagacctatttagaagaaaagatattgctagtgggcagatctcaactctggatgagatgcattaggaataatggcgatgttagactcaaacacagtaagtgacacaaactcctctttctcttttttctgtcattgaatggccccttcctccacccagttgtccagtccttatgttttggtaattctgagtttgtcc

SEQ ID NO: 189063 - DNA, 140 bp, Homo sapiens
gcgctcttaaagaagctacagctcttccccattccctatctgaaagcaaggaaccactgctttggtcaggaaacaggcatacaacatcagatgtgattataaatggccacaatctaaaagaaaccaaaaaataaaaataa

SEQ ID NO: 189064 - DNA, 1715 bp, Homo sapiens
tctggaactactgggctcaaatgatctgcccaccttggcctctcaaagtgctgagagtacaggcatgagccaccacacccggcctagagatttcatttcaatgaactcatgagccacgttcctttctctctccgctcggtagtgtcgggcaggcagcaggagagtgtacaagaagctaggtgtgggcagttctgcaagaggccccagctgctctatggagctccagggaatggttctggtttgtttgttgtgctggaagctttgcggttgacacctccctctgcacttttacagcacgtatcagtgtgttagtcctaggcacttggcttgacataacttgctaggatggaggtagggacgagcctgtctgaagcgggggattttccttggcccagtggtgctcactttccaggacttactctggggcctggaagcagactttcctaggatggtgttctaccagtgcagggtggagattgcagagtgcggtctcgtaaggattcagttgcatgtccaggttatccaacctcatgtccatgttatcacaatcctatggggggcagggagtatcctcatttcatagatgaggaaacaggcagaggttaattgcccaagctctctgagccgggacaaacactcaggccgactccagcattcactgtactgaccccaatatcaaatccttttcatccccaccaagtttgcctgcactttgaattggcaatgcacacatgtcaaaactcaactggatcggccactttgagactccggtttctccctttcatgattttggggagaggagctcagatcagacggcaagagaaaagaaagatggggttgggagcatgtccctctgaggacccaagagagagctggccatggcaggctccagtgctctcagaggacgggtgctgcatcaacgtggactcaggacatggccagcccttcactggacagatgagcagaaaagcacagcctggacatcacagtgggaccccatctctacaaaaaaagtaaaaaagccagtgggcatggtggcacatgcctgtagtcccagctacttgggaggctgaggtgggaggatcacttgagctgggaggttgagtcttcagtgaactgtgatcaggcccctgcactccagcctgggagacacagcgagaccccatctcaaacaaacaaataaaacaaaaatatgacaaaaaagcagctcccccagggttccccagacacaggatcaggctccgtgatcctgactttgggtccagtgttcttcccctccaccgcgtctctaccctgcctgtcactgagcacaaggactccaatgttcagccaagggccacccagtggcagaagagaatgaggaacttcctctgggtgcaaaatttaatggggtgcccccaaaattcagaaaccaggggaaataatattcgaatgcaatatttttaaaagtccaaatcaaggcacaaaatctatgatgaccaaaatatgaaacttttaactaatggcaggatgagtagctgtgtggtgacaagccgtatgtatcagggcccagggcaacagggaaaatcagtcggcccaagcctgtcttcctttatggtcgtgttattttcttcaccagggactgcctgtattcattttgatattgtatttgttacctttcctgtggtgctgataattttgatattttaagtgttatgttaaaatataatttatcc

SEQ ID NO: 189065 - DNA, 1555 bp, Homo sapiens
actttctgtgcaattattctgtatagctaaaactgctctaaaataaagtctgttaaaagataaattaggccaggtgtggtgactcacacctgtaatcccagcactttggaagtcgaggcgggtggatcacctgaggtcaggagttcaagaccagcctggccaacatgttgacataacttgctaggatggaggtagggacgagcctgtctgaagcgggggattttccttggcccagtggtgctcactttccaggacttactctggggcctggaagcagactttcctaggatggtgttctaccagtgcagggtggagattgcagagtgcggtctcgtaaggattcagttgcatgtccaggttatccaacctcatgtccatgttatcacaatcctatggggggcagggagtatcctcatttcatagatgaggaaacaggcagaggttaattgcccaagctctctgagccgggacaaacactcaggccgactccagcattcactgtactgaccccaatatcaaatccttttcatccccaccaagtttgcctgcactttgaattggcaatgcacacatgtcaaaactcaactggatcggccactttgagactccggtttctccctttcatgattttggggagaggagctcagatcagacggcaagagaaaagaaagatggggttgggagcatgtccctctgaggacccaagagagagctggccatggcaggctccagtgctctcagaggacgggtgctgcatcaacgtggactcaggacatggccagcccttcactggacagatgagcagaaaagcacagcctggacatcacagtgggaccccatctctacaaaaaaagtaaaaaagccagtgggcatggtggcacatgcctgtagtcccagctacttgggaggctgaggtgggaggatcacttgagctgggaggttgagtcttcagtgaactgtgatcaggcccctgcactccagcctgggagacacagcgagaccccatctcaaacaaacaaataaaacaaaaatatgacaaaaaagcagctcccccagggttccccagacacaggatcaggctccgtgatcctgactttgggtccagtgttcttcccctccaccgcgtctctaccctgcctgtcactgagcacaaggactccaatgttcagccaagggccacccagtggcagaagagaatgaggaacttcctctgggtgcaaaatttaatggggtgcccccaaaattcagaaaccaggggaaataatattcgaatgcaatatttttaaaagtccaaatcaaggcacaaaatctatgatgaccaaaatatgaaacttttaactaatggcaggatgagtagctgtgtggtgacaagccgtatgtatcagggcccagggcaacagggaaaatcagtcggcccaagcctgtcttcctttatggtcgtgttattttcttcaccagggactgcctgtattcattttgatattgtatttgttacctttcctgtggtgctgataattttgatattttaagtgttatgttaaaatataatttatcc

SEQ ID NO: 189066 - DNA, 1048 bp, Homo sapiens
tctggaactactgggctcaaatgatctgcccaccttggcctctcaaagtgctgagagtacaggcatgagccaccacacccggcctagagatttcatttcaatgaactcatgagccacgttcctttctctctccgctcggtagtgtcgggcaggcagcaggagagtgtacaagaagctaggtgtgggcagttctgcaagaggccccagctgctctatggagctccagggaatggttctggtttgtttgttgtgctggaagctttgcggttgacacctccctctgcacttttacagcacgtatcagtgtgttagtcctaggcacttggcttgacataacttgctaggatggaggtagggacgagcctgtctgaagcgggggattttccttggcccagtggtgctcactttccaggacttactctggggcctggaagcagactttcctaggatggtgttctaccagtgcagggtggagattgcagagtgcggtctcgtaaggattcagttgcatgtccaggttatccaacctcatgtccatgttatcacaatcctatggggggcagggagtatcctcatttcatagatgaggaaacaggcagaggttaattgcccaagctctctgagccgggacaaacactcaggccgactccagcattcactgtactgaccccaatatcaaatccttttcatccccaccaagtttgcctgcactttgaattggcaatgcacacatgtcaaaactcaactggatcggccactttgagactccggtttctccctttcatgattttggggagaggagctcagatcagacggcaagagaaaagaaagatggggttgggagcatgtccctctgaggacccaagagagagctggccatggcaggctccagtgctctcagaggacgggtgctgcatcaacgtggactcaggacatggccagcccttcactggacagatgagcagaaaagcacagcctggacatcacagtgggaccccatctactcggcatcaagtaaactcccgtgcgctgataccatgctccgtat

SEQ ID NO: 189067 - DNA, 605 bp, Homo sapiens
cagtggggagcagggaagagggccgcttgggctgcttagggtgtgctttggaggaagagctgtgggatgtgctgatgggttggaagttggggctagagaagatgagaatcatagggcccgcctagatgttagaccggagcatctgggggaacggctgttaacagagaaggggagacgggaggaaggtcaaggaagagggagctgtgttctgactgcattgcgcctgttagggtccccgctggggctcaggcggacacctgggctgggggttcatggctgctgacagtgcgcagggtacagctggaatcaaagccaagggccttggctgggcgtggtggcttacgcttgtaatcccagcagtttgggaggccaaggcgggtggatcacaaggtcaggagttcgagaccagcctggccaagatggtgaaaccccgtctctactaaaaatacaaaaattagccgggtgtggtgacaggtgcctgtaatcccagctacttaggaggctgaggcaggaggatcgcttgaacccgggaggtggaggttgcagtgagctgagatcgtgccactgcactccagcctaggcaacaagagcgagactccatctca

SEQ ID NO: 189068 - DNA, 517 bp, Homo sapiens
actttcattgacaggctgatgccttaatcctaccagaggcagccactgctcccaagaaaccactgttgcaccggatcatggaacccaagtctcattcttggatcatagcctcttgtatgtctttaaacaataagcaatttcttctcaaatactgtgcactttccccaaacagatatacatttctcctgacctagcactttctgggaagaattcaacaaccatttagtagacactgactatgttgatgttattgtcccaaaagttttgcatctatatattgtcattaatgctcacactaaccatacaaagtgaatactattatctcctcacatttccgacaaggcatagcatggagagtttaaataatttgctgaatgtctcatggccaaaatcctattgaagtattttctgggatcttctctccaaaaggtagcctactggtgatttcatattgcctctggtggcagagagtcagttacttccaagaggcctttactttgggctgcttcagcatcag

SEQ ID NO: 189069 - DNA, 601 bp, Homo sapiens
tttgagagcgggaaatccaggctgcagtgagctgtgatggcgccactgccttctagcctgggcgacagcgcgagaccctgtctcaagaaggaaaacaaaaaaaacaaacataaacatacacacaaaaaaccacaaagtgtgttcatccttttgctaatgccacactgtcttgtctactagaaattggtaagttgtgtgaatccttcaactttgttcttttccaaattgttttggctattctggttcctttaactttcatataaatctttgaattagcttgtagatatcagcaaaatgtcctgccaagattttgtatctaaacttataaatcagtttgaggagaattagcatcataacaatattgaatagttttatctgtgaacatagtgtaatgcactatttaggtcttgatatttttatgggtgttttgtatttttcagtataaagaccatgtgcatcatcttgtgtttagatttataccaaagcatttttgcaggtgttggaattattactgtttaaaaatttctatttctagttttttatttctagcatatagaaatataaatgagttttgtaggttgaccttgtgtttgctgcctta

SEQ ID NO: 189070 - DNA, 172 bp, Homo sapiens
aacttccaacacgcatattgaatcctccacgtcctctatggccaccacctgcttcctgcttctgccaggattgaccttggagagacatgggatgatcgcagcatttctaaggaagggggattgggtgggactggaaggaaccaggaggaggtcaggggactccaggttgtga

SEQ ID NO: 189071 - DNA, 238 bp, Homo sapiens
ccttcatcctaagtgtggtgggaagacactgagaggtctctcaaccccagcacactttttattgatgtgctgggagtcccttctcctggtggacagcattagggtctgttcttgtcccttccccaaactgcacctctgctcttgaccaccaaggctgagaacacacagagagcacagagggccgacacccagcaggagcccccagtcacagccttgtctcatcctccccacacccctt

SEQ ID NO: 189072 - DNA, 649 bp, Homo sapiens
caggaaaagagaaggcaggagggatcgtgccagaggtcttctaggggacagacctggaagtgggatagattatttttgtttatcttccgttggctagacccagtcatgtcggtctactttaactgtgaaaggaagatagaaagtctgtctgagtgctcaagaggaaaagaaaactgagttcaagggagcacgcctaactttacgaacgtcctccttttgacttttttcctctacctaagacattgtgaaaatatttctgttaccgatttagaaagtttagtgatgttctttgacctgcccggaaatacccttgagtactggcagctggagttgggtgaagcaggctgtccatgttccgttcatggatgaagacactctgataacagctcactggtgcgaagggtttacctacactggaagtgagatcagagggagaatggcaatccccatctatggcaggtgtcaatttattgtctctcagcttcaaattcatccttccctgctctgctttgtgatactggaagtggaccctgtaaacatttcttcttagccagctgggtgaatgtaaacgtcatcagtagagggtgccagagtggtgtagtgccaggaacatccctgctgagttctggacttggctagttattatcat

SEQ ID NO: 189073 - DNA, 416 bp, Homo sapiens
cagggagtgacacaatcctgtgtggctcctgtgtggaggggccaggaggagaggagaacagatgagataaagtgttttgaaggtagatcctacaatattttggagataaagagattggatggaggacatgggaaaaaggatgacaggatgatggctcatcaggtttgtggatggcagtgccgttttactgagatgggcaaaactgggagaagaccagcctttaaaagtggaggggacaaagaaatcaaggagtaattaaaatccaggtatttgccatcctatcatttcttgaatgttctattttcaattaaaacttaaccaaactattcacttttacaagatacacgttagattcaagaacaataacgtgatcttttttgcctttcaggattaaagaatcgggttagtctacctgg

SEQ ID NO: 189074 - DNA, 164 bp, Homo sapiens
gaatagagtaatatctaattctacatttatgcaagaataactttactaagttttggatctttaaacaattaaaatatttactaatcccaagttgcaaacagtggttcaagtagaaaacaattttgtttggctggtttatttaatatttccacttcaagttcatt

SEQ ID NO: 189075 - DNA, 300 bp, Homo sapiens
tttcacagctctgggctcaccattagatctacttgacttccaccttcactgactttgtatctgcacttgggactctccaaaggctccaggccacaggtcctcagggctccctaggaacctgaccaaggcctctcccaaaaaggaggggagggacaggttggcttggcatcagttccatccttgttcccacttccccatcaagaaggccaagccccagctgactgggtgcagtggggtgtaaggttatccactccacaagatctaggccctgcttgatgtgttcattcattcactcgtgtg

SEQ ID NO: 189076 - DNA, 342 bp, Homo sapiens
gtgtgtaaactcattgaggaactttattaaaatgttcgtataaaatcctgcttaaactgcttgcactagaaatgagtgctggtagctgctattaaatccaccactgtggagaagaccaacaatcttgggtgttagattttaacaatagctgatggcctgagagaacctgacttgtttctttcagtgatataattgtattcagctgagctttaatgttgtcttctgaattatcctaaagtaaattatttctagacttactagtacatttaggtttaacctacaacagtattgttctcattactaacacagttaaattaggaggctgcctaataattagttttt

SEQ ID NO: 189077 - DNA, 686 bp, Homo sapiens
gccagtagctctgactcctgtcccaggttatgctgagtcccagcagggaaccaccacagctctgaatcagcctgttagccgctgtccattgctcttcatctgctctttatctgaaaatcttcagaagctttccttcaaatgagatgaccacagcagtcttctctgcaggttgcaggaaatgagaggtttggggaaatctgtactctttcaaagggtagataaatagtgataacttttacctgaatgctcacatgtgccccacactgtgagaagagctttgcatttaatccttacccatctctcagaaggagacagcgttgtcccatttcacagatgaggtgccagagaaagggcaggaaaggagctgaagctcttgaggatctcaggaaggatcagagtggacatcagggctgtggcaagtctggacctccttctgggagaggatctgaaaatgggaggcaggctggctggctgcttgaggcttgacagctctgcccaggggaaactgaagccagaaaggatagtagcaagtcccagcctcccagcagatcaaagcctattaaggagttagagggtccaagatgaacagatgctgtgacttgaatgctggggcctggactaagcatcaagtgacaagacctgtgggcctgtctctcctgctgcaggggccctgctggtcttgttca

SEQ ID NO: 189078 - DNA, 329 bp, Homo sapiens
tcatttacatcaaggagcaaccatgaatgtgccagtcgttcagcttttattatgaatgtacattgaatgcacgttcaaaacctaggttcctagcccttgattctttttttgtaaaaggcatgtaggacacctgtacacgttctgaggctccagggaggaaaaaaaatccaaagctatgtacttaacgtttagccaacaggagacttttatttcttttattatgaggccagtggagggaaattggtcattttaaaatataaatagcaacataaatttactatatatgaaaagatatataatcaaagacagaaattaatattccaagaaca

SEQ ID NO: 189079 - DNA, 506 bp, Homo sapiens
acagtttaacaattagggcccaccagtcaaacggcctgagaaaatacaatagcattagacatgatactagcggagaaaggtgtagtttgtgtcatgattggaacccagtgttgtactttcatccctaataatactgctcccgatggaaccataacaaaggcccaaggacttactgctttatccaatgagctagctagaaattctggaataaatgaccccttcacgattttaatggaaaaatagttccgcaaatggaaaggacttacgtcctcaatctcctgccatcagaataggtttgctcattcttgtaggatgctgtatcataccctgtatctgaggattaatacaaaagcttattttaacagctctcacccaccaaaatcttcctcaatcctccctcgcatcattcagttaagcttctaatttcagaggaccaagaggaacaaaatcaagacacgctaaaacaagtctgaagagaaataattataaaaatcaaaagggggaaa

SEQ ID NO: 189080 - DNA, 279 bp, Homo sapiens
aaggaaggaagaggaggtcttagggagtcagcattttgctggtttctgtcatgctctggacaggaagttaatttgtgccaagtataataataggtaatcctctccatcatgaaggggattggggaaatacccctgtacaccacatcaagtacatgctacgtcatgtaacagcaaaaacaagagaaagactatcattggtagagtgtttactgcatgtccatcattttccacacattatatctttccttccttctaccttccttccctccctccctctct

SEQ ID NO: 189081 - DNA, 490 bp, Homo sapiens
gatcttcccaaattttcacaacaaactttctgtacaattattaataacccaatttttacagagatggatttaagttacctggtccaaggtcaagctaaataatcaatgagcaccaagaatccacaccctgttctgtctgacatctaagtaaatcctctttccaatatatcattcttcttggaaatctggaatggattatattcaaaggagataggtatacactaaattgtgtctcccacctcaaccccaaagcatatgttgaagtcctaactcctaatgtgactctacttggagttagggtcttcaaagtggtaatgaaggttaaatgagattataagggtgggaccctaattcaatatggctgatatccttacaaaaaaacaaagagatggtagaatgttgtgtacacagagggtacagcttgaaggtagccatctgcaagccaaggaagacaagaccttgggagaagccaacccagcggacacattga

SEQ ID NO: 189082 - DNA, 825 bp, Homo sapiens
tgagggctgcatcaagatcttgtcattccacatcggggtttcctttgaggatgtggctgtacccctctcccaggaggagtgggactgtctgatccctgctcagaggggcctctacaaggatgtgatgatggggacctatgggaacctactctcattagtaggtgaatggttaagcaaactgtggtacatccataccatgggatacgactcaacaatcaaaaggaactgcccagacttcaccacgatgcaatatatgcatgtaagaaatctgcacttataccccctaaatatataaaacatttttaaaagaaaaaaaggaagaagatacatgcaacaacttggatggatttcaagggaattatgctgaatgaaaaaaagtcaacctcataagattacattctatatgattccattcatatgacattcttgaaatgacaaaattacaaagatggaagacagaacagtggtagccacaggttggggtgaggggataagaaagggatgtggctgtggctgtaaaagcgcagacaagggatccatgtgatagaactgttctgtctcttgtgatggtggtcacatgaatctacacatgataatactgcatataattgtctaaaatgacattttcttcaagagttatctacagtttaaagctcacttttatgaagtgtcacatccatcaccattttaagagacataaaatcatgaaaagatatcaccagaagctacgtaaacatttcagctaagggtaaagagaaagttaagagtgttttcacaaggaaattgaaagaaggcaatccgaatgaagtcaacttggtcacacaa

SEQ ID NO: 189083 - DNA, 166 bp, Homo sapiens
cattccgaccctgtaagcaccatatggtagaggacagtctttctctatgcaggctttgtgagaggacggggagtgcgagactgagggcactgccatgagaaactggaagccctgtcttgccctcttggaagggagggagtgactctgggaagtgggacagaagaaa

SEQ ID NO: 189084 - DNA, 382 bp, Homo sapiens
aagaagacacctcaggttctatcctgcttaaatgggcgagtaggaaaacagactccttgcacaagttctccctaatggtgtactcttcagcggcagtcataggcttttctgtcagttaatacacatatagaaatcatctcagctcactacctcctagcaatgtgaacctgagcaagttacctaagctttctaagcctcagtttcctcatctgtaaaacaaggataatagttgtaaggactaatctggagtagagtcagcaaattttccataaagcgctacaaagtaaatattttaggcttgtggtcagtctctgccactactgtagcaggaaggcagccatagacaatatggacatgatggctgtttcattaaaattttatt

SEQ ID NO: 189085 - DNA, 305 bp, Homo sapiens
attcgaatcctcccaacaacctaggaggacagtaccattaccagctccaccttacagatacggaaactaagacatgcaaggctaagtggcttgcccaaagtaaaacagggagcccaagatggatcaagaacttgcactcagcagtctggctcagagcccacactgcattcctcagccctttgcaatctcaaagggcaatggctttacagtgtggccacgagcagtagcaacaggtatcctcaggaaatttcagtctgcaaaagggatggtcactcttcatagattttttttggtaagggggtgca

SEQ ID NO: 189086 - DNA, 317 bp, Homo sapiens
aaaccctgctcttcaaagaacgattcgaatttgttgaagctccgcccctccgaagccacgccccctccgtaatccacgtctgactgtccagaaagcctccccgcccagaagtctgaagttcgcgtccttaggggaccacgcccccttaggagctttatctttgtgggacctgggtcatcagctgaaaagccttgtcgtcaatccctgaaactccacctgcttatattttcctgtcctttctctttttgggccttgggatcagttttccgagcactctcgtgctcccccaggtgggaagtcaaagttcccatctctgg

SEQ ID NO: 189087 - DNA, 434 bp, Homo sapiens
tcggcccggctggctcctcgccttgagaaatggatttccagcgatggaagcctccttccagccacacggaccacgggaaggttcagatgctcagcctaaggggaccgctgaggccccaaagagtatcctttccttctaaaacttacatggtaggaaactcctacagaggaagaaagccagtccctgcgggactcagaacctcgtaagcaacggcaggaggcacaaacctaggtggtgcgtttcttgcacaattttaccaagagggagtctgctggctccgttcctgccacaccgcctgaccagccctggaccactggacaggaagagacccctcctgaaaaccagggaaagtcatatctgagcaatctgtcacccctcataaagacatgctgccattcacaaatgaaatgccttttaagcatttgagcatattc

SEQ ID NO: 189088 - DNA, 427 bp, Homo sapiens
cattgcggtccgccgcatacagagcagactccgtctcaaaaataataatataataactagcactaacatgatgctacaatttttactggttaccaagttaaaatttctgagaaaggcttttaataaagttttccagacaagttataggtgaggtaacaaagagtccagaagtcccctgggtcagtttgatacctctttcctctggacttcaatttgcttatctgcaaaacaggaaatttgatcccttccaagtgtcaccagagtttttaaagataaaaatggaattcagatgcgaacttaatacagtgagcactagagggcagtagctggttaataagtacagcaattaagacaaatgcaggaaatgacagaaaaggcttttcttctccttcctcctcacctcttccttcctcctcacctccttccc

SEQ ID NO: 189089 - DNA, 521 bp, Homo sapiens
ttaattacttgtagagacaaggtctcactatgttgcccaggcaggtctcgaactcgtaggctcaagcaatcctcccttgttgtgctgggattacaggtgtgagccactacacctggccaaactcatgctttttaagacatatgtcttagctttatcctctgagaaagcctagaagcaatgacacccctgtggcaaagaacacacctgacacctaaattgtggtttctcaacaccattccccattaaaacaaacaaacaaacaaaaaatagggttttgaagaaatggctgattccaggggtctggagaaacaaaaacataaagtgagcttgaaacatcttactgtgacagaaagtaagataaggtcaaaaagttgatggagatgtagcaagagaatgcagaacccatcgcagacagttctactggccaaattagggacaatatgaacatcaaaacgatcaattacagaaatggattttagcatattgatttgaaaaagactccatgagtctgtactgtcact

SEQ ID NO: 189090 - DNA, 393 bp, Homo sapiens
agccttcgggaattctttctgttgctatactggggaaggcttcatgagggcagtaatatttgggctggaccttgaggaatgaagaattgacagagtagtagggcagggcagtatagatagaaggaatgacactaatgacagcatggaattgtgaaaaggtgttagctttggcaataattcctaatgatctagacttcactgtttccagcttctttctaggtagtctagttttgatgaaggaacatttattccctgagaccggaagcatgccttttactaatcttaagttggaagttaatcaaaataactagacacctaacctgctacttccccaatgctctaaatagacaacacttaatacatgtttttcacatcctcttgaattacacaatt

SEQ ID NO: 189091 - DNA, 212 bp, Homo sapiens
tataaaacaacattgggttctcccctctgccccttttaggtaccaaaggcctcaaaacagaaacaacactatctaaacagggctctagaaagacccatctggatggcatgagagattaaaggcagaggacaagtaaggacgaggaaaggatctgacttgagatgtcatcaatgtgaaaataataacaataatgagataacacttacagacta

SEQ ID NO: 189092 - DNA, 392 bp, Homo sapiens
tgcaggggtacaggcgtgagccaccgcgcccagcctagtattgaatgagataagaaatctgaaatgctttacctatggtagctgtccatcaaagttactttcatagaagctggcatcctcagttgcttttgtacactcaggaatcttttcaaagtttaagggtgataaattttatccaaagtaattactcgtaaaataattggatcccaacaattacacccctgtgcatctgtagaagtgcagacatagaagatgtgggacttactctccaagcacacaaaatctacttatagatttaggattctttcttttgaagtaccagaataccatattaaaagtgagataatgtttaagatgagaaggccaggagcaaggcaattatagacttgata

SEQ ID NO: 189093 - DNA, 320 bp, Homo sapiens
ccctcctacatcttttatctcacagtatgcactccatacacaatgaaatctgctattcctctgggctctccagcttccctgtcacagagctatcccactttctccctgggctcatcttaccacattactgtctgagtttagccagacattgttgaatttggagataaagttgaaatacatgaaagagtctaaccgagagtctggcaaatagtgtcagttaccctttccccaaatacccaaaacgttttggttttcagaaaggttgggaagtttcttctggggcctatttccttctttgttttgtcttaagtcttctagtc

SEQ ID NO: 189094 - DNA, 504 bp, Homo sapiens
gttctgatttggtttggtgggggagtagaaggatatggttttgacattgtcactcatgcatggtgttagctggggctcaatatttgttgacttaatgaacaggaaataggaaaagccactgaggaataaaagcataagtttttcaagaaagaggagatttagaaatattcagcagtatccccaactctccaatatccctatataaatctccattacataaagtcaatgagagtcttcatcacccccagctttgactgggttataaaatccaatttagacttggtcctcttcacatagcttaaatgtcagctttggagcagcagctagtggcagcaaattaattattagtgattttgatacctgagacctcatcttatctgccttaagttcataaaataccttggaattttagtttctgaaggagcaaatttgattatcaacaactaaaagacttctttagagggctcagagagaaaactgtgcttcaacttcagacaatccaac

SEQ ID NO: 189095 - DNA, 178 bp, Homo sapiens
gcagtggttagcacagacccccaacgaaagcattataatagcattcccacatgtgccaacgctacgcaaaggtatacacatgaaataacagtgccatcacacacacacacacacacacacacacacacacacacaggtgtgtgttgtgtggtgagtcgaagagagaaagaaagttggg

SEQ ID NO: 189096 - DNA, 245 bp, Homo sapiens
tatttccagactctgctattgcaggagaaaaagggaaaggggatttatgggtatctcataaattacataacatggaattctaaatactgataattgatttttgtaaatattaaatattttgtgagtcaaccaaagcaattgtctgacctgtgctctagatgattcctacatgggctttttgcaggtttgcttgtttgtttatttatagaccattattacagattgaaataattggtagcttttgg

SEQ ID NO: 189097 - DNA, 481 bp, Homo sapiens
ctcgagttatgggactgctgtgggtagaggtggctttttaaaaaattttctgccttagtctttatccctctctctgtcaaccccacacccactttaaaataacaaaagcctcatgtgttgcagcttttcatagtagggaccgaggctgcagggcactgccgcacctagtcatttggaggtcgttgcagccttctgcgccttgaagaagaaggggccagggtgatgatccctggatctcattcacgaggttcttgaccacttcctgggagattgcgactcttggtgtcctttggctagtagttgtcttgctggaaggcttaactgtggaagtgggaagcatagctgaccttagcacgtaaaatcctcgctctacactgggacaggattttgttttgctattgagaattcttaaatgaaatagataatttttttgtctcagatagataaaataataacgatagttgccattaactgagtctta

SEQ ID NO: 189098 - DNA, 520 bp, Homo sapiens
agacatggcccctgcccttatggggctcaccatccagtgtaccttatggtgaaatgctgtgcccctaaaagacattgaatgacagctccaattgagtgatcttactgggggacctattattttcaagatatgtactatttacttaggttacagtatcattctatcatcaaatttcatgggtaatttttatgtacaaaagctgatagattctgagatgagatccagcctgaagccagtcaggatgaaatgataaccctgaacatgtgatgatgaaaatcaagtgaaatgaacactatggatagttcgatattttctcacccacacactaaatgtcaagggatgttttaaagaatgctgttctctgtgcagctagagtaggtttttaatatctgcccatgcttaacaaaaactgtcaatattgcaaccttaatgatagagtgaaatggaagatcgcatgtagcaatgcattattataatcactaacacatcaggtgaggtatacaaattaacaatctcacag

SEQ ID NO: 189099 - DNA, 480 bp, Homo sapiens
  misc_feature (397)..(397): n is a, c, g, or t
tccaactgccttcagactccgggactttccacagccttggtgaagaaaaggcacatgggtcagtgggcgcagctccacagggtccacgctccaggagacactgcagggcgggtggccctgggctggtgtggaggggcctggccctccttgactctccctggcctcaggtctcctgggctcctgaggacagactccagggccccacacccagctgacttttgtcctgtcctgcccccaggtaagcttcccaccagctccttgatagcccagctagacaaagaccccacagcctccagcatcagccttcttgactctaagaagccctaattagcacctgccaccatcctcccagggaactgacactctgatacatgggaggatggtggcaggtgctaantagggcttcttagagtctgaaggcagttggagggcagtctggagagtctgaagggagtctggagagtctgaaggcagtctgga

SEQ ID NO: 189100 - DNA, 293 bp, Homo sapiens
tgtgtcgaaagatctggaagaggaggtacaaccgacaaaggagactgagaagaggctagagtttggaagaaaactaacaggatgtggtatgctggaagccaagttaaagaaaggtggggataagtgaactgtgtcatatattaaggactagcccttttagtcatttggaggtcattactgaccttgaacagttttaaagtactgattgaggcaaaagcctgattggagtgctttatagagagaatgggggagaaaagtcagacagtgtgtgtaaatgaggagctttgctatga

SEQ ID NO: 189101 - DNA, 263 bp, Homo sapiens
actcctccttcctcttgcttttatggcaggtttttcatttctaactcatagcatacatatctatatacatatacacccatacacgtatatcactaaatttattacagacaccaaaaaagggggtaaatcttgtctttctacgtatttagacatacatacaaaaaactcgtggccgggcatggtggctcatacctggaatctcagcactttcggaggccaaagcgggcagaacacttgaggtcaggagttcgagaccagcttgg

SEQ ID NO: 189102 - DNA, 630 bp, Homo sapiens
ttccaccttcctaaccaacagccaatcaagcagctaatatttagtaagtgcttactatgtgcaagacatcatgccacactagacaccagaggggttacaaaggttacaatctaattaaggagattaaatgctgacacaggaagacattaggaaataacacagtatgcttggttcctgatgagtgctcagaaaaggcttcccagagcagggagggatggcgctgagtctttgttttttaagacagtctcattctgtcgctccatctcaaataacaaacaaacatagtagagacaaggtcttgctatcttgcctagactggcctcaaactcctgggcttaagtgatcctcccacctaggcctcccaaagtgctgggattacaggtgtgagccactgtgaccagcagcctaggtactttttattaattatcttcaactcttacaaccgctatataaggtagataccattgtctccattttacaagtgaaaaaaaggaatgtcagagagaatgattaacttggcaacggccacctaggtagtgagtggtggggccagtggaccacccaggacaggtctggctgtctgactaggatctgtactcctaaaatctcaaagccttcatatgtccccat

SEQ ID NO: 189103 - DNA, 332 bp, Homo sapiens
gttggggagcacagaccaacagcaacaatctgtcaacagtgagcgggctcaaacagctgaaaaacataggcatgccatctttgcccactatatgtacatgggtgaaggagaaactggggaagacaagcagcctccagcttctatgtctactaaagaggaataaaaacatcaccatgcaccaaaaacctccattaggttgtttcactgggagaagggccacttacgacgttcacagggtattggtgaggtttctgggggtaacaagctcaagaggcttaaccagctcattttcctggtccttggcctttactatcctcttataatatagctca

SEQ ID NO: 189104 - DNA, 290 bp, Homo sapiens
tttcaccatcttggtaggctggtcttgaactcctgatcttgtgatccacccgcgttggcctcccaaagttaaatttattttatgttctttattggattgttctagtaactgaactttatagggtctaatgctgttgttagtttgctgatttttgttcatggtacattgcttcaattttgtcaaaaatttgagttcctcttcagtgagactttatcaatggacatatgtctctagagagagtttgtgattacttcttctagatatctttgggggtattctgaccaaagctt

SEQ ID NO: 189105 - DNA, 347 bp, Homo sapiens
ctgcgagtccaggggcttgaggaataactctgcgtcctatggaatgtttccattctcatcacacttacaatctgcatgcttgtgtatgttcttatggttgtaatttaatacaggaacttctgagaaatggtgttcaattcaatatcattaagtgactgcttgaatgtttatttgttatcatgctagccttgccaaaattccacatcttggcagaagacacatatgtcctatttagtgaaatagaatctgacctctaaaaagtgacacagtaaaaacaaacaaacaaaaaataaaacaaaaacacatccgctttgcaaaaagcttctttgcctagcagaccttttttg

SEQ ID NO: 189106 - DNA, 440 bp, Homo sapiens
tgaggcgatctagaggatccctccaactagtccaaaggaggggagaagacaggatcaaataatcgcacacttgcaggaaggtgagatgcacagtttggaggcagcataggggaagggcttttaacctggtccagaagcagctgatgaagtaagcactaaccggaactatcaccaagagtctctaaggcagaggataacaggccatgtgcaaaagtgcggtggggaggaggggatggaaagtacttgggacttaaaggaaaccagtgggcctaaagcagacacagtaaaaggcatgccaatgccaatgcctaggggacatgcagggcccatatcatgaggggctctggaggccgtggtaagaaattttgacttttatactgatagcaatgagaagatatcagagggttcaacaggaagcaataaagttagatgtggctttg

SEQ ID NO: 189107 - DNA, 567 bp, Homo sapiens
tgaggcgatctagaggatccctccaactagtccaaaggaggggagaagacaggatcaaataatcgcacacttgcaggaaggtgagatgcacagtttggaggcagcataggggaagggcttttaacctggtccagaagcagctgatgaagtaagcactaaccggaactatcaccaagagtctctaaggcagaggataacaggccatgtgcaaaagtgcggtggggaggaggggatggaaagtacttgggacttaaaggaaaccagtgggcctaaagcagacacagtaaaaggcatgccaatgccaatgcctaggggacatgcagggcccatatcatgaggggctctggaggccgtggtaagaaattttgacttttatactgatagcaatgagaagatatcagagggttcaacaggaagcaataaagttagatgtggctttgaaaaaaaacaaaaaaaaaaaccattctgccttctgggttaagaacagacatacggcagaaagagaacagggtggatgtgtataggctagacccaggaaatacaggaagtcactttagattagggtgg

SEQ ID NO: 189108 - DNA, 585 bp, Homo sapiens
gaagctgccgtactgttactccatagcagctgcactattttacatcccttccagtagtgcacaaaggttccagtggtgcacaaaggttccagttttccacagctcaccaacacttgttattttttttatttttttattttttatttttttaaatagtagccattctaatggatatgaatggtaactcattatggttttgatttgcatttctctgatgattagtgatgttgagcatcttttcatatgcttgttgtctatttatgtatcatctttgggaagaaatactttgttcatttttaattggattttttgattttttgctgtgaattgtagaagttctttatgtaattctgaatattaaccccatagcagatacatgacttgcaaaattgtgtttctttagagttgatttctttaactttattttgattctttaattgggccatctatccagaccaggctggtctcggactcctgagctcaggcaatcaacccgtatcagccttccaaagtgctgggattacaggcgtgagccaccctgcctggccgctgtggatttttaaataaacgtcctttatcatgtta

SEQ ID NO: 189109 - DNA, 406 bp, Homo sapiens
ccaccattcagctctaggctcggcctacacggtgcctcctcgggaagccctccttgccatcctccttcctggtccccgggtcaggccctgggttccgcacattaatatgctctcctcgctctctctctgtttcctgtttggtatgtatcacagctgcagttgggactctgaagttatctgttgaatgcccaagtctcttgcgtcccctccaggctgtcagttccacgacggccgggatttgcttaacgatgttcctgtgtccagcagcccagatctggagtctggtaggcaccgtagagatttgctgagtaacaaattaactacttttttttgcattttttgtagaggtggggtttcaccatgttagccaggatggtcttgatctcctgacctcgtgatctgcccg

SEQ ID NO: 189110 - DNA, 348 bp, Homo sapiens
ttgtatttaggcctatgatctatcttaaactactcttttgctatcatgtaagggtttctcaaaaggattttcaattaattgattagatagctgtgggtcttttcttggatttgttctattctgttgatttatttgtatcttcttatgtcaatgccacactgtcttaattattgtagctttataagattggtattgttactttaaattttgatagaattaatcagtgcagccgtgtgggcctggagtgtttttgtgggaaaaagcagaaggttttaaattagtgtaattacttttacaggtttaattactttagctgatatataagcattcaggttcttcactttttcc

SEQ ID NO: 189111 - DNA, 345 bp, Homo sapiens
cagtcacttggggtagaatgagtctggctagctgcccggcttctacatctgattttggctttgatgtcatttacaggttgccatgtactcagaaatgagaaaaatgactttaaaagtcccctcttcgtaaaaattatcctgaaaaaaaaaaaaaaagcagctactgaagttgataacagatgtgaagaagtctaagcaataaaaggttcttggctggaaaatatacatttcagataaaaaatgaggtgtctgggattgatgatatgaaaaagttccctatatgctctctacagatataaagcaaaagtgactcatgaaactgagttaatgctcccatcagtgaac

SEQ ID NO: 189112 - DNA, 382 bp, Homo sapiens
gggaggtaaccctcgctatcctgctgtgagaatataacatggtatagccaccgttggaaaacagcttgtcagtttcttcaaagctcagtgtagcagggcgcgatggctcacgcctgtaatctcagcactttgagaggcctcccttgatcatgaggtcaagagattgagaccatcctgggcaacatagcaaataagtacaatggtctccggttccccagtagtggtaaagttccccagcccaggaacgtttcattatcccctccgtctccactcctagtcacttcatctctgaggcctgcgagtggggatgggtgacagaaacggttccaagttgtatatatcattattccaaaccatcaagagccagggagggaagagaaaa

SEQ ID NO: 189113 - DNA, 354 bp, Homo sapiens
ttttcttctcccttatgctactttctggttaatttcttcaaactttttttctagttcatttttctagttcacctatttctaatctaatttatttagtttttatttcaacagttctaatatttccttaggtcttggctttccaaatctgcctggtcaattttgcatttagttgtgattacatgttttctttcttaaaatatttcatacctagtaattttatattctatatcagataattctaatatctaaagtccttagggttctaaatctattgtttttcacttgtttcttttcttcttttttttttttcttgagatggagtctcactctgtcgcccaggctggagtacagggg

SEQ ID NO: 189114 - DNA, 156 bp, Homo sapiens
acaattaagtaaaattgttctcctgctctcctggagctcagctctacttgggaagataatatattcacagaaatagctgtgatacaggcaatacattctcagggtcatgggagtggtagaggatgaggaccagtgagcagtggctatctctccttt

SEQ ID NO: 189115 - DNA, 426 bp, Homo sapiens
aggctatcagaggaagaggtctggctggattaacttttacccaaaggagaattaccaagagctgaagaagttcttcgattccctgcagcacagctgtgatattgatatagagtactaggaaactaaagaaacgtcttacttgactgcagttgtcacattatcatgcattacagtgcagcagcctgaatcaaagagatatgcaaaattcaccaaggacagcagcaatgcattttttccccctgtatttgtggaaagacatcaggaaaaggaaggcaagtatgaatgcaaaaacatctgctccctaaactcatttaaaaaatatcactgcaaaaaataaatgtgaatcatctatagtgtagagcagatggaagtgcaatatgtttaacttaaggcagaaaggggatgcaactgaagaaccagaggata

SEQ ID NO: 189116 - DNA, 406 bp, Homo sapiens
agctggagtgcagtggcacaatcatagctcactgaagcctcagactcttggcctcaagtgatcctcctgctttgaccacccaacataggattacaggcatgagccaccacatctggcctgtgagtttaatttggaacacaattcccatgtctatcttcaaggcctagaataatggacattgtgaatgtacccatagtttacctcaagtgctgggacagatttgaagtaggtgaagtttatcttcattgaaccttgtctctcttggaagaagttttgtcacatagaagttctgcctctggcttgggaaggcacgtggggccacacagaagaggactgtcctgggacatttgtattttggagagtggtttctgaatccacttttatctttctgtacttctctctgcta

SEQ ID NO: 189117 - DNA, 364 bp, Homo sapiens
gcttcccatggtgtgtatgataaaatccaaatgcctgccatggccttcgccctgcgtgagcagctgacccctttggcttccctttctgtcccctgccctgtgctcactggcctctctggtcctctgtcagggtcctttctgcttttgcattttctgttccctttaccttgaatacctctcccctacctatggtcacatgtgaattacgagttccttctcttagctcagctgccacctcaaaggccttccctggcctcaggtgatccccccaacttggcctcccaaagtgctgatatgatcaggcgtgagccaccgcacctggcttaagtcagattctttactgcttcctgcttctgcccccccg

SEQ ID NO: 189118 - DNA, 262 bp, Homo sapiens
ccacatcatcatatcttgcctggatttttacaataggctactttctgctcttctcattctttaggttttattcaactggtagcaagtaaatgttcaaatctgaagtgggtaatgtcatttttctgctcgacttctcactattttttttttcctcatctcactcaggataaaagccaaaatcattgcaaagataggcaagtccctacttacctttctgactttgtgttcatttactctgtctcttcattgctctgtctggcca

SEQ ID NO: 189119 - DNA, 446 bp, Homo sapiens
tcctaccccacgtcacccccttcaggaatacccagatgtcttcttcacctccttcaggtctcaacaactccctgaggtctattcaaatgtgttcttcagctccttcaggtctttacccaaatgccagcttcacctccttcaggtccatgcaaatgtcatctcagtgaggccctctctgagcctgcttctcctccaaccctttctagtcccttttactgccttattttctttattgtttattgtctgtctcccccacttgaatgttggttctctgagggcagagaattgtctctggcttatgcatagctaaatccccaaccccagaaaagcacctgacaatgataatcatgcagtaagcactcgctggatactttctaataaatccttctctaaattagctctaatgtgtcaacagaggacaaaagtactagtccctgggaccagtg

SEQ ID NO: 189120 - DNA, 252 bp, Homo sapiens
tgttttactttgaacatacgttcaaaaaccccacctttgtgaattatgggggatcccaagacagtataaatataaacctgtttcagtttaaataaaacttatatatcttctatgaatattcaaatgacaataaaatgaacagttagtcacacaatatatataagctaatactaaattatggaaaagaggcatgttaatccacaattatataaacatacacagatcaaaatcactacattgaccaagaatcca

SEQ ID NO: 189121 - DNA, 603 bp, Homo sapiens
tgctcgtaccctctaatattctggtctttaaagagtactgcagatgatgtcatgttttgttttgttttgttttgttttggctctgggtcctcaatattaacatccaagtctgggcacggtggctcatgcctgtaatcccagcactttggcctacttcctatgccatcaagttcactgccaatataatgctctctaacttctttgcagggctaaacacagcagagtggggaaacaagttccttcctccttcccttggcctcccgcagaggcagatagaggaccaggaaagaaagctctgggaaacagtgtgaaggaggcattcacatttcaaaagacaattctagttcctagctcaaggcaaattatggagattagctgtatttttttttcaaaatgtattacttacaggagaaccttaaaaaaatcaaatatcctattaaagccaatgcctttgcttggagacattttcaaggaaactttaaaatgcagatcagtttatgtatgaagttttttttttttgtttttttttttttttttttttggaaaagggatcccccccttttgccccggtgggacaactcatctttgtaaacccataattaa

SEQ ID NO: 189122 - DNA, 694 bp, Homo sapiens
tttatactgtgaacccgattatattaaaaaactcccaaagagcaagtcaatcacttttctccttgggcctctttgatgccatttagaaaggtatcttgtcagtggagtactggtacctgtacctccctgtgatctatatggtctggggcaaggtgcaaatcaaatgccccctgccttctgtttgtagaagaagaaaagcaaaagacaggaaaatatattcatatttactaacctgggactttctgattggagactgattatcacttgctgttcaagtttagatgggtcaacaaaaaaatgtatctccatcctcaggaacgtcattccagttgagtttgattttatttattcatgtgcttgtaactaaaagtttcctctggaaggaataaagttataggaaattaaacaaaattattaacagtttctctgtcttcttaatgccacaattaaatattgctcccactaattataatagtagttatccttcattgaataattagtatatgttaactattgtgctaagtgctttacatgtttcatctctttttcatttttaaaacaatttgcaaggaaagaagtatttattccctattttgctgtaaaggaaactgagactccacaaatgacagatctttacctaatttcattacaatgtccttcatttaatactctgcttacctgacacgcaactctg

SEQ ID NO: 189123 - DNA, 319 bp, Homo sapiens
acactgggtaccctttaggttgatcctagaatgatcaattcttatcttccttttaaaaattattctctcttttcaaactgttctccataatattttattaccatttctataataaaaaaaagttttattttattacttaaagcaaaaacatcagcattacactgtaccttttctggctatataaagttcttgtttacgtttttatgctaactttttgtctttacatatgaaaaggacacaaagcttaagtagtgatatggctgggtgcagtggctcatgcctgtaatgccagcactttgggaggccaaggcgggcagat

SEQ ID NO: 189124 - DNA, 695 bp, Homo sapiens
ttgggtaaagaatacttaacatgcaatactctggcttcctgacttcctctcctccattgatttatcttagccattcaactctgtggcatatcctgtgcagatgcttttaaactctcagggcatctgcattaactggggagctttgaaaaactatagatgcctaggactcactcccagagattctgatttctttatcagtttctgacattttactctccacctaccacctcctatttttctggcttacttctagtacccaagagtcttaattctttcatctcactgggactttctcatttgccaccttttctgttacatcgtaccctcatatcctcatttccttttccaactagctgagttcccaaagcctgtcattacacttgctcttctgagtctactttcaaccctcttgacttctctccctgagttgttcttgcttggccaaaccttgatgaaaaccaactccatctgttttatacctgtatacttgtaggtgaatatggctcgagcaaacagctatgttgactttcaattcttggctagtacttaatgactttaagttcatggtttagtgctgcccagctgtcttgttaactctagttctttcacgttcccattgcttagatgattatatctttcccttgcattcacattgtcagtatttccattccatcttctctctcagctgatgacct

SEQ ID NO: 189125 - DNA, 361 bp, Homo sapiens
aagaggcagctcatctgaggacagaggaggaaagagggcactcctcatcacagacaaaggaaagagagcaccaacttggcttcccccatgcatcactgcaaagtaaagttttaaacacaacacagacatcaggtagctacagacccgcccgagggtaaatagggtcaaccccagccacgatgcccagtgagcacgtaaaatgtgctgcgtctgaatggagatgtgctaagtgtaaaacacacaccaactccaaagacggtccctccaaaaatgtaaaataccttattgatgattgttgttattaatgttgaaataatactttggatctggcaggttaaaaaatgtattgttgaaactaatt

SEQ ID NO: 189126 - DNA, 603 bp, Homo sapiens
tgcaagaatggccacaatcaaagaccaccacagtgcctcaccctgaattccttccactccatgcttgacaactgcctgttctacaggagcaatcagggcatctgacaaggggtcccttgatttttcctctccacctcaaaatgtctccatatctacactatccccttatctgctcctccttacatagaaaggtcacctgtacgctcctctccatgtctcttctttttccttgacctgtctcaactcacttcccccaacacctgcaccattagttatctccccctccagctgacccactcctcaatctgcaaacaggccaatgcattcctcaataaccttcccgtgaccagggtgagatacaatctgtgtcttcacatcaaactttctgaaaggatattctcatgggtcaccttcaacagctcaccgccctgtgactccatgtccatctgtttggcttccgacctgctcctcacctagaagtgttcctccagtctctgaacaaccttcttctgtgactctactaccttctgtcgtcttagcatccttcagtgcactgggcatcgagcctgttcaagggggcatcctctcagagtcgcagctgcc

SEQ ID NO: 189127 - DNA, 864 bp, Homo sapiens
  misc_feature (854)..(854): n is a, c, g, or t
tgcaagaatggccacaatcaaagaccaccacagtgcctcaccctgaattccttccactccatgcttgacaactgcctgttctacaggagcaatcagggcatctgacaaggggtcccttgatttttcctctccacctcaaaatgtctccatatctacactatccccttatctgctcctccttacatagaaaggtcacctgtacgctcctctccatgtctcttctttttccttgacctgtctcaactcacttcccccaacacctgcaccattagttatctccccctccagctgacccactcctcaatctgcaaacaggccaatgcattcctcaataaccttcccgtgaccagggtgagatacaatctgtgtcttcacatcaaactttctgaaaggatattctcatgggtcaccttcaacagctcaccgccctgtgactccatgtccatctgtttggcttccgacctgctcctcacctagaacctttctctccgcactcactaacaaccacactgatgagctcttactccccagcccagctgcacctcatgcaccaataggctgactctacatgccttcaattctctctcccctggtcctctgtgacaaaaccctttcctggtacccctcctactactccatcgctttcctttgcatatacccaataaaataaggaattatctaaaagttctgaccatcactctctttctagctgtttctccttgggcaaattaatctgtctctgagctggcttcctcctgtcagcgttaaacaggttcacaggtatcctagcattttaggacagagtttgacacattagtccagtggtcagttaagctagtagctgactgtcaccnatcttctttc

SEQ ID NO: 189128 - DNA, 327 bp, Homo sapiens
ctgcacagttcccactttttgttcaggcataagatgtctttgagaagagaaaacccatgtgagtaaatattgagttgtaatctgtattcggatttctggattttttttggtcacagtggttctgccatctagccactgaaccctcccaacctttccccgtcctcagccctcatctgtcacgttcagttaccacttcttgccagctttaccttctagatagttcttgacttcatcctctcctctccatttgtattgccactgccctaggtgagatcgtcacttctctctcctcagttgcttgtctcttccttcatcagtgatgtattc

SEQ ID NO: 189129 - DNA, 1153 bp, Homo sapiens
agatagcgagtgatcagcatgtatagggtattaagcataagaaggactttggattttatcctgtgtgagatgggaaaccattggagtgccagagtaattttttcttaaagctagtctgcttgtcatttcttttcttaaaaatgcctcagttccctgttgcctttggaataatgttcacgtactttactttggcacacaaggtccttcacagtcaggcctctgcctgtttatttagcatcatctgcttctttcccacatgtacccttcactttagccaagtgggatcacatgcagctccctggatgggtcatgatgctttgtgtcttcgcgtctttctgtaccgtttgccctgtgagaagccctccccctcagctcacatggtcactggctctgttttagagggtcctctttgtgctcttgctctctcatcatttccacccggagccactttgcacttaagctgcttaggcttgaaacgtgctgtgttcttttaccagccttgattttactcttgccacacccttgccggttgaaagtatgcctatccagctcagacactgccatcttctgcctccttgggaccctcagaaacactttgtagctctcttctacctaataataattatttggaattaaaatgtttctttgccttcacaaaaaatccttgggctaacttatttcagttttctttgtagctcctagaacagggtcttacagacatttcatattcagtaggtattcatggtgtgtaggattcatagtataattagaaaactattggctttcaaacaactaagggccaaaagcagcaaaaatgaatgcacaattaaaatgagttcctattaacaaaacaaatttactgtaattatgatagctaggtaatccttgttctcttatatatttatatatacttactagtggcaccaaatattagtatacccagtttgagatgcagtttgttgaaatatatttggacacagccaggcgtgatggctcacatctgtaatcccagcactttgggaggctgaggtggcaggatcgcttgagcccaggagttcaagaacagcctgggcaacatagtgcgaccttgtctctacaaaaaaaaaaaaaaattaaaaaattagctgggtgtggttgtgcatgtctctaatcc

SEQ ID NO: 189130 - DNA, 834 bp, Homo sapiens
ataacagtcctccttaccattgcaaggcaaaaataatttctccactaaattcaccacaggataaatagattgcagttttaaatttaaatacctgtgatagtcattagatctcatcgtagatatgcctgttcccctctccctctaggctcacgatagaaatgcacttccccacctactctgagcttacctgtgtggccatgtgacttactttggccaacagagtgtgagcagaggtatcatttctggaagaatgttttaagtgccagtgcatgatttaccagtatcttttccctgacctggtgattatgaaaacacatgctaacatggggtttccgttaggctgggtctcaaagggatcataagctgagctcctgtagacatgaagcatgagggagaaatgaacttctgcctatgggctaagattatattcactgagagttggggctttgtttttcttatgttactgcagcaaaacctactcagtctaccatgaaagatacaataaaaaaattcatgtcacatctaatactttattttcacctcagttaatactactccaaaaaacaggcaaggtacagattagagtccgcagttcgtcaaagagaaagctgagactcagtgtcagcagacctggtaagaatacaaaccagaggttgaatccagttccagcattctttccttataagttgtttgtaatagatacaaagtgaatataagcatggacctaatagtaaggagaggatttagattttaaaagggtttactgcagcataatcttggtatggtcactactagggacattaataaattggatttgaaaaattgtcattacat

SEQ ID NO: 189131 - DNA, 569 bp, Homo sapiens
caaaacaaggaaatttgtgtttttataattataaaaaagtgttcctgtctgtctaggcttgtacctaaatgggagactataaactctattgtccagtattttactgaaaactatgtatgacactctgcagtccattgtgacattcctacagccaagaaaaataactgaaaacactgaacgtgtcagggattcatgataaggattcatttctggagcaaagactggtcttgtgaagaaaggacctgtccccttctcatgcatgggattctacccccatcccacacaccagaagcactgccaggacatctctgcactatgctgtgaggtgggtggtttagggtaccattgttatatgacttttatcattttagttctgtacatcctatcttgggaagtaaatttttggttatttcttttcattttaccttttcttcttgtttaactttaaaatggaaaaagaagcaaatgttcacaataaactttactgtttaatctgaaaaaaaaaagaaaaacattgcagaatgatagccacagttttaaaaataagcacattataaagataataaaat

SEQ ID NO: 189132 - DNA, 342 bp, Homo sapiens
cttgaggacacaggtgaacagatagatactctatcctactggcctagacataagtacacagagataaatacaaatacctgctcccagcacactacacagacacactgcaaaaatctacatagattgccattcagatggttactacataggtcccaagtagcttttgaatctgtccccttctcacgtccttcccctaccaacccacctcaggagcctgtggctgccctgtgaggcctcatccctctcctgcttgacccttccaggcctctctccacacaatagccagagtaaccattagagacacctgaatgttcctggcctgcttcggctgaaattccccca

SEQ ID NO: 189133 - DNA, 252 bp, Homo sapiens
  misc_feature (1)..(1): n is a, c, g, or t
ntctagcggatcctgtcgatcactgtactttttctcttttttgatactcagttttctaaacaatcaaaagacctaaaaagacgacatgagaccaacagaatctttttttttccagcttattcaaaaggtgagcaaaagtcttttgttatcctcattaatattatatgaacatcttgttcaaaagagaaaaataaattttacctttgcatcagtatattgtcagtacagtgatcgaccaacgggtacgcgagc

SEQ ID NO: 189134 - DNA, 191 bp, Homo sapiens
atgtaccttcctctgccaatcaatggggaaaaaaaataaaatggatctttcactataccttaataacttttaattgatacatagtatttagatgttatttctcaaaggatatgttccttggattcctttacatctctaacaaactacaatgttatacaaaacctaaaatgcaggtaacattagaagttaat

SEQ ID NO: 189135 - DNA, 282 bp, Homo sapiens
cccgctccttaggtgtccccttggcctctgggcccaccctctacaagactacaccaccactcccagctccccagcgcgtcggatatccacgcacaccagtcacagcaccggctgcaccacactgtcgggtatgcttagcctctcctgcccagcctgtgagcccttcacagcagggacccaggcttttcatctttctcctccctctgaagctgccaccatacctcctgggggatgacttccacacccaccaggctggccttaggataccaaagccacccataa

SEQ ID NO: 189136 - DNA, 495 bp, Homo sapiens
cagaagatcactgaggaaagagcttctgtccaagagcagaggaggatacgaggctcctgccctgtggattgtacaggtgtttagtgcaccatctcacaggctcaacaggactgatccagggccattttattaatgttaaaacttaggggagctaaatgagtcttaatatcagaaatatggtaaccaagaaaaagtgggaggccaggcaccgtggctcccacctgtaatctcagtactttgggaggctgaggtaggagggttgcttgagcctaggagttctaaaccagccttggcagcacagcgagacctctgtctctacaagaaaaaaaaaaattagtcagatgtggtggtgcatggctgtagtctcaaggggctaaggcaggaggatcgccttagcacaggagtttgaggctgcagtgagctatgatcatgccactgcatggcactgcagtggcactccagcttgggcaagaatgaagcactgtctctaagcca

SEQ ID NO: 189137 - DNA, 285 bp, Homo sapiens
actctagagtatcccctgtacgggagtgggagaatgatagcaagatcaattggttacaggtcctggtgggggtcaaagaactgttgaagccaggactggagggagtgcattgggaagaccagcagggatggcatagaggggaagaaaggacacacccagagagttgtggttctgtagcaagggcctgggacctgagtgtccctcatcacagggcagaagccactcctggaactgggctattgtgcaaatcatccaaaatcctgacaggctttgacttttgtctcc

SEQ ID NO: 189138 - DNA, 653 bp, Homo sapiens
tgaatgtcacttaccctagagtgagtgaaatagagatgccaggaagatataccaggtttatccagtttctttgcatttttctggcatactgtatactcttgagcgcatatgtatcctactttgtgaaatctgggggtaaagcaggacccttcaaacccttaaaaaatgtataccccaagaaaaacatttttaaagcatgaacgcttcctcaagtaaatacatatttatacattatataaatgtctggctattaaaccatgtatgcatatgttaactctaagtaaagcttattatatgttttttagcccataaatatggagatgttttaaaatttcttccagtgccccagtggatgatcttacacctcccgtgcttctgggatacacacacctaattttgcagaccactggtccagaatgtaaattgaagagtttaatgtctaagatatttgttcttttgtttgtagcttatcttttactccccacatttcaaatatccgtttgcaaaataatttttgagttaaaattttcaattaaaaaactgtatccttgaggtagaaaagataaagatagaagatatatgtgaattaggttgtatctctccttaagagggaatactgttttttatctaaggagaactaacaaccctccctt

SEQ ID NO: 189139 - DNA, 230 bp, Homo sapiens
tccaggttagcaacgtcaggaagccattatcatctccaggtctaaaggggctagggaagggttattagaacccagaaagatgtgtaactatagatggctggcagagagggccattattgaatacaagttgtgaactactcacagaacagctttggcaacactaaatccagcaagagggaactagcttttagggagatcctttctgatgtccctcccactgggcaaagcta

SEQ ID NO: 189140 - DNA, 188 bp, Homo sapiens
atctcacctagctatacctggggaatctgcctgatagttccattggggatcctctcgaggaactgctctaataccttcctggaggtctggctcatgaagccggtggttatcagcatgagattgggctagagaaaaaactcattctcgttcacctggggagagggtagaagtcaggatgacatttaagt

SEQ ID NO: 189141 - DNA, 142 bp, Homo sapiens
gataagacacctcgggagactaagaaagaagacaatggggaggcagaaacatggaatctattcagacagctaactctccaacctcctaattaaccttatcctcatccaccacccccactcaccaccatcaccactgaagaca

SEQ ID NO: 189142 - DNA, 368 bp, Homo sapiens
tttcaccgaatacgtatcagagcatatctgttacctagtaagaacaatttcccaagaagacattacaatcctaaacatgcctacacctaagaacagcacatcaagctccacgggccaaaactgatagaactgaaaacaggcaaatccactattatagctgaagacttaaacatctcctacatcagtaatgagtagattaaaatggcagaaaatcattaaggacatatatgacctgagtcacattatcaatcatttttaactcattgacattatagaatactccatctaacaatggcagaatacatatttgtctcaagctcacatggaacactgatgaagatagaccacattctgggcaataaagcata

SEQ ID NO: 189143 - DNA, 226 bp, Homo sapiens
ccccgaccccatcccctggcaatcacttatcggctttctgtctctgtggttttgcgtattcagtacattttatgtaaatgggatcatgtgatacttggctttttctgctgggcttttattaagcatgttttcaagatttcatccatgtagatgaatcagtactgcatgccttttcatggctgcataatcacgtgtttggatggaccatgttttgtttatccatgta

SEQ ID NO: 189144 - DNA, 402 bp, Homo sapiens
tctgacactctgacgcaccactgccaatgctgtacgtactgcatttgccccttgagcaggtggatgtttacgtgtgttatataacttcctggctccttcactgaacatgcctagtccaaacaattttttcccagtgagtcacatcctgggatccagtgtataaatccaatatcatgtcttgtgcataattctccctaagaccctaggagatgcttaaattaatatttgagatcttcctctttttaaaaactgtataggcaattataaatttccctctaagtactgctttagctgcaacctgtactttttttttttccttgcgataggatcttgctctgttgcccagactggagtgcagtggtgcagtcacaaatcactgcagccttgacctcccgagctcaa

SEQ ID NO: 189145 - DNA, 725 bp, Homo sapiens
atttgagctctgttctaagtagaacgtctccccttctttatggactagttttggtgtaaagtgctcctaaatgaatgtttttaatggtgttttgtatcttggcctgaatgtaggtaatgggcttttattgcagaattactttaagactttctgtagatgtcaaaaccagccaaacaagtgaaaagttttgattaaccagttgtttaaattttactcaacaactagtttgaccagtttggaatggacatgggtagtgagtgaaaggacctatttctgtcgtataggaaggacatctgaaccagtgagttgtccccccggattgggatggaggggtgtgcatgttgtgtgtattgtgactgtgtgtgctccagagctctagggttttgtcatatcaccctgacacacatggtgcttatgttgactgttgaggatgttgaatatggagggataccgtttatcctaaataaatcccccttgttaagttctggggtgatgaaaattaattggccttgtaaaccgtgaaaaccttgggtctcaagccccttagataccttgtttgtctactgagaagtatatatcaggtcttgaatgtccaccctgacattttaccatatggattctaggttttttttttttcaacataaagtgtatggaattttaaagcttcacttaatgaaatttgctttgttgaagttctgttttgctttcgaatctgctaacttgca

SEQ ID NO: 189146 - DNA, 452 bp, Homo sapiens
tcctcacgcatgctttcttacttgagattgcagcgaacttctaaggtgggaatattatccccactttatgacatggggtgtgagctgagagccagaggttccaacagccagcagctggttggtgtctgtttgatgatccgccaccactgtttgaggggggaaaatagggaggaaatcaaaatccagctgtggatggagatggcgtgctgtcctccatgcatcctgctccaggtccattgtctcccaaagggcatgtctgctgttccagagaaaagtcattcagtgatacttgtgaaaacatatgaataaaggaagactttatccaggaccatcacaataggtatggggaccacagcaacgggcttgcagtggtggggggagattgggctcaactcccaatacagcacgggcaagtgggaatttgtagtctaggaacagggtagggggtcagt

SEQ ID NO: 189147 - DNA, 494 bp, Homo sapiens
gatccctcctgcgggtcctggttctctccacacgattattcataccgagtgcgtcaccttctgctatggtgtgatcgtgtgacacctgggcactgcgactgcttcctctgatgcgcctgttctctattgttaccccctcacctattcaatctgtttagctcttcggtcatgaatatcctgaagtcaggtccagtcccctcgtctatagtcttccccagtcttacctgtcttcgtgttttgaccttttctgccttgtcgttatatctgttgtctctgtgactgggcaccctctcgcgaggaagaccttctgaaggtatagtgatcctcaaagtttgtacttgtggcaccttgactcctggagatttttgtctcagtctgatttaatcagtgatttttcattctgtatttaatgacttctggtttttcttgagtgagctaattaaaaaaaaagttaaatggttgagtttctttcatattacttgcttttaaaaaga

SEQ ID NO: 189148 - DNA, 462 bp, Homo sapiens
caggaaggttcattaactcgtgcaaactagaaagtggtaaagccaagatgcaagcctgggcagtctgtttcaagaaccttgctctcaatatgcacaaagccacttgtctgagccagaaagaaagttaatggagatgctagcaagtagctttggtcagttgtgaaaagagttgtggttaactttttcaaattaccatgggatgacattgaagatccattagatgacactagaagactttcatgagattctagttgagggatgatgatggctcagatcagaccacaccatggatggggacattcaggatgcgttttgtaagtgtaaccaaaatcacttcttgatggatttgatttgggaggtgagaaaatagagaaacatagaatgaaatataagattttgggcttgagcagtgggtgaatagagatattatagagaagatgaagaatattcaagaaaagatag

SEQ ID NO: 189149 - DNA, 274 bp, Homo sapiens
ggcctgtgacaccatcaggcatgtgtgactaccaaagctcctgtcagctgttttattttatctcctttccattctcagtttgaatgcagtaagcttgaggtgagcctgagatatttttggaatttaaccaaaggaaggggctgtcaaacaaagctagttcagagtcccaggatttgtatcttttggagtgactgtgccctcagaaacttccagagacttttagaactcattcaggctttggctttggcagttgtaagaagcaccacaatttttt

SEQ ID NO: 189150 - DNA, 568 bp, Homo sapiens
tcgactctttaggatcccctgatcttccgtccctgcagaaataaaactaagtagggggaagtaataaaaacaacactgagttctcatcagaagtgctggaagccagaatacagtggagtggtgcatgcaggctgctgaaagagctgtttcttctgcaggagatccttcagaatggaagagaaaagcagatacttagccaacctagagaatcgttcagcaaatacgtgtcacaagaaatagtaagaatgtctcaaggatgaaaataaatgatagcaaaatgaagcccaaatttttaagaagaaatgaagaatactgaaaagagtaaatacaagaaaacgttttagaatctgtcaatatgtagacatgtaaatatttttagtttgttttaaaagtattaactgtttaaaaatatgaacagctgaggtgttcgtagcatgtgtaggaataacagatgagacaacaggaagttgggccccggaaatgcactgctgcaagaatcttcattttcatagcacataacactgtgtgaagatagaatgcaataaatcattcaaaaaatacacagagg

SEQ ID NO: 189151 - DNA, 360 bp, Homo sapiens
agcctgggcaacaagagtgaaactctgtctcaaaaaaaataataacaaaaaaaaccccaaaaaactgggactatctctgcaagtgtgagatatacatggtcaccagagacatgcatgattacagctggaggaatggttaagagcaaaaaccagagggaggccaagcatgtgtctcctgcctgtaatcccatgactttggaaggctgaggcgggagaatcacttgagcccaggagtttgagacagtctggacaacattgtgagactccatttctacaattggaaaaaaaaaaaaaaaggctgggagtggtggctcatgcctgtaatcccaacactttgggaggctgaggcaggcagatcac

SEQ ID NO: 189152 - DNA, 467 bp, Homo sapiens
taaatcacagtaaccagatggggcgtgctaacagatctttttacccagttttcttgacaaaccaagagtatctctccccaaccagattttctcctgtgttgcgttcagcctcttatttcttggttagggaagtaggcttcacatatttcagctaaacactctgcattttcagtttctctgtacaattcatgagttttcactgccctgggccccatgtttctcatcaattcaagtctacactcatggtaagcaccctagttcttgttttttctaacacttaaataatgaataggacttcatctcctagagctattctccttactctattacaacagttattagtgagttttaattagacaaaactgccattccttttgctacctcactatactgtcaagcacctattaagaatattacagtagtaagtattagcaccttttaaatttacattaacaataacagagaaa

SEQ ID NO: 189153 - DNA, 478 bp, Homo sapiens
cactgagaaatgttgttcacattaatgagtagatagaatgaattttattccacgccattcaaattctctgaactccttttgagttatatgatagaatgtaacagtgaaccatcaaaaaaatttaacaatcagtcaacatctacataaagtcctctaaattttgttgaaagcaagtaattgtacttgtggaaagaactgactgtgcctgagtcattcgtgttctcaatccagtatctcatagtgtccctttatgatatcaaacattttgtaccatggtaatattgcatacaagtgagaagtatgctgttctgtaaaatgggaggttgactataacggagaattacagaaaaaataatgtgtacttctatcacaggttacattctcagatcagctgaaggaaagagtgtatatggaatttaaagatatcgaaatggattcctttaaaaccatccatgtctatgaatatcatgtaaagcct

SEQ ID NO: 189154 - DNA, 855 bp, Homo sapiens
tgtggctcttaagggttcatgaaatgactgaatatgaggatacatgtcctgtagaaagcaaatgcgcctcatatactgccaaaaatagtgttagtttcattaatgtgaattttccagcattcagtagttgtaatgttagaaacaattgctggtcaagttcaacttgttgctattgtttttaatttgcacaggagtagtatcagaaattagtgtcactgcttgtatctagctgaattttaaacaacagaacattagttttttatgttggtgccaccaactgtaaatgacataagttagttattacaaaacacagtaattagactgttgcaaccatctaaaaccttaggcttccagtctgtgctgttagtgttaagatgtaaagtgcaatcctaagctaacattatctgtgcaagcaccatagaaacatttgcatatctgcatagatcttacaactgtactctttacctccttgtgataaagctttgtctacctgcaaacacagtcaaaggctacagctgcaaaccaaagccaactctaaccatggccaagagctcaaggacagaagcagccacatgctttggtcagccttctgtaacttcaattagtacaaaggaaccttttccatgaactacctgctgttttctgatgacctctgggatcttttcatttagccctaaacaaagaaacaaatatgacaaaaccacaactaaaaaatgttaattcagtcacagagtaatcttctgaggccaaaagtccatctaaatgcaatgaagatttgctttcattaaagacagaggtgaggacaaaatccgcagtggaagttatgatatgctagaaagcaacaaatgtggatca

SEQ ID NO: 189155 - DNA, 469 bp, Homo sapiens
cggccgcgtcgacaagctccagcccagaaagcacctgctccaccctaactcattccgatcacctgctccaccctcattccgaccacctgctccaccctaactcattccgaccacctgctccaccctaactcattccgaccacctgctccaccctaactcattccgatcacctgctccaccctaactcattccgattacctgctccaccctaactcattccgaccacctgctccaccctaactcattccgaccacctgctccaccctcattccgaccacctgctccaccctaactcattccgatcacctgctccaccctaactcattccgatcacctgctccaccctcattccgaccacctgctccaccctaactcattccgaccacctgctccaccctaactcattccgatcacctgctccaccctcattccgaccacctgctccaccctaactcattccgaccaaatc

SEQ ID NO: 189156 - DNA, 435 bp, Homo sapiens
cggccgcgtcgacaagctccagcccagaaagcacctgctccaccctaactcattccgatcacctgctccaccctcattccgaccacctgctccaccctaactcattccgaccacctgctccaccctaactcattccgaccacctgctccaccctaactcattccgatcacctgctccaccctaactcattccgattacctgctacctgctctgccctgattcccgccaaagcactcatcctgtcattctctttaaattagccaatcggaattagtttagcctgtgcggtcttaaccctacccaataggggaacaacgcagcagcaggggccacgtgcgtcagggtaagaaccccttcccctcccttgtccaagtgtacgctcaccattattccatctgtaagggcgcacccttctatatagaagtaccttgcctt

SEQ ID NO: 189157 - DNA, 605 bp, Homo sapiens
aagcgtgggggtggggatggtgacttcagagctgctgtcgtcaaggcagaggctgaaggtagccccagctgcctgtttctagaccagagctccacagtggcaccaagcaaagccttcccctgctgcaggtccctgggccctgcagggttaggatgagtcctctccctggtccctgggcaggtggcaggaggatgtacagagaggaaggcgctgtggggcctgggttgcctagcacttggtgtgttttccccagtgggcagcatggagcagggaggagcccagggaggtggggaagtgctggcctgtgtttgaaaaaggagcacgcagaggtctgagcacccactgcctgtgggcacttacattcatttcacaaatgaggaaaatgaagtaacttgccccagagagcacatttagtgagtgttggggctaggatttgaacacagatctgattccaaagcaggcctctttgctgtccctttccttgctgcgactgatacagaggaggggagagagagctgtgtggcaactgatttcctaaggctgtggaggtgactttcccatgggcatctccaagcatcagcagttgtggagccaggaaaatggga

SEQ ID NO: 189158 - DNA, 438 bp, Homo sapiens
gaggatccccgtacagagtgaatgttgagggaatccttcttcctgtccatattaatttttttccacatgaaacatattattgttcccttcagactatttacaactgtagaaacatagagttttctaaaaaattactctgttctagtccttttatttctcaagatcaggaagttaccagtgctctcctaacaaaaagtatagaaaataaagtaaaacaccacaaaacttaacacagtgttagcatttctaagcctttactaccttatcattctcaaatacatcacatctgatgattccttaaaagattagtaaagattaccagatttcaaggcaaccagaattttgaaacatagcaacagttcaacctctatgaatgtagggtggttattttttcttctcaagtatcactaccaaccaaggttaataaatagcaaccat

SEQ ID NO: 189159 - DNA, 598 bp, Homo sapiens
taatcacactagtgtaggctatactcgctgggtaaaaacaaaacagaagttttatgtttctttagttactgcctttaaaaagttgtcagatcttcccttcccatcttttaatggcatctttggcattaggccataattttcctgtcacttggaatgtaacaaagtttggtttaagcttccatttattatgcagtttcacccttatcccctcccatcacccacctgacccctctccctgaggagggaacacagttaccctttctcccctttttgggttgctttttcctcttggttgccactgcttctctaaaactaactggctgccagtgtcctctgaggccagtgtccaaaggccagctcttcagtagtgacccttgtgggactctctgaagagatataggccagctctgcttcctttcacctagggaggtgagcaagtgactcacctccacttgggaggagtggggtgatggcaagatggcttgatgtgggccaccttccaggtgaccccttcaccacaccaagacacgggggtaggtgtgcgtggatgctgaacggctgctccttctctgcactctgccgtgcctacactagtgga

SEQ ID NO: 189160 - DNA, 531 bp, Homo sapiens
acattttatgaaaatcagaaataaacttttcagaagcagtattatctacttggaatctgttcaaattttggtagtgatgagacttacatactaatgtaggtgagaaatcactctgacatactctatgctaatgtaattaacagagaacctgaatttcagagaataatataaccgaaggaaaaagttcaccaatcgaaggattgaaaatatctttgaatgatataagtaaatttgagttcatacagcaaaatatgctgtttccatgccttactggttatttaccatttccactcaaaaatcaggctgttgcttagaatcacaagtactacccctgatgcttgtaaagggtgatgttgcctgattagttaaaagcatattattgcattactgtagtagaattctcttttgtcttgcatagtagaaaggcttgaatagactcacatgaaactttatgcccagacttaaatagaactgaaaggcttctgtcacagcagacccaaacattcattcattcattgaaaaatgtttatt

SEQ ID NO: 189161 - DNA, 566 bp, Homo sapiens
actttttttgattcatcttttcttactcatctcccgttctggaattctccatatgcatatattagtatgcttgatgggtatcacaatggtccctgagactgtttatttttattcttttgcttttctctctgttcattagattaaattatgccaactgatctatcattaagcctgctgattctttcctctttattcttccatttaaaacataatgttgagctcctctagtgaattttaattttaattaattttcaacttcaaaatttctatttgctttttctttcaaataactttcatctcttcaatgatagtctctatttaataaaatactgtcattccatcttttgattcttagaacatggttttctttagttgtctgaatatccttaaatatcctcattgtattatttgtcttctaagtccaagataaaagaatgattctattgcctgattttgtttttgttgtcattgttttttttgttaatttcaacttttattatatattaaatggtatacatcatgtagatttgttacttgagtaaattgtatgatgctgtggcttgagg

SEQ ID NO: 189162 - DNA, 658 bp, Homo sapiens
ggccataaacgtgccaacctaaagaatttagttaagggtacaacctacaagtcaaaaattactattccaaacgacctcccaaaaaacttggagaaccacagccatttataaaactacaagcttaaaaagaaggggaaggggagggggagattgatttcaaagatataaagcagtttaatacagtggaaaagagcacagcttttgcagccagagaaaattaggtcttgcctaccttatcagctctgtaaccttggacaaatcagtctcattaagtttcctcattactaaaatgtaaacaaatagtctatgcagcaaatcatactactgacaactaaatgggataacatatataaagtgctcactggctggcacaaagtcaatatatatatatgtaaacagttactatattattaatagtaaaaggaaaaagaaggaatgggtcttcatggaatccagttatgtaaagtcatgaagattttattttcttgaactaacaagattcttaggacaacccttagtgtaatacaaagtttctaaaactcagccacatataaaataaaaacattcattcatttaaccgtaattattaaaacttctttccctttttttgagacaggtattgctctgtcacccagtctggagtgtcgtggtgtggtct

SEQ ID NO: 189163 - DNA, 393 bp, Homo sapiens
cacggtggagcatgccagtgatccgatgcaggggattaaaaagaaagagagagttcagggactctggtgatcaagctgcagagtttcctgctgtggaggtggctgctgtgagaagggagcaggactgagaacaatgcagagatggcttttaagagcagccagtgaggctaaagtatcttttctttagaatgtgatcttttcctaatgacactgtcaactcatggtggatccagaattcaagtctcattataagttaaaactagtgctagcacactgaggacattcaatagatacttaatgaaattatatcaatatgtgttagattatcaaaaaccatgaaatgtctgagattttattctattgacaaactaacaagttagcctgccgcggttt

SEQ ID NO: 189164 - DNA, 150 bp, Homo sapiens
ggagcttgaggctgcagtgagctgcgattgtgccattgtactccagcctgcgcaacagagtgagactctgtctcaaaaataaataaataaataaacaaaaacaagggacagtgggttagagcatggtgacttagaggacagcagaagagg

SEQ ID NO: 189165 - DNA, 660 bp, Homo sapiens
gtcaggccatgaaataagatttgacttttataacacaacacttagtggaaattcattttactagaattctgaacttaataattaaactttttgagtgcttataacatgtcaggcagtatgcaaagtactttgtatatctctctctcattcctggtaaccctgtaaagtaaatattattgacactttaaggatggagctgatgctgacagaaataacttgcctaaggtcccacaggaaatgatggagttgggttttaaatctgcatttgtcctactctaaagcctgcttttaatgacaacactattttgtggaagaaaatcattaattaaatcacaagttaacttggattagcgttcttggatttttagatcagaagattttccttgtcacttgttcttagaaaacaagtttctttttttagattcaataacttaagaaatgtcattccatccaattcattctctgaattaaaagaatataattttttttttcgctccatagtctattactatttttaacattcttacacaggttgtcatattggaggcataagtaggatgattttctcccaggttaggtagatgggcagggtaaggtaggtggtgtggcatctcagatcatccctagtactcagaactgcacgttattaaggatctgtga

SEQ ID NO: 189166 - DNA, 337 bp, Homo sapiens
agtgctaggattacaggtgtgagccacgcgcctggctgtgatgtgttttttaaccctacagtgtacatcctttggtgtccctctttagtgggacagctttgggaataagcatagtcactatggaatgattggttttagcagggctgtctttcagtgtctttttctaatttctctgttaatctgtcagcctctgttatctcacctaatcattagtttgcactaatttcagactgattactctattggttttgaccatgtccaggggcataaattgcctaactatgtgatccaaatttgggcccttttatagagatagtatttgagaccaacctttgag

SEQ ID NO: 189167 - DNA, 350 bp, Homo sapiens
ttataaatagaagattctaaagagaagtttttaataaataagcatttaaaagaaactagggttacttgttatgtttaaaatatatgctgttctcacacaaaatgaaactgctgaaatccaaatttagaagcaaagaatagacttaaattgttaaacatagaaaatataaatatatactttgaagaacaggattaggcatgagccactgtgcccagccacaaataatttatctaagaagtgtttccaaactcattacatttgcaggaatcttcttcaatatacattccctgatgttgcacaaagttgggcaaccgctttagggtttccttctaatcatacttgcgggcagc

SEQ ID NO: 189168 - DNA, 206 bp, Homo sapiens
gaccagtcaacatgtgtttgcccttgagatagctttccctagtgtctctggggagctaggaaacaacaggttagggtctttgtaattcttgcctctgccagggccttggccagagatctgggaggacaacagactcttcccctatgtgctgctagaaaactggttgtaatactgttttcttttctttctttcttaatttttttaag

SEQ ID NO: 189169 - DNA, 703 bp, Homo sapiens
tgtttacctacccacacagcaaatatttaggactgattactctgtatttctatttttatttccctgtggtaaactggtccaaataattggaaaagtttcacatctgcagagacttctcctgaaagttgagaaaatttctactaaattgaaccaatcaaactacatctgttttgaggctcacagtataaactggtaaataagaaaaataattgactattaattttaaaaagcttgacaacagtcttaaaaatttcaacaaaattatgactaccacaactgactaaacgatctacactgtagagactgtctacactcttctgtcactaatggaatcttatataatatagccagtgctctcagccctacaaactatgaacagctcagtagataaatctcaataagcctccacatcaaacagactggaagaaatcaaaagaccgctgagctaagccagaccaggctgatattttggtttattggttaactgttatgcttggaaaggtctaaagcttaattgcaaggcttgaggtgtaagtaaaaaatgcctgacttaagtaaaaatactgatcatagcatctgtcactagttaaaatatgtggagatctttatccaggatattttttgttgtttatattttaaataaatgaaaatagccagtcacacggtgactaaacatgatcatttttcattttttgagaatgct

SEQ ID NO: 189170 - DNA, 816 bp, Homo sapiens
caggctgttggttctatttttctcaagtacagtttgttattttgctctgctttgctgctcatatgcgaggacctttcttggccagcctcttgagatcttctgttctggtgatagatgcttgattcaggtttggagagcagcttagtgtcctcagataattctgggaaagcaactgaagagtgatctggttctacaagctggtgactggacccacaatacccagaagaggtctgcattttgcccctggcaccgcagagtgaaagggaggccagagttctctgcagactccacctgttctccttactgccctttgtagtgaatggacattgactcaagtttgtctatctacactctttggggagccccttaaaacccggatttgacttggaaatgaagcttttggttatggcttctgatcatgctatatgtggtagaagcttagtgtctgtatttttaaaattcagactggcttttaatactgggtaactaagtcatagatgaggggaagttgatggagtgatggaaatagacaattgccattttgcagcccatcaatgaattgatggatctgggcatgagacatcgacacttggtaatatcctccagagacaataagctgttgtttgcccctgacagtagaatactttacctccaaggaagtagtcttataaaaacaaatacagctgatctgttcaagtaacaatttacagtaactacagaggacacgaaaacatggtaaaacaatgttgttagggataccattggcctattccagactgaccaaaggtctgctttctttaacaaataaattacaag

SEQ ID NO: 189171 - DNA, 328 bp, Homo sapiens
ttggagccggcagggccctgtgagttctttgcatcaaatcccccgtttcgcagatggggagcctgagtctgctctgtggatggccccgtgctaggtgttggggatacagaaacatggcaggaagacagtgccctcgtgtgcctgtggcatagaggggcgcccccttacacctcacctcgttagaaccaagctcgacggaagccctggtgagcttttaaaactgaaagttaggctgggcgccgtggctcatgcctgtaatcccagcactttgggaggctgaggcaggcagatcgcttgagcccatgagttcgagaccagcctgggcaac

SEQ ID NO: 189172 - DNA, 219 bp, Homo sapiens
agaggagcgtagaggcccaaggaggcaatagactaatttagcaactctcttcccttcaggggacatcaagagaatgtctcctggtaaagagcatctactgtcttgagttatcttgaggaagtggctgcaaaaacagctaaatgacaagaacaagaacatggaagcaagccatcctgacccacccgcaccaccgcgctccaggaagctggctctaccctc

SEQ ID NO: 189173 - DNA, 547 bp, Homo sapiens
ctactttaattacttcctcaacattacttaggagactgcaatgctcccacaaaacctgcttccgaacccccctccccaggacagcctctgatggcatccgagtccgtaacagcacatgaccttgtccatctttttcctggaggacgggaaacagtatctcatttgcatttcactaacgactagtgattcgagcatcttttcacgtgcttattggccatttatatactgtatcttctttggagaaatatctattcaggtcctgtagtgatttttcattggattgtttgtcttcttactgttgaattgtcagagttcttaaatattctgcatactagtcccatttcaaacgcacaatttacaaatgttttctcccattctccgggttggcttttcatttttttgatactgtcctttgaagcacaaaagtttgtttttttgttttgttttacttttgatgaagtccaatttgtctgtttctctcttttgctcatgcttttgatgtgatctctaagaatccattgccaaatccaaggtcacgaagatttac

SEQ ID NO: 189174 - DNA, 254 bp, Homo sapiens
catgaccctgtcctcagggaactggccttctctttagaagacacccctgtaggaaagaccatggcagacgattgagtggagctgggctgggagagggcagtagagtaggttggtggagaaccgtcagcccaggggctgcccattcccttcctagcatcagggtctcacagttacagtgaaagacctcgacagggaggggccttctcagatgtgtcgtaccctgttgttactggtgcctcctggctggcctctgt

SEQ ID NO: 189175 - DNA, 592 bp, Homo sapiens
atataaatccagcaggtggcactagatagtcttggaagagtgtaaatttctgacttgaaggcagtatttgcctaatgaccttttcttttcatgtaaacatttttatattttattgttgatgcctttagcaatggataggctctgttaagatagctggtccatttgcatataacgtctcacctaattagttttttagatgggctcttaacgagcttgttagatctcttcaagtttactctgtcttgaatcctgtagcccattcttctcacattcacacttacaaaaatgtagtaagaaagagctctggattccccgacataacttctgtcctctgcctaaacattgcattttaattgcctctaccccctataaaaaattagaggtagtaatggaaatgtaagctcctcagctcagcttcctttcctgatgtgccagggctgccctggaggagggcgactccaaccaaagagacaggtaagtggttctgacagggtgccgggctagctctgcctccactgaggagcagcaagaggcaggcgctctggattggcagccagaaggttcaatttttgtggtctgtgtgatgtcactt

SEQ ID NO: 189176 - DNA, 378 bp, Homo sapiens
gctgtgagacttcctagcttccagaactgtgagaaataagtatttgtagtttataagccacccatttctggtattttgttatagcagcctaaatggactaagacactaggatccagagtataatgatggaataattaagtgcatagcatagtgcttaggatatagcattctatcagacagctattgaggtatataacaaacaaccccaaaattcactggcatgacagcaataagcttttattctcatacttataggtctagagctgcctagggtgaaaacatcaagttgcaggtttgtagggaagctgaggaggctctgacagcctttttttttgttgttgttttttttttttttttttttttgagacggagtctcgc

SEQ ID NO: 189177 - DNA, 374 bp, Homo sapiens
gttcgagaccagcctggccaatatggtgaaaccccgtctctactaaaaatacaaaaacaaaaaaaaaaattagccgagcatggtggtgcaggcctgtaatcccagctacttgggaggctgaggcaggagaattgcttgaacccagaaggcagaggttgcagtgagctgagatcgcgccactgcactccagcctgggcgacagagcgagactccgtttcaaacaatcaaacaacaagaaaaaacagagttagcatggctgtgtttcaatgaaactttattgtaaaaactggcagtggcacagatttgcccacctgtcctaaataccagcggagtcaggctagaaagaaagactgaatttactgtttttttttttt

SEQ ID NO: 189178 - DNA, 417 bp, Homo sapiens
ttttattcattcatacttttaaaaaaactatttcgtatttaaattttactctgacaataatggtatataaaaaatatcggggctctttttaaaggaacaacaaccaaaaccctcataggaaaagacagggtccatcttgttagcatacgtgttggttaagagtgctgcctctggaaccaggctgtgttcagctggaactctgtacctattttctcatctgtaaaatgggaataataatagtgaccatctcaattacagtgaatattaaaagagttaatatatgtaaagcagagcagtgcctggcaattgacaagtgagaactgtggctactattattaccgttattaacataccttcatgagctgggccctcttggtgtgcagtatttactttgtaagtctgagacacctgggagag

SEQ ID NO: 189179 - DNA, 473 bp, Homo sapiens
ggtagtggctgctgagggttactgctcagatcttgctcttcggggctgatgttctcattctgccaactgccaggaatgctgcctgctgatagcttgtagttgaatccccagacaagggaactgcctcacccaagtttctgcctctcattcctcagggacagcccatatccagtgcctggtcaatgaggaaacacaaaaatccaatccccttgctcagttcaggatatctctgaagagccatcccagcttcagagatccctatcgtgttggacgaggcctgctgcaactgaatcccagtttaagttccctcacttcccaataaaattcctgcaagcaaatctccactgtacagtctgtttcccagagaactcaacctaagatagcttaggtctggactgggccaaggaagcaaacgctaaaaagggatttcgggccgggtgtggtgtttcatgcctgtaatcccggcactttgg

SEQ ID NO: 189180 - DNA, 425 bp, Homo sapiens
agctgactgcacctcctttgtgtcttccccactccatcccctgcctgctgccactgccttagttcacagcctcatcatttcctccttgagttgctgcaacaatctccagctggcctctctgccacccagtttttgcctctctccaacctgtcctcctgactcttgccagagaaatttttctaggaaaacctacccaagcacggaatgcccctgtataaatgctccatgggttgctgagcacccccagagaaactgtcgtgactgatccacgctctcacttcctcggccttgcatcgtgctgtcccctgccctcccaggcttccctcagtgcgagcatctcctcacctcctgacctttgcacaagccactccttctgaggagcactctctgtttcccctgcttctctcctccttgcctaactccta

SEQ ID NO: 189181 - DNA, 101 bp, Homo sapiens
ctcatttctccaccaatatttagtattttctgattttctaatttttatcaatctggtatatataaagtggtatttaattgtggttttattttcatttttct

SEQ ID NO: 189182 - DNA, 385 bp, Homo sapiens
agtgtctgcagcagacctcagcaggggaggaagcaccctaaggcagagcagatcctgatgaggcacaaaagccacactcatggcttgggcatcattcttgggtctgtgggcagcctttggagagttctgggtaaggtagtgaccgagtcaagtttgagtgttttaagaaagacccctctgggggctgtggggagaatggttttgagaagggctaccctggggctccaagaccagtggaatgacgtgaagtccaggaattctgaagcatgaagccaagggcgtgagctaaagccaggatgatatacagtactgggttcagagggaattgccccccagtggccttccctgaccacccttaccctattgctgtcacatttctctatgt

SEQ ID NO: 189183 - DNA, 336 bp, Homo sapiens
caactgcaaaccgagaagacttttagtcattatggcaataagtagtatagggggaatatctccttcagcactgaaaactaagcaagagtcaggcaaaagaaaaaagctttggagaactttctacaaaactgggattgaagaaaaggatggtttgtgatttacatccacaagagtggccacgaaaaggaaataaatagaagatgtaacaaaaggtcaccgtcgcagacttaagtcagaggagtaaaagctggagctaagataggctgtgcagtacccagggcatattcatatcttcctagtgtctacagtaagaacactaattacaataaagaaatg

SEQ ID NO: 189184 - DNA, 685 bp, Homo sapiens
ggctccacattcagtgacagcacgtcagcagctggaagccagcatcagtgggggtgtttacaccatgggaatgggcccactccacagactagcgctgtaccaagagagccagtttggtttctgggggtcgtggggttaggtcctcatgcttctctcggacccaccccctagaaatgtccccacccaacccccactgtagcctggatggacggggatgagctctgcggggctcccgcctgagccatcttgtcttcagctgcgtttgggctctgagctccagccatgctggctccatgacccaggatgggattcatgcactaacgtgaagagagcaatctcctgaacagaggaaggagtgggccctggaggagccgtggccctgggtggtggcaccaggcagctgcaggaccaggggcagcggtgaggcacgaagcctcagactgggtgtggttcccactcgttcttgccggagaaacctgccttttcaagcataattcaatcaaaaggccttttgtggagcccaaactagaaggctttgggttccagcactgtgcctcagtttcctcatctggagcataaggatgggaccgtcactgggtgtagatgtggggtcccgggaggcgtgcaagggccatgtttgggcaggtgcctggaatggaggaggccttggtaagtaagcattcat

SEQ ID NO: 189185 - DNA, 309 bp, Homo sapiens
atttccagtacatatgttcatattatctatgaatagcaacagttttcaatccttacaatccctatatcttttatttctttttcttgtttgtgtaactgttctcatgaggccctccagtataaagttagatagaactactgattgtggcatccttgtattgtacctggcctcaaaggaaaagctttctaatatgtcattattaggtatggtgttcactgaaggtttttatggttattctttattcttcataagaattatcttttcatgtaaggaagtttgctaggggaaggaagcttgctagggtgctaa

SEQ ID NO: 189186 - DNA, 319 bp, Homo sapiens
aaaaagagggaacaaccaaggtaagccaggagaaagatggtaaagacaaaaaagcaaagacagttgatctctagacagggctgagttgaggacaaggaacttgaaatcagatatatcatgaaattccactgtctaagccaacatactgtgctatttaatttcagattcaagtgttgttatatttacctactttcatattttagcaaagttaagcaaatcatttacctatgttttcttcctacacctttagcagaataaacaaaatgactggcatatcttaagggaccagatggctggtaatactaaacaaccactcaaa

SEQ ID NO: 189187 - DNA, 279 bp, Homo sapiens
agatgcaatttctgaggccgagtgacctacatagagaatacatatttaaagacaaaaatatgagtagagtttcctcagttgcctgaaaagaccaaagagaggaatttttaaaaaatcatttctgaatttttccgtagtctcttccaagtctgggatttgggtttaatagcttaatacaaacacagaaattctaggtggttagtcaggagacccccaggttctagtggggtcacagggaggaatatatagtaacctctctgagcctcagttttctcattt

SEQ ID NO: 189188 - DNA, 130 bp, Homo sapiens
actgaggaatggccatcagggaaggccttggaaagagatgggtgctcactgtgtttcaaaagatgagtggattctggatctctaagttgatcattgtccacatatggacagcacattggatcaggagcgg

SEQ ID NO: 189189 - DNA, 121 bp, Homo sapiens
ggatgataatggcattgtagtaacagaaaatgaactctgaaaaattagtgtgtaaaatgatgcctgagtcttgctttaaactagtctagcaaaaataagcgaaggaaggaaggctggaagg

SEQ ID NO: 189190 - DNA, 463 bp, Homo sapiens
tactactgccaagttcataatcccttacccacaattccaacatccaaaaagctctaaaaagtaaaaagttttctcataacacacttggaagcaaaaccccaaccaaagggaggctatttatagtatttaccctacttagggaaggtattttcttttctgaaaaaacactatctttgattagagaacaccacctcagatcctgataggggcgttaatgtaaactttccaaaatccaaaataattctaaattctaagacacatctggccccaacggtttcagaaaaggaaatgtgaatctctaactcattccacagataaaggacagtgggcttaaattactagttgttgattacatctctattaagtggtatttactctctgaaaaataaggcaacttattaaaaaaaattggaagcaactttaaagtctgacattaataaggaattgcttaagtaatttatag

SEQ ID NO: 189191 - DNA, 415 bp, Homo sapiens
gcagcatgttaaatgaaagctgccagtccaggacaagtcagaaggttgtgcccctatgactaatgaggtgtgacccttatgactttcaaaagagtgtcttagtaacatcagtgccaagatttggttctgaaatacagttcccacctctaacatctgggcctttttgtaactcatgctacctttgagtgggaccaaggtggtcagctttgatttagcctctcctgttctgccccatcagccctggactccggccacttctcagaaccagcctctgccacacacaccaagctttggctcattccccataatcctccaggatcagccctggcactccccctcccactctggttttcacttttttgttcctgtttaagagctgagagttcctgtttttgtttttctcctctgtctctgc

SEQ ID NO: 189192 - DNA, 606 bp, Homo sapiens
gattgaaagtctgaatattttaaatgatgggggcagagagaggaaatgagtgcttaggaatccatttagttttatttttttattttcaaaattaagtaaaataggccagtgagtcaattttagtttggaagggaggggttatcttggcacaagttttaaatgagtatcttagtcatgtagttgtgatgtgtatttttaggactacccaattacttaactcttgttttctacccttctaaaggtggaaacctcagttttatgcttgaaattaggtcaactttgtaggaaatgggattgatacaggaatgtttaatattcactactgtatatagtcactgagtacctaggaaaagcacgtttttagaatattatgtaagtgcggtacccctaccaactgttaggcttcatcttttgtggtcagcctaccctatacttttcagatggaggtatttaaaattactaagaaaacatgcaacttattagtaacaaagtggaaaagatattgctgtgtttatgatgaagcatattctctgttgtcaaatataaatttttatgcatactggaaaaattagttgtacaaaattgaatgtatgtgatacctttctt

SEQ ID NO: 189193 - DNA, 336 bp, Homo sapiens
gcctctctgggtcttcgtgttcttattggaaaagtgaggggagtgcatgtcattttgggtgaagtggtttgacttatgtcaccatcaaccaaataacgcgatgggaggaaggtccaggatatagtggagatggaacgtcttctgaaaaatccccttggtgctgggatattgaatgtgctgcttacttgaaatgtcttggtaatttaaaatgatattatttgcattatcttgaattgagacctttagattagtaaacagtcactttatttgaggctttgttcctgatatctaaaacacatacaattaaatgctaccatttaaaagggacagtttaga

SEQ ID NO: 189194 - DNA, 148 bp, Homo sapiens
aagttcaatagccacacattaattaatgtgtggcttatttgaaacttttcacatgagcccttcactgtgaacccctaaactgcaagcattttggataagggggactcaacctgtcccacattttgtttacccatacagccatttagta

SEQ ID NO: 189195 - DNA, 150 bp, Homo sapiens
cccccgaaagtacctgttatttactatgttaacaggttttatttgtattactgtaaaatgtcagcaagcttatattcataggaatcttctatcttctatgaatttatcaagctattattgcctaggacttatattacttttgctggcaag

SEQ ID NO: 189196 - DNA, 345 bp, Homo sapiens
ctacatgaagggcacacatctgaagactacagcttgatttttccatgtgtgcatccacctaaccaccactaaccacccacctaaccaccactaaccacctgcctaaccaccactaaccacccgccaaacaaccactaaccacccacctaccactaaccatccacctaaccaccactaaccacccacctaaccaccactaaccacccacctaaccaacactaaccaccactaatcacccacttaaccacttaaccaccactaactgcccacctaactacctgaccgtccacctaaccaccactaaccacccacctaaccaccctgccacccacctggtcacctaac

SEQ ID NO: 189197 - DNA, 369 bp, Homo sapiens
tggccctccctgtttatgggtttcatacctgtaggttctgcatctctggcttccacatctgcagatacaaccaactgcagattgaaaatatttgggaaaggccgggcgcggtggctcacgcctgtaatcccagcactttgggaggccgaggcgggtggatcacgaggtcaggagatcgagaccatcctggctaacatggtgaaaccccgtctctactaaaaaaatacaaaaaattagccaggcgtggtggtgggtgcttgtagtcccaactacctgggaggctgaggcccgagaatggcatgaacccgggaggcggagcttgcagtaagccgagatcatgccactgtgccccagcctgggcgacagagc

SEQ ID NO: 189198 - DNA, 386 bp, Homo sapiens
tcatttcagaactgacataaaagaaggtaagtatgggtctgtgtacaaacgagtaaagaccaattgcaaaatacttcaatttgacacaaactaggttgaaagtgaaccccaaaggaaataccaaacattgaaaatgacaaagttcaacttgttttgaaacaggcaataagtgaagaactgtggaaccctaacaaagaaatatatttaaaaagtgactcaccatgcaatgaatttgcaatatataaatatggcgcgcaattgagcactctttgcaatatatgaagttcagttcagacagctattctaggagagtatctcactgcagtcccagggaggcacaggtaaccaccagaggcagaacacatttgggtgagctggcaactcct

SEQ ID NO: 189199 - DNA, 132 bp, Homo sapiens
cacgggctttatcagaagggttctcagtctgactttggttgatttagcaacagcagtgtactgaggataaatctggtgtttggtaaagtcctcctgtgtggttggcatgctggatgaagggcaggggatgtg

SEQ ID NO: 189200 - DNA, 303 bp, Homo sapiens
aaccacttatgaggagaaagtgggttctctgctgtatgccttacacaaaaataaattgtatttgtaataacaatataagtgtaaaatataaaactgttagaacaaaatgagggaaaatatttgtataatattaggagaagaaaagctcttttttttttttttttttttggaaaaaagtttttttttttgtgccccggttgggaggcaagggccggaatttggtttaattgaacctttggcttcgggattaaagcaattttttttttttaaccctccggagtggtgggaattccggccttcccc

SEQ ID NO: 189201 - DNA, 461 bp, Homo sapiens
ttgataatctatggataatagcctgcactttgcaagctcactgggaggcgtggttacagcagaggtgttatgcctatcacaatgtgtgacaggtaggaagcactcagtgaataggagctggcatcgtggtctcagagcaacacagcctaaaacatcattcacatacacaagatttcttaacacaaagatggattgtagattggtaacttcagagaactcaaattgtgaataaatgccaagactcccaacttcctgggtggagcagcgtggcacaagcccaggaatcaagctgcccattccctgcagtgtggtctggggctactcacccaccttctttgccttgtccttgtcactggccaaggccattatgatcctattatactctagggttcctgggaggtgaggaatggagacattagagtccatattttgtgcacagaagagggactgatacatagtaa

SEQ ID NO: 189202 - DNA, 239 bp, Homo sapiens
ccccagcagatcccctttacatcctcaggagcagaaggcctcagcacggctgcacggtgtgcattcactctgtggatacctgtgtgctccacaacagcagtttccctggacttctgtggccaacgtgtgagcccacgttcggcctcccctgtggattggggtgtgagcccacgttcggcctcccctgtggattggggtgtgagcccacgtccctctctgtgccctgttgtgtggctgtg

SEQ ID NO: 189203 - DNA, 495 bp, Homo sapiens
aaatgacttcatcaactaattgtcccctcacatttcagacccatcttactctctcacaaattgatccatattcttcctgatcttttttctcctgtcaaaagctaaccatttcatttgtattttaaattttctcaaaaccttgcattaatatattgcctagatatgccacacttgcttcttagagaacttgcttgctcttagtcatgaaaaaggaacccctacctgctattcctgcagccctattagcacctaatagaaaatcctgcacctagagacatcaaaaaacctgatgttctaaagattccacaagcaactttagagctgtgtatgaataacacaactcctcaagaaaaacaaaacattaaaccactgttttccataatgttttcaaagtactcattagtattctaattgacttggcacacacaaataaaaaacacacacacatacaaaaggcaccaaaggtttttcattctttaaaccagcatcaagaag

SEQ ID NO: 189204 - DNA, 504 bp, Homo sapiens
tgctgggattacaggcatgagccactgaacccagccagtttcagaatttctaatccctgggagaaacatttactaagtagattatagcatttatatatagctctttttgtctttagacttgccgtactcagtccaaggtactggtaacttagattagttcttttcttccccacttcctttagtgggtcatgtccagttaagtcaggtttatttgctagtgtttgatgccattttggattctcccacatgttgattgtttgtgtgtatgtatgtttggagtgaggatgtgtgaaacattactatggttctgggagtcagagctgtacagaacggtttacaaaatgtcactccctcatcacccctacagtgcccttctcactctcttttttccaccgtcttcccactcacactctagtttctagtttatccttgctgtatttcttcacaaatgagcagatacagtacatgtatatattcttttgtctcccttttttgtttgtctgt

SEQ ID NO: 189205 - DNA, 350 bp, Homo sapiens
tgctgccaactcacagcaggggcaccctgtgggggtccaggaagtggccagaaagccaagaccctctgataagcctgatattttgtggggagaggagagaagaggactgatctatactgaaaacacaaaaatgagttgaattgatatttttaaggcagttcctctgtggaatcaggatttcaatgtgagggacacacttaactctagggtccagatagaaactactgaatttagtgtttctttctttttttttttttttttttcagagaatggtcacatattctcaaaagcccaattatagaacaagctgaaagtcaagggagaggtcatctccagaaaagttttcccct

SEQ ID NO: 189206 - DNA, 282 bp, Homo sapiens
agccgggacttccctttgcccttctccggctgggccgtgggggaagcgcgggggtcaccagatgaccgctcggggcctgggagggaccctgctgagtcagcgccgtttctcatctgctgcagagaatcccgcggtcagggcggagagaatggcggctccttccgcattcggccgccccgtcgggaacgcatgctcctcatcggcaaggctcctcattagctgtccacgtggacaccacaagcccagggctctcgtcccctcccttcctgaagcaccatgctc

SEQ ID NO: 189207 - DNA, 530 bp, Homo sapiens
ggaaaagattacttctataattcatcaaggaaaatactaacttgctcccccagagagctgggggaaaacacattaatataaatataattgaggagtggaaacaaagtctaggaggagttaaagcataagtatcagcctggatgtgaattctaatataggaattagaattcctatattaaaaattgtattagaaacctttactttcttgtgatttctgttagttcagtaagtaacctttcttggaaggtctactaattcctttcaaaaaagatatttattttatatcttactataatatactaagcactgttattgctagggtgttttgaaggggcaggagatggtatttaaaactgagttgcagttctaggcagttaaataaaatccactgaccagaaaaaaatatgtaaaatgataaggcaggataagtattcactgccaaaaagtcaacaaagaaaatagtaaggatttatgttcagcaatccctgagattaaaatttaaaataaataaatagggatagtacgatttg

SEQ ID NO: 189208 - DNA, 293 bp, Homo sapiens
ctgattctagaggatcccaagcttgattgcaattgaaaaaataaaaagaaaaaaagaaaaatgagatggtgtggtaaagatggaagagtgatcagtggtgatataaaggagtgatctactctggctaaagagggactcaggaagactttacagaggagtattcaaaacgggccttgaagggtgaatagacaaggtacatggcacatatgaaacagcttgatgcatttgggaaaccacaatttgtttagaataattacaccagaaatatgggcaaatgacagaagaaactagag

SEQ ID NO: 189209 - DNA, 295 bp, Homo sapiens
ctgtgtctttacattaaaacatatttatttggaagagaagcagtggggacaatttattacagcacacacacacacccctcacctgttcatagattacttcctatcctgcagtacatttactttctgtctatatttctaaatggtgtcatttttttctgaaaattagtgaatttccaaaatattggttttcattctgtatgtgcagcataaatatttacaaatcatttttcttttttgccagccttacttaaaatgcaggtttattgcctagtgttctcaatgtatttattaatgg

SEQ ID NO: 189210 - DNA, 586 bp, Homo sapiens
cgacaggccatgtggtatcagctcgttctgccacactcccgaagttgctgctgggcacatgcttggtgccagtccctgtgctatgagtatagctatgagcaagactggcaggctcctgcacctgagggtgctcttagtccagtagaggagacatagaagcaagaacgatacttgtagattatagttggggctaggaggaaaataagcaggatagatgcttgtgaattactggcggggcaggggctccactttagagggcctgagtgcggtgccaggacacctggtacaagaggaagtctttgagaggctgatgtttaagctgaggaataggggaggggctggagtgagtgtcccacccagaggaaagagcaagtacaaggtcgtgtggaggaaagggggcctgccaaggaggtggctgagtgtagtgagcaggacagtcccaggtgaggtgagctcttagagccgtgggaggagcagagctgaaggcaggagctcagtctgagggcaaggggcttcttccttgggggcctgtgggcacaccccctttgcccagtactgttcttgccaaatcaccccttgttcaaag

SEQ ID NO: 189211 - DNA, 253 bp, Homo sapiens
tttgtattttgaaaacaattctggctactgtatagagacaagagtaaagtgggtaaggaatgatggatgcaggaattctgaacatgaagccttcatccaggtgagagattatggtggcttggcctcgggaagtgatggtggagatgaaggtaattgggaagatttgagaagcctttagtgcagaatagacaaacagaacctgatgaaatgaggggactgtcgggtgtcaagaatgtagagtacactggaatgg

SEQ ID NO: 189212 - DNA, 307 bp, Homo sapiens
cagtcaccagtcattgtcacattaatccaaggagagaagtcaccaatattcaacttacagatttgctgaacacttgcaaagatttgcatgaggttctactggggatacagcaatgaaaacaatcacctatagaaaccaaaagccagtgggggaaagaatgtattgcagaagtaattaagacaagcacgattactattttgtatagagggatagagtggaagttgctagatggagattaattttaccagagtgatttgtatgcattgaagtatgagtcaaagctctagtaggataatcaggaaacaaa

SEQ ID NO: 189213 - DNA, 382 bp, Homo sapiens
agaggatggccactgaggggttgtctgggtcatgggaagaatccttcatgaataagattaatattctcatggaaatgaattctcactcttgtgggactggattagttcctgagagagtgagttgttgtaaagcaagcttcttcctagtgtttgccttcttttcactcattccctagcctttcagcttctccaccatgttgtcaggcagcacatggcccccaccaagagctgagcagatgctgatgccacattcttatactctcaagccaccacagtcgtgagccaaataagcttcttttctttataaattacctggactcaggtattctgttatggcgacacaaaacagactaagataggaaagaaagaactagtcagctaa

SEQ ID NO: 189214 - DNA, 489 bp, Homo sapiens
gctaaaactgaggagagactcctcctaacccattctatgaggccagcatcaacctgataccaaaacctggcagagacacaacaacaacaacaacaacaacaaaaacaacaaaatttcaggccaatatccctgatgaacactgatgcaaaaatcctcaacaaaatactagcaaacccaaaccagtaccacaaccatgtaggctaggctttattcctgggatgcaagtttggttcaacatatgaaaatcaataaatgtgattcactgcataaacagaactagaaacaaaagccaacaacacacactggggtctacttgatggtggaggttgtgaggatggtgaggattgaaaaacttcctatcaggtgctatgcttattacttggatgatgaaacaatctataggccaaacccctgagatatgcaatttactcatataacaaacctgtacatgtaaccctggacctaaaataataaaaaaaaatctttaaa

SEQ ID NO: 189215 - DNA, 159 bp, Homo sapiens
tcacctagtgcccctcagcatttacgagaaagagtttatttcaacaacacccaagttagggtaaaactccctacctggtgtctccgtattagcatggcaactcatcacaggggcaaaatcctgctattcctaagcatactaatttaagaaacttttgtt

SEQ ID NO: 189216 - DNA, 269 bp, Homo sapiens
gcctctggcccactgagaaagtggctaatgttgtaacatgactgtctgggctgctgtagattgggtgatctgtagctcacagctctggaggctgggaagtccgaggtcaaggtgcctgcagatctggtgccccaggacctgttgctcacagacggcaacatctcactgggcctcacgtggcggaggagcaggagggctccttcaggccttccaacaaggacaccaaccccggtcctgagagcgaggcctcccaaaggccacacctttta

SEQ ID NO: 189217 - DNA, 340 bp, Homo sapiens
tgatacgaaccgagctgtaacctcctgggataggatgtcctggggacagcaaagccactgccaccctacagagcagttaacctagaacaaaggccctatggccttgtgcccaggctcaaccccttaagacatcctttcccaggaggagcctttgggcttcctggagcacccaaaatgcttctttgaggtttctgatacttagagtagggggagatgtttggatggctgaattataacccttcaagtgttaagacacaagctgctattggatggagagagtctccggagtattctctctggtgttttaactttattaagttattcatacaccacagaattc

SEQ ID NO: 189218 - DNA, 290 bp, Homo sapiens
tctagaggatctcgatgcatgtggcagaggacagtccagacagcagcctgccagaaggcatttctcccattatataccgttgtaaagagaaactgtaaagtctcctcctgaccatatatttttaagtactggcaaagcttttaaaattggcacacaagtacagactgtgctcatttctgtttagtatctgaaaaccaggatagaaaaagctccatgagcagaggagcccatgtaacctttattatggctcaggccttgcaaaaagggctatagagtgttgagtgacaaag

SEQ ID NO: 189219 - DNA, 196 bp, Homo sapiens
agcctgaatgcggagggctccccatgctgtctttctagccagctcctctgtgttgagctgtagccctgactatgcaactgccgactcatcgtttcctcatggcattgccacagccgtctccagctccatggggctgagacctgaagtcatcccttttccatctgtctgctctgcctgtcttcccatctctattcct

SEQ ID NO: 189220 - DNA, 120 bp, Homo sapiens
tggggattgatggagcaactgggtagaaggggaggtttgatttttatggtgtatgagaaagtacaaagtgtctacgagtaaccgttcactgctattcatggggctgggtataagcaagca

SEQ ID NO: 189221 - DNA, 266 bp, Homo sapiens
atcacttgaacttgggaggcggaggttgcagtgagctgagatcgcgccactgcactccagcctgggtgacaaagtgagactccatctcaaaaaaaatatttagcactcagggaaatggatttctttgtaaagccctgaagccagctgatcccactgagcttcacactactgctattctgggttgctaaacaaagtgccattccttttctaataatttagccctctctccaactctgctcgtactcttcttggatttttttttccta

SEQ ID NO: 189222 - DNA, 449 bp, Homo sapiens
taaatgtgtcttaagaataattatatatcctaacaagtgaccacatccttcgatgtgtggatctgatcctccttcactagaaggctggggataaggcagaggcaacactagcacaagtatgcattccctgatcccatcatgaaacactgaagcatgccaccacgagctgaggctctattttaagtacctgagatagttaataaaacagaacatcctgccttgaaggagtttctgttcacatggttgcatcaacacagaccatgacatttgcaaaggaacatctcttgggtcatcgggaaggcagctggtcctgtagctcatatgccttcaagttagtttaaaactatttcaatctattccaatttgtctagttgtttcatgatctaacaagaattattagaaccttcagcaatgcctggcttggaattccaactgtcctctttaagaac

SEQ ID NO: 189223 - DNA, 547 bp, Homo sapiens
tgaagaatgaccttcatataatggccacacagccacttgggccaccggagctcaccgtgagacacactcaccatctcgtcttcatgtctggtgctccctttagttttctggcaagaagctagggagaaggtgacttgagctcctcgtgtgttttgatcactcaacaaagaagacaaaagggcgtttcataacctgacagtgggagagcacattaaaaaggagctgagctgacctttgcactgtctatgaagaatgagtttcctaaactcatcatagcaacaagatataacgggggttattaagccactaaaactttttctgaattcatatgcactttttcccaaatagaatgctgacgacaaataattttatcaatcattaaagaagatcccttcagaacctctccagggaaatacttgtagcttagttctggttagcacgtaatgccacaagaatctggcatcatttagaccagccatttattcagatatcaagagcaagagactgtaactgattccctgacctctgactaaaaacaaatataaac

SEQ ID NO: 189224 - DNA, 794 bp, Homo sapiens
actacagctgtaggtcaacactgcagaggcatgtcctccacaaattcttatgttgaagtcctaatgcccaattcctcaaaatgtatccttacttggtcactgcagatgtagtaagttaagatgaggttatatggagtagagtgagcagctaattcaatataactgtgtccttataaaaaggggaaacttggacaaaggcttacaacacagggagaattccacatgccatgtgaaggcagggatctacaagccaaggaacatcaaagactgccagcaaaccaaaaaaaaaaaaagccaggggagaggcatgatacagatttctctctcaccacccttagaaggaaccaaccctgcggacaccttcatcccagacttccagcctctagaattcagagataagaaatcactgggtttaagccactcggtctgtggtactttgttataaagccctggcaaactaataaacttacttacctatagttgtcttaagaatgtaaatatctcgaaggggagactatctttacaacgttatatcttttgtatctttacagagcaggtactcagtaaatatctgtgggaccaatctgtcctactatatgttatgtcatttttctatttcagtaaatgacaactccattcttcctgttgcttgggcccaaaacctggagtcatcccgaatgccttcccttttcccaaaatcctcatccaatctgtcagtacatcagctctacccttaaaatatatccagaatctgaccattttcacagtatccttagctatcaccttgtccaagc

SEQ ID NO: 189225 - DNA, 498 bp, Homo sapiens
cactcctattcctccacctctagctccaatcagcagtagttccacgaaggtgggctaaaccaagaaaaccggcagctttgctgtcaaatatgactaacttgatttggagcagagcatgcataaaacccccatgcatctgggtgttatcaaaaacaattagggaagccatactggttggagcaaacaacagaccagaagaacaggcagaaatctaaccaggctatatagggagtgagaaagctataatgggccttgaaaagctcccacacatccctagtatttggaaggttgcacatgcatgcagtgctgtatgcacactgaagagagactggaaatggctccagttatttacatgtctctggatgaaaatgaggctttttgtaggagacatgagaatgacagaaagtaaaaaccaggacaaacttctatggttagtctgtttgcatcattatagagaaatacctggggctaggtaacttgtaaagaaaagagatttat

SEQ ID NO: 189226 - DNA, 127 bp, Homo sapiens
tgctgagattattgagtgtgagccactagactggaaataccactaagaaaaaaaccttaacatatagagaaggaaagaagaagggaatcaaaatggtacaccaccaaaaaaacaactaaatttttaa

SEQ ID NO: 189227 - DNA, 183 bp, Homo sapiens
tctgtgtttcctgaacttctcaaacccttggaatttcctgagtgacgacgggaatgttatgctaatcaggtaactaatgatgggcctctggatagcttcaggataggcgctgtctctggaaggaccaactatgtggttgggactctgaaccaacctggcctctggagagggaaaggagttgga

SEQ ID NO: 189228 - DNA, 570 bp, Homo sapiens
gtgagccaaaatcgcgccactgcatttcagcctgggtgacataatgcaactccgtctccaaaaaaaaaaaaaaaaaaaaaagttaaatttttacaagagatttttttaaacatagaaatgaagtaactgaagcttatatcaagttggttgtataaccacagagtgagaaattattttgagtaacttttggtttttttggagatagggcctggagtgcagtggtgcaatctcagctcactgcaacctccacctcctgggcttatgccgtcctcctacctcagcctcccgagtagctggaactacaggcacatgccatcgcagctagctaatttttgtgttttttgtagagacagggtttcaccatgttacccaggctggtcttgaactcctgagctcagacaatccacccgtctcagcttctgaaaagtgctgggattacaggaatgagccagtgagcctggccatttgagtaactttatagtgatttgattgttcaacctaatcggatagactttgcatcagttacttcttgtcacaataatgctgcttagtaaaccatcccgaaaggta

SEQ ID NO: 189229 - DNA, 458 bp, Homo sapiens
aaagggggagacttaaaatattaccattttccacttgcttctgtagttttaaaaagctatatgaatggttacagataatgataccatttaaatgaggttttatatgttttgttgttcttgagaggagaaaagaaactagtaatttaagctaaccagaaaatatagggaagggaaaaataaacaagataacacaaggaaaactagttatatcagctatggccatgtaattaggtcaaacatcttttaaataggtgtgaatgagtcagaaagcagaatccaggttttggtcatctgccagagacccatgtaaagtctaataacataaaaaataaaaatgggggccagacttggcagctcatgcctgtaattccagcactttgggaacctgaggtgggaggattgcttgagccccgaaaattgagcctatggtgagctatgatcatgctactgtacttctg

SEQ ID NO: 189230 - DNA, 444 bp, Homo sapiens
agctcggtaccccaataaatagttggtcattgatgttgtgtgagtgattttgacagatgggatagtaggtcactttgtgtctaattcggcaccatttttcagagcataaagataaaatatctgagtaagcatattatatttttagaaatcagccaggtgaacaagaacataaatgctcaagggaattgagggaaagatacagatgccaaaacattatttcagcaaagacactaaatggaaggggaaggaaatttttccatagcacagaagattctttaatgctataagtcaccttagaaacaagcaacttacatatcaatctaggaatttcactgctctctagaggtggtaatgagaaaaagagggaagagaagagagggagggaactaaggtggttataagaagggagatgaggatctacaatcaatgaccaacaatttattg

SEQ ID NO: 189231 - DNA, 710 bp, Homo sapiens
ggatcacaggaggggcaggcacgccttctcttcctaatgcctggaagagagggaaacctggggagtggggagctggtcacagaaacatgagagagttggaactggcatttctggactactggcttgaaaaggttctaactgaaaacagagaggagggagaacatgccttgataaactcacaaatctggagacacgaaagtagctatgtgtaaggtgaacagctcatttttcgcatacagccactgggaaagggcagagaacacagaatctggagaggaacatagagcaggggccacaaacacgggaatctgagatttgacagtggatgaaaaggtggctgcagagttgtccctgagctcaggggagatggaggtggcaacagacgggctgcctacttcccaagactcagacctgtcagtactggccagtgggtgaacatgaccaagaacaggccaaggacagtgatgcaagtaggcctagcacagaggtccttggtgagaaaaggacttccctgggccgagaactacatcaaatctcaggagaggtcagtgggatgataaggacaggaatcattaagtcctagatccagaggcttaggagcatgtacaagattcacatgtgcaggccttgtatgctttatggaactcatgatgacactcatacaaaactgtgtccatttcacaaagctcatgcccacacactgctgggca

SEQ ID NO: 189232 - DNA, 326 bp, Homo sapiens
tactctgagcctgtattggtgaacgcgaactcaggggagatggaggtggcaacagacgggctgcctacttcccaagactcagacctgtcagtactggccagtgggtgaacatgaccaagaacaggccaaggacagtgatgcaagtaggcctagcacagaggtccttggtgagaaaaggacttccctgggccgagaactacatcaaatctcaggagaggtcagtgggatgataaggacaggaatcattaagtcctagatccagaggcttaggagcatgtacaagattcacatgtgcaggccgggcgtgatggctcacacctgtaatc

SEQ ID NO: 189233 - DNA, 643 bp, Homo sapiens
gtcaagaatagtcacggcaatcttaaaaacgaacaaagctggagtcctacaccaaagcctataataactacatcaaataccaagtcctgtagcaatgattgagagtaatccacacagagtggtactgctacagtaacggacaaaacagaccaaaagaaaagaacaggccgggtgcggtggcttgcgcctgtaatcccagcactttgggaggccaaggcaggtggattgcttgaggccaggagttcaagaccagcctggccaacgtggtgaaagaaaaaaataaagacagacaatagcaattattggtaaagatataccataagtgaaactctcacataatgctgttaggaatataaaccgggacaatcacttcagaaaactgaaagtgtctaacaaagctgaaaatacacaactagatgactcagaaattctacttctaggtatccacttaacagaaatggatattcgtgttcaaaaaaagtataattgtaagaagcataatttgtgatagccaaaacatgaaaacaacctaggtgtccattaacagtaggagacatataaattgaggtatattcttaaaatggaatgctagtcggtcatggaaaagaactacaactatatacacatgaataaatctctcaaa

SEQ ID NO: 189234 - DNA, 220 bp, Homo sapiens
gtggaaacaagaggtgcattgcaacatagcataaaaccagctcccagaagaggaagcaattgtattttaacgagaaaggaatgagtttttgtcgggaaaccagcccatttcgggaaaccagcccatttcgcaaaaatctcagtaaaatcttggtacagtcattgctttctcaacagcaaaaagttaatcaggttctgtgtctccccccacccaccaccac

SEQ ID NO: 189235 - DNA, 315 bp, Homo sapiens
ggcacctggttcgatgccatcaatcctagatatttgcagcgggaactaccggggaccacagcagacggcagtgaataaagacaaatgaaattaaagaccctcttgggtgtgctgactgcctaccgcagggagacttcattaacagggggcaagggatacaagactgaagaaaacacaaaatagaacttattttcaaaccacagcagtttcaacagttacccaagcggtgtaccgaaaccacacacaggactgactttagcaaaaacaatatgaaccaaatggtttaccacagtatgtgctgttaaaaaaaaaaaa

SEQ ID NO: 189236 - DNA, 683 bp, Homo sapiens
acaagtcaatcagccatcacgaagtgctgctgtcagcaaggtctccatggcgtgtgggaggacacaaaggagaggcatctaaattaagctggagtcaagaatgaccataatgaggctcctgggaccaaccataggttaaagaaaaaccatctggtgctgagaatccaaaggcagcgggaaatcctcaacaggaactggagaggttggagaaataatagagcagaagccacctggaagcaggggcccaaacaacagggcaggttgttagctgcattgcacatagaagggtagaagaggaagaatgattttacttcttgacaaagaagaagaaggaaagacgtctgcagggtaagcatgtctgggagtccctgccacctgctgccattcatttaatcatccctgggagccggactgcaggccctgtgccaggctgtcagcagcagaaactggcaaggagagagctcactcagcagctattagataccagggcctgcccaccagttacagtgtgaactggggactggaggaacaggaagcaatggctgatctcagcagtcagcaggaggaaaagtaaggcagaactgaaatgtatgatgtgtttactttgttatcagcactgtgtcatgctaagtacctttgaaatgtctcttcttctcattcctcgaaatagtcctactaagtag

SEQ ID NO: 189237 - DNA, 126 bp, Homo sapiens
gggagggacagaataaaagagtggagatggatacatggtagaatgtgaagcaggccgagtttgagtgtgggtgctacgagggagaaggatgactagagatgactgggattacatgggcgttataca

SEQ ID NO: 189238 - DNA, 249 bp, Homo sapiens
aattgctcagggtcacctaaggcaaatctgtatctagagattaagaggaacatatcctagggttggactgagctgtggtaaatcacaggattatataactctgtactgtgttctgactttcgtaacttggctgggagaagggaagagtgagcaagccccctgccctcccctaaagcaggcgctttgcctaaagccatgcaggactgcagaaggcagctgcagatacagttgttgtgtaacacgaggtag

SEQ ID NO: 189239 - DNA, 478 bp, Homo sapiens
attaaatttttgatgaacatcagggtcttcaatgaagaggatgatgataattgctatcattgattgagcacttaccatgagctagaccctgatctaagatctttgtggctgttaaatcttcacaatagctccatgaggtagatcctacgattatccacatcgtacagataagtgaatcaaggtacgtggaggatagcattctgtctactttcctacaaaccattaagtgcaaaaatgggatttgatctcagccagtcaccgtgctgatgacatctttcaacctgctgggctagcaggatattgagaattccaggagaaacgaggtaagtagtatattgtaagaggagaaccttggagggcacaaggagaaaacagcttcattcttttccccaccatgtgcttgaacctgctccttggaactagttcccctctgccctctgggtgtgtctagggcaggtcccctgatgcttctagtcac

SEQ ID NO: 189240 - DNA, 114 bp, Homo sapiens
gaaaatcatataataaagtataaactgaggtacatgaagaattgttaagagctttaaaactttgatctaaccagagaagcaaaggaggctgaggcctcctacttatggtcactg

SEQ ID NO: 189241 - DNA, 908 bp, Homo sapiens
ggtggtacggcccggagtaacgagtgcttgaactctgttttcctccctcccgcttacgggctgctctgttcccaacagtctttcataggatttttgctaatggtgagagctccctctgccccacttggggctctgtttgtgctccctctgctcccttggcggctgcccagtgcatgcagtcgtgggagcaaaccctcttcccctatcttccctgcctaattatgcctgcttagcttctgccctgccagccctccgcctgcttgccccttcataacctgcttgtttcctgtggattctgcctggctggccacttacctcctggattcatgttctccctcatcatcaggctagttcccagatcatactgtgctcccagattctctgtgacttgtagtcattgtttatgatctgagtgagtccaaattgggcctggtcctggttcctcgttcagctctgtggcagacagtgttgaggaataagggggtagaacaggagtctaaaatgttttggtggattaaaagtggaacagattcaagggtattagctcaattctgagctgttttgagtttcactcagcaaaggtgggtaagaaggaggctacctcctgagctgtatgttaatacttcttatccttatttatccaagttcctgaggtctccaattgtcccagattaggaagggctgcctgtgtttttatgttatttgcagggtggatgaaaaaactaaaaccaaatattttcatgtgagcagggattagaggtacctgggatttagggaaggtgaacgcagtacaagtgaaaatttttccttaaacttcattgcttctagaccagcctgaagcccctgtgtatctgttaatttagtctggtgcttttgttgctcctgatttagggacattagatgagaag

SEQ ID NO: 189242 - DNA, 1155 bp, Homo sapiens
agggggtaggatatataatcttacacctttttgaagggaaaattggggttaatacagagatactgataagaggctgggaaagggcaagagataggtttgaggtttgatttgagtcctggggccagaccctgccagaggaggttccaggctgttcctgctgtgagtgctttcgtttgctgtgtattgtatgcagtgtacaacatttctgtgtgctgtgtctgtgtggtatttgtgtgtccatttgtctggggcttggctgctccatcgctcacaacttttctctgttttcctccctcccgcttacgggctgctctgttcccaacagtctttcataggatttttgctaatggtgagagctccctctgccccacttggggctctgtttgtgctccctctgctcccttggcggctgcccagtgcatgcagtcgtgggagcaaaccctcttcccctatcttccctgcctaattatgcctgcttagcttctgccctgccagccctccgcctgcttgccccttcataacctgcttgtttcctgtggattctgcctggctggccacttacctcctggattcatgttctccctcatcatcaggctagttcccagatcatactgtgctcccagattctctgtgacttgtagtcattgtttatgatctgagtgagtccaaattgggcctggtcctggttcctcgttcagctctgtggcagacagtgttgaggaataagggggtagaacaggagtctaaaatgttttggtggattaaaagtggaacagattcaagggtattagctcaattctgagctgttttgagtttcactcagcaaaggtgggtaagaaggaggctacctcctgagctgtatgttaatacttcttatccttatttatccaagttcctgaggtctccaattgtcccagattaggaagggctgcctgtgtttttatgttatttgcagggtggatgaaaaaactaaaaccaaatattttcatgtgagcagggattagaggtacctgggatttagggaaggtgaacgcagtacaagtgaaaatttttccttaaacttcattgcttctagaccagcctgaagcccctgtgtatctgttaatttagtctggtgcttttgttgctcctgatttagggacattagatgagaag

SEQ ID NO: 189243 - DNA, 246 bp, Homo sapiens
tcaggacacccggtgtggattaaggaggtctatcgcaggggtctacacatcaggacacccggtgtggattaaggaggtctatcgcaggggtctacacatcaggacacccggtgtgaattaagtaggtctccacaggagtctacatgtcagaatacccggtgtgaattaagcaggtctccacaggggtctacacatcaggacacccggtgtgaattaagtaggtctccacaggagtctacatgtcag

SEQ ID NO: 189244 - DNA, 397 bp, Homo sapiens
ttgtgatatattagaactgtattgaatgatgagacttcccaaaagtttaaaacaaaaaaaggaggcagaagagaacgaggatataaatgaggacactctcgctgaggacacatcagctgttagcagtctgtctctgtgtaccgagctcaagaactgtgactttggttggaagttagaccttttctatccagcttcagacatggtaaccttcacataagctgctggatttgttctaccagaaatttagtctgttgtgtgactccagccactttgcaactcaagattattacttgttcaggtttctttcattaaatagctaaccatttaacaactattatcttcttagggtcgactgatggttacccatacagtatatacatcatccatatcctttcct

SEQ ID NO: 189245 - DNA, 501 bp, Homo sapiens
aactggaagtctcatccattgctcatggggatgaaagatgatgccacattggcgagcagtttggcaaagcttcagatgctgagcatgtacttatcatatgagccagcactcccactcccaggttcttacccaagagcactgagaacaacatgtgtgtgcacacatagcaggtgtttttctttgctagagcttccacaagcaggaaccatggatggggtgttgcaacaagaaatgtattttctcacatatctgcaggctggaagtcccagagcacggtgtctgcagggttggtttctcccaaggcctctctccttgccttgtagatggccacctgttctctgtgtcctctcacagtcttccctctgtctgtgtctttgttataatctccccttcataaaaggacaccagtcactctggattagggctcactctaatagcctcatctaacatccattacctctttcaagaccctgtctccacatatagtcacattctgaggta

SEQ ID NO: 189246 - DNA, 319 bp, Homo sapiens
gaatataagaggaagaaaattaatctgatcccagtgagaaagccctgagcacagatgtaaaagaagaaagcagcaaaattgtattgataatcctatttcctgaaatagatctctcatatgaaatgtaaggagattttagaaaacagctattacctattctgagggagattagacagggacagtgcagggggaactgggtgcttcatcatatcagattgtccctggaagcggaaataaataggcttacaggaaattggattattaagcagaagatcaacaagagaaacctatgtggcaagtgagggaaattaatggagag

SEQ ID NO: 189247 - DNA, 361 bp, Homo sapiens
tactcatggtactttgttcatatgtttgtgtgctggacatggtatttgaaaaattgtttatagaaataattagaggctttgggtgtgatgtctttttccaggtgactgacggcactagccaacgaggatcattttaatacaagttgaagcccaggcgcgctggctaaggcctgtaatcccagagcactttgggagactgaggcaggcagatcagctgaggtcaggagttcgagaccagcctggccaacatggtgaaaccccctccttactaaaaatacagaaattagccgggcgtgatggcgggtgcttgtaatcccagctacttgggaggctgaggcaggagagtcgtatgaacccggga

SEQ ID NO: 189248 - DNA, 393 bp, Homo sapiens
actctaaaatgtttgcgttaatggtaagggaggaacagctggacaaatggccttacggggcaacaggcagttggtctgcaaggctctcgtgctttatcactggcaagaatcaaggcaagagcacagaactgcaggttacactcagaaaaggatggcgttaactcgtaaagaacacacgaataaaatgtttctgcagttttgggtttcataaaaccctaaatccggccgggcacggtggctcacacctgtaatctcaacactttgggaagccgaggcaggcggatcacctgagctcgggagagcatcctggccaacacagtaaaaaccccatctctactaaaagtagaaaaattagccgggcatggtggcgggcacctgtaatcccagctactc

SEQ ID NO: 189249 - DNA, 130 bp, Homo sapiens
gagttaacaaaaccgcttctctttctgtacgagaatttgctccttggttaacgctggctctcatcccttggaaacctgataaggaaagatgtcatcagtattactaggcaacattgcttatagtaaaaat

SEQ ID NO: 189250 - DNA, 280 bp, Homo sapiens
cagcaaatgtgaaaaagcaagaacacccagttctgagtctcagcctggtcccaggcagcggattacaagcacttaaactgctcagcgctgttgtcacacagtcttactaagtgtcgtgggtgtttgacgtaccaagggacacacagaatcacaccaacacatcccactactctctagccatggtaaatgtgttgcctaaaagcattgcaggtttcaccctttttattaaacaccattattccaggggcttgattattagtacattggtgttggatgtcaa

SEQ ID NO: 189251 - DNA, 386 bp, Homo sapiens
catgccctctcctccaccatcagatgataatttcaccaaaatccttctttcatcattctaataacattaaaacttcagggtgccaaaatggccccccaatttagaagtgacaggagtgcacacacttctcatagttaactcagttcaaatttacctaatgctagaaaattagaagccccttatttcagatacactcaacctagcaacaggaaaaataccttaacaagtgaaagttgtcatttctctgaacatatactcctactttcagaagccctagcacttgtatttctacacttgcctaaatcaacattcttcataatcctagataaaaacacgtatctctatgtaactttctgggatatgctgaatcacactaagtagaaacc

SEQ ID NO: 189252 - DNA, 196 bp, Homo sapiens
aaatcagtgcttcaggaacacaatttcacctgttttctgagctaaaggaaactaagacttcccgttcagagcagagttgaatttcagctccattcctggctgccaggtcacgtggggagggcagcaggtgcccggcactcgtcccttgcagctggggccaaacacagttcccagcccacccggcggacgggccggc

SEQ ID NO: 189253 - DNA, 1174 bp, Homo sapiens
ggtaccctgaatattctgggtcaagcgattctcctgcctcagcctccaagtagctgggcctacaagtgcatgccacacgccaagctaatttttgtatttttagtagagatggggtttcatcatgttggccaggatggtcttatctgttgaccttgtgatctacctgccttggcctcccgagtagctgggattacaggcatgcaccaccacgcctggctaattttgtatttttagtagacatggggtttctccgtgttggtcaggctggtctcgaactcccgacctcaggtgatctgcccgccttggcctcccaaagtgctaggattacaggcgtgagccaccacacccggccgacattggttttatttctttcgctgcaacctgtttttagaagtttaaaatagggctattttggaactagttgtttattggacctctttaaatgggttagcgtatttttccttgtatgacacttaactcagcagcctctggataaaaagaatgtgagacacaagtgcattttttttcttgtttatggtactgtctccttgaggtctttcatattagccctctgttccagaaattaaaataacttcattgaactcataagggaataggagatttgtcctaaaatccaaacttggctttgaagatgctacagtgattttaatttttttttttttttttttttttgtggagaaggggaggtttcgcgcctctttgtgcgcccagggctgtggggttcgcaggggcgcgcgcagactctctgggctctccccggaaaccctccgggcctctcccagggttctcaaggcggattcttcctgtgtttttaacgccttttccaagtggggcgtggggattctcggggggctattgtcgcccaaccccgcgccaggggggtaattctgtggggtttttggcggcggcgaaacgcgggggtctccccccggtggtggggcccgggcggtggttcttgagaaaactctccccgacaccctctcaggggtgtggaactcccgcccgagcacttttgggggggtcctccacaaaaagttggtgttgtgggagaataaccgggggggttttgcagcccaccctttggcgcccacgccgcccatggtgaactttatatttttttttaaaggggacccacaaattgttttaacattat

SEQ ID NO: 189254 - DNA, 136 bp, Homo sapiens
ccatcccagacactttgcagaagtgggtgcagtggggactttggacgaatcagaagcttctggctgaggggacctttagttcttctaaccccagactcaggggactccaggactccctacaccctccagttatggg

SEQ ID NO: 189255 - DNA, 298 bp, Homo sapiens
tggagattgcgccactgcactccagcctggagacagagcgagattctgttaaaaaataaagagaagaatattagccttatcagttgagaaatgaaaaccctacgttttagaaaaacatcatagaagactgattcaaatgttttaactgtactactaaacctagaaattctaaagactagtatactggaactacctcccctgccttaggactgactattgctattttcttgtagatagtcactttgtaatgtagtggatggtattcactgtatattgtacctcttcagctcctttaata

SEQ ID NO: 189256 - DNA, 265 bp, Homo sapiens
agagaggagaaaggagacaagctggagagagagagggagacagagaggagaaagaagacagctagagaaatataagacagaggagacagagacacggagagatagagacagacagagagacagaaattacatggtgatagagagaggtggagagagaaacaaggggcccataaagagcagaaggggaaacaggaggagatgggacagagagaacagagagacagagagataaacagtgaggaagaaagaaaaccatgagaaagga

SEQ ID NO: 189257 - DNA, 153 bp, Homo sapiens
ctttagaaaatatccactaaccccaaagcaatgttataagtcttaaaatgattatttaatgattgtactgttactcatttataacctgacattattaggcaagtatttacagataaatcaattataagtgaacccatgagaaaatgtaattag

SEQ ID NO: 189258 - DNA, 408 bp, Homo sapiens
atatagagactgtgggaaaaacagcctgatcttttcagctctagtgaggaatttacaggagaatgtaaagttttaagtagtctatatcaaagaatactataatttcttccgatacatgtctatgattgtgaaagaccagaagttaagcttgagtaggtgaacagataggtaccagaatggccttaccaagtaagtaaacttagaacacaaacaccactccagttgacctgagaatcacatatactacagggagaatagagcactttcttaaaatggagtgagatattttcctctctccttttcataaaaccacagtgccacgtgcagatgatatatattcagacaaattagaataatacatgacttcttttttgaatctttaaaaattgaaattgtccacattattta

SEQ ID NO: 189259 - DNA, 458 bp, Homo sapiens
tgtttctgtatatgtttgaaaacttctacaaggttttcacattgaagctttgtatttttagttattaaatacgcatttaacagaaaagtcacagaattctcacttgaaagaattctatctttcaaaatccttagtacaaaatatagttttccatcatccttactagtggcaactaaaaaaagaaacaaacagatgcttattttaaaatctaggccgggtgtggtggctcacacctgcaatcccagcactttgggaggccaaggcaggcggatcttctgaggtcaggagtttgagaccacggtgaaaacccgtctctactaaaaatacaaaaaattagccgagtagctgggattacaggcgtgcaccaccatgcttggctaatttttgtgttcctaaagtatagtttagtttttattattttgagatggagccactgtactccagccgatagagtgagt

SEQ ID NO: 189260 - DNA, 332 bp, Homo sapiens
atcctctgagcttgctttccttattaacattcaagaaagataaaagcgccctggctcacattagtacccactccaattggggtgttcctgtcagtgttctgtcttgcatgtgacatagccccccaggtatacggggagccattacccacacacatcctcttcactgtcactcagaggacatgcacaggaagtggtggcaaccgccccttatgacacactcagtagttcttgtatctgttccactgccacatctcttccttaaaggcttgaaaatgcatctaagggtaatatttgtaataaaagtgaacttgacagatattaaactaaatttt

SEQ ID NO: 189261 - DNA, 236 bp, Homo sapiens
ctgtgtacttgttcttcaggcaagaaagttttatcgagttttgactgctgtgtgctgcaactcactgtggtcttctatcaggctaaaacataaaaatggaaaactcaccccatacccggttgttactcctttcttcttccaagctctctcttcttttctaagtcctcctgcttttgttgatgcttaagcgcttcaggcagttatttttttgcatattgtctggagtttatacttat

SEQ ID NO: 189262 - DNA, 504 bp, Homo sapiens
aaagggctgtgtggggctggacggatagttaggacttacctgagcaggaataagttttcaatggtacaggcagatgctttgggaatcaggaagtgacctgctcctccttgaaatgactctgggctggggcaatggtgacactgccacctcatgggatctggggttacctggtggaggaaagacgcaggatgaagagaaccaggtataaccctgccacttggagtttttcctacaacttgggctggtgaaatgctgaatctcagtttatgttcaaaataaatgaaacctcattctattaccaaaataaactgctcacatgtgatgttgataatgagacagccagacagaagctgccttcataccaaaacaagtgaatcaggtggtaggaataaatgaacaaagggcaaggcattgtcactgcccctttccttcagcagtagaaagactgactagaaaattcatacgtaaagaaaaagacctttttttctgttgttacaacctgaa

SEQ ID NO: 189263 - DNA, 313 bp, Homo sapiens
cctctggtggctccgagcatatgtggcaaagctgtgtcttatttacctcccacatcatcatcctctcctaccctcatatgacatttctgcctgtccccttgacagtggagtagcagctgcatgttccgaacgtccccaccctgccattttcctaaaatgctcactaacgttatttgactctcaggatgtgtagacattttaaagctgtatttcaagataaggccatttcaaatgaactgtgtcttatgcacagggtaataattctctgttcctggcttttttatttttaatgaaaaatgcctgcaaggacctc

SEQ ID NO: 189264 - DNA, 319 bp, Homo sapiens
aacaacgatgccatcataaattcttcctctcattagttttccatccaaaaccaaggaacatctatttcattaaacagttccttagattttaaaatgctactcaacaatgaacaaaatactaagatataacatgtcagattctcttatttttatttttttagggacaggctggcctcaaactcctggcctcaagcgattcccccacctcagcttcctgagtagctaggatgaaaggcactgagtcaccccatccagctagattctctttaacaatttcaaggggtttaagctgaaattagaaactgggtctcatcttgtg

SEQ ID NO: 189265 - DNA, 308 bp, Homo sapiens
gctttccacctccctgtcaaaacaataaaaaaggccacaggcctgtggttctggcctccagggaactggtggcttctttaacccacactgctgctgctgaatcccatttaggtttagggtttattttgtatatgcctttgtacaggctaaatgctggtctagttgaaaatcaacctaaaacaaccttaatagcatctcattttattgtgactttactttttgtgttgtttggtgttttacttttggagacagagtcttaatctgtcaccaaggctggagtgcagtggcatgattatggctcaacctcc

SEQ ID NO: 189266 - DNA, 495 bp, Homo sapiens
ctgtgtggagtcagcctttttgtgagtgcagcggccctgcaggatgcaccgggtttgagaagtggactcccccgtctcccgccacatcccaaaagccctcagccatgagggcaggacgaagccgacggtcgccctcgtgccgagatgacaaccgggcacagaggcggtggctcccagcttcctgccctcttccccgtagtggggttacccagcgtgactcatggcccgagccacaggcacccgcccagggagccacggcggggagacctggctttattagagatgcgttcgtgcctcatcaagtccaaaggaggaaactggcgcgtccctcactttccctgaaacaggctcccccacagcccaagcggtcaggttaaggtgcatttgcagacagatgccctagtaggaggctggagcttttggcccagaattttccctgctgtaggcccatggtcaccgagcctgcccgggggctgaggccctgaggaggtgcca

SEQ ID NO: 189267 - DNA, 527 bp, Homo sapiens
agcaaaggcctaagcagagaacctagatttccagctttgccgtgctgtatcaaggtatttctccacccccaccagtgccaaagaaggcacagactgagaactgggacttccattccaaccaggcagtaatgaggtatccctccctttttccagtgggcgatgtcagagaggacttaatggagagttgagacttttaccatagctcagtggtaataagttcccaaggagccaaccccttgactctggtcagtaaaggcctacagaagaactcagacgtccacccccatctcacaataataaggcagcacccccttcacacatcagagcaatacatatcaaaggaggcctgtaaaaaaaccctcaaaacccaagatttaagtaggatccagagtctcataacataagatcccaaatgtccagatttcaatagacaatcactcatcatacgaagaaccacaataccaaactgaattagaaaaggcaatcgacagatgccaactaagattacctagatgagagaatcacaa

SEQ ID NO: 189268 - DNA, 446 bp, Homo sapiens
cttggtatctcagcaagttcagcagcccttaggcctgatttgggtcccagcctgggtcagtttctattggcaaagcctgctgagcatactttctgacatctcctgtgcctactggagcattgctttctagtcactgataagccacttgtattactctgcagtgtttttctgtattgaacagtgacagaaggaactgcttgcagtcagcccaggttgggttgtgagttaagaagatggactgcatcaggtcgataagagcctggggtttttctgtataggagggagtatgctgtttccagttgaaaatatctgtagtagagaagggctgataaacataaagccgttctcctccttgaacctcattttgtgcatctaaatagatctgtcccctaggttctctgaatggcatctgcaaagctcgggcgtgtcctgaccggagatggccg

SEQ ID NO: 189269 - DNA, 358 bp, Homo sapiens
tcccttcaacccctcacctgcccctcaacctggccaatgagctgttaacacagcagtaatagtcccactagctttgggaagatcaccaaattcttcccccttcccaatcccttgcctcttacccagaactagttacataatttactgagctcagtgcaaatgaaaatgtgaggcctcttgattaaaaatcattaagactttcaagatggtgacaagagcaccttcagcaagcatggggtcctgtgagaccgcacgggctgcatgttcctaaagccagtgctgcccttgccacttccatcttaggttaccaggaccaaccatggagatgtatataacacaatttgagaggcactgaaca

SEQ ID NO: 189270 - DNA, 699 bp, Homo sapiens
tgctttttaaaattatactttaagttctggggtacatgtgcagaacgttcaggtttgttacataggtatacacgtgctatggtggtttgctgcacccatcaacccgtcatctaccttggtatttctcctaatgctctccctcccctagctccccaccccccgacaggccccggtgtgtgatgtccccctccctgtgtctatgtgttctctttgttcaactcccacttatgagtgagaacatgcagtgtttggttttctgttcttgcgttagtttgctgagagtgatggtttccagctccatccatctccctgtaaaggacatgaactcatccttttttatggctgcataatactatgctattttatatcagggacttgagcagctgtggagtctggtatccatggcagggtcctggaaccaattcccagtggatactgagggatgactgtacagctatagagtggccaacattcatttgtaaacagtacccacgagcctgtgtctttctgagtgaaatctgtgaagcaataatgaattgggaaaatactagcttgttatgtagattcagttgctttctgcttttatgaagttctaagtgtattagtcacaggatcagcgacagaaatgctacctttaagaagaatttcaatgtaatctattggggcatgctcacagaagttaggaaatcaatcatgttt

SEQ ID NO: 189271 - DNA, 363 bp, Homo sapiens
ctgtggtctgcgtgtgacgacatattgtgcgttctcagatggctgtgtcctcatacaattaaggtcccatttgatgcaagctcttccaatgcaggtgtggcttttcagtgtgtcttgtctagacttgtgttgggggcatggtgtccagtgcagcagttacatgaaagacctggctcttaagagtgtaactgcatgagctgcaggaaccagggacggatcagggtaggtggtgcccagcagataatttggcacatagcaggactcatcctgtctaggcttccagcgggatttctcattgattagcctggctgggaccaaatctgtccagtcacagggcattcagtcaaggctgccacctcagcc

SEQ ID NO: 189272 - DNA, 398 bp, Homo sapiens
acttttgcctttactaactcatttcacaagtatttgaggatacacttcagagcactgaggttacaaagacaacagtgtctgtcctcaaggtctgtctaggtaagacacacagccaaataaacaattctaatacagttatacagttttagttctgacacctccaatgagctgtagacttgtatttgtcatttccagtcagaatgcaaaacacagatccaaaacagaactttcaatttctcctccaaatctattcttccttcagctggtcgtgtaagtgatgccactatcacatccacttaagacaaaaacccagaggagtactgccttaatcagtaatcagtgttacccttcttctcactgtgcatgttaattttgccacatctttttttttttttttt

SEQ ID NO: 189273 - DNA, 490 bp, Homo sapiens
ttttcgtacatataatttctcaatcttgtttaaagtacacacgcacataagaagctaattaatagtacaaggcagaatcagttaaatgccacatgggtggcagacagttttataaacaccacccaaacctttatttgtacaaaagcaaaagcaagcaacctcatcgttaggagaggagttactgccccataacccaggaaagtcttaaaaagaaattataccaagtgtacttttcatctctatttctgtttttcactttttcagtcaatcagccacttactatttattaagtatttcttccatctaagcaaggtgggggagggagagaaagagattattcctacgtttatgattccaatcttgtttaaagtgtattcgtaaaacgtgagttaataatgtggcatcaaatgagtgccttgtgggcctcttgatggtgagtgttataggaatgtagaggtcaaaggaattgctgtggactgtggtgtgtgtg

SEQ ID NO: 189274 - DNA, 336 bp, Homo sapiens
gtaccccacttgagtccattgcgcatttcttagagtagagatggggactcattccaggcaaggtcacaacggcattttgttgccctcaatgctgtttttcactttttcagtcaatcagccacttactatttattaagtatttcttccatctaagcaaggtgggggagggagagaaagagattattcctacgtttatgattccaatcttgtttaaagtgtattcgtaaaacgtgagttaataatgtggcatcaaatgagtgccttgtgggcctcttgatggtgagtgttataggaatgtagaggtcaaaggaattgctgtggactgtggtgtgtgtg

SEQ ID NO: 189275 - DNA, 139 bp, Homo sapiens
atttcatcactgctggagaccagagaactttccttttctgaaaatatatctgatgtaagacagacttttattgggttaaaacatggacatttgagggctaatttgtatagcaactggcatcatcctaatatttgtatcc

SEQ ID NO: 189276 - DNA, 490 bp, Homo sapiens
catttgtagcatccttatttgtaatagtcaaaaactggaaacaacccagatgtccatcagtaggtgaaaggatgaacacactgtgctatgaaatgctactaaataagcagacaacaaagaattttatcgaatgttttgccactgccataacatggactgaccatccttctagcctccagtaacagttttctgctgccgactttgtagtccttaagccagtgtcacatgtttagaatttttgttgtatctttggtacttctgttgctgatttccatatcagtcagaatgagccaggttttactgtgataacaaccccaaatttcagtgacttaaaagtttgtttctttgtcatgaactgtatgtccattgtgggttagctgaaagttctgttttctgttattctcaccctgagactcaggctgatagaagtcattgtctgaaaccttcctggttgctgtgaatgttgactaatttaaacttgcttgatata

SEQ ID NO: 189277 - DNA, 396 bp, Homo sapiens
tgagcctcagctccttctaatttagtgacagagctaccattctcatctccacatagtatctcctgagtaactgtccagttctcaggcggcttaactcccactaagccccgaagagatagattttctattttttaaaacgcaagcccctataaagggatagacggtgcttcttttaaagagcttttaaatattattaaactcaaattttcctctctagcaggttcatggcatgtagagttaaatatagaaagagcgtttgcacaaagcctgtatttgattagttcccttcttaactgatataattaaatattgaattgacccagagtgctgaatattactttctggtgggacctgtgccaccaaatacctaaaagcctttagttgtttctttgctgc

SEQ ID NO: 189278 - DNA, 444 bp, Homo sapiens
cgggcactatggtagggcaggagagaagctatctgcaggccttctggaagctctccagtgcatgtccccactggggtgggggctgactgtctccacgtggggttagtcctgcagaacaggcaggtagagtagagtctgagggcatgaggaaaggcagtctactggagagggcacagagagttcaacaaacactgaaacttaagtttgtcctggacatcttcagcatccgactttctggtggaaagcttaaagtataaatgactgtgccctctcaaaagggcacagaagtaaaactgggaggattttgggaggggactggatgtggggtgaaaggtatggtgagagcagagaagaggggcctgagcctggggtcaggggaaagtaggctaaacaattcacaggatgcagacatttcagagaagggtgacacatcacttggccctg

SEQ ID NO: 189279 - DNA, 411 bp, Homo sapiens
tgggcagattacaaggtcaggagatcgagaccatcctggctaacatggtgaaaccccgtctctactaaaaatacaaaaaattagcagggtgtggtcgtgggcacctgtagtcctagctactagggaggctgaggcaggagaatggcgtgaacccaggaggcagagcttgcagtgagctgagattcgtgccactgcactccagcctgggcgacagagtgaggcgctggctcaaataataataataataatacaataaagtaccaaggaaataagaaggaagagaggaatggagagaggaagaagaaaagaaagatggaagagaaggaaggagagagggagacatggtgacagaaaagaaagatgaagaaagaaataatagataatcagcaactcaagaaaaagaaaaatact

SEQ ID NO: 189280 - DNA, 442 bp, Homo sapiens
cagtgagcctgaatcctcatctcctgattgacaggaaaaatctctgtggtatcagatcacctggattgcccagtgctatgggctcctggactcaagaaaattgttcaaagacgcaccaaaattaagtattcattattttcagagtttgtatcaaatttacagtggtagccaaacaggaaatatcacatgctgccaagatcaccacaggcatatttaaaaacttgtattaaatatctggttgctggagtgcaatatgaggtgctgttcaaagagcctctgtagctgtggtcctgccttctggcagcttacagcagcctaacgcagacaacccttacccccatgtaaagtgtaagaaggtaaggtttgacagagcagaagcatcgccatcttggacaagcactgccattttaagttctcccaattaaaaaccgcctaaatccag

SEQ ID NO: 189281 - DNA, 679 bp, Homo sapiens
tcaaaaaaaaaaaaaaaagtcttccttaataaaacagttaaaaactccaagcctcacaatactctgtaggcctcactttatacatcagatttggaaggtcacttcagaacaaaactgcccctaaggaaacactttcctttacttgcaactagctgcacagaaatctgggcccctgctgctttatagactaaaccctttataagctaacgaatactggttaaaatgcaggaaaagtgccattctggaggccctctagatacggtgtttggattggccagcactgtaatggatctatactgatttaagcatagcaaccagtgccatattgtaatactaattcattctcaggagggagtcaagaaacattttcttgagttaaaatcaaattaacccacataaatcaaacctgtgaacaaatttataagtcttgttccacactactgggccgtttgaccaaggaattaataaactgatagtaactcagccgagcacagtggctcatgcctgtaatcccagcattttgggaggctgaggcgggcgaatcacttgatgtcaggagttcgagacccgcctggccaacatggtgaaacccctatctctactaaaaatacaaaaattagttgggtgtggtgacgcaagcctgtcatcccagccactcaggaggctgaggcaggagaat

SEQ ID NO: 189282 - DNA, 1186 bp, Homo sapiens
ctcgtggatggagtgatggcgagagtacaccagataagggaggggaaggggtttttatttctaacgctgggtccctacttctgtgtctctcccccgtgggttagggtcagaccgcagaatctaaactgaccctattggctatctgtgaatattttccccaaataaggaagggtagggggatgtgtgagtcatgatggtgggatgtgcagtttcaaagagtggaatagctgcagaatgagtagccaagggaacagatgtgagttattgattagagctgatgggaaggttgtttacagtaactagaggcaaggaggcaagagaatcactttaacccgggaggcggaggttgcattgagccgagatcccgccactgccctccagcctgggtgacaagagcgaaactgtctaaaaaaaaaaaaaaaaaaaaaagaaaggcaataatactcaactattctcttcatctgaagttcttaggtctgtacttccccacagtgcttcaaaacagaggcctccaggaaccaggaagaaagaatggaggctttattacactgacactagaattatttactattataatcagaatagtattctagtatcagtgtaataaaatatctagtatctgtataatttattaagagcatgtttggactaagtgtagtttttacatttttttctgaaaaatttgatcctaaggaaaacttgaacatctaacacacccagtctagtagatttacttaattttttagcattttatttctttctcctcatgtaaatcttacagtgaacaatttgagtgtaaattgagcataaattgtacatgtgatgcttgacctttaaatactttgtaatgcacctcctaaaaataggcattgtcatactaaaaccacaatactagtatttcacttaaattaaaaataataatgtcatctaatgtctactttccgtaataactaaaattctcctcattgattcaacgtatgctcttgggtgtttttggatctaagatccattcaagatttttgcattgcaattgtcagtgtcttcagtgtctttttgcctataacagttattactgtccattatattgactttcagagagtcacactcattctcttagaaagtcatacaatcagatatttctgattggattctcatggtgtgtgtaaatattcctttatttcatgcg

SEQ ID NO: 189283 - DNA, 794 bp, Homo sapiens
ttaccaagttctgtggcagtcctttttcatgtattatcagttctcatgtgaacctcacaggactggtggtggtatcatttctcagttgaccaaggctcacagagattaagcagtttgttcaaggttacacagcctccacatagctgagctgtgcttggccgcaggcttggctgagcacatacttgactcaaaggcactcgcctccaaagctgaagcttcgttagatgtagatacattgttgtcttctcagagtcatcagaaagttagtccagggtaagaaaaaatgtcatctccaggcccagagggatagcctgcagcttagagggcacaggtttgccagtgttcattgaggaggtgaccagagggtgaatgggcagccactggcacaaactagcctgctctctgtggccaagcctgccctctgtggccatagtgaaagtaccaactgggctagggatgcctctgcccttagggttggtgcccagagttcatgccagtggcttttaagtgcctgggaatcaggaacttcctcagttcaccaggcctccaagccccaggatgcctcctgacagttctgttaaagacacactgagtcttctccaaggaaaattgaggaaggacacacccttcccaatattggcttctttcaataaatttctaaaagggagccagacatggtggcgcacctctatgactatagtcccagctactcgggaggctgaggaaggaggatcacttcagcccagaagtttgaatctggcctgcgcaacatagtgagaccccatctctttaaa

SEQ ID NO: 189284 - DNA, 770 bp, Homo sapiens
aaaagctgctgtattgactacacatgccttcatttcttctaccctgcttctttcatgcctgcttatctgaatgacaccaggatgacatttaaggcacatctgaagatggggaaaccacagcacagaataaggctgggcccttgaatcaataaatgaaggagaactactcaagagaacaaaaccaccagcaatatccacctgtatttgtcttttcataaggtctcactcagtcacccaggttggaatgcagtggcgtgatctgggctcactgcagcctccacctcctgggctcaagcaatcctcagcttcccaagcagctgggaccacaggcacacaccactatgcccggctaagtttttatatttttttggtagagatggggtttctccaggttgcccaggctggtcttgaactcctaagttcaagtgatctgctcacctcagcctctcaaagtgctgggattacaggcatgaatcaccgtgcccagccttttggcccactttttaataggttgctttttttcttttaaatttgttaaagttccttatagatgctacatattagacctttgttgaatgcacagtttgcaaaaattttctcccattctgtcagttgtctgtatactctgttgatggtttcttttgctgtgcagaagctctttagtttagttagatcccatttgctaatttttacttttgttgcaattacttttggtgtcttcctcataaaatctttgcctgtgcttatgtcctgaatggtattgcctaggt

SEQ ID NO: 189285 - DNA, 872 bp, Homo sapiens
aaaagctgctgtattgactacacatgccttcatttcttctaccctgcttctttcatgcctgcttatctgaatgacaccaggatgacatttaaggcacatctgaagatggggaaaccacagcacagaataaggctgggcccttgaatcaataaatgaaggagaactactcaagagaacaaaaccaccagcaatatccacctgtatttgtcttttcataatgtgtgacacatgtgctcatggattattgtccgaagcaagacatgtgaccaagcctaacatcaactgggtgaagagctatatgttcctttctcaagaggcactacaagtgacatgccactgggcagatggagtctcgctctgtcacccaggctagagtgcagtaccgcaatctcggctcgctgcaagctctgactcccaggttcacaccattctcctgcctcagcctcccaagtagctggcactacaggcgcccaccaccatgcctggctaattttttatatttttagtagagaaggggtttcgccgtgttagccagaatggtcttgatctcctgacctcatgatctgcccacctcggcctcccaaagtgctgggattacaggcgtgagccaccgcgactggcctaacatatttttaaaacctgcagaatgtttgtattacttttgtcatagtacataacatttaaatggatttcttgtttgtgtatgtgtgtatattcattcacaacactgatagtttttctgaatatttcctttggattttattcttttctcattcaactaaataagaacctgcaccatctttttctagtgtaaaaattacaatatctgaagtgaaactactagaataaatcttgtgacaattcttaaggat

SEQ ID NO: 189286 - DNA, 277 bp, Homo sapiens
ccgagatcacgccactgcactccagcctgggcgacagagcgagacttcatttcaaaaaaaattgagggcttgtgaagaataatgactttcatatttactgttgaggggaattgagagggtgactagtgagtacatattaatagtatggggcatccattctttactcaaggtagcaggttagatacccaaaacttttagttgtgcaatagtgtcccctcgcctcccccagacagttgtgggaaaggaggaaaaggttttgataaagcagagattaaag

SEQ ID NO: 189287 - DNA, 398 bp, Homo sapiens
tgcaacctgctttgatgaattcaagagaattggtggtagcagcaaggagccatagtgggttttgttgttgttattttctttccagtagcactttgatgaataaaaaataaaatcctttgttgtctgagtgctttatgttgcagtttctggctttgccttttaccatcgttctagtcaaatctatgggtttttttctgactgattgagctgggctctttcactgattccttctggaatgtatatatgtattactacatcactgcaagatgtcaaaatggaaaaggacacgtactttccttttctgagaccagcctgaaaagctgcagttgggtggaagcagagcccaaccgtttcttccaggcaaggtgtaccaaaggagcagaattctggggtgagat

SEQ ID NO: 189288 - DNA, 687 bp, Homo sapiens
gtgtggccttgagcatgtcattgaacctctctgggtgttagtttcttcatctgtaacatgagaataataacacttcataaattcattagcaagactaaacataatcatgcctatgaaagtgtggtagcctctaaaacattacgcaaatagccaagtattatcattatttctgttagtaatgaaacaatatatgcgtgtcagataataaggtaaagctccaactcctaatcttttcaggagactctttgcctttttgcatttttttttcccctgctaggatacatagagtggtaagatatgtagaaagcagagttcaggggaaagttagaatgaggcagagcttccaggatagtactttcttgttgatctgttatttttctaaacctttttcttttctgtgttgaaacacaatgccattttttgaacttcaccaattgttatctcagatatggatatgcctgaggcctgggcaagtcagggcagtgccactccagtttcagaaaagaaagtgtgatggggttcagcaggggaattgctgttgtacttcattagccaagctcagtaattccaagaatacccctgcgggtgtgggtgtttatgaaatgcagattcacaggccttgccccagcaaatttgataggagtctaggaatctgtatttcacaaacactgtcaatgaatcccatgc

SEQ ID NO: 189289 - DNA, 1636 bp, Homo sapiens
  misc_feature (1552)..(1552): n is a, c, g, or t
  misc_feature (1555)..(1555): n is a, c, g, or t
  misc_feature (1563)..(1563): n is a, c, g, or t
  misc_feature (1568)..(1568): n is a, c, g, or t
  misc_feature (1570)..(1570): n is a, c, g, or t
  misc_feature (1574)..(1574): n is a, c, g, or t
  misc_feature (1580)..(1580): n is a, c, g, or t
  misc_feature (1586)..(1586): n is a, c, g, or t
  misc_feature (1588)..(1588): n is a, c, g, or t
  misc_feature (1592)..(1592): n is a, c, g, or t
  misc_feature (1594)..(1594): n is a, c, g, or t
  misc_feature (1613)..(1613): n is a, c, g, or t
  misc_feature (1616)..(1616): n is a, c, g, or t
  misc_feature (1620)..(1620): n is a, c, g, or t
  misc_feature (1623)..(1624): n is a, c, g, or t
  misc_feature (1631)..(1631): n is a, c, g, or t
  misc_feature (1633)..(1633): n is a, c, g, or t
ttgcaggggaccctagaatagtttttctcctgccatttctatgaatgtctgaacgtgcaaatatgtcaatgactagggaaaatatagtgacgcactggtcattctacaactttaagtctacacaggttccttcatcaaaacagggcattaaaaacaactaagctatagagccagatcactggaggtactgtagtttataacctgcttataaaccccagttcttaagtccctcaatgcctagcatgctacctaccaatacgcatacaaataaatcagacgatcttgtgccccccagcccaatgtttaccaagacttcaaaatgttctggtgagatcacctccctgctatgtgatgcaaacatcagagtataaatcttttcagaaaactttttaacaactgttggaaattttaaagataaaagcaatacaggtcaagcagacccctgaagaacctctggagcaccacatggtgctggcaccagctctgcccccgactcccttcatcaactcaggcacctcccttcacctctgtaaagctaggtggcttgaactccataatctctgacgacaccatctgccgaatccacggcaaggacacacagaaccagagaggctacttcattaagctgcagtgtgcatttacatcaaatcaaccattccatagtaacaaggcaatatgaggccatctttttaaaattccataggagaatttaagtaaattgctagatccttccagttttttctgtgtgaatgatttatcccagcttctaggaatatgtgcaatattattccacagagcacatctttcagaatcttgtttcagattattgttacttaaatagtccatttctcctgaacagcccttcaggtaagagacattcaatactcattagaatctctactctcatgatgcattgtatgatctgagaaccaacttacatggtacaagtatagacacataacatcaaagaagatacacaatggccaagattctggtttcattagttaccagggaaatataaattaaaccacaataagattccattacacacccagtaaaatggctgataatgccaagcaccgatgaggaagtgaaggaactggaactctcatacgtggttagtggaaatgaaaaatgatgcagccactttggaaaatgggatggcagcatttgataaagttaaacacacacttagcacacaacacggcaattgcactctcaggtatttcccgaagtcaaaatataaaacgtgtctacctacacaaagacttgtagtcaaatgttcatagaagctttatccataatagccaaaaactggaaagaacccaaatgcccatcacttggtgaactgataacaagtagtaccgcttatcttcagggaatacattccaagactcccagtggatgcctgaaaccagacagtaccaaatcctgtatatactgggttttttttttctatacacacatacctctgataaagtttagtttataggccggggacggtggctcaaacctgtaatcccagcactttggaggctgaggcaggagaatngcntgaacccnggagncngagnttgcantgagcngngatnangccactgcactccagcctngcnacanagnnagactcngnctc

SEQ ID NO: 189290 - DNA, 882 bp, Homo sapiens
  misc_feature (798)..(798): n is a, c, g, or t
  misc_feature (801)..(801): n is a, c, g, or t
  misc_feature (809)..(809): n is a, c, g, or t
  misc_feature (814)..(814): n is a, c, g, or t
  misc_feature (816)..(816): n is a, c, g, or t
  misc_feature (820)..(820): n is a, c, g, or t
  misc_feature (826)..(826): n is a, c, g, or t
  misc_feature (832)..(832): n is a, c, g, or t
  misc_feature (834)..(834): n is a, c, g, or t
  misc_feature (838)..(838): n is a, c, g, or t
  misc_feature (840)..(840): n is a, c, g, or t
  misc_feature (859)..(859): n is a, c, g, or t
  misc_feature (862)..(862): n is a, c, g, or t
  misc_feature (866)..(866): n is a, c, g, or t
  misc_feature (869)..(870): n is a, c, g, or t
  misc_feature (877)..(877): n is a, c, g, or t
  misc_feature (879)..(879): n is a, c, g, or t
gccggaccctgatattctggctgtggaatattattccacagagcacatctttcagaatcttgtttcagattattgttacttaaatagtccatttctcctgaacagcccttcaggtaagagacattcaatactcattagaatctctactctcatgatgcattgtatgatctgagaaccaacttacatggtacaagtatagacacataacatcaaagaagatacacaatggccaagattctggtttcattagttaccagggaaatataaattaaaccacaataagattccattacacacccagtaaaatggctgataatgccaagcaccgatgaggaagtgaaggaactggaactctcatacgtggttagtggaaatgaaaaatgatgcagccactttggaaaatgggatggcagcatttgataaagttaaacacacacttagcacacaacacggcaattgcactctcaggtatttcccgaagtcaaaatataaaacgtgtctacctacacaaagacttgtagtcaaatgttcatagaagctttatccataatagccaaaaactggaaagaacccaaatgcccatcacttggtgaactgataacaagtagtaccgcttatcttcagggaatacattccaagactcccagtggatgcctgaaaccagacagtaccaaatcctgtatatactgggttttttttttctatacacacatacctctgataaagtttagtttataggccggggacggtggctcaaacctgtaatcccagcactttggaggctgaggcaggagaatngcntgaacccnggagncngagnttgcantgagcngngatnangccactgcactccagcctngcnacanagnnagactcngnctc

SEQ ID NO: 189291 - DNA, 404 bp, Homo sapiens
aaaagatctaagtgtgttttgggcggagtagggttccacaagtggaatattgtgtgcactcagtctcagaatgtttaccaagacatctgtcaccttcaccccgtcatctgatagcacagagcaatataacttatgaataatgctagtccttaacgacatgacattatcaacttctctgaataaagaacgtgttctaacctttactattctaaaatacttccttcttgagattctgatataaagttgaacatttatgaatagaatatttaattgcttaaaagaatttttcctaacagccctaaaggttgactatagagagaaaatttttttaagacactgctaatcctcatagctaacatttgagaagctaagaacaagatatttaaaattactttaataaattt

SEQ ID NO: 189292 - DNA, 585 bp, Homo sapiens
gtgaaattgtgctgagactggtcctggggtaccctcatcttattcagcttacacagggtaaaggaagggctctgagctcaatggcaaggccacatggctgacagcagaatcccatggtgcaaaggcaatttctttaggagaggcccactgcaacccttgcaaaatctaggaacagccaagaagggtattttctccataatctttctgaatgtggttgagtatatttgggttccctactttttgtcatttatatttctatgaacatgaggtttagaatattcagctaacttattagtcaatccaagacttgatattatagtacttcctgtttgtctgctgtttcactttgtgcagattcattcattacccatggtaattccagaaatggaaatttccagaaatggaaaataaatggaaaattccagaaatgatcaattcataagttttaaaattgtgtgccattctgggtggtgtgatgaaatttcttgccatcatgttctgttccttccagggtaagactcctgtctttatccagcacattcatgctgtagacaccacctgcctgtgagtcacagttgcagtctc

SEQ ID NO: 189293 - DNA, 493 bp, Homo sapiens
gtgtggcatgcagcagtgaatggctgtgtttggtggttagatgcagaacatttcttgtggttctgctggctgtgtgtgtattgcctgttttgattgtggttaacctgactcaccatttggttccttaaggttgagtttcctttcctgtcctttatgaacatcgtcaccttgttcaaaagggaactttatcctttcttttcaaacgtttactgagtttctgttctgtgttaggccctgtgttaggagccaggtacagaaagatgatcaaatatcttgactttaaataatacctttcacatttacctctttaatctcaggtagccctaacaaccctgtaaaattgaaaaaggttgttcatgtaccccccaatataaataactagtcacagagaaatgaacagacttcaggttacacattgtaatagtgactgagctgaagccttagtgttttgaccccacccctacccattcactagttaggagagtctaaataa

SEQ ID NO: 189294 - DNA, 124 bp, Homo sapiens
gtctcacagtcccggcgcaccaaatgcgtgtggagtcctcccggggaccactgttgatgatggcgttcaccaggacctgcagagggttctcgcctgtgagcaggtgtatgatctcgaaggcatg

SEQ ID NO: 189295 - DNA, 432 bp, Homo sapiens
ggctcaatcaatcctcccacctcagcctcctgggtagctgtgactacaggcatgtgccaccatgcccggctaatttttatagttttggtagagatggggttgtgctatgttgccaaagatggtctccaactcctgggctaagtgatcctcccacctcagccttccaaaatgctgggattatagacgtgaccgtgcctagccatgttagtcttcagtacaccttctctttgctgacagccccgcgctcccatgctcctgccagcctctccagccgttccttcctggtctctggctggctctgcctcctcagctcagtgcccagatatgtttttccccagggctcagccttaggcattctccacagcctacgctcactccttgggcgacctcattcagtccctggctttaagaccccatcatgacgcagacccc

SEQ ID NO: 189296 - DNA, 497 bp, Homo sapiens
cccttaacccagggcaaccactgatctttttggttgttttgttttgttagagaccgggtctcactctgttgccctggcttgagttcagtggcataataatagctcactgcagcctcaaactcctgggctcaagtgatcctcccactcaaccttccgagcagctaggaccacaggtgcacacaaccacatctgctaattttaaaaaactttttggagagatgggagtctcactatgctgcccaagcttgtattgaactcctggcctcaagcaatcctcccaacccagcctccccaagtgctgggattacaagtgtgagccaccacgcctgaccaaaaccactgatcttttactgtctccatagttctgtcttttccagagtgccatatagttagaatcacacagtatgcagccatttcaggttttttttttcacttggtaataagtattcaaagttctttcatgtactattagttttattttatttttaattgacaaa

SEQ ID NO: 189297 - DNA, 325 bp, Homo sapiens
aaaaatattcaaagaaaatgttagtcacttttcaaaaaaagcacagcataccaagatgatgtagtaagttaaatattcccttgtgctatttatagacataaccatatactgtatcatttctaattggaaaaggtctaccagagatactatacacctgatcctaaaactatacattatcttctgctacgcctctaggaaacaagactataataacttgaattttaagaactacacattcaagataaatatttgattggtttttccatctcactattaaaatgaagcataagaccctcaaattaggtttaaatgttttaacagtgaa

SEQ ID NO: 189298 - DNA, 587 bp, Homo sapiens
gccactgcacccggccaccactaccattttcaaatggagaaatagtacataagataacactgcgggctgggcgcaaaacaaacaaacaaaaagcaacataacactgagactgcagttcaagcagcctgtgtttatttcattgctaaatatttgtatatgtttaaatatggcagttattgtcctgttgattctctgaataggacaaagtagtctatcctccagtggtcccttctccccagtcccaatgtggtgaagagtgggatttttcctccaagagagggtttgttattcatttttctgtctcaggatttaagggcacagtcttatagtgccaggctgctttccttaagatctatagaaagacagaccgcaaaggaatggatactacacacattaaaggcgacacaaggcttatgtagggcctctttcgggctgttctcctcagagcaagactgctctcaggcacagaggtcagccacaaccctgtgttccgtgttctgatgctcaatcacatcaaggatggcagacaagcaactttcccaggtgctcctgagcttcagggagatgttgcctcagccggatgccca

SEQ ID NO: 189299 - DNA, 389 bp, Homo sapiens
tgggacaggggaagggacttcagggaaatacttttgattcaaatagttaaattttggggtaggagagaattgaaccttgaattaagtgtcaaggtgctaaaaagacagaaactctgatcactgtgaaaaaaattcttgatttattctcttagtcactggtatagcagccaatttagaaggaatttgccctgctgagtagctggtagtttgaggcagccattatttccttgacacataaactttgtgcatttcataaaggatagtgaaaactgttggaacttttcaatattcattaatgcagaaaaactttctcttaatattcttattctcccccagtctcttctcagaaggacctcaggatttagtcccatgaatataatttcctttcc

SEQ ID NO: 189300 - DNA, 211 bp, Homo sapiens
cagaaacaagcatacaatgtagcaccaatatatctggcaggaggcgtttcagtggaaaccttacaggccaggtgagagtgtcctaacacaggtctaaatgaaaggatagttcagaagagggcactgcagctggctgaaagagaacaagaaaggctgtaaggtggaggtgaatttttaattgagccgtgaaagatagggaaattctgtatga

SEQ ID NO: 189301 - DNA, 458 bp, Homo sapiens
tccatttgcccttttgatctagaattaaaagatgaagatgatgaagatgattgtttcatacttgagaaagcagctagagggaaaaggcctatttttgaatgtttttggaatggacgattaataccatatacatcagttgaagactttgactggtgtactcctcctaagaagagagggcttgcaccaattgaatgctacaataggatatctggtgcattattcactaatgacaaattccaggtcagcacaaataaattgacgtttatggatcttgagctaaaattgaaagataagaacaccctttttacaaggattttaaatggacaggaacagcgaatgaaaattgacagagaatttgctttgtggctgaaggactgtcatgagaagtatgataaacaaataaaatttacactttttaagggagtaattacacgtcctgatcttccttctaaaaagca

SEQ ID NO: 189302 - DNA, 1044 bp, Homo sapiens
aaggctgtccaagcttgattgcctatacatccagttctatttactttccttaatttttaaaattgggaattattttgaagacaaataaaaataatataacgaaagtaaaatctaacaaattccaaccttaaaaaaagaacaaacaacacaagtacaaacaaaccaaacccagaaccaatgagtggaagcttcctgtttacctatcttcaacacctttcatctttctactttccaacaggtagctactaaccaaaatttaacgtatatcattcttgtgtcaacagagcaaggcttatggccagaaatgaatgaaattcataatgaaggtattctgaggaaatatgatcttactctcaaagtctcaacaataccctgggtgataacaactggctctcaaggaacaagatagctcccaagcaactccagtgcccaggaaagatggtgaagagatctttgcagacaatctatcagttactggggcagaaaaatcattgtgactagtcatcttcatacgatagcttaaaccaacagacagaatttatagtgtagcgaagggcagtctaatgcagtagttacttggatccactcttgctgttttgtgaccctgggcaatcagcttaagcttgattgccagttgactcacaggagtcaagctcaaatctgtctcctggtgcagtaattttattagaacaggtttagcgggtagattctgggattactaggtgattggtggaaggaaaggggaggtctagaaagtccttggcagtacccagttatctcttcatgactcctcatgggtcccatgttcaaatttgggaggagttaatatgaagcatgtggtggcaattcaggctgtgatgacgctccttcagagtgaactccagttggctatattggttgcaactgatttcagccagttttgttatcttacaagcagaaggagtttcagtgtttcagaaagttgtttcttatctgctatcttgcaactcaagactttctgttagttactggtttaagttttgtacatggttgactacacttcgt

SEQ ID NO: 189303 - DNA, 682 bp, Homo sapiens
agcttgattgcctatacatccagttctatttactttccttaatttttaaaattgggaattattttgaagacaaataaaaataatataacgaaagtaaaatctaacaaattccaaccttaaaaaaagaacaaacaacacaagtacaaacaaaccaaacccagaaccaatgagtggaagcttcctgtttacctatcttcaacacctttcatctttctactttccaacaggtagctactaaccaaaatttaacgtatatcattcttgtgtcaacagagcaaggcttatggccagaaatgaatgaaattcataatgaaggtattctgaggaaatatgatcttactctcaaagtctcaacaataccctgggtgataacaactggctctcaaggaacaagatagctcccaagcaactccagtgcccaggaaagatggtgaagagatctttgcagacaatctatcagttactggggcagaaaaatcattgtgactagtcatcttcatacgatagcttaaaccaacagacagaatttatagtgtagcgaagggcagtctaatgcagtagttacttggatccactcttgctgttttgtgaccctgggcaatcagcttaacctcccccatatattagctttctaatgtataaaatggagatgacaatggtatctacctcattgaatggtgca

SEQ ID NO: 189304 - DNA, 593 bp, Homo sapiens
aggtatagggtttttttcccacctacttcattgtgtctccttttaattttgattaatattctgtttggggcaagcagacttacattatatctatatataaatatatatgtaatgttttctatttgtttatttggaacagataaaatgatctcagagcccactgcatcctaaaatggatatttatagacttagcccatgaacaacatggatttagactattttttttatgggattactacccttgtgtttattttgagttagttcaaaagttcttatgtgattttttccacttttatttattttttaaaactgtgtggactgaattgtttttcttccagggagcaagatacaaattatctggatctgaaactcgcagcctaaattacactttgtgctagtaacacagacgtgttctggtagtagtaatagcacaggagtagtaacggtagtttattataatactacagatccatttttggaaatgcagttgatttgcctgttgcaaggaggggaaatggacatcaatttcacagggtcatctgattcctcattagtagttcctatttggcaaattaaaatgcattttcagataa

SEQ ID NO: 189305 - DNA, 406 bp, Homo sapiens
aaaaaatgtcaagcgcctactacaagcctattattaaactaggtactgtgggatacaaaagtataagacatggattcaaaatttattttctttgttgaggagataagacagtatatattccagaagacatgcagtttacaaatgagtttagtttgaaaaattgtttttggtgtcatttgtttgcatcttgcagataatgcaggtaagttatagcagaaccttaaataatttgaagagcacttcaggaagaggttttaatgtttggtgactattgggaagcaaagaggagctttgttataccttgaagttggtgtggaggttggtgaataaggctgggtgacctttagagatttctacaggggttttctaggtgggtttaaccgctatgatggtgattaggggagga

SEQ ID NO: 189306 - DNA, 373 bp, Homo sapiens
aaaaaatgtcaagcgcctactacaagcctattattaaactaggtactgtgggatacaaaagtataagacatggattcaaaatttattttctttgttgaggagataagacagtatatattccagaagacatgcagtttacaaatgagtttagtttgaaaaattgtttttggtgtcatttgtttgcatcttgcagataatgcaggtaagttatagcagaaccttaaataatttgaagagcacttcaggaagaggttttaatgtttggtgactattgggaagcaaagaggagctttgttataccttgaagttggtgtagacaattgagacggtgtaccgacgctcgacattcgtatatcatgtgtcatatgctgtt

SEQ ID NO: 189307 - DNA, 657 bp, Homo sapiens
aggctgaaggtcaaaggatcgcttgagcccaggaggttgaggctccagtgatctgtgtttgcactgctgcactccagcctgagcaagaccctttctggaaaataaaaaaaaataaaaaaaataagaaaaaaaaaaagaggaaaactggtctgtgttgccaatctggtaagtttcaggaacaaggcaaacaattggtgttgggagccagttctctatgggtctctccagtttctgcatgtcttatgagcagattgcactgacagcttttatgggctactatctttcctgtacaggacatctgtagatagcattttaagatagcaatagtgtttctctctggagcagatggaagatttgtttgctatgcagaataataaaaataatgtctccatcaaagcaaaggctgggcaggattattagttcccttataaaaaatgggggtttcccaatctcagattttctcaactgtggtgcatacccactgcatgggcaacatccacctagacccacccagccaccgtgttacccacatggtctttgaggggcaagaaaatactatacaaacagagctgtcacaaacatgaagttcatactgcctgctgacccaggagtgctgtgtcttctgccatcatccgtggaattttaagaagctaactt

SEQ ID NO: 189308 - DNA, 811 bp, Homo sapiens
  misc_feature (776)..(776): n is a, c, g, or t
  misc_feature (800)..(800): n is a, c, g, or t
accactgtcgccatgaacagtgtgggggaggcatgcacggacatgaagcgcgagtacgaccagtgcttcaatcgctggttcgccgagaaatttctcaagggggacagctccggggacccgtgcaccgacctcttcaagcgctaccagcagtgtgttcagaaagcaataaaggagaaagagattcctattgaaggactggagttcatgggccatggcaaagaaaagcctgaaaattcttcttgaccttgacagtcaccttgaaggatttcgcaagtccagaaattgaggactctggatttttgtcaactaactctgtgaacatagccatcagatttgatgaggaacttaggagagaggagttttatttcctccttcgatgttttcctctcagttgtaaaagatgaactctttgagatgatttctcacctgctgtggtatcttgcaggaactgtgtgctaaaattgaacaatttttttgagattatggttgcaatacttggcgtggaatcagctttacataaatataccttgtatgcaaacgatgataaactagtcaggatgagcagagctgcctgacctcttgatttctgctgcaaaagacatatacactgtactggggtcactatttatgaaagcaattggttaggacctctttttttcctctcagggaactaatgctctgaaaagggatctgggcacaacagtttcagtgagtgcttttgagcacacttttattttatttataccaatgggtaaaatggggggggcccggttttncaaagggggccgcttttccccccnccccccttcca

SEQ ID NO: 189309 - DNA, 800 bp, Homo sapiens
accactgtcgccatgaacagtgtgggggaggcatgcacggacatgaagcgcgagtacgaccagtgcttcaatcgctggttcgccgagaaatttctcaagggggacagctccggggacccgtgcaccgacctcttcaagcgctaccagcagtgtgttcagaaagcaataaaggagaaagagattcctattgaaggactggagttcatgggccatggcaaagaaaagcctgaaaattcttcttgaccttgacagtcaccttgaaggatttcgcaagtccagaaattgaggactctggatttttgtcaactaactctgtgaacatagccatcagatttgatgaggaacttaggagagaggagttttatttcctccttcgatgttttcctctcagttgtaaaagatgaactctttgagatgatttctcacctgctgtggtatcttgcaggaactgtgtgctaaaattgaacaatttttttgagattatggttgcaatacttggcgtggaatcagctttacataaatataccttgtatgcaaacgatgataaactagtcaggatgagcagagctgcctgacctcttgatttctgctgcaaaagacatatacactgtactggggtcactatttatgaaagcaattggttaggacctctttttttcctctcagggaactaatgctctgaaaagggatctgggcacaacagtttcagtgagtgcttttgagcacacttttatttttatatagtaactaatggttaagattgatggtggcctggattagcaagaggagacagcttttaa

SEQ ID NO: 189310 - DNA, 484 bp, Homo sapiens
accactgtcgccatgaacagtgtgggggaggcatgcacggacatgaagcgcgagtacgaccagtgcttcaatcgctggttcgccgagaaatttctcaagggggacagctccggggacccgtgcaccgacctcttcaagcgctaccagcagtgtgttcaggtgagccctcccgcctctgttcccaggccctgcattctcggcgctgtgtcccaccacactcatcgtattttacggggattgggactggactggaagggtggagaaaagtcgcagtgaggccagtggcaggagctcgctcccctaccatcaccaccgaggccacttgggtgtctctccgaatgacaaatattggggcagtgcttttcaagaagcacagtcacatcctttggttcatttggtgttcaccctaaactcgcaaggtgggcatagttactcatattttatacataaaaaactaacacccagaaataggaagtgattaatc

SEQ ID NO: 189311 - DNA, 329 bp, Homo sapiens
tcccgggttcaagcgcgtctcctgtctcaacctcccaagtagctgcgactacaggcgcatgccacgacgcctggctaatttttgtatttttagtacagacggggtatcacgatattggtcaggcgggtcttgaactcctgacctcaggtgatctgcccgcctcgacctcccaaagtgttgagattacaggcatgagccaccacgcctggcccatttatgatttttaaaaagttatttcttgtcatgtttctccatgcaagttgagaggataaagcaaaagcaatatgcacaatgaatcagcaaagggctcattattaaatgtttactga

SEQ ID NO: 189312 - DNA, 367 bp, Homo sapiens
ccggttctggagaggggacagtatggcgggcaaactgtaaagtcccggcacgtggggggtgcgattccagcgagggccaggcccgtcttaagaagcactgtgtggggagtatatgagtccccggcttccgctccagggcatggtgcagtgagggaccccccacgccaggcatgctccttggtagggtctttctcaccggccccctgcagccgacagggaatgtgggagctggtgctgagggggtctgaggtctgtcctacctgtgatcccctgagtgaccttgggtaagtccctgtcccagcctcagtttccctttctgagcagctttggggggggggttcccgaagaaggcatctctttgaagttc

SEQ ID NO: 189313 - DNA, 231 bp, Homo sapiens
ggaaaattatagactagtcacactcatgaatgtagtttcaaaaatcttaaacccaattttaaccaacacaatccagttgtatataaaagacataatacattatggctaagttgggtttctcccaggagtacaaagttggtttaaaaagttggcaggaacaagaagaggatgcccactatcatccattcctacctgatcttctggtggaagtcctactcagtacaagaaaac

SEQ ID NO: 189314 - DNA, 371 bp, Homo sapiens
accctaccacagttagggtttaaataaaatactacaattaagagaaacacccatttcaaaactattactcaggtagccccaaacatctctgtggagtcaaaacattaagcttcatcttcttttggttttccatttggaattttgaagacagtgaagccaggttccttaaagggttacatttttttttttaaatcatttccaatgacagaaaaaggtgtcaaaagttgaaaatccttcctacttcaaagaaaggaacaagtgacacacccaaccctgatcctggtgtagccactgtgcagctgtaactgattcgggaatgagcccaggtgtgaagccagaatctgttccaccctctctctgcagcctggcaa

SEQ ID NO: 189315 - DNA, 185 bp, Homo sapiens
cacccacctcggcctcccaaagtgctgggattacaggcatgagccaccgtcgttggcaggttttacaaacaggacagatacaaatctgcttatctgctggaactggattaggttggacaaatgaactcttcagggcctttcaagccctacgttaagattgccaccaaaattctcggatgccctct

SEQ ID NO: 189316 - DNA, 276 bp, Homo sapiens
ttaattacctgcccacatagtaaagtgctaaataaatgttggacattgcttttgcaatttcatttatattctacccattaagcaatgtttaaaatctggaataaaatagattattaaagaaatatgcagagacaattatcattgaccctgattccatctggaaatcagggatgaagaatcacggagaaaaaaaggttaaaattatctctgatcaaaattaaagtctatcaaaatctcaaatggcaacgaattcttgctgaatggccttgtatgtga

SEQ ID NO: 189317 - DNA, 272 bp, Homo sapiens
ggatggatggatggatggatggatggatggttggatggatggatgaagagccttccagctgactcttcagaggcattttccaatccttcatttggttttgcctataagagattaacttcacttgtgtgcattcctttaattcaaaagctaattgttgagtatttaaaaataatttctatgaaaacattaggataaggctctttcccctttcaagccctttgcatatgctagtccttctgcctggaatgcctttcttccttcctctcttcaca

SEQ ID NO: 189318 - DNA, 332 bp, Homo sapiens
gcaagggcttttattgtggtttccacaggaaaggagaagcaaggcaggggcggcaggcttagggctggctagtttgaacaatttcagcaggctctgggtcacaggttgtctggtacttggctctagggttgactagggcatgggactagtggcccggcatgtaagcaccaaataaaggaggtgactgggagtgcagactctggatgggttggtgttcctattacaggcacacttgcaggtcatcagtctattatttctaggaattggtcagccctggaagaagcagtttcttcagtgtcaacaaggctccaagatgtcaaagcgtaaaacat

SEQ ID NO: 189319 - DNA, 129 bp, Homo sapiens
ctaattaaattaaatagtttttacacggcaaaaagaacagtcagcagagtaaacagacaacacatagagtgagaaaaaatcttcacaatctatacatctgacttttccacagggtacttttccacagga

SEQ ID NO: 189320 - DNA, 608 bp, Homo sapiens
actgggcactgtccctcccacttaggacacaacgtaggatgggagatagatttgtaaacaaatacatgtatggatgtaattagcgctgcaatggttatatgtaccaaatgtgagagacttaaaagcgtgtgtcttggggagagtaaggaacgactttataaagaaatgtgcaaacgagatctgactgatgagtgggagtgtgcctggcaggtggaaaaaagtctaacgttctaggtggagtatattgcctgtgcataagtaccaacgtgcgaggcagcatttagggcacaggaatctgtgggacccacccgggagccctggtagagtgcgagccgccacagagacgaaaacgaagggccctgcttactgatggtaacgatcgcatggtctggtggggagaccaaggcatacacaagtaatattaataattacagaatcacctaagagcaatgataggaggttcacggggttttatcacagctgggagaggtgaggcgcagagttcctgagggcactttttaaaccacctgagccgcaattataatttggttaagtaagagttgtaattaggtaccatggttttacccccaaaagatggtaaataggaa

SEQ ID NO: 189321 - DNA, 409 bp, Homo sapiens
acgtggcttgcaggaaagaacattggatatccctgggctctgttaaccaaatacctcctttctgtgtgggatctgaatttgcaaagatgcccagaccccagactgctgacaccagagctcctataagcataaatcactatagtcatcattagcaactcttctatctagacttggaactcctcgtgcaaattgctatgaccctatgtctgtgtgtgacttcttgggtcaagagcaaagcagtttaggcagggtgttaagaccacaagccatgcagttaagctgacctggattcaggttctccctccatcacttactagctgtgtgatctaaggtcactcacttcacctctgagcctcagcttcctcacctgtgaaatagaatggtgcttataaaggttagataaaatcta

SEQ ID NO: 189322 - DNA, 946 bp, Homo sapiens
tgaggatgtcttctccccttaaaccaggtctcttgactcggagtcttccaaggattgattctggagtgtaagtcagcaatatgaacttgatgctcattttggcctaaagatggagtcatgatctgtcccaggctgaagtacagtggcacgatcatagctcactgcagcctcaaaggcctgggctcaacggatccttcctcctcagcctcttgaatagcagattttatacacatctgcaaagtctttggccctatccacccttcctcttgactctgcactggccttaggcacactgcatgactttccaggctgggccaataaaagccatgcagcttccatttggttctctttggttgcttgttcatccctctggagatgtttcttatgagaacccagaagccatgctataagaagccacaaggagaggccatgtatagaaactccagtcaacagttccagatgaacctgtccttcaacactcagagccaagctgccagacatagacgggattttaccatgttgcccaggctggtctcaaattcctgagctaaagcagtctgccgttcgtgagcacacatccaggctggtttctttttcttcaggagccagaactgagccaagactcggacagggtcggaattcagaaagatgctacttccttagttgcacgcttctggatatgcgcaactacgcggacgggtccgcagctgcgtccacactaggtcccatgggctgtgacgaggaacattccaaccggagcggattggcaatcacgaggttacaccaccgacacggggagggacccaaagaggagagacaacatccgcggcaccccaactagagggcgcatagtgcagaccggcgacgctccgcacacacgacacgccactaatcagtcgcaccccgcgcaccaccggtctacaaaccactacactcaattctgttg

SEQ ID NO: 189323 - DNA, 321 bp, Homo sapiens
cttttacttgatttcacacacacacacagagtcactatctaaagaaatgtgcctccattacctacttttaaagttatgaattatttaaagattatataacctattgcttataatttaagagcaacagacaagattatattttaaaatactgtaaaggttttttgaaaagacagtatgcgcaaatacagaccacattgttgtataacagccagagatggatgatcaaaacactctgcagccgtcatgagaaaaagtcagaacagctgacaactagtacacgtacataactttgctcattatccccattctatcaaatatata

SEQ ID NO: 189324 - DNA, 530 bp, Homo sapiens
agaatgtgtaacaacgacccaaaaaggaaaagatgggtgataaaacttgcacgttccaatgtgaggggctagagtctccacagggctttcaaagacaactttaaaaattggtttgacaatgctgcttctacctgaatataaaagagttgaagtaggaaaagccaggtttttggaaattaaataatttatttgattatggctgtcattgtgctctgaatcttcatagaggagggaagaagaaagcttctgtctcccacaaaacctgaggggtggggctttagagagaccatctggagatcctcatctgtaacacatgacatttctggggctccacagaggatgtctgacccacagcaggaaaagtcaaaggtggggatattgtgactgactcagccctcaaatggaggagcatgcattgggagcttcattgagagcaatactgtgcttacagagtactgagagccaagaatgatgtttcctctgggaccagatattgagaaaccagcctgtagtcgttgtttttagtaact

SEQ ID NO: 189325 - DNA, 283 bp, Homo sapiens
  misc_feature (31)..(31): n is a, c, g, or t
  misc_feature (63)..(63): n is a, c, g, or t
  misc_feature (104)..(104): n is a, c, g, or t
ccctgtaacggctgatgctcacagtctgttngcttccctcgggtcttcctcgcctcaagtttnggagtggtaggacccatggctcttctctctgctccggctgnagattacactaggcctggaaattcctttgagagcccattcttctaactgtgctgggtggcattcctggagaggattctctaagcagtgtccaggtaacccactcttccctgaagtccccagccacattatcaagcgtcatcagttcctaaagcaagagacctcaatgtgcatcagcctg

SEQ ID NO: 189326 - DNA, 489 bp, Homo sapiens
gacagctgcagaacttgtggaaggttctttggcatcacacttgtttagtgagaaatttaattttattaacatccatagctgaagcagtgcacaaaatgagatgggctgataagatgtcaactctggtctgtgttggttaaaaatggatttctgacttttacactgctcttcccataccaagattaactgtaagttttctaagcttattttccacaaagcccacaggaaaggctggcttctttcatttagcataacgttttcaaagttcaccacattatagcatgtatcagcacttcatttttttgcatgactgaataatattccattgtatagatatcccacattttgtttatccattcagcagttgatgcatagttgggttgtttccactttttggctgttgtgaatactgctgctatgaacatttgtgtaccccaacacaaaaggtcacatattgtatgattccatttacatgaaacatcccaaaca

SEQ ID NO: 189327 - DNA, 431 bp, Homo sapiens
tttagaactgaagaaattgaggttcagagcttgccaacttgtccaactggacaattaactgcagaaactagaacttgatcaattccctgattatgaagtaacagaaatatgtagaagcatcctcttcctttaaattccaaacagggcaatcaacagaaaattaaccttgaatagtattgacagtgattattgctctcacattcaagaacaattacccctcttctaggaaatcagtaactaactttttaggagctaacttcaattcttacccaactaagtttccttcagtcttaagcagatacctatttacagattctctaaaaaggtctccctaattagtataactcattacacacctacttgttttcttattgcactactgtgttataattttaatactcatttcattttcaaaatccatccatcgaaca

SEQ ID NO: 189328 - DNA, 185 bp, Homo sapiens
gaccctggtagtaaaaggcctttagagctttcaaaggaatgaggttatgtctgtggatgccatcaccaagcaaagggcctctggtccaaatgcctggagacagccccaggtgggaaaaccaccaaatgggcaatgccctctctgctgcgcctgccacagcgttagagccctgcacgtaagcccgg

SEQ ID NO: 189329 - DNA, 200 bp, Homo sapiens
tcagaagcagggacttgaaggaacaataccgcctgagtcagttttgggaggagccagcctacaaagcagaatgaatctctcctgcttgacaacctcccttagcttcccatttcctgcaggacaaaggagaaggcccttgccaaggcccacaagcccatgtgaactggggactgtcttcctctcctatctcccagcccgtc

SEQ ID NO: 189330 - DNA, 195 bp, Homo sapiens
gtcactgcacccccatgggactgacatttctcagggctgaaggagagtggcacaaaggtcaagaacccactctgcctgagctcagcctgagctcaaactcccagttcaggctctttcctgttgttttactttgggaagataaatgttttacccatcagtgttgtcatctgtaaaacaggaattacaatattatct

SEQ ID NO: 189331 - DNA, 401 bp, Homo sapiens
tatttcattcttggtgaaacccttaaaacatgctattgacttccactttttgttgttgctcttcttccccagtttaaggtatcaaaatgtccaacttcttcatttagcttcttctccctccagtggaaacttctgcagaattgcacattatcaaagccagatatcctcaacaaaataatcgttcaactgcacctaatttcaattagatgaaatgagattggtgatgcttgacttttcctaacaataatgcccaagggcttcctcggctctacgacaaattgatagaccaaaaatcatttcactcagtgctcaggggcaggaacccaaagagaaaaacgcaatcacctttttcacatagatccagaagagacctcaagcaagaactggaaatgcagggtttg

SEQ ID NO: 189332 - DNA, 324 bp, Homo sapiens
agaaatgactgagcaggaatttgggcccaggtttcgtcaccaaattttgtatgttttagctatcattattgctgtccttgttattgatgttatcggccctgagggtataatgatgagcagaatatatcccgattctaagaagtcaagaggaaaggaagctagctttgctttatttcaagtttctcattcttttttgccgtcattcttttttgatcacaaaatgcccacctgtgctctagaaaccacgcctccattggacaggctttgggagtactggctccagtgatttgggtggttttgcactgatttctcatccagcaagca

SEQ ID NO: 189333 - DNA, 631 bp, Homo sapiens
aaatccataaaacagtctgataaaatgatgagcaagtctgttgtaactagtgtttggggcttttttgtgtgtgtgcatatcgcattttctgcttcacatccagtaccctatgagagtgaatgccttccaaacaaaggcctttctttggttttgcctgtcaattactttctatagtagcttcttgttcttttaccttccacagtaatatttacgattcatgagtctggaggttaagacagcaagtgcctgcctgcatggcataaattaatgctatctgtatagaattcattaccctgctttcacgcactcaaaaggaataatactaatcaaaaaattgctgtcatcgtctgtgtcctttgctggctgaggctgatgtgtaacagcaggtgcttccgaaagaaatgccgttggcacttgtaaaggctggccagacacagctatgtcctttttgcttagggaaagaacatcgtttcttttgatggtggattgtcagaaggaattttcgcagaatagttcaggcaaacaaagtggcacaacatgaaaatgatttcagaagccaagcttgactgtagaatttgagaacatcaccagtcaacaatcacacaaagaatgatctctctttggtctgtct

SEQ ID NO: 189334 - DNA, 279 bp, Homo sapiens
atacagtgttcatccttggaagatacttgatcctacttggagtggaggagggaacttcttgcctgagtattctcccagcaaaactttggtgcacactctaggctgatatgtagaaaatttcatgagacttttctgaacctttgtagagtcaatatttggcacttcagacacagtaaggttttaaaaacctggtttttcactttgtgttcatgcttgaggcactactgagttgctgctaatgttagcagggctgcctttaacttagttaggtatgctttg

SEQ ID NO: 189335 - DNA, 634 bp, Homo sapiens
tgacgcttaagacccccgctgtcattacagctctagtgtcgtgactgggatgagttcccgtgtgtgcacaaaatgggctcctgttttgaggcaatgcagttacatgaactctaggcaactctcctaactggtttaggacatgtgaggactatctacctctcctgtagcaaagaacacaggcatctgcagcagtaacgaggactgctgggcagttgtagcttaccctctccccataagaagttcatcctggctttgagctgatctcaacagggaaaacagtatggctgaaatagggttcttcactctcttgtctatggtgctatcctgggtttctgtgttccacaaggattttgcaattttcctggtgctctccagtgtacttcctcattcatgctagtgaaaatacagttgtttattcattgttttggtccctttttgctggggaagatgaataccaggcaagtctagacagctatcttgctgacatgccagtccacaagttttttcagttgtcttaatttgtaacaatcttgttcagattaaaataaacttaatttcaatagtatataaaaattttgcatttgtatagctctatttccttctgcctcctttgtgctattatttactaaattta

SEQ ID NO: 189336 - DNA, 125 bp, Homo sapiens
cttcacaatattaataatatatgtctttcctttaccatttccacctccaatataattatttgagtctttctacctcacattaaactattgaaactattaagaatccaaccaacatggggaaatag

SEQ ID NO: 189337 - DNA, 198 bp, Homo sapiens
ccatatcttttatacttcctcccactaatattataaatccactaatacagtacatagtaaaagaatcagattttttggatgaaacccaccatttaatgtgtttgacttgaattcataattctctccttctacaattaaaaaattaaagtgctaaaagattatccgcacgtaacatggttttacatcaagtatatatta

SEQ ID NO: 189338 - DNA, 136 bp, Homo sapiens
tgctgggattacaggcgtgagccaccacacccggcctgtagatcattttcttgccatcatggtacaaatgagagttctgttttatggtaactaaaaaaagttctttacttatttgttatgatatggggtattttga

SEQ ID NO: 189339 - DNA, 146 bp, Homo sapiens
tgagaagacaagggagggggagcctcatctgcccagagtcctcctgtcagcctgtccaaggtgggcctggggctggggctggggctagaggcctggtgatcagccaccctgcctttctctgcccttcctccctccctccctccaca

SEQ ID NO: 189340 - DNA, 194 bp, Homo sapiens
gacctgcctgagtaggtgttcctgcctatgtggcatctgcctcatcaatccccagggccctcttcttggtctttccctgctcctagggagatctttctcagaattcttgctccacttgctccagaactgctgaaattccttaggctttggtcctgggctctcatttcacaccacatatactcatatggtccaat

SEQ ID NO: 189341 - DNA, 337 bp, Homo sapiens
gctatcctaatgggtgtgaggtggtatctcattgtggttttgatttgcatttccctaatgagtgatgttgagcatctttttatgttcttgtcagccatttgtctatctttggagaaatggctattcaagtccattgaccatttttaaaaaaagagattgtttgattttttgttgttgctgaattgtaggagttctttatatattgtgaattttaattccacatcagttacataatttgccaaaattttcacctgtcctgtagtgactttttcattctgttaattgtgtcccttgattcccagaagctttaaatttacatgggaactggttttaaagt

SEQ ID NO: 189342 - DNA, 335 bp, Homo sapiens
ttttctaattcactaggaaaataaaagcaatctgaaggaaactctctcaacattacatcttggtaccctctagtatctagacccatagtctcctctcttctgttagtagagttgaagtcattatggtcctacttaacagcaaatgtttgacttacactctaaagtttactcctcctccacctactctagaatatcattagaacttcctcattttattcttgtattatcaagctttttctctttattggattgttcctgctagtttacctgttttaaagtcattctgacacaactcctcttcatttgacataatcatggtctcatttctctgctct

SEQ ID NO: 189343 - DNA, 102 bp, Homo sapiens
taatcataagtcaaatgatttattaataaaataaaattttctttatttaaataaaatttataggagatatttctcttaagagggataaaggttgaaaataaa

SEQ ID NO: 189344 - DNA, 569 bp, Homo sapiens
aactctctgggacagagctctcagaaggtggagtagactgccatctttgctgtttagtagccttagccattgttgccttcaggctttagagagtcaaggtgaccagggactggagtgaactgccagcaaagcactgctgcccttgggaaaataggtcagactgcttttttgagtgggtccatgatcccattcctccgcagtaggcaggatctaccaagtggagactccagccccctcctgctggtgtgttcaggctggcaaaatgtctgtacctccctgggttggagttcccaaagggagggggaggggcaggccaccatttttctgtttcacagccatcactaatgataccttcagatcctggaaaatctgaggagactagggactggagatgactgccagcataccacagcatccttacgaaaaagtaaccagactgttatgtgggcccttaaacctatgtctcctcactaagcttgggcccacagcacagatcccgcattctggacaattgcactgaatgattactcacctgcatctctctggggtagagcccccagcagacaggc

SEQ ID NO: 189345 - DNA, 593 bp, Homo sapiens
tcccacagagacaatccataaaggcagatgatgccaatgacagctccatcctccttagcctcagttccttcatttctaaaatggggacagtagcacttacccttgcatgttattgtgagcaatgagtgggatgatgtataaagtacttatcagagtgtctggtatacatcagtgcttgctcaatgaaatctatgtgagacagcagttgcggcaaacagagcttggactctggagtgaagagctaggtcagaaattaaattagccccactgcctaaaaaatacatgacttttgttagttgacttggtttcttccagtgtcagttcctttatctgtaaatgggaatgctaatatttatcttgaaaggttgttttgtgatttaaataatttaatgtatttaaagaccctagttcaccacttggcatctaggaggagctaaaaaaatgaaaacagttcttagtcaggttcccctttaacactattgctacacctaaaacaaccaatttggccaggagtggtggctcacacctgtaatcccagcactttcggaggccatggcaggcaaatcacttgaggtcaggagttcaagaccagg

SEQ ID NO: 189346 - DNA, 221 bp, Homo sapiens
gcgtccaggtcatcctttaacatagtatctctacgaaatgactgataaactccacccaccaaaagatgtcagccctggaggttctcaaaaacagtttcttaaatctgactggtctgtgaaataaaaaagctggggagacaggaggacaggtgaccactaatctagaacattaacaatttcacatatccaaattcaagtttatctgaatccctctaagtcat

SEQ ID NO: 189347 - DNA, 469 bp, Homo sapiens
atacctcaacatgatgaaagccatatacaacagactcacagctagtatcatactgaatgcagaaaaactgaaagcctttcctctaagatctggaacatggcaaggacgcccagtttcaccactcttattcagcatagtactggaagtcctaactagtgcaatcagccaagagaaataaataaagggcatctatatgaataataatgaaacttgacccctatctcttgccatatacaaaaatcaaattaaaacggattaaagacctaaatctaatacctaaatctatgaaactattacaagaaaacattcaagaaaccccctgagacattcatcttggcaacaatttcttgagtaatccgtgagggccctcacggattacctcaaggagaaacatacacatttattattatagatagagatttcagcccctatttcagtaacttgatccaactgacatttatagaattat

SEQ ID NO: 189348 - DNA, 648 bp, Homo sapiens
gaacttggcattgaacactatgtggttttgtgtaagcagaatttagattgtgatattttctgtcgcttcataattctaattttagactttcaaagtaggataattcactccagaaagtctgaaatctgtgattttccatacactgccaggtacattgatgtcagtggtttgaatcaaactgaatatcctttataaaaaatatggtggatcattttatatatctacctgtagaattgtgaccatgggttttctgtttttttatttataaaaatgtaggagattctttttatttgcatttgaaaatttcttggaaacacataatacagtgatatttatggaattttcctgcagtggtagtaaatgtgaagagtgagggataagtttagagcacaagcctcttactggtcttttgctttacttaaaaattttttttttcacttttctaattacttgtctgaattgcacagggtttcagtttgaatattgcaggtaccatgaagtcttttcttgtagctattatgtacttgtgtgatgccatcaactagattataagtgccttgagcataggggttactataaattcatctttgtattctattgtacttagcttctcacataacaactaatataggataagtataatgagtt

SEQ ID NO: 189349 - DNA, 264 bp, Homo sapiens
tcaactcttccatttcctcagcaataaaggtgcctcacagctctaccctgttcctaacacgttgaatggcagcctatgaactcagtaattcttttctttgtaatgggagttatcaaattgtcattttctttctgtacctcatattgttatttctcctattctaattcctgtatgtacaaacagccaattccagattaccgatatatcttttaaataagtccaagcataggccgggcgcagtggctcatgcctgtaatcctagca

SEQ ID NO: 189350 - DNA, 346 bp, Homo sapiens
gctggtcaagaaggtgtacaacgacattgtatcaaaggccacattgtgtggtaaagccaataggtcctacaggatttgtcaaggagatggatcttaagctcacccttaaagacaacagaatttggacaggaaaaaaatagccacaggatctagtccactgggatctgtcaaatggatttttcaaacttctgagcttacttgagaagaaaccaggagccaggtgagagaaaaagtaaggttcttgagcagtttctctcaagtcttcagggtacaggaagacttgtctgactgaaaaaatagatctgcaaagatagcttgggtcgttgttacacattctggtccagct

SEQ ID NO: 189351 - DNA, 136 bp, Homo sapiens
gtctgagggttctgggctctcttctctgccatgtgcattagcaccaccttccacgtgctcaccacacacagcagtgtgggagtcacatcaccttcgttctgcctttaatcatctctctcagccataccctcctcgc

SEQ ID NO: 189352 - DNA, 636 bp, Homo sapiens
cctttaggacaactatggccccaaaaaaaaaaaaaaaaaaagagaaaaagaaaaaagaaaaaaaatgttggaaaggatgtgaaaaaggcaaagctcttgtacattgctgatgagaatggaaagtggggaagccgtcatgcagaactgtttggcaggtgctcaaaaagttatatatagaattatggtgtgatctggcaagttttctcctagatatatactcaaagaattaaaaacaggtgttcaaacaaaaacgtgtacactagtgttcataacaacatcatttgtcccaaccaacgggggaaggaaccaaaatgcccatcaacaaatgaatggataaccgaaatatggtatatccatacaatggaatactgtttagtcataaaatgtaataagtactgatttatgctacaacatggataaaacttagaaacattatgttgtgaacataccagaatctctgggacacatttgaagcagtgcgtagagggaaatttatagcactaaatgcccacaagagaaagcaggaaatatctaaaattgacactctaacatcacaattaaaagaactagagaagcacgagcaaacacactgaaaatctagcagaaggcaagaaataactaagatcagagcagaac

SEQ ID NO: 189353 - DNA, 415 bp, Homo sapiens
caaatctggtaatgtttgggaacatttcgggagaggaaagggccagggctagtgcagctcagaaaatcatccgaactctttaaatcacagctgcacaggtgacttgatttagagggagaggtgtaaactgtcattatctgtgaatactgagctctaatcctgtagagctgcagtggagactgctagagaagatgattcctgatctgaaaacaattccagcctggaggatcctaaggcatttccttgtaagggtagttttcttctgtgcggaaaagaaatgaaagaacatgtgcaaatatgggtgggagaagaagaaacagagacagagagagagagagacagataagttgcaaaaacttggatctttgtatttctttcttttctttttcttttcttttcttttcttttttctttt

SEQ ID NO: 189354 - DNA, 248 bp, Homo sapiens
gagattctcctgcctcagcctcccgagtagctgggagtacagacacataccatcacgcctggctaatttttgtatttgtagtagggacaaggtttcatcatgttgaccaggctggtctcgaactcctgacctcaagtgatccacccacctcggcctcccaaagtgctgggattataggcatgagccaccatgcccagccgagacagggtgctttatacacattaagtcattaaacccattaaaaccct

SEQ ID NO: 189355 - DNA, 417 bp, Homo sapiens
tgcagtcaacaaatcatgcatgaagtattaattaagcaagtaattcctggtgtgtgcctatctctgtgctggttgctatgggtcaaactcagataagatgactatccttggcattcttagcaatccaaagaattagtgaaatataaagcagtttgtcgtgcagttaaaaactgtggactctagactgtgagtgctaagggagtgagagaaataaaggtcattaaggggcttggctggtcagacctttgtggaaaaggcatgtcttcatgtgggccatgatagatcggtaagatttgagaagggaagaagacagtccataagggagtggagacagtttgagcaaaggcacaaaggaagagtatccttggacaggtttattatgccctgtataccttggccacagagaatggtctgcat

SEQ ID NO: 189356 - DNA, 366 bp, Homo sapiens
tcacccaactcggcctcccaaagtgcctgtaatcccaggattatgtgcctgtaatcccagcacttttttgcaatacctggccaattataaatgccactttatagaagaggagaagtggcagagataagaaactggcaggtcacacaaagcccagattctatccaaagcaaaatgcatttgggacctgatatcgtttggatctgtgtctccacccaaatctcatgttcaattgtaatcctcagtgttggaggtggggcctggtgaaaggtgattggatcatgggggtgggtccttcatgaatggtttagcaccatttcctcagtgctgttttcgtgatggtgagttctcttgagatctggttgttta

SEQ ID NO: 189357 - DNA, 259 bp, Homo sapiens
tgaaggtaaaggaaaggagaggattaagagtagatccattgcacctgtcatgcctttcaatgaaagaaggaatgcaatgggaacacaggtttgggtgaagcaaatgaaataaattcagttttggacatcctgaatttgtgataccagtagccatcattgtttatggtttacctagcattgttgcaaatattttacatttatcatgtcgtacaattcttaccgtaatctcacaaaaaggacactattatttgttatcccc

SEQ ID NO: 189358 - DNA, 993 bp, Homo sapiens
acactcacacccacacatgcacacccacacacatgcagtcacacacatgcacactcacacacatgcacacccatacacatgcacagccacacacgtgcacacccccacacacgcagccacacacatgcacacccactcgcacacccaatgcctgccttgtctttccccactggcttttgtgactcagattgcagggcaggcccagcacccccggatcagagaccccgtctgcctgtcactccttgggcccctccattccctccctgcattcacctctcctgggcgtcataacctctcaacacctctttccctttcctcccaaaccctcttctcccttctctgagctgcttctctcctttagactttcctttctttctgacttcaccatctgaagagtgtcaggccctaccaagcaaactgggccatgcctaaggggacactgggggaaagggccatgcctgagggacccagcctgggggaaaggtgggagtccaaggccacagggctgcaggtctcatccagggctgactcctgtgtaagaggacacagtggcaggccacagccatcccaggaacacaccagcaaggctccccaaaaagccacggtgatgggagcggaaaccctggtcaagaaataagaagcaactcctgcagtctctccctgggtctccacggaggatttgcaaacgaaaatgaacagctgaagccttcctaggtaaaactcagtgtgccatggggccccatgtacacagaccaagagcccacacagaaaaggcagcttgcagtggcatccaaccatcatttcacctgccttctcccatcacagtttggggacagaaaccaaccacagaagaaaaaagatggcaagctgggcatgctggctcatttctgtaattccagcacttcaggaggctgagatgggtggatcacttgagccaggagttcgagaccagcctggccaacacagcaaaacctcatccctactgaaaataaa

SEQ ID NO: 189359 - DNA, 372 bp, Homo sapiens
tcagtccgtccttcagctctcccacctcccttagcccactctcctggtacccaacaggagccccatttctttgggctttttttctttacaaaaactggttttggcttaggacgctcagataagcattctcacattttggagaaaatactgttttaatcttcttcctctttatccaacttttgccagattaatcaaaacacattttccagtgccccttcaattctctttacgctcaattttcaggattttattttggttattaagagctgtgctagtgatacattcataacaagaaaaagcagcaggtggccaggtgcggtggctcacacctataacccagcactttgggaagctgaggtgggaggatcgcct

SEQ ID NO: 189360 - DNA, 223 bp, Homo sapiens
ctactcaggaggctgaagcaagagaatcacttgaacccaagaggcacaggttgtagtgagccgagatcatgccactacactccatcctgggtgatacagtgagactccatctcaaaaaaaataaaaaagatattatcttgtattagggttctccagattaacagaaacaacaagatgtgtgtatgtagagatatttgttttaaggaattggcttctgtgtttg

SEQ ID NO: 189361 - DNA, 369 bp, Homo sapiens
tcctaccctatcctctcaatctcaggaatatccagttattgcaaacatgcctctaaggggtcaagtcacactcactaccgccaccacttggtggctccactcaacagatcttcactcaacagttcagcactcaacagatcttcaagagcagggtcagcccttgcagggccttgaaactgagggcctccttaaactcgtgctgggtgatctccctagtcctggccctgctcagcagtctgccgctgaagtgctccctgggagcagaccaccagcccaatcctccagcctctccaggttggattgagtgtctggctgactcaggagcatcacatggggaccaggatgccagagggaggtggcgaggcccaa

SEQ ID NO: 189362 - DNA, 363 bp, Homo sapiens
gttttcaccatgttggccaggctggtctggaaccccgacttcaggtgatccacgttggcctcccaaagtgttgggattacaggtgtgaaccactgcgcctggccatgaagtgtccaataaatattagattgacataaagaaccctcaggtgtgctatctcatggaataccctcaaattcctctctggatcttcctatcacagttgtattattggggtcccatttggatctctcccactataggtagctcttcagtgggacgggctaggtaagagaggctgggagtaagtctgtctgatctaggatgtcttgcttaccacccaggtagggggttatatactcccagcctttctgattccattgt

SEQ ID NO: 189363 - DNA, 353 bp, Homo sapiens
gtgtgtgtttaaagactgagccaagtcacctccagggcagtgaaccttgtctcagggaccaatgagatgaaatgtacaagctcaaattgaaaacatttgtgtactgcagtctttccaggaagtgttctctaaccactgagctaaacacagaagaatgtataaatatgtatgctctgccaacagaagaattctatttgattataattttctgtttctatcaagtgcgtatccctctctgttggaaacacatggagtgtaagctgagtgggttattattttagcaatcatactttgccaaagatctggtcattttttccactaaggtatatgaggcactattcttttattttttt

SEQ ID NO: 189364 - DNA, 247 bp, Homo sapiens
attttaagataaacaaagactgaaagaatttatcttcaggagatctgtactacaagaaccactaatgaagtacttcacacagaaggaaaataatccctattgaaagcataaaaatgcagaaagaaataaaaagctataagagtaaacatatggatgtatccaaatgaatattgattgtattaaccaatgctaactatatgctgctggtttaaaagtatataacaaaacagcacaaagtatgagagag

SEQ ID NO: 189365 - DNA, 414 bp, Homo sapiens
taaaatatgatgcagttcaaataaagtctgcctgtgggacagttctgcacacaggctgctagtctgagattcctcctggcacagcccatgagaatttcctccctcacacatggaaagaaactggttgttttggaaaccagccaaagagaggctcaagttctccaagagaattcatatcagtctttgcagactagtattcatatttctttctactccaaatggttcaattacatctaaagtctgcgtgaaccctttacaagaaaccagtggccagtgtggatgaccagaagctactctggctatttgggtcaagatctataatgcctctctctgtttatattcattatttacatttttaaagttatttgtaagtgcacgtatacacacagtttacaaaaattcacaaatataatg

SEQ ID NO: 189366 - DNA, 199 bp, Homo sapiens
catgattgggtgcctgggcaaactcccctggctggttttcacctttctgttcagccagcaggttggaaatctggtactagaaaaagctgcatcccagcaagcatcatagagagatgagcatcttccttgtctattaggaagacgattctccaggtgataggagagagaaggctgagtcccaaagtgggcgggggacttg

SEQ ID NO: 189367 - DNA, 498 bp, Homo sapiens
tacatttattgtctcacagtttccacaagtctggaatccaagcacctcttagcaggatttcctgcctcaggtctcacaaggctgggatggaggtgtcagctgggctacgtttcttcctggaggctctgggggagatccccttctaagttcactcaggttatccacagagttcatagccaaggagatgcgggactgagttctgggctttgtgctgtcagccacaggctgcccttagcaactaggggccactcacagtctttcccacatggaccccccagtgtggctgcttacttcattgagccagccagaagcacctctaggatgggtttaacagtgtgaaggagtcttaaacttaaaagtgacgtctgccacctttgccatattctgtgggatagaaggaagtgccaagtcctgtccacccttgaggtgaagggattacaccaaggagtatacaacaggagtcaaatatcatggagaatactgggcaacatggcaaaa

SEQ ID NO: 189368 - DNA, 360 bp, Homo sapiens
atggggagttattgcttaatgactacagagtttcagtttggggtgataaaaaatttttggaaatacatagttgtgatgattgcacaacattctgaatgtaattaatgcctctgaattttatgtttaaaatggttaaaatggcaaagcttattacatatgcttttaccacaataaaacattgtaacattaatcatagaaccaaaaccataaaaccatttttttaattgtatatatttacagagtacaagtgcaattttgttacatggatatattgggtaggagtgaaatctgggcttttagtgtgtttatcactggaacaatgtacactcaccaatttcttatcaccctcccccttcccac

SEQ ID NO: 189369 - DNA, 181 bp, Homo sapiens
gtacctcacaagacctggcagaagcaggaagcacattggacagattaaaaaggaccaagaagaggaagaagaccaagaccctgagagttatttttgttcaccactgtattgaggtataatattttggggtctcatttttgttggagttctatagtatccttaatgtggcagaatctggaat

SEQ ID NO: 189370 - DNA, 559 bp, Homo sapiens
gccctttcttccctgtcgcatacggatgccaagatcctaactattgcttactcaagttgagtaacctggatcccctggacaaatctctcctggtgtgatctttaattccttagcggctgggacatttctcagggtttgatacgagtttttcaccctgcaaagaccctgaccaaagagaggtaaggttctgggagcctctgtctgccccgacatacttgtgttagcatgcagttctggaagaagctgagactgctgccctcctctgggaccttggggccatggtgttctctgagcaccccgtattgacgtgtcctaagagacgtccgaggggccgtttgtaccttctggcctggggcagccagaagtctggccaagtctcccggacttagccggatgtgggtgtgttggcctgtcccgccaactgggagctgagaatagcagaatagggtcagggggtgatgggaaaagcactagttggctgctctcctgggcagtggggcagtgaacagaggaaacatgatgcggggaggtgctgtagaaatgggcagtttggagaaga

SEQ ID NO: 189371 - DNA, 386 bp, Homo sapiens
ttctctttatcactatttttcagcaattagattttgatgtactgtggttatcctgcttggagttaagcttcttcgttgttggtttatagttttcgtcaaatttggaaaaatttggccactgtctccttaatttcatctttctgttctcccttccatatatagccactcgatattattccaaaaatctctgaggtttgattccttttttccctagttatattctctttgtgctgtattttagataaaatttgtttttcaatttcactgatcttctttagtatctagtctgctattcagttaattgttttcatatattgtatctttcatctctagaagttctgctttttaaaaaaatctttgatttttctcattaagtatttgtatta

SEQ ID NO: 189372 - DNA, 382 bp, Homo sapiens
tctcgggtttttgttgtggtctttttgtttgtttgcttgtttttgagacagagtcttgctctgttgcccaggctggagtgcagtggtgcaatcttgactcactgcaacctttgcttcccgggttcaagtgattctcctgtctcagcctcctgagtagctgggactacaggcatgtgccaccatgcccagctaatttttttgtatttttaatacagacagggtttcaccatgttagccaggatggtctcgatcccctgaactcgtgatctgcctgggtatttctttgtagcaatgccagaatggcctaacacacctagcccactgtgagcacttcttcaggaaatttctctgaactggatcaggtgaatcacctgtctgcaca

SEQ ID NO: 189373 - DNA, 157 bp, Homo sapiens
tcaaagtgaaataacagaagctaagaatgagctgtcaaacaaaagggacaccaagtccatgtgcctgactagaacaggtatatgctcaaaagggataaagaaattaagttgggccaggcacaatggctcatgcctctaatcccagcactttgggagg

SEQ ID NO: 189374 - DNA, 326 bp, Homo sapiens
tatgtgggctctggaatgacaccaagtagccattaagatgtcatatagtagacatcataacttttaccctatgttcaacagcgtacagccaatggctaatcaatattatctctggaaaccaatgagaatacctgtcaaaacttttatcagcccactccttgttcccctttgcctttaaaaacctgcttgtaccaaacagagtactccccaaggcaacctgaaatgggtccctggcagctgttctcactttggctcaagtaaactctttcgaaattatattttgtgcctcagcttcttccctttaggttgacatacactcaaggaca

SEQ ID NO: 189375 - DNA, 718 bp, Homo sapiens
gtattttttcccccagtttggagagctcacagtcctaagtcattctacttgatgtttaatttaccacaaataaatcatgtagcttaaagtctgtgtatttctgagagtaaacaggtagaaaaagcgagaaacagcagaaaatgcactccccatatttaggagttataatcatgtatgtaaagtgtgttctctgtttaaataacaaaacaaatttgttaaaatttgtacttatttgtaagtacaaataagggaagtgggaccagtaaactcgagactatattgtcaagaaaacttaaaaaagaagtgtttcaagagtaaaactctttccaaaataagctgtcaatccattgaaatgtgtccccaattggtgggttcttggtctcactgacttcataaatgaagctgcggaccctcacggtgagtgttaccgttcttaaaagcagcgtgtctggagtttgttccttctgatgttcagacgtgttcggagtttcttccttctggtggggttcgtggtcttgctggctcaggagtgaagttgcggaccttcgcggtgagtgttacagctcataaaggcagtgtggacccatagagtgagcaacagcaggatttattgcaaagagtgaaagaacaaagtttccacgtgcagaaggggaccccagcgggttgccactgctggctggggcagcctgcttttattctcttatgtggccccaccgac

SEQ ID NO: 189376 - DNA, 314 bp, Homo sapiens
tagtgcgagaactaataatatcaaacactaggtgataacctgttaatttccatctaaatgcaaaagaggctcttcaggactatggaatagaatgtcctctaaaataaagagaaaaaagctttcttcatttcctaggcattttcctctgagttcccacagtggcaaacattctcttacattaacctatgggacattgccccaaatatccattcaaatatcaggttctctgctatctgtgagccacttaagagcagtgagcatatttttggcttcagcattcttacagtctagcatagggctttgcacatcatagg

SEQ ID NO: 189377 - DNA, 259 bp, Homo sapiens
atctggagaggttgtaaaaatactgattgtagagagtctcataccttcactctattggggtagggcatggtgtcacattttgtaacattaactaaatcttcataggtgtttgctgtaaaactccatgaacttcagtgtgcacaccatctaggttctaccaccagcattttttttttttttttgagacagtctcactctgtcacccaagctggaatgcaatggtgcggtcttggctcactgcaacctctgcctccgggtg

SEQ ID NO: 189378 - DNA, 366 bp, Homo sapiens
taatctcgtttaaacaggaggcagtcattagatgagatttggaagctggggagtttggggaatggggacaataaaaaaggtaaaaaaacaaccacttggagagacagaatatattgtccactagagagagtgattggagggataccagatagagcataagcagctgagttggtattagaagcagtcaagtaggttatgtttgtatttttccttttaccaccaaggttcaaaagtccaggatcaggagcggaatttaaatatccacacatactctaccaccaaacacctacaagtatgccaggcatgataatatgcacttgcaagtttcctcatttaatctttatagtttcctttctcttttccctc

SEQ ID NO: 189379 - DNA, 481 bp, Homo sapiens
aaggccttttcatcccacaaacacaataatcaagccctgaggcaccaaaagcatccaagggacagccaggaaccaagaattcttcttctaaccatgagatattgacagacaaatcttcctgccaagataataggtccatcatgacccaatttaggaaacttgatagaataaaactatgtttgggcattttcttggaactggactgtttttctctccctgatgtagaatggcttctaagtgattactcaaactctagcttgcaaactgcttgaatcaaaggaagagattctcaatacccctgtacattggccttcgtctgtggaagtgtgtaagaacacggtgcacaatgggtttacgctctttagagagcctgtgtcagggttcggggagggacaggtatcattttaaggtcttcaactgctgcctccccaggatacccatggtcaagcgtgttccacatatttttccaaagtcatgattc

SEQ ID NO: 189380 - DNA, 382 bp, Homo sapiens
tgaatttctgttgtttataagccacccagtggaagggattttgttacggcagcccaaacagactaagacggtgtgaaaggaaaggaaatctcaggaccccaaagtcacgaagccaaagggaagtcaagccaggaactgtgttcggcaaacctgcccctcagtttattcctgaataagagggctacaaaggtaaaaaagctacagacctccctcgctgtttgcctgcaggaaattcccatggaccaaggacagacagaactcagtcatccctcagcagctcacctgagacaggtgcagatctgatggcttcctccaccctattgcttcactgagccagactagggcggaagcgactgttcctctatcctcctctcagatgtac

SEQ ID NO: 189381 - DNA, 103 bp, Homo sapiens
ttccaacacatactataatggaagagaaaaaggtaccacaagagtgaaatactaggaagcaagaaagacctgtctaaaaaaatatttaagacaaggcttaaag

SEQ ID NO: 189382 - DNA, 452 bp, Homo sapiens
ggtggaatactctgggaacctagcttcctctgggtattaattgatataaaagtaagtagatgagctggcacgatgcctgtgtcccagctacttggtaggctgaggcgggaggatcacttgtgcccaggagtttcagaccagtctgggcaacacaacaaaacctcatcccaaaaaaataaaagtaggtggaatactcccccatctccctacctcctactccacaagaaaggatgaagtatgccctcatggtagggagcatggataggagctcttccttaaaactggcaactggggtggtttgtgactctattaggagggataggagttagacagctggaaggatttaccaaaagttaggaaatgaagtaaaggaatgaggtgtcttctcctttttttttttttttttttatgggaaaaaaaattctggaccaagggcccagggggaaaaaaca

SEQ ID NO: 189383 - DNA, 265 bp, Homo sapiens
agttactgggtgggtgaatgttggtaccatttactgagacaggaaattggaaaggagcaggatttcaggagtagatgagtgggaaaatatgaggcctgtttcacacatgtcattacttcttatgacaatttatacatctctctcccattttgaatgtataatgttttagtctacatcaaaaaagatctaaagggtgttggcagataggtacctcccaagaatgtatacaagatgtgaaaataatgtttccctacatactttcact

SEQ ID NO: 189384 - DNA, 468 bp, Homo sapiens
gggccctgcctgtttgggctgcctggcatgcagaggccccgagtcaatcattgttgaaggccttaatgcactgaagagccagcccagtgctgtcaacaaaacttggggagctcggaggggcccagttgaccctggctggggcccagggagcctctcccagtgtctcaaccatgagaggaagttgcaagactgccatttctgtccacaggctcagctctttttggtcaactttcccagctcttggtctgaggcctgtgtgttctcacatgccttgtcacaccctatggggacaggttgctaggaaagtgggtggggggacatttcctcattttctagctcgtttgggccaaggctgagagatctatgaggtcaggggtcgtgctcccctctgtggactcagctttgaggacaccccctcaagtttcctgttgcccgcctgctttgtgattgcattagcacccggcctgc

SEQ ID NO: 189385 - DNA, 352 bp, Homo sapiens
tgtacaactcattgaaatctctctttataagtcactcataaacatgactgcagtcatatgcctcacagttactgtactttaatctgcacttgcttcctcctacgtatttacttaaagagtcacagcttgctggaaatgtatccttcctactgttgctctgtgtgtctccaacggggggattggatccttgtatgtttttttaaccagcagataattgtgtgctttaacatgcattggtacataatctgctttccacatagaattagagaatacccttatatctccagtggagtgtcttagtccatttctgctgctgtaactagagactgggaaatttgtaaaaacaaatata

SEQ ID NO: 189386 - DNA, 442 bp, Homo sapiens
tagctcacgcctgtaatccctgcactttgggaggccaaggcaggtggatcacttgaggccaggatttcgagaccagcctagccaacatggcgaaatcccttctctactgaaactacaaaaattagccgggtgaggtggtacactcctgtaatcccagctactcaggaggctgagccagaagaattgcttggacctggggggcagaggttgcagtgagctgagatggcgccatgatactccagcctgggagatagagcaaaactcttccttaaaaaacaaaacaaaaaaaacctgctgcattgggattcagtttcagcatgaattttggaggagacaaaaacatttaaaccaaagcagatcgggtggtttaaacaacaaatttattttctccacctttggaggctagaaacccaagatcaacgtgtcagcagggacccactcg

SEQ ID NO: 189387 - DNA, 645 bp, Homo sapiens
cagagatttatgcagcgagtcaaggagaaagaagcaacatttaaagaagctgaaaaagagctgcaggacaagttcgagcatcttaaaatgattcaacaggaggagataaggaagctcgaggaagagaaaaaacaactggaaggagaaatcatagatttttataaaatgaaagctgcctccgaagcactgcagactcagctgagcaccgatacaaagaaagacaaacatcgtaagaaataatagtttctcttactattctgagagccctatcattctacatcgcaacttcctgtgagattgtctttgtagcatttaactctgaagttctcattttaaaaattggcttgcttattgtatattttccccaactaaagtgtgaactcctagcggggtgtggtggctcatgcctgtaatcccagcactttgggaggctgaggcgggtggaccacctgaggtcaggagttcaaaaccagcctgaccaaaatgatgaaaccctgcctctactaaaaatacaaaaattagctgggtttggtggccggtacctgtaatcccagccacttgggaggctgaggcaggagaatcacttgaaccccggaggtggaggttgcagtgagccaagatctcaccattgtactccagcctggg

SEQ ID NO: 189388 - DNA, 602 bp, Homo sapiens
tacatatgtaactatcttcaggcagtaacacaaagcgcaaagacccttccatgctaaatccccgggtactcggcaggagtcacccataagcaaacaactaaatcttcatgacccacaattttctcatctgtaaaatggggtttataatacatttcccaaagaattgaagtggcaattatatgtgtgcccaaaaggtagtaggcattaaaagtgatagttccatttcctattttccacataagaactaaaagggtagtatgacatgtaatagcgctcaagaaatactttggtaaaacttgttaaattcttaaatcaagcacattttgccattttcttgcatcatcataattcctctgccaagtcatattaaaaaaagcaacaaaagcattttactgaaaagcattttactaactaaagcttttagctgtgaactccatatgtgtgctctttctatgttactcatttaataaagactaagataaatacaaggactcagaaatgtagacatgggtggcatgtactcagtgagctcaggtactcacattacctcagttttactggggaagcagatggcaaagtgctaaattaagtgaagtagcaag

SEQ ID NO: 189389 - DNA, 311 bp, Homo sapiens
gggtggcgtaagtacatcagttgtgtagcactcatcattatctccagaactttgcttccagttttcccgaaactgaaagcttagtgatccattaaacattaactccccattttcttctcccgcaacaacccttttattttctgtctctatgcacatcaaaagcacaagtcagagaccacttcatatccattagaatggctattatcaaaaaacagaaaataacaaatgttagtgaggatgtcaaaacaagaaccctggcacattgctggtcagaatataaaatggtgcagctgctatagaaaactgtatgg

SEQ ID NO: 189390 - DNA, 386 bp, Homo sapiens
cacagtccctggcagagtctggaaggcttcccagaagtggcacttaaggatcagtggaatgtttttttgcatgaaaagcagggaacagggccgcaagcagcatgaacaaccttgagaagtctggaaaaggcttcgaggattttggtgtggctggagagtaggctgcacgtggcaacatcaagaaataagacaagggaaagaggcagagtcaggcacagaggtgcctcaggagccacggtaaggagttgaggctggatctggaaccacagagaaccaccgaggtggtgttcagaagcagaatcacacagagaaacttgcattccagaaggttcactcaggctgtggcttggagaaagtggacgagaggctggaagatgctgctgtag

SEQ ID NO: 189391 - DNA, 348 bp, Homo sapiens
acagtggaccgagcagagcaagtggctggactctgtctagctcagatgaggtcccaagctgttgctcactggtatgtgcatttgattttgcttcattacatatttgagtccagcacagcagcaaaaagcaaagatgatatttgaaaatagagttccatcctagggaagactgccaaaaccagggcagcctgctttcagagtttgacttctccaggtgctaagccctagggctgtgggtgagggttcaggccctgccctcagggatgtcctaatctgatttgggatattaagcacacgacagaataatgattgatactgggtatgcttctgaacctaaatactcatttc

SEQ ID NO: 189392 - DNA, 309 bp, Homo sapiens
agcctggcgacagagcaagactccatctcaaaaaaaagaaaaagaaaaatgaagataattacatcaaggcacattgtaatcagattgcttaataaagatacactcataaaagtaaccagaaagaaaacaaaaaggaaaaaaaagacacacgacatagagaggaacaaagataagaatgacagcagatgtgtggtcagaaattattcaaggcagaagacagtagaactgaaaaagaaagtaggtcaatctagaattctatacccaacacaaatatccttcaaaaatgaaggtgaaataaacactttttga

SEQ ID NO: 189393 - DNA, 650 bp, Homo sapiens
gttgcagtgagccgagatcgtgccactgcactccagtctgggtgacagagcaagacttcatctcaaaaaaaaaaagaaaaaaaaggacgcagggaccaacctgaacatgatcccaatgatcaacaatggggacaattgagaaataaaataaatataagttatcagattaaaaccaagagaattaagtaaacatccatgagtacatactgatattaacggatgtttgaacaagtaagtggaaggtaaagaaaggaaaacaacccaaagaactgtaaaggatccaatatttactaaaattactaaaaatttggcaaagattattatacttactagtatttgtttttctcctcctttccttgagcatttagctaaattgaatttcttagatcccctctcattgggttgggacttttgtgccttatttttggccagatggaattttggcagaaatgacaggtgtcatgtataggcctatctcataaaatgactagagctatactgcccaatatagtagtcactagatacatatggctattgatcacttaaaagatggttgttataaattgagatgtgctttaagtgtaaaacacaagattttgaagatcttgtatttaaaaataactttaaatacatcattaataatctgatat

SEQ ID NO: 189394 - DNA, 150 bp, Homo sapiens
aacatcaccagtaacctctatggctacatttaatagacacttttccagtccttatgttacttgatctctcttcagcatttcaccctgctgacctgccttgctttcctagacaataagctcttctgattcttttttctctgtctccactgg

SEQ ID NO: 189395 - DNA, 334 bp, Homo sapiens
ttagtgtttattttgctaacttacaaaatggccgaactggttggcagagcttagtgtttttgtgggtgaaagcaaaatctggcaaaacaatcacaaagcaatctacactggaattccataaaacttatttccaggctaacttcctgccagtgatacaatagctaatatttacggagcacttttgtgtcaggcatatgtcaaaattctcctaatccttacctataaagaagacaaagcccaagagtgtgtgtgtgtatgtgcgtgtgtaagatatcaccccacagtctgaattatgcaatccacactatcaactatcagcgttaggtatcactgc

SEQ ID NO: 189396 - DNA, 593 bp, Homo sapiens
actgacctttctgccatgcaatctaactgatcagtaataagggacaggaatggtgatctgtcttattcattcccacaaggcaggcttggcatgaacaagaataacatttggcaaaaatctctgaagagatctgaacctcagcctcagtggaggtagaaggtccctctgcccatccttggttcctttaatttttcactgtccttcagcctagaggtaatagctgctcttttgctgcttccttaaggtccttttaaagttccttttagtagttgtattagtcccttttcataccgctataaagaaatacccgagggccgggtgcagtggctcacacctgtaattccagcactttgggaggccgagttgggtggatcacaaggtcaggagttcaagaccagcctgaccaagatggtgaaaccccatctctactaaaaatacaaaaattagccgggtgtggtggtgggtgcctgtaatcctggctgtttgggaagctgaggcaggagagtcacttgaacccgagaggcggaggttgcagtgagccaagatcgcgccactgcactccagcctgggcaacagagcaagactccatcaca

SEQ ID NO: 189397 - DNA, 379 bp, Homo sapiens
tggagccacagcctcagggccagggctacagagaagcttctggatgccctgacttccatctgtcacctcatgccaataaggaaagtttcgggtggatctggccgaggcggctggggtacagaagggggacccagagatggggcagcccagccctctgccctctcctcatccccatcaggtagattctgcgaacccctgccatgccccggggatcctgtgacttcgtgacattacacagcagtcatgtcacctcccaactatcctgatgttttctttgtggtctttcttttcagtgtcctcactgtatgcccactttacccacttcccacctccggtccccctcatgctgtgcatggatcccgaacctctcccagcccct

SEQ ID NO: 189398 - DNA, 488 bp, Homo sapiens
cctgcctcagcctcctgagtagctgagaccacaggcacacagcaccatgccatctttttttgtagagatggggtctcactgtgttgcccaacgctagtctcaaaattcctaggctcaagcagttctcccacctcagcctctcaaaatgctgggattacaggtgtgagtcaccgtgcctggctggtaatgggttttctgtcaaaattgttcaagtgcaacaaggtgactttcagaaagctggagggtagattttccaacttttgtttttagtgaaggaaccctttttcaggtaaaactgtgcagaaggcctaattgccagtcacacagaaatagagctgctctggtttatttgggattggtagagatgctgagccctgctactccaggtttgcactgtatagtggaaaagtctgttagacttagatgacttgtgagggcccttctgactctaaaattgtataattctaggaggagattgggcataggaa

SEQ ID NO: 189399 - DNA, 217 bp, Homo sapiens
cctaacttcaacagtcagaagcttggcctcccctccgtgaacacacacaaatttctgaattctctgcaaccctgcccatgccagggggagcctagagtgcctattccacccatcagttccccatgagattaggcaggctctgacccaaaggctgacatgtctctaggtatcgtcaaccttccccaagccttgtccactcacctggcatgttagagct

SEQ ID NO: 189400 - DNA, 243 bp, Homo sapiens
ttacctggaagaattctaacagcactattattctcattttacagatgaggaactgaggcacagaaatgttcagcagcaggcccattgtttagagctgataggttgtagagctgagatttaaaactaccaagtcgaagcttacaactgtgctatcttacttttttcaattaagagtcatccttatggaactttggagttgggagttccttagcaattacttaatctaaccctttcattttactg

SEQ ID NO: 189401 - DNA, 342 bp, Homo sapiens
ggccttccaaagtgctgggattacaggcatgagccaaagcgcccagcctagcctgtttttaagtatgaaggataatgagacataaggtagattggacctataatgtcttctcagaaatcatgttaaagacccaccgtatgaaaacagttgggggaatctgcccttttttgcccaaagcagtcctcacattggctttactaccccctccccagcctcccacattttgtactttgctctggacatcctcacgagccagatcctcattgaaaatgagcccctttgaattagctgcttaaaaagatggagctaccatgatgccacaagaaacccagcttgtgcaaa

SEQ ID NO: 189402 - DNA, 658 bp, Homo sapiens
aatgtgtgacattttaagttactttatactattaacttttacaatactttatggtctttttttttttttgagacacagtctcactctgtcacccaggctagagtgcagtggtgcgatctcggctcactgcaacctctgctgtccaggttcaagtgattctcctgcctcagcctcccaagtagctgggattacaggtgcctgccaccatgcccagctaatttttgtagttttagtagggatggggtttcaccatcttggccaggctggtcttgaactcctgacctcatgatctgcccgcctcagcctcccaaagtgctgggattacaggcgtgagccaccgcgcctggtctactttaatggtcttaaattgctggtatatttacaaattattgtggagtggagtgactattctgttccagacgttgttctagcactgtggatgtagcagaaaacaaaagagaccaaaatccttgatgtcgtggaacttgtttctagtgggaaaagacaataaacaaataatgtcagtagttataagtgctatgaaggcaaaacaggtaaggagctagagaatgtgggaggggctggtatttgagacagggttgtcatggaacggctttctgttaaattagcatttgagcagagacctgaaagaatagac

SEQ ID NO: 189403 - DNA, 301 bp, Homo sapiens
aggagccctggggaggagagcgggggtgtttaccagcttggtgccagcacagactttgctcactatcccagcagctctgtgcagtacacaccctgcacagatgttcagcccacactgaccacagccaaggcagtgagaggaggccaggtgtctgagtgtgtagaggccattggcagcctccatgggaggaggcgacatcaccagaagggcagctggaaagaattttatatctgaggctggagtagtttagaaactgagtttgcagtttaggctgaaaactcaggggcacctttctggtaga

SEQ ID NO: 189404 - DNA, 550 bp, Homo sapiens
aatcagatgggttttcataaccagtactttctcagagtggtaaatttaaaaaaatatataaagagaataaataatatttgttgagaatacttcaaataatgtgaagagttattaacttacagcaggagttggcaaacttttctataaagggccatatgggtctttgtcacaaagtcttgggtttttgtttttgtttttttaaacagctatttaactattcctagctaatgggcaatacaaaaacagtgggcaagatttggcctgtgggcagtagcttgctgaaaccttatttagactctaaattttttgaaagagtctacattgatgcatatttttttttcttcctccaaatacagttgacccttgaacaacatgcgtttgagtgaccatgggtccacttgtgatacacgtttttttcccaaccaaatgcagatatggagggctgacttttcatatacctggatgttcctgggccaactgtaggactagaggctgggggggtcttggaaccaatgccgtgtgtataccagggatgactgtttcttatggc

SEQ ID NO: 189405 - DNA, 365 bp, Homo sapiens
caggcacaagccaccactacccggctagcacacgttctaaagtatatattatcctaacaaagcctgaatgaactcagtttggtttcctctctctgtgtatgactaggatcttcacatgccttaccacctagtaagcagcaatctctccatcttattattgttacatggagttttagttttactgttaaaaacacacatgaaaaaacattttcagtcatctgttcatcaaatttatttgtgtattttgttaacttctgtggttacagtaatttcttatgtattgccttctccgagtcttttttttctggctgaagtatatcctttagtaattctttcagtaaaggtctggatattcggcgtgtgca

SEQ ID NO: 189406 - DNA, 387 bp, Homo sapiens
atcctcaggcataaatgggttttaaaggatgaattaagaatattattaccacatagctagaataactcctcaatctgtgtttactaaataaattcaaacttttaatgaaacctttgaggttaattgcattgtaattaaactttcaacaattgggtttagtttgaaaattattcaacttgatttactccttttgaaagaagtaaacacatttcgggtatgatctcatggtatggtttgtgtgggtgtttttatctttgtggaaaatatattattaggtacatgaagcagggggaaattaagaccctaaattcgaggatattatctgtatttaggaacagctgagctgttgatcaagcgttttctatgtttggttataaatttggggca

SEQ ID NO: 189407 - DNA, 835 bp, Homo sapiens
cactaggctaggtacgaggccgggttggtttaatcggccgagggctttttctcctgacttctcctggagatgaagagaactgcaaacactgtgtactgctgcacgcgggctcccccaggccaacagaactgctgggtatatccgcaccatgtacctggggattcagagccagcggcggaaggaacaccagcgacgcttctactgggctatgatgtatgaatatgcagacgtcaacatgctgcgcctcctggagaccttcctggagagcgcgccccaactggtgctacagctctacatcatgctccagaagaacagcgccgagaccctgccctgtgtctcctctgtgacttccctgatgtccctggcttgggtgctagcctcctatcacaagctgctgcgggactccagggacgacaagaagagcatgagctacagaggggccatcatccaggtcttctggcgcctcttcaccatctcatcccgagtgatctcttttgccctctttgcttccatcttccagctctattttgggatcttcgtggtggttcactggtgcgccatggccttctggatcatccatggcggaacagacttctgcatgtccaagtgggaggagatcctcttcaacatggtggtagggatcgtgtacattttctgctggtttaacgtcaaggaagggcggactcgatatcgaatgtttgcatattatacgatagtcttgaccgagaatgctgccttgacgttcctttggtatttttacagagacccggagaccactgactcctatgcggtgccagcactgtgttgtgtctttattagctttgtggctgggatc

SEQ ID NO: 189408 - DNA, 580 bp, Homo sapiens
aaataagaacatgtggtatttggttttctgatcctgtgttaatttgctaaggataatggcctccagcgccatccatgttcctgcagaggacatgatttcattctttttttatggctgcatagtattccatggtgcatatctaccacattttctttatccagtccactgttgttgggcatttaagttgattccatgtctttgctattgtgaatagtgctgcagtgaacatttgcatgcatgtgtctttatgatagaacaatttatattcctttgggtatacatccagtaatgggattgctgggtcgaatggtagttctgtttttagctcttcaaggaatcgccacattgctttccacaatggctgaactagtttacactcccaccaacagtgtgtaagcatttctttttctctgcaacctcaccagcatctgttattttttgctttgtccatttttaaattgggttcttggtgtcgaatgctttcattttagaaatatggtttcattggctttagaattctttcctttttttcttcccattttttagctctacctctccatgtcttctggcatcctcattg

SEQ ID NO: 189409 - DNA, 403 bp, Homo sapiens
tatgtttattgattgtttactatttgttgtgctgggttctttatatagttcatcttatttctcacaacaagtctatgagctggatagtattatatcactttgaagagagggatggaaaaatgagacttcagaaggtgagctagttgcctagcatcctatagcagtaaatgatggagttgagtacagtttgggcctctctaacctcagaattatgaaagtggcaataaccgtgccagcggttctgatgctgggaagttatttcagttggaagtacatctctgccaatggtagagggacccaaactgtgtttaatcacaggttcagtgaccatagtctgtagaataaacaactctctcatattcacttactctgatatttcaaacatatatggctgcttttatgg

SEQ ID NO: 189410 - DNA, 516 bp, Homo sapiens
taagaggtaaaaactatagaacctggtaattgattggctgtagaagattaaggccaaaagggagcatgtttgcaaggacagagagtttggacactttgaacggaagcaccttaggtaacatcagttctgccatgtaagttggtgcaatgttttctgttttagatgaagaaacatgtttagtcaggtaacttgtccaaagacaaacagctggaagatggcagagttaaagctggatttcatttaggtcttactcaaaaaactttgcacttttcccatgagtggctggtcctggcacctcagggcatgtccagaaccctcctagcatctgcagggctgaggatgcctaggcttctctctctaccaccgggacactcggatctgcctcctttaggcaaggttattgcaatggtaattgtggtttttgccattaaaagtaaagcaaaaactgcaattacttttgcaccaacctaataaaaccactgggctcagtgcttctatttgcatcgccatctctag

SEQ ID NO: 189411 - DNA, 495 bp, Homo sapiens
tcctgtcatgcagaggaaacagggcagagaccacggtactcccgcacggctggaaacaagcaaagaaacatttgagtattcgtaacacaggaaaagggccagatttggcttaaagctgctccccaagaagagtatctcagagtggacagacttcaggcatccagtttcactggttttcaactttggggatatttctgtttttttcccatatgttactcagttctcattttatctggaggtcgttttacttatctggagattgttttatctgaattgaaaagcaccttgggtttgtgaaacgtgaggcctctccaggtccacattgctagggtatgatgctgttgaagccagaagaatgggctgcttcagagagaaggagctccccatctctgtgggtgtttaaacagactggacacctgcttggcatgagagcttcttggaagagcagctttgaaagagaagcaggggaggaaggcaagaggtagtggggtcaaa

SEQ ID NO: 189412 - DNA, 339 bp, Homo sapiens
tgagtgtccccatatgaccagctgctgagggaagaagagatgcctcctttccctatgacccagatccctgtaacaaacctcatttcccataaggaaacctcagtgttctttgcagccaaaaggcaactaccaaatgcatatgaaaaggagatgaggtttcatactctctttcaacacagaaattcagatacttagtggacttaagtatggaaaaaaactacaggtagtaactggtcacacgggtctccatggtttctgtttatttcttgcaaaaaaaaggataaacttggccagctcacagcaacaaacatggaagtcaaaagaatgtgccttcagaaa

SEQ ID NO: 189413 - DNA, 623 bp, Homo sapiens
gtaattagcatgaggacctgttaagtgtataaacttgagccttgataaaattgtagtacccaaaaatgaataaagtatcccagaaataatgctttttcttttttcacattttatgaaacagtttaacactcagaatacagagttgacacacataaacttttcctttgtggtttcacgtgtttacatctttctgggtctgtctatttgcatgcctaccacaacttcccaggtgtctgtctttaagggacttcacacaattacttttttaattaatgttcttaaaactgtctttggctagagattcaaaatattttaagagtgatggaaactgatgttgagagagtaaagatttcaaaacaacttagcatgactaggtgtttccctctgtgactttgactaccaaatcattaactcctgtgataacaatgaacatttcacaacgtttaaaagttctcttattttactattggatttttataagtagttagaaatttatgcaagaaagtattgccactgtcttcatgaggaaactgaggcttgagaatcttgtgatttccttaaagtcatacagctggttagcggtagaattagaccttaaatcagtttattttcatggtcagttt

SEQ ID NO: 189414 - DNA, 483 bp, Homo sapiens
ggtaatttgcttttgtacagaagtggaacagagaatgaacaatggtatgacctacacggtataatgtggctttctttctggaaaatcagtaattaactcaaggaccaaattgtcttattctaagatgtttgtcttcaaaacaatcctcttcactattttcatctttttattgtggtaaatttgtacatgacagtattcaaagcattctcttacttcagcaaccattcgtttatgaagttcctgtacattgcctggttcactgagaacatgaagctgaatcagacagttccttcccttaaggaatccacattctggtagggaagatagagaagtaaacaaatgattacagtaggtacaaaaggtaccctggagtcctgaggaggactcacctctgctttagcacctgacagaggaaatgcctgaattgagtcttggagggtggtcagagattgctaggtgaagagatagcagcagaagcacaaa

SEQ ID NO: 189415 - DNA, 304 bp, Homo sapiens
tatctagatgttccccgcgcgcgtcatcttggggtatcgtcctactgcaggagaaccacttgaacctgggaggcagtggttgcggtgagccaagatggcaccactgcattccagccagggtgacagagggatactctgtctctaaataaataaataaataaataaataatattagtgcttatattacatattctctagaatttgattggtaagggttggcactaggctactagcctagccagaagcactgattcagtttcagtgtcaattattagccaaaatatatggtcctccctctccacca

SEQ ID NO: 189416 - DNA, 356 bp, Homo sapiens
tgattgcatttaacagaaggaagccgtttgagcattgcaggcatgttgtatttgcccttttcttgttgcctatatgtggaagaactgacagccatgaatcaggttttgggtccaagcagtaggtatataaagatgtagctgtctatatgcatatagtagaaatatgaaaatgtatacacaatgtaaaattacacttaaaatccttggccattctggaatatatgaaattccttaatatgcctttgttttggtttgtttggacctacgggccttacattagccatcccttttcctggtctcccttttctcccccaatccatttcctgctccttgcattcttactgtcctactcctca

SEQ ID NO: 189417 - DNA, 482 bp, Homo sapiens
agcgattctcctgcctcatgcctgctgagtagctgggattataggtgccaccaccacgcccagctaatttttgtatttttagtagaaatgggatttcaccatgttggccaggctggtctcaaactcctgacctcaggtgatccacccgccttggcctcccaaagtgctgggattacaggcatgagccaccgtgcctgacctctctattatcttaaagtctcgaatgattgttatcattactgccatttattgagtgcctactatgccccaggtgctggacaaagtgtttacatccatcatcttgtttatttgttacaagaattcagcaaggtaactaccatttgtgccaatatcctggaagaagaggcttagatggagtcattagtacagttttactggggagtaacacctgtgaaggggaaagagtggaagccatcagatcacgatgcagacctgacagagtccccaccaggccaatgggg

SEQ ID NO: 189418 - DNA, 132 bp, Homo sapiens
ttccatcattccagtcgtccagattccaacagaagaaatccacagaagaaccacggtgctgctgttgacgctcctctcctaatcagcagtggatctcgcactccaggtcattcttttcaaaacactgatgta

SEQ ID NO: 189419 - DNA, 475 bp, Homo sapiens
cccctgctgctccctcttcactctcaacgttacagaaaaggaaactgaagcttcaagcagtcaactgatttttctgaaagcaccatgagataagtgcagggccaaagcctcaacagttaagccaggtttccctctgattagctgtcacaagtgactacacagagaagtagactcggtatcactaccactgaaaaaaatgtaaactggtacattctgtcaacaatgatacagagatgccagtccctaatgagtagctagaaaataataagaggctgagtgccttggaggagactggaaagggatcctgtaggcctgtggagtcatgattcaaagatcgtaatatattccaaatgaaaaaggaagccactgaccagataagaaagggaatgagatcatcttacgtgcatcttttaaaattccttctggttgctgtgccaagaacagataaaagagtgacaaatgaagaagaggaact

SEQ ID NO: 189420 - DNA, 278 bp, Homo sapiens
tgtgtgcacaggtctgttagatgcacacaggtagtagagaaaaatgtgtataaattattcccatctgatataaaaaatatatatccatcccattcccatgtcttttttccttcaactgttgttagagggatgttgtttatctaattagggcccagctggcatactagaactactttctatttgtttagtccacctctctcaaatgatatgtgttttcttatgacaaactatggcacaaatcttcagctatgtggatccctcagccacttccttttctt

SEQ ID NO: 189421 - DNA, 234 bp, Homo sapiens
tttatttggggtttattagtctaaatagaaccaaggtaaacatatcaactttttcctcaaagtaataacagtacccatcctaacagatactcaatctccaattcactggttatcccctataatgtgtggtgtttttttttgtttttttttttttgtttttgagacagagtctcactgtcacccaggccggagtgccatggcatgatctcggctcacagcaacctccgcctccca

SEQ ID NO: 189422 - DNA, 396 bp, Homo sapiens
aggtttccccttctctcatcctgtccctgttcccgagtcattcctcctaggttaaggtttcccaagctctaccacttgacagtacccctctgtgcacattccagtttgtacaacacttggattagtattagcaatgtcttctctactgggtaagagtcttctgccgtcttggatgctcaattaaacagattagtttttctcattgctacagaccagctggtggtaaactatggctcacaggccaaatctagcccatggcctgctcttgtcctgcctgcaagctgaaactggttttttacatttttaaaggatggtaaacaacaataaagacaaagaacatgtgacagagaacatatgtggcctgcaacacctaaaaatatttactatctggccatt

SEQ ID NO: 189423 - DNA, 264 bp, Homo sapiens
tttcaagggctcaacaggcacacatggttagtggctactgtagtgaaaagcacagacctacgagcatgatgcaatagtgaaataaatcactatttcatcattctttagttatcttactgcagtggccaaaatattcctcatctttccaagaaggtataaaagacatctggagataaaatctttatacattttggggtttcttttttcacctattaaagagcacagttgaaaatccagaatttctgatttaacattcataaaggc

SEQ ID NO: 189424 - DNA, 183 bp, Homo sapiens
ctgcctcagcctcacaaagtgctgggattacaggcatgtgccaccgcacccagccttgggatcgatttttcattaaaaaaatctgtttttagactaaatgcctgcaatgatggtgttgccatttcctgagttaggaacattgcagaggaggtgggaggagaggaagaggtgggaggagaggaa

SEQ ID NO: 189425 - DNA, 236 bp, Homo sapiens
taccagatcagtctgtttttaagtgatctctgttgacatgggattagattcagaactttctttgatttcagtgagaaacaaccagggatggaacccttgaagagcatggaatcctctgtccttccggagggttgttgcaactgacttgtccccacccctagtagttctagagctaggttcctgaggcacatctgtatccttgaagaaacacttttatttttcttcttagattcaat

SEQ ID NO: 189426 - DNA, 304 bp, Homo sapiens
cccaaagtactgggattccaggcattagccaccaaacccaacctctgtttaaacatttataattaaagaagaatgtaaaagaaaaataacatcagaaatttttggtttttgaaaaaacatcatcatcccctggcgaacctaattatgaaaaaaagtgaaaatgcacaaatatacagagaatgtaagaattaggaagaccatttaaccacagataaagaagagagacaggtaatttagtagtatctgcatgcagtctcctcaactgaggatactgcaggtcacacatagaggccagaatagcact

SEQ ID NO: 189427 - DNA, 371 bp, Homo sapiens
gccattttacattcctatcatcaagagctaggctactcaaaagtaactgtatatatgagggaatgtagaagtcactgtgcgtgcccagggaatggtacaggctcataaaatagctcagaagaccttgagtttataccttgtgctgatctttactacagacaccctatgccaattttaaaaaagcaaaaaagaaaaccaaaccaaacctgatgagccctggggaatcagcatctgatctccagagttaccacattagaagattcaaacattcagttttcaacaacagtaaaatcataaggcatacaaagaaacaggaaaatatggcctactcaaagcaggaaaaagtaagtcaccagaaacttgctgagaaa

SEQ ID NO: 189428 - DNA, 345 bp, Homo sapiens
gctcatctgtaaagcagtaaaagctctgtccaacaagagcacactgattaacagacatccattcccctattaaggagtcaagataaagtccaaccgtgcaacagattttttttttactttaaacaacatgttgtccactgcttctccacctataaaatgaacatcatgactcctaactaaattggtaactcccaactgatgcctgccagatatataagtatgtatttcttgattccccaaatgaaaggtaagctccttgaaagaaagtgaggtttgtgtcaatcttttgccctaatacctggcactgtgatatgagtcactagattttttctttttttttttttt

SEQ ID NO: 189429 - DNA, 509 bp, Homo sapiens
gggcacagcagacactgaacaagttacttggtgactacagtgtcctcaactgcaaaaagtgtccaataatgaccaatagagtatttgcatcacctgctattttgattgccctcaagatttcaggcagcatcattttgatatggtatctttgtaagcaaacttaaattctctttggaacatgagtacgtgtaagcaaaatgatgtggtccaactaactttgaataaatagtgctgcaacatccaaagacacaatggattgagtaacctctaaatcaactgcccttataaatgaagatagtcagtgttaaacttaaaaaaaatctgaatgaatatgcatattatacttaagattgttctggttaatgtaaagaacaactgaggaaaagaatgaaactgaaaaaagaaaatgacatccaaacctttcttcagacagacaacctctgtgtcagttttcagggttcgtcatactgtttaatttcaaatctttatggagaggatatggggggaat

SEQ ID NO: 189430 - DNA, 717 bp, Homo sapiens
gttcttagtttcaaataactcatttattttgcagacatagaaattttgtcattctttatgaaagcaatgcggctgttctactgctacttcttggcaggcaatacctgcatagaaaccaatgagcatggctgaagtgaatgtcagacattctatttctgtctgcccacggtgcagcaaccactgacacacttggggcaacctgctttacccaaagtgcagcccgggatgaggccccacctcagcagaactttgatgcatgtctaatgactggcttggagaccttgttcttggaaactacagggctgacatttaagtatcacccatgaaatttgcctcaaggttcaacgctgacattagctaccaatttcggcttcataaccttggagtattctctttgctttctagagcattaaataccatcctacaaagcataaagccattattgacctgttattctgccaaaagacacatacactttgttgatgcccacaattttctttttcttcctctatggtaggtccagacctcttccgtttaggtagacaggcctccttttgtaggtaattgtctgcttccctgccatgttattggttgagtcatggctcatatccacctctctgcctttgcagtttttggtgtgtgtgtgtgtgtgtttttttttttttttattgttgttgttgacagagtctcgctctgtcatccaggctagaaagcagt

SEQ ID NO: 189431 - DNA, 906 bp, Homo sapiens
ctggcattgccctctgtcatcctaaggcgatggaccttgttgctatgtaagggaagtccttacccagaaggctgagaggaacagaatttccaaggacaaaacacttgccaagaagcccagcttcacaaatttcctctatttgtcaaccccttggtacatagttgctgctttgatgaggctgatttcagctgaaataccacagcagtgggaaaaggatataattctttccttgcattccagtgtgaggctgatgtaggcaaagaaacctgccaaagcatttagagacgcatgaagtcccctgttgtgtttaaggtctttttctccacttggacaggttggcagccactctccttctctcttgctcaatccttcctcctgcattccatcggagttcttgtttcccatccaaagagctcaattcctttctgagcaattcctgttttctagtcttccatctcttcctgttgtacagacaccagttcatcagaaagagtttcccagttaattttgatgtagcccagcgtcacctcttacagtgtctggctcagaaattaattcttccttaagtctaactcaatcccccatgttcctcccctgtttctaaactctcagcaggctccccattatctcctgaactaaattctgtctcctaagcccagccttagaggtcttcctccttctggtctccagggctagatgcactgtctcccctggctgatgcagcctcatgccggggtgtgtggccttggaaaggggaatttgacttgtacctactcacccccagggtcctttatcaggcacctgttggtcccagccagcctcttcaacctcatttcctatttttccttctacccttgcctggtggctggcccagtgccctactcaccatgtctctgaatggcatca

SEQ ID NO: 189432 - DNA, 839 bp, Homo sapiens
agctggccggtgaggatactcagcgagtcacccgcctcctcccaaagtgctgggattacaggcatgagccaccgcgcctggccttttctttctttattgatgggttatcaaaacatctgttgaacctcttgtcatagtttacccttgctacataacaatttagtgttttctaaccatattataaattctgtggtagaattaaacttattcaagtattctcagattgttgttgggctgtactttctctaatttgaaagatgctgggagtctgaatactaaaagtggcatgaccattcatattaaaataatttttaatattgacattattattgacacttcagttatttttatgaccaaaagtatataaagatcaaaagcataaatacataaaccacaacatcactaaagaataattcctattgagatatattgaaatttgtttttgtaattatcagcttctttggactacctattgaaatagtgactgaaacttaaaagtagttgctaaacaagtcaattatagataccttggtttttcacactgctttataataagttaactatagttactcagtcattagatatgttctctgttgactaaatggatgaatgtaatctttaattttggaaataattcaagttcttggctgtgtgtcacttctgttttttttcttttttaaatgtaactgctctttgccacctatatgtcttttaccatcctgtatatgaagaaagaattgtggctatttgcaatggtagcagcaatgtagtacaaattattttattttatttttttgagacagttttgctcttgttgcccaaggctgaagtgtcaacgt

SEQ ID NO: 189433 - DNA, 306 bp, Homo sapiens
ttttgttctttctgtacagattccagcatgcgcttcttaagtcctaaacaaatctctgaccaggctgctgtgaatgaagctttactcccacagtattatgaaagcaaacacaagcccagggtcaagtgcttcttttgttccaaaagttctttcccacgagttcaatcctgccattagcattgatttccatggctttaatctggggcctcctatctcagcttgttaaagaactgttcagctatgacttccttacaatattagggggaataacatgaaaagagaaaggtaaaaaaggcaaaaaaaaaa

SEQ ID NO: 189434 - DNA, 219 bp, Homo sapiens
gcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagg

SEQ ID NO: 189435 - DNA, 529 bp, Homo sapiens
gagtaaatgacaggatagatttggcccactggccacagtatgctgacccctggactaaaggatgaatgcacaacaatgcatacgtactttttaaataaaaagctaacataatattggaactgtaggtgaatcttcgatcattagagtactagaaccagtttgtatctattttcaacaggaagccgactaaatggaaaaagtctaaaagagcaatactttaaaaaaagtttatgtgtttttaatgggaaattgatcccatgcaattatgtcaaagagttgttatttttaacctagaaaagtaaaagctaaggggaatttttttttgtttgtttggaaaatgaagagtcttttaatagttcttctaaaatcttaggtttttgatattatgaggggagtgttgctgttatatacaagaagctattcagttgttcataccacaaatttgggagccatccttgtctccctccacccactgccccatcaccaaatgtggttaatgctggtagtgtttcaagcagatccctgttcc

SEQ ID NO: 189436 - DNA, 365 bp, Homo sapiens
gaacagatgttttatattcggaattcatacacggggcatctgagcacaaaatgaaaagggagcagatatctggaacttacactgattctgcacctttctaacggaagcaaagacgacacatggatttgcaagagcatcttcccagcagctgaaatgcaaccacaacactgcacttctgatcaccacaatgagaattttctcaaactggattatatccacagcaacccggctaccataactgcacttggtttcttcacctgacaaaattaaagcacttaaccactccagggtaggtgttacagagaaacttttaaaaactcaagtcaaaacaaagacaaaaccaggaattctcgattctggggcag

SEQ ID NO: 189437 - DNA, 1304 bp, Homo sapiens
atgactggctcttgagagccccaggcagggccccgagcaagtttttctaagtgccaaggccagcaaagtctgaactggccgcactcattaagtccctcatttggcaaaacaaaacagggcctggggcacccctggttcctggccttataggtcagtcaactggctgagaaatggtcaagaaaagaaacaatgacccttctgtggatgtgagtggatgatggactctggcctgtgtctactctcctgatgtgtagcccaccaacagtaatagaagtagagggtagggggttttgccaaggctaaggcttcaggtacttgctaacagttatagcagctgggtcactgtcatctggacttaccagttcatgccagtgtccctgtgacttatgcatagtgtgcgccacagccctctagaggtacctggagcccggactgccaggctggaggctctggggtactgaaggtgagctgtctgggcaaactattaagaacaagacgaactgttcacaatggagcttctcccacagatggggagctctgtgaggccttcacctgggtgcatgttggacttccattgctgttgctgttgtccctagacaagcccgttagcaagaagcaccggcaggggagccatgcactccataggcttgggatcacccccgggaaagcgatcttccccgggctaccacccccagctgcagttctgtgttagtgcatccttcaaagctaggagaattctagggtgaccagtgagctaatgttgagtgagcaggtattgacttgaacacactgcaggcctttggctgtctcatgctgtccttactcttcttgggaacagtgagtcactcagctggccggggtggggatgcatcctggtgaagagacagctttccctgaagatgctacagaaagttactgtcagatttcatttgtttctgtttcctgagatcaactaacagaagaatctaatggtgagagtgtcttcattcatgttttacgttttatcaaggcacactggaaagggaattatgtggctgacttcccttggccttcccaagagaagattctgttcttatgtcagtgtggcttctggaagtgtctcctatcctcccatcctccaggcctgtggtgtgacttctgccccgaagtcctactatagtgagtcatctggggagaggccactgaaaagaggccttcccttcccatttcctcccctgcctccttagaacacactctaagtcagaacttaatctaagaagaaggaagctggaccaggaaccttggaagtcagccagccctagaac

SEQ ID NO: 189438 - DNA, 604 bp, Homo sapiens
  misc_feature (59)..(59): n is a, c, g, or t
ataggatccccaagccaatacctgctcactcaacattagctcactggtcaccctagaanttttctaactttgaaggatgcactaacacactgcaggcctttggctgtctcatgctgtccttactcttcttgggaacagtgagtcactcagctggccggggtggggatgcatcctggtgaagagacagctttccctgaagatgctacagaaagttactgtcagatttcatttgtttctgtttcctgagatcaactaacagaagaatctaatggtgagagtgtcttcattcatgttttacgttttatcaaggcacactggaaagggaattatgtggctgacttcccttggccttcccaagagaagattctgttcttatgtcagtgtggcttctggaagtgtctcctatcctcccatcctccaggcctgtggtgtgacttctgccccgaagtcctactatagtgagtcatctggggagaggccactgaaaagaggccttcccttcccatttcctcccctgcctccttagaacacactctaagtcagaacttaatctaagaagaaggaagctggaccaggaaccttggaagtcagccagccctagaac

SEQ ID NO: 189439 - DNA, 136 bp, Homo sapiens
cgctgcaggtttgctgagggaaagagcactgcaaagatctcacatctggcaatcatttgtcaatagctggaaagagaactgcaggaaactttctggctcttggagaagatgaaaagacaaaaaccatgtgtcacac

SEQ ID NO: 189440 - DNA, 133 bp, Homo sapiens
ggcacacaggtcctatcttcctactctttctttttgaaggggcccaatttccagaaaggcagaggaaagcccaacctttcatcagaaacatttccaaagctttagggacaaatatgaacattccttactgtgc

SEQ ID NO: 189441 - DNA, 216 bp, Homo sapiens
acatttaggaagttatgaaaataaatcaggagaaagggactttgtgaaaaaggtgacagtagaaagggaaaggaaacaagttttcctagtcatgggaatcagtctatgtcactcatgtaataatcacatatggctgttatgagctattcctggggtatgaattttccaaactccattgggatgccttaaggaaaaaattctgccttacttacagtt

SEQ ID NO: 189442 - DNA, 1023 bp, Homo sapiens
cgctcaggctgccgatcggctcgttctctctgcgttgggaccgcggagggcattcgctgtgtgactcagggcaagtgtgcgcacctctctgagcctccgcggccttctctagcaaaatggtggagccggtacccggctgtaaggcaagctgggatgcgcggagtagcgggtggaaagctggactggagttctcactcggccgctgggtgacttcggtgcactagggatagtaacagtaccacctcgtagggttgtagaaagaccaagtgagttaatatttgtaaagtgtttagaacagcgtctactgcatggaaagtagtatttatttgttagagagactccaggaggtcttgcccagggattgacttctcccttccctgtctccaccccccacattcccgtttgtgagccaagccttgcttttgcaccggccgggctctcttgcctggaaatgcatacccatctcaaacctgggctttaaaatcacctcctctgggacgccttcctctacttctcacagttcaggcctgttctgccccacacagcagaaaatgcccacgatgcaataccagagtctgcatgggaccatttcaacaacccttagaagctgactcagctgtctcctggccctgacttttctaagatgagaggagctggtaggaacaatttgggaaccctcaaaggctgagagtatcccacccacttcacagatgaagcaaactgaggcccagagaagggaaattacttgcccaagatcacccagcaagtaagaaacagagctggagatgagctcaggccagcacggaaccacgcaaactccttctgtaggctttgtaaaggattgatgagaaaagcagatggttaagagctctacaacttctgtgaggtaaagaatatctgcagggctggacgtggcggctcttgcctgtaatcttagcactttgggaggccaaagtgggtggattgcttgagtctatgagttcaagaccagcctgggcaacatggtaaaactctgtctctcta

SEQ ID NO: 189443 - DNA, 1126 bp, Homo sapiens
cgctcaggctgccgatcggctcgttctctctgcgttgggaccgcggagggcattcgctgtgtgactcagggcaagtgtgcgcacctctctgagcctccgcggccttctctagcaaaatggtggagccggtacccggctgtaaggcaagctgggatgcgcggagtagcgggtggaaagctggactggagttctcactcggccgctgggtgacttcggtgcactagggatagtaacagtaccacctcgtagggttgtagaaagaccaagtgagttaatatttgtaaagtgtttagaacagcgtctactgcatggaaagtagtatttatttgttagagagactccaggaggtcttgcccagggattgacttctcccttccctgtctccaccccccacattcccgtttgtgagccaagccttgcttttgcaccggccgggctctcttgcctggaaatgcatacccatctcaaacctgggctttaaaatcacctcctctgggacgccttcctctacttctcacagttcaggcctgttctgccccacacagcagaaaatgcccacgatgcaataccagagtctgcatgggaccatttcaacaacccttagaagctgactcagctgtctcctggccctgacttttctaagatgagaggagctggtaggaacaatttgggaaccctcaaaggctgagagtatcccacccacttcacagatgaagcaaactgaggcccagagaagggaaattacttgcccaagatcacccagcaagtaagaaacagagctggagatgagctcaggccagcacggaaccacgcaaactccttctgtaggctttgtaaaggattgatgagaaaagcagatggttaagagctctacaacttctgtgagtttctccacgttggtcaggctggcctcgaactcccaccctcaggtgatccacctgccttggcctcctaaagttctgggattacaggcatgagccactgcacccaacctgaataatctattagagtctttatctctaagaagagaaatacatctgaactaaagggtaaaaaatggcatgttttaattggtaagtctaaatgcaaaacgatgacaataaaattttaaaggactgcttccttc

SEQ ID NO: 189444 - DNA, 189 bp, Homo sapiens
cggaataatcgctggttatcctttacacctacatcttagcagaattcaggaccctctcacaattctaaagggagattgtctttccaaaattacgaccatcagagaaatctgacaagactccaactgatcaagcaagactctgtttctatttttttttttactgtgaaatgaaaaaaggcaaaatgacag

SEQ ID NO: 189445 - DNA, 1287 bp, Homo sapiens
tgataagctacaacataaacacatctaggttcttgttcttagaatacagcatgaagaatttgctttcttctttcttcctaacattttcatgtgagatccagaaaggacacattgtctctggccattcgaagaaagaaagaaagaaagaaaaaaaaggtatttagagacagagagagaaaaaggctgaaatgggttcgctgggttctaaaaatccgcaaaccaaacaagcccaagttcttcttttgggacttgactcagctgggaagtctactctcctttataaattaaagcttgctaaggatattaccaccatccctacaataggtttcaatgtggaaatgatcgagttggaaaggaatctttcactcacagtctgggatgttggaggacaggaaaaaatgagaactgtttggggctgttactgtgagaacaccgatgggctggtgtatgttgtggacagtacagacaaacagcgactggaagagtctcagagacagtttgagcacattttgaagaatgaacacattaaaaatgtgcctgttgttctattagccaacaaacaagacatgcctggagctctgactgctgaggacatcaccagaatgttcaaagtgaagaagctttgcagtgaccggaactggtatgtgcaaccctgctgtgccctcacaggggaggggctggcccaggggttcaggaaattaactggatttgtgaagagccacatgaaatcaagaggagacactttggcgttcttcaagcagaactgaggctgcgaaaaatccaagtctctacagagacactgatgaagttgaaagggtaattgtttttccatgccaaatgaggaaatcaaattaatgagttgacaaacttttcctgagatgttatttcatctacatttagttaaacaacttagaatgatatctagaaaatatttattttcagccaggaactttagcaaactgtggcaatgatcactgggaatgaaaacgtataatgttctacaatttttgttatcacattggatgactttgaatatagtagtgacacttgggaccaaataaattattttatatgactactagaacaaagttttagtaagctgtctgctaatagagtcagaattcttccagattgtttccagctgtaacaggtattgaatttccaccgtgctcctatgtaacagctgggtggtgtaaaaaatgaacttcaaattatggagtggaagaagcgtaatgttaatatcttgtaaattcgtattccctattaaataaagctttcttattccct

SEQ ID NO: 189446 - DNA, 558 bp, Homo sapiens
actcttctttattggtcctttcaggtttagttcaagcttctaggaagctcgccctgttttctcttgcctataataatgtctccttttcttttcttatccctattccccctggattcctattagaaataataatggctaaaatttgttgggtacttatgagcccaggactagtatgcatatatctctcactgaattctaaaaaaaaaaaaatcctatgtctatcctccatcttacaagcaaggaagagactggtctgaaatcacagcaaggggctggggtggggagtgacctaacagtctccctccacaacctacagtagtaacaaaacttggcattgcctacctaccttggtccaagtccccacttaatcactaacttctatggtgtcaattatttcatgtgtactatttgaaagagtgagtcatctttcttgaaactgtttctgtctctctttttcttttctgagacagggtcttgctctgtcatccaggctgaagtacagtggcatgatcttggctcactgcagccccgttaccattcggatgttggagcggccgc

SEQ ID NO: 189447 - DNA, 400 bp, Homo sapiens
actcttctttattggtcctttcaggtttagttcaagcttctaggaagctcgccctgttttctcttgcctataataatgtctccttttcttttcttatccctattccccctggattcctattagaaataataatggctaaaatttgttgggtacttatgagcccaggactagtatgcatatatctctcactgaattctaaaaaaaaaaaaatcctatgtctatcctccatcttacaagcaaggaagagactggtctgaaatcacagcaaggggctggggtggggagtgacctaacagtctccctccacaacctacagtagtaacaaaacttggcattgcctacctaccttgcttgtaagatggaggatagacataggattttttttttttagaattcagtg

SEQ ID NO: 189448 - DNA, 548 bp, Homo sapiens
accagaagtcatcacttatagcacatcagaaaacacacagaaggcagaaatcctgtgaatctacaaatgtggagagccttttatcagaattcactaatctgagaaagtacagagagaagtccctgttagcatcttctgaaagtccagaaaccttttcttacttaacctactcagtttacattaaaaacagtgaaggggagaaactttgtaagtatgagaaatattttgcccagaaataaagggccatcttagtgagcagcagatatttgatatttgaaacatcttacgaatattttgaataagttgtaactttgaaaatgattcagttttggttatacatgagagattttagctcactggaaatgtcagtttggtaattgagactaaaaacttcctttagaaatattatactaaaattcttgtttctgatataccaaaattttattgaaaatattcagttacagacatactgtgtactaggaatctaacttcaaaaagcacaattaggtcgaatagtcataaatacaccaaatacaaatgcaaagtgt

SEQ ID NO: 189449 - DNA, 368 bp, Homo sapiens
tctgtgaacagaacctgacagtcagctaacagtatacggtcaaacattaggtttggggaaatgagacaaaggcatgtatcaattcctaacaaagcttcctaggatacagaaagacagagattaggtacaaattagacctacagggattcaaattcatgagcgctgcttagaaagctgcctgaaaggctgggcgtggtggcgcatgcctgtaatcccagcactttgggaagccgaagaggatggatcacccgaggtctggagtttgagaccagcctggccaacatggtgaaaccctgcctctactaaaaatacaaaaaattagccgggcatggtggcaggtgcctgtaatcccagctactcaggaggct

SEQ ID NO: 189450 - DNA, 550 bp, Homo sapiens
tggctgaagctgcagcagagggaaaattctagaaggaaagagagagagagattttcatgcttgaaagcattcatttgcaaggaattgagtgtgctggagaaaggggtttttggtggcaagagaatgagagacatctggagaacatgtagggaaaggagagagaaagaagatgcctcaatagcagagaaggctggaggcacctaggaagtaggatcataaggtatcatgtggaaggtaggaatggaaccaagatgtactaattaccactatgtgctaggcacgagctgttctcctgattatctcatttaatcctcacaatgtccggcacactgcctggcatatagtaggcactcaaaaatatgttgaatatttaatattaactaaaaaaaaaaaaatgtttaatattaaaaaaaaaaaagtgtgaacaatcctaagagatgtctattaccaattacatcttacagataagaacatgaggcccagaaaggttaggaaacttgcccaatatgtcacagctagggagaggtggaaggacaatgacttcaaagtt

SEQ ID NO: 189451 - DNA, 389 bp, Homo sapiens
ttgagaggcaaatactccctaccatacaaacattgggcctggccgtattaacttcctttggccaatgaaatataattgtaagttatttatatcatatcttaggagaaaattaagagcactgagtgtttcagcattttcaattttccctctgacctaagacaaagatagggctgttcttcagcctggaacactgagtaagacacatttaacagtgccccaaaaccacagacaacttgtagctaacatgggagctagaaacacatctttactgtaggaaggcactacaatttgagggttgttacagcagccttacttcggaaaagctagtccagaaactggtaataggagtacgttattgccataacaaacatgtaacatatgtgacacct

SEQ ID NO: 189452 - DNA, 312 bp, Homo sapiens
gggtgattagcggatctttagaggcacaaggaggacacctggggatctggggtgcagattgggtccagggggttataacagagaagagagaatttaacagggagagcagaggaggcgcatagatgggagaagaggcagaaatctatggagattgaggacgatctaaagatttgggagaaggaccaacaagaggttaaataagttgcaagggtggagcccagctaatttttgtatttctagtagagatagggtttcaccatgttggccaggttggtctcaaactcctgacctcaggtaatccacccacctcca

SEQ ID NO: 189453 - DNA, 349 bp, Homo sapiens
cttccaaattcctaaatgtgacattttaaatgctttattatttgcttccctccccagcttcccttctcagaatttcagtactctatgtagttatagcttagccgttggtagcctccaagatcctccccttgctctgtgctgctcctactctacagcttaaatgctgttgactccaatagggtccccaccctggctacccaagtgtcatgcttgtgtatattcccacctctgaacatcaccatcacctgaatgtcccacaggcactatcaacatatttaaaattgaacctggtgacttaagccaaagaaatctgatagctatccttgtcctgatgtttttatttcctaaa

SEQ ID NO: 189454 - DNA, 376 bp, Homo sapiens
ctttatgccagcagtgcaaaagttacacaaagtagcagcctccaaaaactattgtttacttaaatgaacaaaaaatgaaatggaaaacataagtaaaacattattaagtacaatgaattaatacttaaaatctgtctatgggatttaaaattgatttagccccttaggaaaactgtttgacagaatctatgatccagcaattccttccctgtatacaccccacaaaaataaatgtgcacacaaaaagtattgcaaggttatttacagcagcattatttataatagtcagaaaattgaaaaatccaagtgcttatctccagtggaagggacaataaattgtggcacatccatacaatgcccttatactgaaccgaga

SEQ ID NO: 189455 - DNA, 200 bp, Homo sapiens
acatacacttcccaatttggcaaaactacattattaagacaagttctaatctagtcaatttcagcattgctataaatagtggttcttacactctgtttttgtgaatctagtaatagctacacatctttccaaagaaatatacatcaggtgtcagcacacaagattttgtatagaatttcagaggcttcatggtccctccc

SEQ ID NO: 189456 - DNA, 234 bp, Homo sapiens
atagaacagatgcaaagctcaaggattccagaggaggcgtggagggaatgacaattagaggtggctttgaagaggaggactatttgacttgggctttgaagaatgcagaggagttttctgtgaggagaggggattcagggtcatgaagaaaagcacggaggtaggaaagggcatggtgggcttagccccacaagcacctcctgattaggtaccatcatgaaccatggctccact

SEQ ID NO: 189457 - DNA, 329 bp, Homo sapiens
tggtttctaggataccagattgctggtttttctacctacttggcttcatagtctcttttttggttcttccttattacacctacctcttaatattggactgcctcgtgggatctctgttgttgttgttgttgttgttgttgttttgtgagacagagtttcactcttgttgcccaggctggagtgcaatggcgtgatctcggcttaccgcaacctctgctgcccgggttcaagcaattctcctgcctcagcctcctcagtatctgggattacaggcatgcgccaccacgcccagctaattttttgtattttttagtagagacggggtttct

SEQ ID NO: 189458 - DNA, 192 bp, Homo sapiens
ttttatagtaccttacaaggcatgtcaaagggcaaaattcttttacttgtcttagttttttgtttgtttgtttttgtttgtttttttaatgactgtggaacattcttaatctctgcaacacaaattgcatttttctctgctcatctttgtatttgtgtgtgtgtgcacatgtgctcaggaaaggaataaact

SEQ ID NO: 189459 - DNA, 733 bp, Homo sapiens
aaacttttttcttttcagttcgaaacccagaaggacagataaagctttattccaaaggagcagatactattctgtttgaaaaacttcatccttccaatgaagtccttttgtctttgacgtcagaccacctcagtgaatttgcaggggaaggccttcggaccttggccatcgcatacagagacctggatgacaagtactttaaagagtggcataagatgcttgaagatgcgaatgctgccacagaagagagggatgaacgaatagctgggctatatgaagaaattgaaagagatttgatgctactaggtgccactgctgtagaagataagttacaggagggtgttattgaaacagttacaagtttatcactagccaatattaagatctgggtcctaacaggagacaaacaagaaactgccatcaacatcggttatgcctgcaacatgctgactgacgacatgaatgatgtgtttgtgatagcagggaataatgctgtggaagtgagagaagaactcaggaaagcaaaacaaaatttgtttggacaaaacagaaatttttccaatggccatgtagtttgtgaaaaaaagcagcagctggagttggagtctagttgtagaagaaaccataacaggagagtatgccttaatcataaatggccacagtgttggctcatgccctagaaagtgatgtcagagaatgatctcctagactagctgcatgtgtaagacgtaaa

SEQ ID NO: 189460 - DNA, 573 bp, Homo sapiens
aaacttttttcttttcagttcgaaacccagaaggacagataaagctttattccaaaggagcagatactattctgtttgaaaaacttcatccttccaatgaagtccttttgtctttgacgtcagaccacctcagtgaatttgcaggggaaggccttcggaccttggccatcgcatacagagacctggatgacaagtactttaaagagtggcataagatgcttgaagatgcgaatgctgccacagaagagagggatgaacgaatagctgggctatatgaagaaattgaaagagatttgatggtatgagtttagaagcatgatggtttgtgtttacaggaaagatagtatgtgtttagagatttagcacaggaataagccattggctaagtcatcttgcacacagcagatgtttctctttcaatcactgaatcatgctttatatgttggctttgagttttccatgtatggtcctagagagcctagaattgtatttctattagcagtagcttatgcaattggaagcttcccaagagtagaagatagtaggctacctattctttgtcaacctctgatg

SEQ ID NO: 189461 - DNA, 275 bp, Homo sapiens
ttttatgcccagccttgttcccttatttgagtgagttggaggtttgtgcaagattttatccaagtggaggtttttccatctgtgtagccacgggcatgtctccaggcacaacgccacgtgctagttcccttactggttcctgcagcctgatttccccccaccccaggctgctttctattttacgtggggataaggctctgaccttgggccgggggctctccaggggctcttcccttgctgtctacctaaggcaagctaactcctttcgtcccccg

SEQ ID NO: 189462 - DNA, 436 bp, Homo sapiens
  misc_feature (50)..(50): n is a, c, g, or t
  misc_feature (323)..(324): n is a, c, g, or t
tcagtaactatttgctgcatacataggaaatccctcacaagattataagntaacttgaaaacaaggatcatcttctcactcatcaatgtagcccacactctacctaaaagaatacattattgaccaggcgcagtggctcaagcctgtaatcccagcactttgggacgccaatgcaggcagatcacctgaggtcaggagttcgagaccagcctggccaacatggtaaaaccctgtctctaataaaaatacaaaaactaggccaggtgcggtggctcatgcctgtaatcccagcactttgcgaggccaaggtgggtggatcacannaggtcaggagttcgagaccagtctggacaacacagtaaaatcccgtctctactaaaaatacaaaaaagaaattagctgggtgtggtggcgtgctcctgtagttcctgctact

SEQ ID NO: 189463 - DNA, 215 bp, Homo sapiens
accctatctctacaaacaataaaaattatctgggtgtggtggcatatatttgtagtactagatacttgagagactgaagaaggaggaccccttgagcccaggagtttaaggctgcagtgagctatggttgtgtcactgcactccaaacagaggaaggtcctgtctctaataacaataataaaaatagaactattcaaatcaagaaatatcaagtg

SEQ ID NO: 189464 - DNA, 554 bp, Homo sapiens
tcaccttcatggtgttccataaatgataggtaagatacgggcacttttttaaaaaatgacatttggacataagtatcagatatttggcttatgacacagtaatgggtatcttaagcctagaagttgtgttttagattgaagaatcatacatgattctctttggctgtatttatccataaattgtcctgtccttggataggacatctagacacttgtgaagtggtcattagtaaattgagtgtgaaacatggcattttggagaataaattgtgaagcaacctccctgaaaacttattagtaggataggacattcatgttagcgagtggacctagggtgttgggcagagtcagggagaccaggtgacttttagcacagtgcttttctaccttgtttcggtctagatggaacagggttatcagtgtccagaaaaaaagtctttggcttccggttaatctgtccgccccagccattgaagagagtggggtacttatttatgcaatatcaccctaggccttttctagtgtttgtatatcatctctctgcaagtttcttc

SEQ ID NO: 189465 - DNA, 530 bp, Homo sapiens
gagtcttcacctctcttgcagggatgcttgtcagtgttgccaacttgctgagaactgaatgtggcagatgcctttgcacgggcagccccaggtttagttcaactaaacccagatggtttagttcaggagaaaagggtcctggctgagcagtgagggcccagggctggcttggtgtcctggcctcatacttggcatctggcccacactgccccgtgtctgctgcagaatgagagaaatgccattttctgctccctcagtgtcagctgttaagttacctgctcagctctgcctggtgtctgtctgtcccaagcctcagtttctttagtgtccctaaagaaggtttagatctgagagccacgtgtttgtcttgaccactaataggtataatctgtgaagttaatgggcaaatggcaccaatccttgggaatcttatttttgaattaaaagctataattgcttcttcagttcagctgagccttgagctgagccacaagaacggcttcgtcgtgtgtgcatctgtgagcccctcg

SEQ ID NO: 189466 - DNA, 749 bp, Homo sapiens
aagctggcttttctacccaccagctgtatgacactgggaaagtaacttaaactttctatgtctcagttaccttgtctataaaatggggtaataatagcatctacctcatagggtacaggaaggattaaatgagctaccatatgtcaagtttgaagagcagagcttagcacgtagatagtgctgcataaacattgggctgtttcccccatgttctctcttttgcttctgctgctttggaagccatagatcttttagcagcttcttgcactaggctcagctcaggtcccccatctgacagcaagcacttttagcttctggcgcttctcagcagccagcctctggccatagtctgaactcagaccctacaagcaatgcaatcccctaccttttgcttttggccctgttctgtttctggtactttgtttttgagcccatctgtgccctattacttttctcagctcatatttttttctgtccctgctgtatgtttggaagagaacaaataagtcgactggctgtgctgtctcgatctcaagccttgctaagttatttcattggtcacacagagatgttacctgtcctgttaggcatttctggagattatgttgtgagataaaggttcaaagcagtgtgaattggctttagccagaattaggaacacagcagaaaacttgtcctagaaaccagagagagcctgtcagtcttggtggattcacaaagccttcccgcagcaggcttgttaaaaaggc

SEQ ID NO: 189467 - DNA, 735 bp, Homo sapiens
caaattgttgggtacagtatacactgctcaggtgatgtgtgcaccaaaatctcagaaaccaccacttattcatgtaaccaagtaccacctgttgcccaaaaacctatcgaaatgaaaattaaaatttaaaaaaaaagaattcataaaaaaaaaaggttaagactgagtttttatgttatatgtcttttactacaattaggattttatgacatggaaatatctctaagacattctttagtgaaaaaacaagctacagagcattctgtagagtataatctcgtttacagatatatataaaaaaagtagaatgtaacacacatatgctgacctcaaagagaaggtctagaaagataaataccaaaacggtaagtgacaatctttactaagaaaagtaagataagccctaaacaatgaaatggaagccttagtttttattttgtatagttctatatcatttgaaatttttataccaagcctatattcctgtgttatctgtgtaaatatatatttaaaccaagaacagataggacaaaaagaggaaaaaacagcaagatgacatttaaacataaccaataaatgtaaatggattgaggcaggagtaagcaaactacagcccacagcctgtttattaagcatgtgacctaagaaggctttttatacttttaaaaagttgtaactaggctgggcgcagtggctcacacctgtaatcccatcactttgggaggctgagaaggc

SEQ ID NO: 189468 - DNA, 322 bp, Homo sapiens
tctccgctattgccattccacccacaggctggatagtgccgaagttacacttctgaggagtcagcatcctgacgcagcctaaactttacactcactccctgctctccagaatgcacacgtctgcctgtgcaaaaacgacaagcagagtcaggtgacctcagctaacaggaatgtgggcagggctgcggctgaatgccagagctacttttattaaattccttgttaagtaaattcaaaaggggtttgtttgtagctggcagtaaatacctaagacaagatctctggaatttctaccttttttttttttttaatttaaaaactg

SEQ ID NO: 189469 - DNA, 352 bp, Homo sapiens
tatccaggtatgaagctaaacatattacgtgagttatatcacttaatgtatgtagtaaggagaagaaaatcctggggtggtagcttcctttgctctgagtcatttggtaggtaacatattgaaactacttctgttagcaagttttcattatttactggcaccacaccttccttgctcatagtttctctgactgtacatccttgaacgagcatgaaataacccaataagtcttcgtgttgctgagtagttttcatacactatctagggtgttatgcagagcgtgtttagtggggtcagataaagatcagaggtccaagactggggcttcctatagtgagaaggggagttagga

SEQ ID NO: 189470 - DNA, 227 bp, Homo sapiens
tcctaaaatcacaaggtttgaactttgaagcacatctgacccagtttttcagatatggaataatggtcatgcatttccgttactgtgactcagttaatttgtgtctgttaggaggcaaatataaaactgctcaaagtagcaaaatttccaatggggaaaataagtcctcaaatgagtgacacttcagaaaaagaagtacaactttggtactctagtgtgaaatctaa

SEQ ID NO: 189471 - DNA, 332 bp, Homo sapiens
atctttattattgccttttagatgtctacaggattagtgtgtcgctcaccctgtagctgcattcttcctagctaagcaatcccaaacaccttgagcctgttacctattaggccaatttaaaaaatttctcttgttgcctttgttgttgggtggggtatttttggacttgctccagtttctcctattcatttttcttttaaattttaattaatgtatagtatactggaaaggttattatctggttctcaagtaaagtctcagttactatagccaagaactgggttggctttttttttttttttttttggggcaatgtgtccatttccctgtcg

SEQ ID NO: 189472 - DNA, 306 bp, Homo sapiens
gccttgagccctcctcaaatccccttctccctggctgctttcttgagttactggacatctgacagcaacaagccccactcctgtaacttcctgccgccccaacaaaattgggacccaaagtagtggcttggattagttttgtcctggcaagagttaacttccaaggtccacccattactatcatttcacgaaggagagatttagaagctaaagtgtaacttaattgctcagacagcagcgctcttttaatggtgcatgttaaaatggaggagaaaatgaaatgtaaaataattcagcctgataatg

SEQ ID NO: 189473 - DNA, 558 bp, Homo sapiens
cagaatctgcatctcccaggttctttctggccctacagagtcatgatgagattaatgagtaattttctccttaattcctcatataaagtattataaaggttttgtaaacttatcttggttttaggagggtttaattctagaatggagtgaaagtaaatgtcagtaatataaaaacaaagtatacaatacaataagtatacgtttaattgtatcctttttcttgttaaaaacttttcagttacttcctaaattgattaaattgaggcttgcaaacataatactgtttcttgtatttacatatttttgttgttgttgttcccaagatcgctttgaactaccgtcaacattttcaattggggcagaatctcaggttcaaataagtagctagtctgttgtaacatcagggcagcaattcagatttctggattctgaattcatttttttctgggtcacagtacactgcctttaggatgtgtctttttaaacttctttttcctctaaattataaaatcagttcataccttttggggaaattgcggaacaagtttacagttcctg

SEQ ID NO: 189474 - DNA, 255 bp, Homo sapiens
acaatggtgggacacatttgagagggaaatctgaattgcaattagttgaggaatgagtggaatgtgagaaagtggacacatgttcaatagctatggctgtgatgagaagacagcagatggttcctcaaagaggaattaggatgaagtcaaaggtgggaggtgtgtttttgttttagagtgaaatataggacatagttaactactgacccaggataattacacagaggggtaaagatgttggtggagaagagggag

SEQ ID NO: 189475 - DNA, 340 bp, Homo sapiens
gttcctctaccagatcacgcagtacgtatcataggctcgtgactgtctcgtggtttgaaaatcgtcgactggtgaacccccgggtggggatttcggggcgcggaggggcagggcctggccccctcgcacccagcctgggacttacccggagacacagaaacggcgtctcattgcaggaccctcatcgcaggcgagactccccaaacctgcggtcgttagcttcaaatctgcttgacacaaacctcacagcccttaaaacttcagaacgagatgtgggtggctttttaatgtttttatttttagaattttttttttttggttgggtaagaactgtttagaa

SEQ ID NO: 189476 - DNA, 400 bp, Homo sapiens
ctcctaaagtgctgggattacaggccgtaagccactgtgctcagcccctggctcctttttaagccctcctctcctgactcacttttgccagcatgatctcagatggttaaatgatgaggctggggtgtgtaatagaaaaaagtgtacttggaggctctgaagctgtagccactgttctaagcatttcatccacatctggtaatttactctccgatcaacactatgaggcatggacaattatcaggcctggttattctatgtttaatttatttatttagagatggattctcgctgtcacccaggctggagtgcagttgtgccatcttggctcactgcaatctctgtcgcccgaattcaagccattctcatgcctcagcctcccgagtagctgggactacag

SEQ ID NO: 189477 - DNA, 211 bp, Homo sapiens
tccttctctgtctttcactgtcctcctctgtccatcactgtcctccactgtccatcactgtcctccactgtccatcgctgtcctccgctgtccatcactgtcctccgctgtccatcactgtccattactgtccatcactgtcctccgctgtccatcactgtcctccactgtccatcgctgtcctccactgtcctccactgtcatccgctgt

SEQ ID NO: 189478 - DNA, 202 bp, Homo sapiens
aaaacaaaaccaccgagttggaagctgagccaaggtccaatgggggaaacaacgaacggaaattgagggcccttcaccctgtttgcatcctggaactgggagagctggagagagagaaaccctggctgtttgggaatcaacaactccgaaggagagaaagactcatggactgagctgcagcacagccgactgtcaaggagac

SEQ ID NO: 189479 - DNA, 517 bp, Homo sapiens
ttctgaagttttagtcacaaagtagcttttaaaataacaatgtttcttaagtcttaaatgcctttcttaccaattataatgacaaatcaattatgagatcagcctctgagttcaagagattaatattcatatttctcataaggtacagacactgcttttgttcatttgataagaattttaccagagacctactggtaaattttaccagagaccactggtaaaaaaacttactcagataatccagaggtaaattacaggattaagttacaaacgtaactgtggtagggagctgaacaaaaaaaaaattaacaaaggattcaattatcatagttctgattattccccttgacaatatggttttagatgctaaacgtaagtattaccatagtaaacagcagcatacacattctccatctttgcctcacaccaaacaagataaaacttccatgttaaccacatagaatggagaaaaagaatgtcaaatagttgtccatagtctgtgtttataataatgttc

SEQ ID NO: 189480 - DNA, 455 bp, Homo sapiens
tccctgaacttgaactacaattaggacctgtgtataatccctttgcagcctgtcttacagttagaggtaacttaggtatagaacacaactgtatgtgttggtgtcaggtgtactagtggtgagttttgtgtggaaatagtgttgcaaatggtaactagaggaaatgtaagtgatgtggcagggtcctgtgtatctgtctctgtttcttttaagatttgggaagaggaatgtgggagtatgtttttgtcgataaaagaaacatgaagagacataggaaaaataataaaaaagaagagtaatacatcgaaatgaaaattttccagaccacattagtgtgcatacatgagctgcacagagctgcttaagattagaatactgcccttcacatcaccttgaccttcctgccgcaggctgtccatgcacagtgactactcttggtaggagattcttaatga

SEQ ID NO: 189481 - DNA, 663 bp, Homo sapiens
tctcataggagactgaaaaccaagaatatacctaatggtaacaggcagtagaccaaagatcatggactgtggctctctcccagggcaagctctttagtctccctgatcctgaatttcctcatctataaaatggggatcatcaagcctatctggaagggttgcactagagatgcaggtgaaatcgtggatgtatgatgcctgccactcagtagatgctagttcttctttctcttgctgatttagcaacaggcttccttttaggccccacagagatctctcctttgttctcttaagtctaatatgtttagatctattgctgacacctgatgaaatttgccaagtgtcttgaagtggctacagtgccaaaaggcttgttcttggcagataccatatttcagtttctcagatctcctctggcaagagttctgcagacattctctaatcggagtttgggggctacttaaatgattagtcccactgaaggtagacctctgctttgaaaacagccctctgttgtccaggaagggcttgtgcatgcctttataagaggtcatgtaaagcatggttgggacagaagttgtattgggttcacttgtgtgtcctggctcctaaagcaaagggattatccttgccaaaggagaaatatttggaataaaataccat

SEQ ID NO: 189482 - DNA, 336 bp, Homo sapiens
tactaaatggctgtacctagatgtatgttacctaaatggctgttacctaaatggctgttacctaaatggctgtacctaaatggctgttacctaaatggctgttacctaaatggctgttacctaaatggctgttacctaaatggctgtatggctgttcgaggttggggagtctgggtagagaaaaacgttaaagtgtacagtttggtgacattaattacattcacagtgttgtacaattatcaccatcattttgaaaacttttttattaccacagatagaaactctttaagcagtaacttcccaacccccccaaaggccccgcagaaaaaaaaaagg

SEQ ID NO: 189483 - DNA, 402 bp, Homo sapiens
attttagaagtatgattttatagtgggccctccataagtgtgagttcctcatctgtagcttcaagcaaccatagattgaaaatatttaaggccgttcacagtggctcatgcctgtaatcctagcactttgggaggctgaggcaggtgaattgcttgagcccaggagtttgacaccaacctagacaacatagagaaaccccatcttctacaaaaaaaatacaaaaaattagctaggcatggtggtgtgcacctgtagtcccaagctaggagagatacagagcaagaccttctcaagaaagagagaaagagagaaagagggaaagagggaaagagagagggagggagggagagaggaaggaaggaaggaaggaaggaaggaaggaaggaaggaaggaaggaagg

SEQ ID NO: 189484 - DNA, 140 bp, Homo sapiens
cactgcacccggccgttatttgtcttaattttctaaaaaaaagaataagtaacgagaaatttttttattttttgctctttcatgtctgaaaatgtcatttctctactttcagaattaatttaatgtttggctagatatgg

SEQ ID NO: 189485 - DNA, 108 bp, Homo sapiens
ctctcaacattttacacaacaagattatgctccacatgatatacaaatatctgttgccaagccagagaaaatggatggcaaaatgaccaaaatcctattagttccctt

SEQ ID NO: 189486 - DNA, 456 bp, Homo sapiens
gacaaaatgtatttctttactctgatgtctttgaaagtatatatggaatcccttcagagtggatataataagaggtatattaaaatttatttgaccatacaaatattttcatgaaacatccattagaaactagtggtatcttaggagtcaatgtaataaagttttgggaataatattttatagcccaagtgatatttttggagacaactacgtaagtaaaatcgattaccttttaccctcataaaagagatgtaaagagaaattagactagtaaatacatatactttcactctgtagtacagagtgaatgtaaaatacagtaaaatgttaagattgtcatctacttttttaaaaaaaatatcaacttggaattgttttttaaaggctcaatcaaggaagtgaggtgtgcaataaggtagcaagtaaaacgcagtttgcgttttatgtcatggtaga

SEQ ID NO: 189487 - DNA, 273 bp, Homo sapiens
actggacctcattatggatttacttttgggatacactcatcattccagaggagggtaaaaggctgagaagcttaaggtatttcagtctgttttatgttactcatttgcgaaaagcaggctcatcgaatacaggtgagtttcaacgcttcttgaatatggcagcatttaaaagtcttcagaccgcatggtggctcatgcctgtcatcccagcactttgggaggccaaggtgggaggattgcttgaggccaggagttcgagaccagcctgttcag

SEQ ID NO: 189488 - DNA, 729 bp, Homo sapiens
aaatagaatatgatagggctaacttctttgaaaatgtaaatattaatattactcaaaacaggttattctagggctagactttagtaattcatttccattttggacaaatgttttactttgtcttaaatccatttgaggttcttgttgtgcataagtggttggttggatttttagggttcctgagaggaaagggttgaggaatataaaattcacatttgtacttttggtagtggtataggaaataaacctttagagaaagggggaattctttgtcaaatagcaattggaatataaatatgattataaacatattggtggaaaaatcatctttcttataagtggaattaagagcatattgttggatggtatgacagaagcaaactcctcccacagaatagtagaggcttatgaataggcaggggtagtcataaaaggaaacaatatcttagtttaaggcatttaattgcaaaaggagaacacaagtgtggaatacactaaagacctctgattcccagtgttcttaaatagcaaaagaaactctagaactttgcctctaaggtattacaagaactttgtcaagttgcacatgagaaaatagagcccatagccatatagtaagcaaaaaaattctgtttgagtattgacatgacagtttttgaaagttcaagcagaaaaccaattataatgagcactggaaagcccggagccctgctgttcaataaataaaaa

SEQ ID NO: 189489 - DNA, 245 bp, Homo sapiens
tgagacacattaccatgggtgatttatggagtttcctctttagatcagaaatacttcccaaaccacctcccacttggtgcttcggcacttacagtaaatgaagtcaagactgaaaatacacacaactccttccttactttgacatttctttttttttctttttttttttgagacaagagtctcgctccgtcacccaggctggagtgcaatggcacgatctcggctcactgcaacctccgcctccc

SEQ ID NO: 189490 - DNA, 168 bp, Homo sapiens
aatgccagtgatcttctccagggcttcagcttccctgaaagacagctactcagggcctattattaaatgtttaaggtatcattttttaactttgaaataaaaactgaaatatttggaaaatactgataaacgaacaaacaaaaaaacctgaactaactccctaaacga

SEQ ID NO: 189491 - DNA, 256 bp, Homo sapiens
attgtttcaatctcttgctactttttgtagtgattattttcttaaaaaatgggtcactgtataaatgcctatgtcatgagaattgaaactattctacattgtagatggcagttagcttttttgaattcatttccctctctaaatcataatattatctgctgtaatgttgtttttcccactttgctttttaagaattttcatgccttcacaaatttttgaaagttaaccctttcttgaccacatatcctagcaggtt

SEQ ID NO: 189492 - DNA, 129 bp, Homo sapiens
ggtgactggaatacaggatgggtaagttttgaaggaaaaaacaggacagttctggagcacaaagtacaatgtggccaccagagggtagtatttattcaacaaggatttcttgaacttcatactttacca

SEQ ID NO: 189493 - DNA, 655 bp, Homo sapiens
taggagatatacctaatgtaaatgacgagttaatgggtgcagcacaccaacatggcacatgtatacatatgtaacaaacctgcacgttgtgcacatgtaccctagaaaaagtataataaaaaaacaaacaaacaaacaaacaaagtaactgaagttggattttgcttttggtgtttgatttgattggagggtagctgttttgctggcacctcaagcagtgcctgatctaaaaagtgaacctcaaaaaggggatgcacgagatgatccacggggatgcacaaaaaaataggaatgtgtttctttacagtgtaatatttgtataccatacataccattattctactctccatttttatcaataaattagtatccatatattgagaggtcaaactcagccttttttcattgacatggctccaacaatcaaaaacaaactgaagacccagtggcagtctgaagcgtggaatggaaggcttgcaaaaaactgcaggaaggattgggaaaaagtgatgaaaccacaccaacgccctgcctgtcctagttattcacgttctcagtttagaaagaataattgtaaaaggagaatgatgatatttttctgaactccagttgaatgtgagaaaggggaagtgaacatgttcaatacaaggttcac

SEQ ID NO: 189494 - DNA, 161 bp, Homo sapiens
cccacaatcacatttcccagagtaatgagtatttcctttttgtccttccagatatgcatgttgggaacatattacataaactggtttgtaatatgttttgaaacttaatatgaatatgttttagctatcttttcatgagagaacatgcatgtctaagtgta

SEQ ID NO: 189495 - DNA, 303 bp, Homo sapiens
ctcagtgataagagatttagctcaagctgggaacaaggaccacaaagaagccagccagtatctgggttaacaaaaaaaagagtaagtgaacagaatagatcttgaaggtcatttgctattggttaggacttgggtggggccttcaatcttatgaacctgagcagggaaggtttggaaagactgtagtgctatttaataattattcctttgtttggacaaaaaaatggggtagaaacgggagagaatgggggaaaagctataagccatttcctccttttatgccagctttcctgaacttagttt

SEQ ID NO: 189496 - DNA, 164 bp, Homo sapiens
tccaatctatataatcccagatgagcaacataaagtccctacatttaataactacgaacccattaacaagacccaagtctgccaagattattaaactgaagtcacagacaagacttgtttgcatactgctggaatgtccccagtatgttgggtttctggtttgt

SEQ ID NO: 189497 - DNA, 101 bp, Homo sapiens
atctcctagtctacacaagcaatgagtcatttagaccattatctcttacatctttattctgcattaattacctgatcattttaaatgaaggctgttgttgt

SEQ ID NO: 189498 - DNA, 242 bp, Homo sapiens
catttaatcctcatacaatacttcaaggtgggtgctatgatactcaggctctttggagattacaaaatttcccaagctcatgaaattaaacatgaggagggaaaaaagcaagaatctaggaccatctcaatctcacactccagggtcagggcatccctagaggtgtatagaaacagttgttgcccagcttgggcaacattgtgaaatcccatctctactaaaaatacaaaaaattagctgag

SEQ ID NO: 189499 - DNA, 165 bp, Homo sapiens
agaggtaactgctgttaatagtctggtgactttgcagacgcgtttctgtgcttttacgtgcgtgtctatgcaactggaaaacgtatagtttttgtaatctaatcgcttttttaaaaaatcatgctgcgcgagtatttggctgatttgtcgttgtcactcgctgta

SEQ ID NO: 189500 - DNA, 343 bp, Homo sapiens
gagcagatggggaagaaaggcagcattggcattggaaaccacatgggtgtaaaattaacagggctccgtgcttgccagatggggcgggtgaaggaggggtccggaatgaacaggaggtttggagcttgtgtctgggtgagcgtgggactgggggtgggggtggaaagggaggaggctggagcaagatgctgagttaagtccagagtgtgtgtgggatggagagggagcttggataggaagcctggggactcgagggtctgcagctcagggctggaaagtcgaaggcgggtgtcagcagcagtctgtggcggggggaactgagctataggagaaagagtgggtg

SEQ ID NO: 189501 - DNA, 154 bp, Homo sapiens
tatactattaatatctatttatctatctacctctagatccatgaatttttaatttttattcaatgaactataatacattactatcataatttattttgattctcaacttattccatatttggccagtggaaccacttcagactggctctgtgtc

SEQ ID NO: 189502 - DNA, 170 bp, Homo sapiens
atgggcctaccataaccaaagggtccattttctggtctccctctcaccctgggacacttccctgtgtccttgtccatcaagcccccttaggcttcctgaataatattcttctccatagaaaccttctcctgacagctacaaagacttatttgcactgggagcctcttcta

SEQ ID NO: 189503 - DNA, 605 bp, Homo sapiens
tttattgaacacaaaacctgaaattgaggttaaggctgaaaggtccagtcctatacacctcagcatctaattttttccatggccaatggttaagatgatcaaggtctgatgtatataaaaatagcagtgtgtatagcaggatgaaaattagttcataagttaatgtaataaacatccattaagtgcttactacacacgaggtactgccctgtggtcatcagagaaataagttgcagcctttcccttgaggagtctacttaagacgacacctaatggcagaacagcaagacaaatgcaataatggaggtgctgagagacactatatgggaaggagtggctaattctgcttgaggaaatagggcgtgacatcaccagcaagggacaattaagtcaggtcctaaaagtgtgagcaggatttttgacacctaaaaaaggagggacatttcagaaagaagaaactgaatgtgaaaaaaattaaaacccgtaagtataaacagggttggtgagtctgggggttatgagaaattctgcaagggacaggaagggctgggagatgaggccaaagaggtaactgagtccaggttataagaaactctaaatgtcat

SEQ ID NO: 189504 - DNA, 597 bp, Homo sapiens
ctaaatgttacacatgaacccacgtatgtatgtggatgtggatggggtgttataccatgacttcctaaaacctagcttcaggcgtggttagctcttctattaaggtgcagtgaggctttttcaaaggacatgaaaccatcaaactactggaaaggaggactacacggaggggtcaaaccaagaacttgattttctcacttgtaatcttggagattatttaagggaatgcctagaaacacaattagcgtaaaattcacctagaatcagcattcattgcggtggatgaatcactggcttcagaatcacccacaaagctgattgatagttcagatttggggcccccaccttaggcccaccgaattggaatctctgggaggaggctaaaaactgcattttccagaaactctaggtaatttccatgctcctaacattgagaattgtcgccttcataatggtgtttgtcactacacaggtgttgtaaacctctctaaatggtttcttcagcattcaagtttgacatgacaaaatgtgcatgcatgcagtattcaattactgtttagcactgtaccctctgagaggaggagatcctggggtacg

SEQ ID NO: 189505 - DNA, 342 bp, Homo sapiens
agttacaagatctgaagctgctgtttgagatgcacagcaggactctggtgggtgactcaggagaaggaaggcagaaggcagaatccccgccctagcgaagattcgaatccagcacgcgcacatggcagtcgaagaagagagtgtagacagtgggcaaacttaagggactgtcgtatggggtgaacgaaattcttaagtgccaaggaatgcaaaaactggccctgggaagagtcaggaatgaggtggtttctgccagaggtgaggtctaagtggagttttcaagaaggctgtgggtgtggcgggcagagttctagggtccttggggtgctgctggcaggacga

SEQ ID NO: 189506 - DNA, 262 bp, Homo sapiens
caagaatggttctgcccagaaagccagttgcaggggccctggatgtttcctttaacaagtttattcccttatcagagcctgctccacttcccccaatacccaatgaacagcagttagccagactgacggattatgtggctttccttgaagactgacttatcactctgagttcaagattcatcttcagaatcctgtatactgacaaatatagaaatgtaaagtttgtattttcaatttattggatggcttaagcacctcagca

SEQ ID NO: 189507 - DNA, 375 bp, Homo sapiens
tagaggttgcagtgagccaagatcacgttactgcactccagcctgggtgacacagtgagacgtcatctcaaaaaaaaaacaaaaaagaaagaaagaaagaaaaagaaaaatattaaatgatgatgtaggtgatatatagatatggggaaattgaaaaggtagtagggaaatgattgttaccgagaaactactgtagagaatcagggaacttctgggaaatgtggtctcggtaagaaaaaaaaagaaaagaaaaacggtggactagtggcagtttttaacaagtgaatgacatggtcagatctatcttccagatggacagctactgacagcagaggacacacaatctctgacattcactctgtacctgcaccctct

SEQ ID NO: 189508 - DNA, 688 bp, Homo sapiens
ctcttgaaccctgcctcctggaagcaccagctgctgcgtaagatcatccaccaccaggtgagggcccctcctccagcgtgcaggtggccagtaaggcaaagcgaggcagagttcctgcagccaaaaccaaatccgcctccgccttggttctggaaccatgggtgccctagccagcaagtgccatttcttgactggcatccagggggaactctgagtctctgtccattaatttattagttcatcccttcatttagtcaactaactcatttcttcctaccactaactgagcacctacggtaccaggtatggtgctaagtgctgggaacaccacagtaagcaaagcaagcatggcccctgccctcagggagcctgcagtctggaggagaggacagccctacaaggagtgatcaaatgaatccagatgtcatcgtagttgtgataagctatggaaaggggaagtgcagacaggatagcagcgagagggggctgctggggagagggggctgcccagaccacacctttctgagaactgggaattttaactgggacaccgaaggtggccagatgaaacacagaggggctttctaggcagagaacagcacctgtgatgaccctgaggtgaagaggtggttggaggcagcagaggcacagggacaccggggagaggggctgtaaagagaagcatttg

SEQ ID NO: 189509 - DNA, 314 bp, Homo sapiens
ttccggcttctgtgcatccacctcctggttcacccagcatgagaccttgaagacaccctcatccattcctgtgtgtccccagtcataccaaccccatgacacaggggaaagacttggtttgaatcccacctctactgtttaagacctggtgaccttgaacaagttactgacctttctgaacctctgttccatcattcgtacagctagactaagaccacaacacagggcttgttttaaataataaatgcagccaggtgctgtggctcacgcctgtaatcccagcactgtggcaggccgaggtgggtggatcacat

SEQ ID NO: 189510 - DNA, 320 bp, Homo sapiens
aactcttgggttcaagtgatcctcctgccttggcctcccgaagtgctgggattacaagtgtgagccactgcgcctgatctctctgagggcagatcctgaatatggtagtatactgattctgtttatttgtaagctagtgattgctttccacttctacgttgtagctctctttccaaggaattgcttttctaagtttttacggcctcgacttgccaaaaggatctgggaagtatttggtacttcagagctttttgtcaactctatctttcagaccaccaaagatgtggttccccagtgcagctcaaggttctagcacctaa

SEQ ID NO: 189511 - DNA, 578 bp, Homo sapiens
ccacctggccctttccagaaaaaagttagctaaccagtgttctagatgctcttttatcctttgctttttaaatttcatatatcctggaaattattccataccggttcacagagacattctttattcttttctccagctgcatagcacggccgtctatgtggatgcatcacggcttattcgaccaccctcctatacatgtgcattcgggttattgccgatagtttgcacgtacagccaacgctgtgaaaaataataatgtggtattacagatcttttttaaacttcccccatacaatttctcataaatatccagaaagaaaactagttttcatttgctacacaaaaactgattcaaagcagattttgaataattttttcattgttgtttctttaagcttttattttgcctcctggttaaaacctcaaaaatgagggcaggatcaggaagagaaatgtaacgtgggccatgcataggctctcctggtacgttgtagccttgtgaggcctctgggggaatggccatgcacagatgacaggcgaggtgtcatttatacccaattccagtagtaaagagagtc

SEQ ID NO: 189512 - DNA, 474 bp, Homo sapiens
agtagagatggggtttcgccatgctggccaggatggtctcaatctcttgacctcgtaatccacccgccttggcctcccaaggtgctgggattgcaggtgtgagccaccgcacctggcctattttcttttaatgagaacctcagccaggcgcggtggctcagccctgttgtcccggccctttgggaggccgaggcgggaggatcacttgaggccaggagttcacaaccatcctggacaacatagtgagacctccgtctctgttaaaaaaaaaaaaaaaagaggggacctcattaaaggtatacagcaaatgaaactatgatatgatatattttggctttgtaaatcaatgttttcacatactggttttgttagatttatttttccatcagtgaaaacattttttgaacacaaattccttttccaattaaacaatttgtaagtaaagtttattcaaatgtatgttaaaacatttaa

SEQ ID NO: 189513 - DNA, 682 bp, Homo sapiens
tgctgtccttgctcaggatgagctgagccattgtggaagaactgcacagaaacactgctaatggtgacaaagacatacaccgagttcccatgacactaaaaactcagcacttctccaacctgattgcttttacattgtttgagttccacctcctctagtaggtaaccaacaaaccaccacagaggcagagttaaacaggctgagtcactcacatcagcactctcctctttcattccatctgaaaaggtgagcacttcctttggtgagggaggggaaagtaagaaatcacaagaataaatttaaagaggtatggaagcttaaaaaaataatttcgtgtatattacttggagttaggttatcctgcttaatccactgcttgccttaacgtatctgtgatcactgttattttattgtttcactaatatagtatacttcttgagacactggttttaaagacattatgttactgtccttaaatttctcagaagtgtttttacctcctagctggttgagggaaatgtttatcctatggaaattgcatatgcccactgcagaaaaaattgagtttcataaccctagattaaaaccttagccttggccgagtgcagtggctcacgcctgtaaccccagcactttgggtagccgagcggggaggaacacttgaggtcaggagttcaagacc

SEQ ID NO: 189514 - DNA, 636 bp, Homo sapiens
gatagataaagactgagaaaagaaatggtcaaagtcttcaagagctcaaattacatggataaaataaagaattcttcatcaaattctagaagatcttagttttaggaactgagcttttagatggcaataagcttatgaaattcattctttaaaattccaaaatcaaaaccctgcaaagaatgaaataagtcttctactctgatattctagccaatgtagggtgtgctctgtatggggatccttgagagatatcacacagaaacaaggcactcactgcactctgtgagcaatacgaatgacttttcttagtttaaaccactaaatgttggggtgatttgttactcagtaatacacaactggaatactctttgttctaaaaataaccccaaaacatagaaaacagaaatgagaactcaatctttgatgaagttagcattaataaatgaggacaggacaaacagaagaaaagattatacctgagagcgtacaggtgagggatatgtaagagaagcaaaatactttgccccacaaaactccaaaagagctcttcagcagaactgccagaagaggctggcataggtctgaaaacaaggagaatgcaaaagactcccaggtcccatccctactcagcacagc

SEQ ID NO: 189515 - DNA, 365 bp, Homo sapiens
  misc_feature (354)..(354): n is a, c, g, or t
cgactttatgacacaggtaatatctattatcatttgacaaataagaaaaccagggcacaaagaggttaagcagcttgctcatagttacacagatagcagatgactatttcaaaaagggaaatttatagcttccctcatgtaagatgagggaatgtgagcttctgaatgtgatgagcaaacgaaagaaaatgaaggaggcaaagtacaaagagagttgaatgaaaggactgaattgaaagaaatgctttctccttcacaattttctctaatcttatttggctgactgtggtgctcaaaaaaatgacaataaacaggtaagagaattataatcttacctgtttattgtcatttttngagcaccacag

SEQ ID NO: 189516 - DNA, 585 bp, Homo sapiens
aaggctgccttccagggtaaagtttatgattttcccataaatcacatataagcacttagcaaaaaatatttaaaactctcataagttttggtcctaaattcttttctcttgctgttactacaaaaatgacagagacaaaaaatttattatttataacggcttggaatctaattccaaatgagttgcttccgtagattcacgtaatactgcagaactaaatatgcaagattcccgattccaaatggaggccaaattccatccacacaggagacagaggaaccctcagcagtctctccttgaagtaatttttttttttttttttggaaacggagtctggctctgtcgccaggccagagtgcaggggtgtaatctgggctcactgcaacctccaccaccgaggttcaagcgatcccctgcctcagcctcccgagtagctgggactacaggcacgtgccctcatgcccggttaatttttggtccgttggtttggttttggtattttaagtagaggtgggatttcaccatgttggtcaggctggtctagactttgttccaggcaccaggtagctagcttgtaaattaatt

SEQ ID NO: 189517 - DNA, 409 bp, Homo sapiens
ggatttgttgtggaccctgttacatctagtggttgggtttgcagtgctttccctgactgttggccagaccagcctcttgtcctgcagagatgcccctccttccagatgtgtctggtactttcttatagtgttgtttcagcttagtcccctgtcccctgagcttcttttaaatgagaagttctactgaaaggcccagttgattcaagttaaacattttgggctagaatatatatgatgttctatgcttcttgtgtcacttcagggaccccagtcatattttgttgcttcaatacaatagatggcagtctggtctttgtgtgcattatgttctttctgtggactggaatgcaatgcatttaacacctgttgatgatcctggtcctagatggtagttttatttgggggcttg

SEQ ID NO: 189518 - DNA, 122 bp, Homo sapiens
ataaccagattgaaatctaaaaaatagaagggatgataattttagtagaaaatatccaaaaaactaaaattattaggacaaatcagttccaacaatttacacacaaaggtttttctaacaga

SEQ ID NO: 189519 - DNA, 479 bp, Homo sapiens
gcaaactcctactcattcttcaaggcccaacctgactgcacttcccctatgaaaccttcacagaagcccccaaatttaacagatcccactacttctgctcccgaaatgtaacagcattctatgtgtacttctatgcaacaatttccaaacttcattatatcaaccataatccatgcttcttgtcctcaccaggccatgaataactcaagggaaaaaactgaagttggtttaatctctatatccctaggctgagctggtacacacctggtaattagccaaggttcactgactaaggcagcctgggttagcagaaaaaacacaggacctgaaaggatcctgaagaatcagccagttttatttttataaaataaacacctttattttatgggaacctggaacctatagggttatgcaatttacctaagatcactaaatgaaagagtgataaaaacattactagcttctgattattctcttga

SEQ ID NO: 189520 - DNA, 438 bp, Homo sapiens
cttactgtcaagtcgtgacgggagtaagattatattctgcaatgctactcatgaatttggaaattggcagaggtctcaagatatctttcttacattattgcttgctttaaaacacaatcttatagaatttttgtacaaaatgaaaaaaaatctctccagtgaagccaacagtgtttattattgggtgtaggcacagaaagcctttgcaaggtatgagactccaagaaccaagacaatttttaggagctctgaccttgatatttaagatgtaaggtctctactgactcaacaaggcatagaggaagcatttccgaatttaaagcagactatgttctatttctggaaaaaagttatgctgattgctgcattgctaaaagaggatttgtcatcaactgaaagatctagccaaatagttggacccgtcacgacttgagtata

SEQ ID NO: 189521 - DNA, 445 bp, Homo sapiens
ttattatttttttttgcatctccactgataaactgacaatgcaattatccagtctttgatacaacttgtgtgcgaaaccatctgagcatggcaggaatttttggagtatcttttccatttttattaagtttattttggcagggtgggaatagaacaatgaacttttaactactgattcaaattgtttaatgagcagtcttaaaactactcacattgcttgtttctttgaagaaacagttttgggttttcttgaaacttgtacaacttgtttttgaattgttaacaaagctgtcataggtttatcttaccttaatttcaaaaaagtattattttttctttgatacagagtctagctctgctgcctaggctggagtggaatggtgcgatcacagctcactgatgcctcacttcccaggttcaagctatcctcccaccttagccttct

SEQ ID NO: 189522 - DNA, 404 bp, Homo sapiens
cttaactattttttatttttttgagatagggtcttgccttgtcacccaggctggagtgcagtggcatgatctcggctcactgcaacctcctgctgggctcaagcgattctcctgcctcagcctcccaggtagctgggactacgggagcataccaccacacccagctaatgtttgtatttttgtagagatggggtttcactatgttgtccaggctggtctcaaactcctgggctcaagtgatccgcctgcctcggcctcccaaagtgctgggattacaggcgtgagccacggtgcctggccccctgcttaactttaaaagtacaggctaataaacattaaggaagagaatgtccagatgagtacaaataatgcaaggtaatcagtgccctattaagagttgccca

SEQ ID NO: 189523 - DNA, 221 bp, Homo sapiens
agggttcagaattaaagaagttctcaaggttatactggaaaaaactccttcccaacctattcactcatttcccttccccgaaagaatctgatattaattatttcttccagatccttccagagatattttatgcaagtagaaacaaatgtgtatttatatattcaaagtcctcttgtttctatttttacaaaaaagacagcgtattatacacactgttctgt

SEQ ID NO: 189524 - DNA, 385 bp, Homo sapiens
agcaaaagaaatttaacaattttgaaaaggaaaaacatggcaaaaaaagaagaaaataatggattcaccatttctctctcaactggactatatcaaaaatcacatatatttttactactagattgaattactacattgcaatatgaggctacctaaaaagacaactcagaaattcaaaagtttgactctttaatggtgtaaactacaaattataccaaaccacttaagaactcttgatagactacctattatttgcaagcacactgggaggtacaagttactctaagccactaactactgtttatgaagttctatgtggtctgatctgagctcaagcgtattgcaaattcacttaatctatgaaccattatggaaagtgtgatca

SEQ ID NO: 189525 - DNA, 348 bp, Homo sapiens
caaaaaaactcagcctaccattaaattctgtaactttatatctttacgtatatttctgcaatttgccaagaaaaagcatttgagcatcctggaagggaactctgactgacacgcgggacaactgcaggagcggagtctccaaggggaatgagcagctccctcctgcacgcctgctgagccacggggtctgcgatggggatgtgatcaggggctgcccagagcctggatatgagctgtcctcagagtcacactttaaaacgcatgtcggggcaggcagggcagctctcaggccttaaaccaaactgcaatcgaagagacagcatcggcccgtcctgacacaccctgctt

SEQ ID NO: 189526 - DNA, 99 bp, Homo sapiens
atttacatataatgcattttatttatattttggtatatattcctggctaattcagtttatattcagtaggtgggttacaaactgctgtttgtttttaga

SEQ ID NO: 189527 - DNA, 501 bp, Homo sapiens
tggtccctgcagggtggggggccaggaaagcccacggtttccttccagcccaggcccactgaccccacagcactgagccaagggtgtggtcccagtctgagtccaaaagtctaagaactgggagcattgacatctgaggacaaggaaagatggatgtcccagctcaagaggaaagagagctcgctcttcctctgcctatgttcaatccaggacctcgacagacatgttgatgcccacaggcaggggcgaggcaggtcatctttactcagtctacagagtaaaatgctaatctctctgggaaacgccctgaaacaccccagaaatcatgttttacccgtgatctgggcattagccagtcaaatggacacataaaatttactaccaccggatgtcttccaccacctctacctcgtcaaaccaaattccagttcaagccataccttaaaccaaaggtgagagtaaggagtgatttagttatattctgtgaaaacaagcataggc

SEQ ID NO: 189528 - DNA, 573 bp, Homo sapiens
caggtgaaataaacagccttgttgctcacacaaagcctgtttaagtggtctcttcacagggacgccagtgaaaacggttaaagaccttggctcaaacttaagcctaatatgtttccactgagggttagacagagaagtgatgtgactgcatttcattttaaaagattacactgactgctgtggagaacagatcagtggtcaggagtggggaaggcaagagtatgaagtacgggaactaaaaataatccaggccgattgaaaattcaagaataatgtggctggagggtgataagatacgaggttatagagatgaattggaggtggggcatcatagagtatattgtaatgatatgggaagatgtctaccctatgatccaacaatgtacacaggacattcatttcttctacatcctccaagtatttctttgtttacaaggccagccatttgactacatttaatgcctcctgtccatcaaatcaatttgtccaaacaaccaattttttaaaagctagagtctaaaaagaatacctttgataaatgtcatgatatatccaatgccaagtgagttagtt

SEQ ID NO: 189529 - DNA, 510 bp, Homo sapiens
tttgtctcctccaggagtaatttctcatttgcttggttttcatttgttgaattaatgggttgagtgttgtaaggacattgtgtagtgattgtgttcttcttgacttttaaatttggcccaaaggcatgatttgtctcccttattctctaattttcaagttacatgtttaaaaatggaacctggagacatccaaaagattttctttttatattattctgtctctctttcctttataggggatgagagatgctgtggttaagaataggatccaatctaagtcacaaaaaagtggcctattataaaacttctgaaaaatttccacaatgaccattaagggggcagatggttctctgtctactgaaaaatgctgtgctaaaaggtcacatttcttaggcacccagagggctctaggaatggtttggaagttagagaatgaacaaatgtggtggagagtgctgattctgctctgcaagataatgttacgtgcttcccccattgtattcagtggtc

SEQ ID NO: 189530 - DNA, 386 bp, Homo sapiens
ataaaggtgctataatccttcatacaaccctctgagaactgctttttccgaaaagagcagtaagagcacaaaggcttacagagtttaagaaacctgttgtaaataatggaacttataagcaccgacgctgtagtctaggcctcgtgcctgtgactacagtgctttttccattacaccatgctgccttccagaagagtccccaaggagttacatttttctcccactgggagacaaggcagtaactaacttggcagaacagaaagaaatgagtgactgttttgtgtctctgccaagcaagtattcatgccctttgcaatatgacgtggacacaaaaccaactgatctttagcagctaagcattctagaatttgctgaagaattttctc

SEQ ID NO: 189531 - DNA, 219 bp, Homo sapiens
tcctacctttgacaaatgcaaacaaaagatagtgtgtgtcttagcaaattgtgtacatgtataggggttagaacaagacatactttacagttgtaaattgcagattagagatagataagataaccttcttgaatgtatcctttttgttctataattgcatttggctataatgtagaatagaaatgtataatgttctgtttatttgcatgaggaaaaaaa

SEQ ID NO: 189532 - DNA, 703 bp, Homo sapiens
ctcattttgttcagctttccaaggaatgtatatatggaagtcatcatcgatccacgcacagtgtttgtccctgcaaatgaggaaaatcagagcgctctgggaaagaactgcttacatgcagaagggatccaacaacttccaaagaagcctttgccatttgtgtccaggggtttcctggtatccctgcggctcacacaagataacaattgtccctcaccaacatgggcctgccttccatgccaatgctacctgggaggtgtagaggaaacacaagcgtgcttcagaaaggcagacaggtacacaggtgacaagggccatgtcatccagccccctgcgatacatctggaatctggctgtctggcttcaactatttatggacacagaaatgcacgtacatagggatgcacgtctgggttcagggtgcccttatagtgcatcatctcgctaaagagcactaatgttgagcatccctctcaacacccttgcttccacacctgcaatgcagctcacaatagcctcggggccatgcaatcctactgggaagactttgatctacaccgggatcaggataagccagagtctcattgcctatcagactcagcttggagtggcagcctatgtgttcatgccacatgcatgtgctcacaatgcatgggacacaacatgggcacgctggcctgaaagctatgcctgctgaccacaa

SEQ ID NO: 189533 - DNA, 387 bp, Homo sapiens
ccgtgagccaccatgcccggcaaatgatctgatattttattacattatagcagctttccaagaatttggtaaactacaaacctgtggactaattgtagttaattcctatacacactgaaaagtaatttgcagcatttttctcattttgagtagggctgaaactctgctgtaggcctacatataatcagcccattctccagaagggcagggctcttatttcaaaatattgccttgttccaaggcttcctctgtctcggaagttctttatttgaagtgcgttaggtatttactgtgtcgaaggctttcccacactgattatcatctcaaggcttcatcaaaccaatggatctttacactggcattcatactgtctttctaaaataagtt

SEQ ID NO: 189534 - DNA, 319 bp, Homo sapiens
tactagaagctgattacctatcccggggaggtaggtgaggtaaattaagaacatagatttggggagaattcaaaggattagcaggggagcaatacttgggctctaactctagggaataatgctgatacacaaggtaagatttctgtctgaaccacaaaaacaaaaaaatctgatcatcagtctgaaatcaatctctttaagaggttttaaagattcttccagaaatttgactaagttttcattttacaagagacacctgttctctgaagcctctccgggatacagctccccgggatacaggggttaccggagctcgaaa

SEQ ID NO: 189535 - DNA, 375 bp, Homo sapiens
taaaatactctcaggtaaacaaaaactgagatagttcatttttactggacctaccctgcaagaaatgctgaaggaaatccttccggttaaaatgaaagaaccttagacagaactcaaacctgtaaataaataatgatctctgataaagataagtacatggacaactgtaaaagctagtcttactgtaattttggtttctaactatgctttttgttttccacgtgattttattttatttatttatttttgagacagagtctccctctgtcgcccaagctggagtacagtggcacaatctggactcactacaacccctgcctcccaggttcaagcaattcacttgcctcggcctcccaagtagcggggattacaggc

SEQ ID NO: 189536 - DNA, 606 bp, Homo sapiens
aggaggtatacaaaatataaaccaaactataaccagtgggacatgactagcctgaggaagcacagcggtaaggagctagaatatacacttaccacacttggactttctactgtttttttgttttgttttgttcgagacggagtctcactctgtcaccaggctggtctcgaactcttgacttcatgatccacccatcttggcctcctaaagtgctgggattacaggcgtgagccactgtgcccggccctataatttttaaataaaaaaattagctgggcatggtggcacatgcctgtagtcgtagttacttgggacgctggaacaggaggatcgcttggcctagcagttcaaggttggggtgagctacagtttcattgcactctagcgagggtgatagagtgaaaccctatctcgatatatttaaaaaatataaatataatgaaattaaggtatgtacattgctttcacttaatagactgcagtatagagtaaatataacttttatttgcactgggaaaccaaaaaatttgtgtcactcactttattgcaatattctcttcattgtggtgatctggaaccaaacctgtgatatctctgaggtatgcc

SEQ ID NO: 189537 - DNA, 594 bp, Homo sapiens
tccatatggttggacgaggagagatgtggtttctccatgttagcccagctagtctctaactcctgacctcaagtgatccacccaccttggcctcccaaagtgctgggattacaggcgtgagccacctcgctcaagcacccttaggttttaaagtttaaccttggggtgtttaaattttgcagttagatttgctaggtagtcctgggtattttgggaagttcttgttttggcagcatgtcagactttatccttgatgcttgggcctttcaggtttgagcctgctctgctggctcggaactagtttagtcggaaggggctggcagttgcctgtagggggtagattcatctggtgtgtattatgctgatggggttttttggttgtttactcatttggaagatttcagtatggaccagactgtttgtgtagagtgggaattgagtaggttggagtcggcatgattctgagaccgaaatagtaattatggcttcgtttgtcctgaaggattctgtcgtgcacttcagttgtctcagcctcttcagagttgaacgtgatgtggttgtcatcgtccaaccatatggtaccgagctcacttt

SEQ ID NO: 189538 - DNA, 706 bp, Homo sapiens
ggtagtcagaaggctttttggaaggctttgaagggtgggtagacttgtgaaggacataaggcatgccaaggtggcctaagaaagagtatcagccaggcaaggtggctcacacctataatcgtagcactttggaagacagatcacgagcccaggagttcaagatcagcctgggcaacatggcgaaaccctgtttctacaaaaaatacaaaaattaaccaggcatgatggtgcatgcctgttgtctcagttactcaggaggctgagttgggaggatcacctgagcccaggaaggtcaaggctgcagtgagccatgatcatgccactgcactccagcctgggcagtagagtgagactctgtctcaaagaaaaagaaagagtaggctgggcgtggtggctcacgcctgtaatcccagcactttgggcggctgaggtgggtggatcatgaggtcaggagatcgagaccatcctggctaacacggtgaaacttcatctctactaaaaatacaaaaaattagctgggcgtggtggtgggcacctgtagtcccagctactcaggaagctgaggcaagagaatggcatgaacgcagggggggtggggcagagcttgcagtgagccaagattgcgccactgcactccagcctgggtgacagagtgagactccgtctcaaaaaaaaaaaaaaaacagtatcaaggtgagaccagcca

SEQ ID NO: 189539 - DNA, 199 bp, Homo sapiens
gtcctaataagcctgggagcacaacaggagtccggggcttatttcatcccttatctacaactgtaaaagacagccgtccccagagcagccattttagaggcctacccctaggagcgcattctctttctcagggttgttccttgctgagaaaaagaattcagcaatatttctcctattttcttttgaaagaagagaaata

SEQ ID NO: 189540 - DNA, 209 bp, Homo sapiens
aagttccacctgttgagcagtattgtgcatgaagagatgctgctcaactgcggcatgcccaggaagccgtatgttacgatcctggtgggatggtccttcacagtcatccttcacagtcatcaggtgagcagacatcaaactcagaacagccagggattgagaagatgagcaacagtgggactcctcacacaatactggctcagacaggt

SEQ ID NO: 189541 - DNA, 216 bp, Homo sapiens
gctcatttgagcattcacatgttcattcagccagagcttaatttaggaccaatcctttctctaaaggaaatgtaagcaatcctaagctagtaactaagctggttgttatagtctcattttacattccaattctaatgtctttctttatttcttatgaccaaacctttttctagtagttcattttcagtatcccgtctgatttactaccatatcttt

SEQ ID NO: 189542 - DNA, 441 bp, Homo sapiens
atgaacattcacccatgctgctacctgtctactcacgtttgacttttttatagcttcagaattctgtcattcattcaaatttcctgatggctgctggcaacagttgggcagagaaagagctttgaattgaaatttgaactaggatgcaaacctaggtcttctacctctaaactggccacagaaccctggataaaatgatagcccctctggtccttggtttccttctatgtaaaatgaaataggtgtgtctcccatggtgcccttcagcacggacatcttctgattctggtacccttgctttgttagcaaacatcagagtggtctttttaggggaaggaccctgggagagggtccctgactgcagggtaaagagactggttttcttgtgtgcttgtcttcttctaactattcccagcccccgtactcctggacaggctggca

SEQ ID NO: 189543 - DNA, 221 bp, Homo sapiens
caggaggctgaggcagaagggtctcttgagcccaggagttcaaggctgtagtgagtcatgatcatgccattgcactccagcctgagtgacagagtgacatcctgtctccaaagggggagaaaatggagagaagggtgtggaaaggggctgatgggaaggggagccctcaggagctggcactttagcttagaccaggatgctgagaagaggctggtcctgcc

SEQ ID NO: 189544 - DNA, 824 bp, Homo sapiens
gtgatgggaaactggatatggttgcatgcatctgtagtcccagctactgaggaggctgaggtgggaggatttcttgagtcaggtagttcaaggctatagtgcactatgataacaccactgaatagccactacacttcagcctgggaaacataacaagaccccatctcggggaaaaaaatgatggggtgtcatttctgtggttcaatttgaaaagactgtgacctcctcttgctattattctctcactctcgccttctcagcttgcaagcatggatgcagcaagctgccatgtgtgcaaggcccacaggcaaggaactgaaagtggcctctactaacaaggaatcaaggctctcactcaaacactctatgaatccaatcaacaaccacataagtgagcttcaaatcagatcttttcccagttgagccttcttaagagaccatacggctggcctacaccttgattatagccttgtgagagaccatgaagcagagaaccctgctagtttatgccaggattttgaaccacagaaactgagataataaatgtgtgctattttatgccaccaaactttgggtaaattgttacaaggtatagacaactgatacagctgtttttgcatgacaacactagagttgattattgttacagggaccatatgattcataaagaataatatatttactatctggctttttacagaaaaagttctgtgtgagaatgcaagcaaggaggctggcaggtatagtcttccatgactcagaaaggagggaagaaccagctccacgagcactagtaactagatgagctacatgagcactagaca

SEQ ID NO: 189545 - DNA, 356 bp, Homo sapiens
aatttacaagactatagtcatgaatgaaatgggatatatgaagctcctagcatgtcacctggcacaaatagtgtccttcaaatattaggtcctttcctcttcccacaaggaacttttagactgaaagttaatcttgggaatgagaacaaaagagaaagagtaaatgaagctcaggggaagttgagtggtcagaagaaggaaaagctcatgtctactcagcataaatgtggtatttaggacaagctctgtgaaggaggtaatgtttgagctgggtacgaaagaatggaggaagaatttgcttatactgtgattaggggccaagttatgccagacaaaagcattaggcacatgcaaaa

SEQ ID NO: 189546 - DNA, 360 bp, Homo sapiens
tccattcactggttcatgccaggatgctgaaatgaatcctttcttctaataccacaatctaacccttctatcaacttttgttggttctaattcctaaatacagcttgagtccatccacatctcttcagttccactgtcaacccccagtccaagctactgtcatctcttgcctccagcctaaagccaataaccttctgacactgtctcctaaattctcttcttattccttctaatcaactctctgaactttggaacaactaaattaacatggttcatatggccctgaatcatctgaccactcctatgccaagccttgtcttgaaacactcaccctcctcagtttgctccagcacactgacc

SEQ ID NO: 189547 - DNA, 224 bp, Homo sapiens
agagaaaagaaatcgcacatccccacctctatcagggtcaccaaatgaaggcatcaatttcaagtcccgttattatctgcaaggaactctgcattgcagcacttacagacacaacttatgctgtctcctggtgcccacacagctttcgggtgatggcagattgtcagccaaccattccccccagctgctctctcttaatttgctccctcatctcaccacgaaaa

SEQ ID NO: 189548 - DNA, 397 bp, Homo sapiens
gagtaggtggttggaggtagcaccttcctgagttaattcgtgtggtgctaacaacatcatctgcctactaatgttgtctttttaaatttagcacagcagactttgataacctgcctagaccagaatacaggccttcttaggaataagcagctttgcagagagctgtggacagccaacaagaaatggtagaaacttagatagccacacaatcatagcaggagacttcaataatctaccgacgacattagacagatcatcgaggcagaaaactaataagatatttgggacctgaatagacacttgaccaaatagccctaacagatatctataaaacactccacccaacaagagaatatacatacttctcatctgcacatagtacataccttaaaattga

SEQ ID NO: 189549 - DNA, 221 bp, Homo sapiens
ccccactacctaaatggctgtaattaatttatatttactaataattttcagaagcactttgagtttaagaaattgtccatatgtcatattttctaatgagtatcagaaatttacttaaattaaggtttatcacttgggtgagatctttgaaaatgatttgctaccgtaaggcatgactgcctggcctgtaaatctgacacaacttttcctaagttgtggct

SEQ ID NO: 189550 - DNA, 409 bp, Homo sapiens
ggcagattagatactaaacacaaattgaagactaagatttgtgaaagtaaaataaagagtaaggaaaaagcaagtatttcagaatgttattttaaactaaaccaaaaagttaaaaagaaagaaaacaaaaacaaatggcagcatagtaaagtggaaaaaccaaaagaccaccaggagatggagacctgtgttctaaacctatttctgcaattaagtggttaagagacgtttggcacaatcatgcaaaaattaagagagtgaactttgggaggccaaggtgggtgaatcacttgaggccaggagttcaagaccagcctggccaacatggtgaaaccccgtctctaccaaatatacaaaaattagccaggcatggtggcacatgcctgtaatcccagctacttgcgtgacc

SEQ ID NO: 189551 - DNA, 514 bp, Homo sapiens
agaatggccaaaacagtcttgaaatgaagaacaaagagaactcacacttcccaatttcaaaacttactgcaaagctactgtaatcaagacactgtggtactgctatatggatagacatatatagatgaatgaaatcaaatggagaatatagaaataaacctttgcatttatggtcaattaattttgacaagggtgccatgataatttactaggagaaagaatactctttttaacaaaatgttttgggataagtgtatatccacatggaaaagaatgaagttggattcctaccttacaccatgtacaaaaattaacttgaaaaggatcaaagacctaaatgtaagagctaacactaaaaaactcttagaagaaattttagatgtaaatctttatgaccttggatttggcaatggtttcctagaagtgacaccaaaagcaaaagcaaccaaagacaaaaatagataagctggatttcatcaaaatggaaaactcttgtgcttcaacaggcactgtg

SEQ ID NO: 189552 - DNA, 542 bp, Homo sapiens
ctggtctcgaactccagggcttaggtgatcctctcgccttggctgcccaaagtgttggcattacaggtatgaagataaaaaaacctcatgaccagccaaaaaacattgttaaatagctaaaataatacatacttattctagatatatatatgtgtgtatatgtttaaatagggttaaaaatgaatcctacttcagacttcctttcctctccagaggtaacagcagctgagtttggtgttcactctgctgaccattctgtctactttatatgtttactatatatacacatatatagtatatattacatattatatagtatatatgcctgtattatataatatattaagtaaagggggggcttacttggttttttaacttaattttttgaataagcaaatggtttagaaatgagaaacattttcttttatagctacctaatatgtcataatatagatgaaaatgttatcggaccatgttttttctttttaagaaatgagggtctcactgtgttatccaggctggagtacagtggctattcacag

SEQ ID NO: 189553 - DNA, 250 bp, Homo sapiens
aagtgaaaccatggacactattagtgctcagacacaaagctgacagaagcagaaatgaacatgttcttaacagtgtatgtgtatgctgctttgacgagagaggaacacaccgccttaagactcctgggagcatacgttttgaagggtcagaaagaattcagctttgaaaagtagaattaacagccactttggtccaagtttttcacaacaaagcactacaaagtgggaattagctctgcttacctttttt

SEQ ID NO: 189554 - DNA, 381 bp, Homo sapiens
agctggggaggcctcacaatcatggtggaaggcagaaggcatgtcttacatggcagcagacaagagagaatgcgtcgagtgagggaaaccccttataaaaccatcagatctcgcaagacttactgccacgagaacagtatgggggaaaccgcccccaggattcagttatctcccacctggtccctcccacaacatgtgggaattatggagctacaattcagtatgagatttgggtggggatacagccaaaccatatcaaacaccaaattcacagatgctaattaatggtgggaagtaaggggtgataagtcacactgaagtattaaaacatcaaaattttaaaatgcttttaaaaagattgtgcccttctgtgttcttcca

SEQ ID NO: 189555 - DNA, 284 bp, Homo sapiens
tgagccctgccttgggctgactgcctctcacctccagatcaaaatgtgcccctgatttctgaatgtctcctgcccaggcctggaaaacctaaacattattaccttcccctagcctccctcatcccctaaaatgaggtttctaagggttttatctgctgttgtcaagtttatggccataatttgaaatgctgttaatattactgtcagcagagagctacaaattacaaagttgtaaagtttctttatagtgataactgtcagccttcactagcagcacccgcaag

SEQ ID NO: 189556 - DNA, 425 bp, Homo sapiens
tgcttgggagccaatgttctaggaacagaagtaattccagtgtagcaaaggcatgaatgaggttaagacagagcaagataatggtggtgagagacaaaatagacagaggtcaggattttgcagagttctacaaaccgcattaaacaagataatactctattctaagggcaatcaactaaataactaataagcaagagagtaagtgaattagactgcatttttagaagattatttggaatgtagaatgaaaaatgggtcagagtaggacagatggtagatctgggttgggcaaaaacaggaccctggggggaaaaaatgaatcaattgcagaagtaattctgagagagaatccgcaggcctgggctactgactgggtgtggggaccaaagcagagggaagacacattcctctgactttacttctca

SEQ ID NO: 189557 - DNA, 171 bp, Homo sapiens
aagtgaattaatggttcatttgacagtggagttttatgaatgcttctgtgctgtgggatttcttgtttaatcaagttagctgtatccaaatcaacagagttaatgtgggctgccagccaagatgtaggtcaagagtgggttgttaaaatgttagtcgttaaaatgaaactc

SEQ ID NO: 189558 - DNA, 937 bp, Homo sapiens
tttggagatttggctatcatctctctcctggttccccagaaggtcagataaataacttgctttcagcttggtggcttggtacttcagcatgagttattccattttggtttggtctcttgggtgtagtgcgggagctcagtccaaaccaatagcctcctgtaaattttatttaacagtctttgtcagaataaagatatttacttttaattttcttgaagaggagaaagtcactttttaagattcacttcacagcaaaactttgtaaaagccctcgtgagatacctcctcctcagcgcaaagtttgcagtcatggcagcagctaaaaatgtgcctacaggccgcatgccaccatgccatctccctgttaccattaccttcttctttctctccttcctgctgatgcagcagtgcctccttggatacaggatcattcctgctctaggctttttcctgagaggggcagctctcctgggattctggcgaatcaaatgcttcatctcaacagatttgtttatattcgccccttttccatgtggtgggaggaaaaactttttcactactttctttaattcaatgcttggggactgctgaattagaataacagaagacagattaacaggataaaagttacacagtttttattaatatttacatacatgggagttcacagaagagaaaatcaaaaaagtagtctcagggtcttgtatcattcaaacataggacagggcggattgggcttcaaggggtcataaattgtggggaagtgactaggaatatgggggaaactaatggaagataggattattttagtaagggttgctaattcagtctcatccaggtgccgactcctcatcttgtgataacttgtgataagagttgctctcctttctgtggtccggaagtacggagcaccctcacaagggaaatttctgccctg

SEQ ID NO: 189559 - DNA, 161 bp, Homo sapiens
aggggcagtgtataaaaaatggcactaattactgaaacaatgttatttaccacatacactggcagaatgtttactatgtttctttacagccggggtttatttttgtttgatgtatttagttgctgtgaaaatgaacgtgttgctcactctcgatagacctg

SEQ ID NO: 189560 - DNA, 263 bp, Homo sapiens
tatgataattatttgatctgtcctttccaaatcttcctgtttcctctacacttcaactgacaagtcctaacaacaactgacgagtcctaacaatgttgccatctctcaagtttagagatttgttgcattttattccttaagccttataattcctccattcaagattttagatacttcaaaagggtattttctggaagaattctctaatttctatgatagcaatgtataaatctaccgaaactcttgcagtcatctctttatgg

SEQ ID NO: 189561 - DNA, 217 bp, Homo sapiens
aactttcttatctcaccctcccatctctgcctactgaaataccacctgcaaaggatcagttaaatgatttgtggtgtacacatacaatgggatattatagagcatacatctaacgatcatacctcaaatggggagtctttcaaacatgcttatctggatcttctaatttttctacaatgatcgcatataacttgagtggttatgtaactgtaagaaa

SEQ ID NO: 189562 - DNA, 521 bp, Homo sapiens
tatttaaatgatgctatgaagaatgagcaggacttgaacatttcaggcaggaatagtggggaaaacagaggtggagattataggacaagtttaaggaatgactgaaacaattcagttgaagtacagagttatctgcaggatggtaggggaaaacacaatagaaaacatagatggggacaaagcatagaagattgtgcatgctttgattcttgattctgcaagagattatgcacgagttttaatcctgcatgagaatggcaagaatggtatttgtctcattcacaataacaagcataaaataatcagaatgaaatcagtagagaagaattagcctgttttacgggagtgaaaaagcgcaatctaaaaatttgaaactggtatacctgcaaaaccctgtttacaacaacttaatagatccttacccccatcctctcaaaaaaatattttatcaatgcatcatcacaaaccatttatccatgtaacaggaagccacaagagctgagagacagcccacatctcca

SEQ ID NO: 189563 - DNA, 326 bp, Homo sapiens
cctgctgcatattggccaattagagtaaaaatcagatagggagactacctgtcaacaaagtaaaagatatagtccagagacaaataacatttgtatcagtttttctttttccaaagtcttcataaaaccaccctttggaataaactgaaaaatgctgcatttttgcaaaataggaatttgaaaagaaaaaaaaacaaacaaaaaaaagcctttgtcttctgcctcttttacggcttattgcttgtatcccaactagcaatgaatctggcgaatgaacacagaatggcaagacgtatttctgtaaatctccaggaggtttaaacaca

SEQ ID NO: 189564 - DNA, 274 bp, Homo sapiens
cttcataactagaacatttcccttcttttttattataaattctcattttgtattttaatcacttttgctttgtttctattgatgaggcagaaagaacatggtaagaagcagctcttctccagtagagaagtccacccagatactggtagtggtgtgttccttttccacaagagttctctcctgtcaccatcagggagcatgcttttgaaactggctcattatgccttcatgggaagaggtccaggggtctggttttattagaagtggtatgaac

SEQ ID NO: 189565 - DNA, 607 bp, Homo sapiens
gatgtcgaatgtatgttgaagaaagtacgcacagtcttatcttctgaacattttgatggaattaaccacaaacttcatgcaagaacagtaaaaggaaagatactattcaagtccagtacatcataatgcagaattctgtatcagtaccaccaaaagatgaagataaaaatgaatgccatttcccatccagtactgaagtgttaaagttagaagacatttgctaagtcaaatcacttcaggaagctcatcctgggagtggaggaacagatgttctgtcattgccacattcttctggacacagactggagaactataggaatgtatgttgaagaaagtacgcacatcttatcttctgaacattttgatggaattaaccacaaacttcatgcaagaacagtaaaaggaaagatactattcaagtccagtacatcataatgcagaattctgtatcagtaccaccaaaagatgaagataaaaatgaatgccatttcccatccagtactgaagtgttaaagttagaagacatttgctaagtcaaatcacttcaggaagctcatcctgggagtggaggaacagatgttctgtcattgccacattcgtgatcaag

SEQ ID NO: 189566 - DNA, 323 bp, Homo sapiens
tgcactagtcaatgaaagtgacaaatgcaagattctctgagattcttctctgccattaggactgtgatgttagagttgccatcagtctggatcctggattctggggttagatagatgtgaagtaaagcttctcctcttacaacacatgaggataatttagcatagatgagaaataaacttttttttttgagacagtctcattctgtcacccaggctggagtgcagtggcatgatcatggctcacggtagtctcaaaactcctgtgctcaggtgatcctcccacttcagcctcctgaatgggtaagtaggactcaggtggtgtg

SEQ ID NO: 189567 - DNA, 413 bp, Homo sapiens
ccttaatagtcagagaaaatcaaattgagatacacaattttacataataaattagctaattttggtggtacagatgaagagaatgttaagtcactcaagatatctgggacatttaaaattgatacaaagcctttgaaaatcaatttgtaacaatttatcaaaagccattgaaattgtgaatcatttgaccccatgaatgtaggaaaacctctaaacacgaacatttcattaaagcattacctagcaatatttagttggggaatggttaaactaattaacatgcagccaagctgcttaaggaagtctgttgatcatgagagttctccatctgacttgtgccaacagttctagattcaggaattttttatgtagactctttatatgcttttatttttattattttgttttatttt

SEQ ID NO: 189568 - DNA, 389 bp, Homo sapiens
agattggggtatacctatctcatagaatatagagttcattgtgaagatttcataagagaacagtgccaagtgcttaacacagtgtgtggcacatagttaggactcagtaactatttactcaataaatgaaccatattccaggttacccaaactcaaaatattggagtaattttttgcttgcctctcttatattcagtgagccctactggtttttagaattgtagaattttaggaatctctgtctttactggattttttgtttgttttgggcttttttgtttgtttgtttgagatagggtctcactccgtcaccgactgcactccagcctaggtgacaagaataagactccgtcttaaaacaaaaacaacatatttgttcacttttgaac

SEQ ID NO: 189569 - DNA, 437 bp, Homo sapiens
tcaacgcttatacttcatgctctactatctcttctttttttttttggagacggcgtcttaccgggtcacctagacgctggagtgcagtggtgtgatcacagctcactgcaacctctacctcctgggctcaagcaatcctcccacctcagcctcctgagtagctgggactacaggcatgtgccaccatgcccaactaatttattttattttgtagagatagggtctcactatgttgcccaggctggtctcaaacccctggactcaagcaatcctcctgccttggcctccctaaatgctaggattataggcgtgagctatcatacccagcctgtgttgttttttaacaatatataataaaagccaacatttattcagcactgaagtattttatacacattagctcacttaatttttacaacaaacctgtgtgggaagta

SEQ ID NO: 189570 - DNA, 142 bp, Homo sapiens
atctacgttatgcagatatatcttttgtatcaatagtaaaaggaaacatgcatatttctaaaaatgttatgcaatgtactgtagcagatagaaaacagatggatgttattcttctaagacagtggctgctgtacttgagaga

SEQ ID NO: 189571 - DNA, 360 bp, Homo sapiens
gcactccggcctgggcaacagagtaaggccctgtctcaaaaatgaaaacaaataaaaataacatgaaaacactaaccaaaagaaggctggtgtagctctattaacttcaaagtggactttcaggaatacttcatattgaaaaaagcttgaattccacaagaagattaacattttcttatgtacctaatggtataaccttgaaagatatgaagcaaaattgagagacacaaagagaaaaagacaaatccaaaataacatggctgggcgcagtggttcacacctgtaatcccagcactttgggaggctgaggtgggtggatcacctgaggtcaggagtttgagaccagcctagccaacatgg

SEQ ID NO: 189572 - DNA, 208 bp, Homo sapiens
ttccattgttttgggggacacacaaatatctgcatgattttgagaaactttatgttaaactatttttttagttctcttttgcatcatgtctaaaatgtgtgagagtagtggtcactgttctattggtttttatgttaattttctgcacattccatctttttttattagtatattcttgaaatatagtctgaaattataaaatataatg

SEQ ID NO: 189573 - DNA, 539 bp, Homo sapiens
tagctgtaaatgaaactgacggcaaaaaacagagcagagaagtttaaagaaaaaaaataacagcattcctggtgatgccccattgggccaatgaaacaaacacattctgaagcctttcctaaccaggagccaaccaatctcatcactgtgaagccaggttagtttggttttccatgattttcatctgactgaaggcatctcaagtatacaccgaggggacaaaggcaagctttggaaaatgtggtagcaagtgatctgcaagctactatttaataaactttatgccagctcaccctaccctgcagacatcacagcagcaaataaatgagagggaggggacccagaatgcttaactggggaagaaaaactgaggaagacattgtatactcatggcctgcctcttttccagttggctgagaagccctttttattaatttgttccatttccttaccatgtccttagcagtggagatatattttttggaaatgtattgatcacaattatatttccttacactgggaggacaaggaggctccct

SEQ ID NO: 189574 - DNA, 857 bp, Homo sapiens
tgtctgtgtgttaggtgtagacatctgcaggaagtgtggaatataaattggagaagtaaaaattgcagtccctttaagaagtctatgaggttctgatgactaagcagggacaatgaaaaggccaaaatgagggaggggggtcgaattcaagagaaattttgacacttgcatatgacttttaagttccttttcaatcctgacttccaatgactgcatgtgaggaaatggaagcgggcagtcaaagatgggattcccgagggatacgatttggtagataacagaatgactcacaggaggttgtgttcttagattgtttatggtgttcccaaaatagaggcaccattgagctgctcagaaaaactgttttgtaaatggggtatggtatatatgaatctaaatctctcttaagtgagtatttagtcaagtttaaaggacatgccatccttttaatcatcttaatagacataaacatactgaatcatataattaataacaatttgaagtgaccaattaaatcaaatggacaaagtccaggtcctgcgagcagctgtggtgtcattcagggcgacttctgtgggtctcatttgtaaaaagacaggtttggatgcatcctactgatggcccttttagtctcaatgggctatgattctgtgaataattttgctatactttaaatgtaacaatccccttttaagaaaatcaagcagatgtgactgagaacaagtgtaatgatttgtttaccaaacatgtaggcagcacctgctagtatggcgtccagcaccagggaaatgtattaacacagaacacagaatcagcatggcaggctactgtattccatgaataaaccactggggcat

SEQ ID NO: 189575 - DNA, 206 bp, Homo sapiens
tacaattattacacgtcaaccaaaaacaaaaggaaaggaaaataaaaagacacaaatattttccttaaaaaaaaaaaggccctcaaattggaaaggaagaagttaaactgtctctgtttgcagatgacatgaaaactctaaagactctaccaaaaatgttggcactaataaaaaatttcagcaaagttgcaggatacaaaatcaat

SEQ ID NO: 189576 - DNA, 391 bp, Homo sapiens
gaagagaaagagagatgggagatgtttgtcaatatttgggttttgaatttcaattttcttgttctgagaaataaaatattgtctagaaaagacatggggcataaaacttataccttaaataataaaggacatttttccttatgttctcccagctgaaaccctgccacaaggttaagaacctaaaccaagctggttaagaacaaagggaaaacaatatttagatgtcggcttttcattttctctataaaggctttcctgcccttccccacaccttcaggctaagtaggaaggagaacgttagagccaccagatttatttgtgggttttgaagtcaggtggtcctatatatcacttttggaatagaggctgggaagagacaagccccataggg

SEQ ID NO: 189577 - DNA, 453 bp, Homo sapiens
ggtctccttgtctccccacacaccttcctatgtaacttcacttggacccagactaacctgaataccactaataacaatatctaacatttattgagcattattgtaggctcccagtaagagaacagagccatatctcttcatgcctatcaatcattgtcacctactgtgcacagtggctggcattcagtaggtactccatgtacactagctcaataaatgaatgaatgagtgagtgaatgaatgttttctccctgctcacgggttcctgagtgatgttcccagcaccgtttaaatgttctacatgggttatctcatgtaatgctcatggcaaccctacaaaggtactattattgtcctcatgtgcaaatgagaacagtgaggccaaagtgaaagtggtctagaaacttgcccacttttggctgggcgcagtggcttatgcctgtaatcccagtg

SEQ ID NO: 189578 - DNA, 635 bp, Homo sapiens
tatattgtcagcaacaccctaagggtgaagagaagctgcctgcctctgtgcaagacattatctgagcaggcgcctcatccagtgggacgatgccatccacatttggaagcaggctgagaaatgcttcggcactggcagcaactcctcatcagaaatgctctctcgcattttatagtaaacctgtgttgactctggtggggagctctaaaaataccttatcatggagatttgacatttcttatagcagccgatagtttacattgacaagccccttggaattgtttcagaacactaatcacttgctgtcagcagctagttcctctgaggggaagagcggggctgatcctgcctctgttgtgagactgcatgattagagggacatttctgaattcatgtccattccttcatttccagtgcatactgaaatcaaaataccatcaaaggctgatagaactgattcacagaatttgtttttaggaatttggattttttaaagtacagctaagcctggtggtggctcatgtctgtaatcccagcaccttgggaggctgaggtgggagaattgtttgaagccaggagctcaagagcagcctgggcaatatagcaagaccgcatctctacgaaaaataaaattt

SEQ ID NO: 189579 - DNA, 702 bp, Homo sapiens
atgtctattcagattttctatttcttcatgatttgattttgtcttgataggttttgtctgtctggaaatttttccattccatctgtgttattcaaattgttgacatatagttgcttatagtacactcttataatcttttttatttctgtagaattagtagcaatgttgccactttcacttataattttagtaatttgagtttcttctttttttcttagtctagaatctagcttaaggctggtcaattctgttatcttttcaaagaaccaacttttgtgtcattgattttctctattatctgtctgttctccattttgtttatctttgctctgatctttattttttccttctttctgctagcttgttctttttctagttccttacattgtaaggttaagctcctatttgagacctgtcttttttaatataagcatgtatagccatcagtttcccccttagcactgctttcactgtcgaacaagtttttaaatttgtgttttcattttcactcatctctaagtattttataatttcccttgtgatttcttctctgatccttggttatttaacagggtgttgtttaatttcgtgattttttaaatgtccttgttgctgatttttaactttactcctttgtggtctgaaaagatatcttgtatgatgtagatctttcaaaatctattgacacagactttgttgttg

SEQ ID NO: 189580 - DNA, 362 bp, Homo sapiens
aatgtctagaagagtttttccagtattaccttctacaatttttatagtttcaggtcttaacatttttgatccatcttgagtttatttttgttttgcttagtcttgctttgtctatgcaggttcttttttgtttcatatgaattttagagttttttagttatgtgaggaaattatgatgttattttcataggaattgtattgaatttgtagcttgcttttggtaatatgatttttacaatactaaccctacccatctataagcatgggatgtgtttttatttgtatgtgtcatctatgatacctttcagacatattttacagtttttcttgtagagatctttcatggccttcattagggataa

SEQ ID NO: 189581 - DNA, 178 bp, Homo sapiens
gcttttttctgcatcaatcgatacaaaatcatgtgatttttcttcattagtctgtcagtatggtgcattacattgattgattttcaaatattgcaccagccttgcatacctggaagtagccccacttgctcatgatgtataattatttttatgtattgctgaattttattagctaata

SEQ ID NO: 189582 - DNA, 329 bp, Homo sapiens
aacatggtggtccaccgctcacgggaggtcaccatattgatgccgaacttagtgcggacacccgatcggcatagcgcactacagcccagaattcctgggctcaagcgattctcctgcctcagcctccctagtagccgggattacaggtgcctaccaccatgctcagctaatttttgtatttttagtagagaaggggtttcaccatgttggccaggctggtctcgaacttttgacctcaagtgatccgcccgcctcagcctcccaaaatgctgagattacaggtgtgagcctggcctcagaattctgattttaaaataatttagcaggaa

SEQ ID NO: 189583 - DNA, 141 bp, Homo sapiens
aaaactttaaaaagatttttattttaaaatgatcaagaatataacatataaaacaagaagactaaaaaacagaagagaataagaggaggaccttaaaatctattggatcttagatatggcctcgctaggcaaatcgaccca

SEQ ID NO: 189584 - DNA, 312 bp, Homo sapiens
tctggtaaatagtgctacgtatatgtactaagattttttgggtagggaagagaattaactgaaatattttgaaaatatagaaaaatatagaatatggtaaaatgaacactttcatgtccatctagaattaatatatattactgttgtattatatttgtttcaggtctttttcttttgttgtttattttgtttaagaaataaaatgttacagctacaactaaagtcttacagtcttaccaatttttttttttttttttgagatggagtctccctctgttgcccaggcttgagtgcagtggcgcgatctctgtt

SEQ ID NO: 189585 - DNA, 213 bp, Homo sapiens
taaagctgtacctccacaagcacccataattcatagttaatatcaaagattagtgttcccatacatcctcacagcctttacattggaagaatcaactcaaacagcagtagaagcactaccaaacaggcagagagtagtaaaccaaactctgctctcctatccagtgatcttgcaggatcagcataggaagcacaccatcttcacactaaaaag

SEQ ID NO: 189586 - DNA, 447 bp, Homo sapiens
tgaagtcaacactagcagaaagagtgtacaaacaccacaggctttcagctgttgtgaggcacatatttaactctgatgtaactatggccaagaagaatgtcatagttctaaataaccaaaagaaaaaagtttcttggtgggtaacgaaaattttttctcagttaattcaaaggatattctttcgtattagttttctatatgctcagttgcggatttgagaatcttgtttccatagataaacaatattcgggtgaattttattttctgcaaaatctcattctaatagtagattttaaatttataaatatctgtaaattaatttctccttgttaaagtcaagatttgaagccagggctttctgaaggagtatggcaattcaaattgtcaagatgttgctctgtaccaacattataataggtactggggatataaagacagatatctttg

SEQ ID NO: 189587 - DNA, 458 bp, Homo sapiens
tgaggctggtctcgaactcctgaccttgtgatccacccacctctacctcccaaagtgctgggattacaggcgtgagccaccgtgcctggccataagcttggatctttttgtgcactcactggtggctaggggcaggctacccagaaatatgcaatgtgtctgatgaaaccagttgaagttaataaaaggaaaatttgttgtgtttaattcctataattgactgatatcagggctttattcatttatagtcagcctgtgttgtctgtgttccttcattaggttgactactaccttttagttgttcaaaacagcattagttgttcaacacagcatatgcaatagaagacatggttcccattctcttggaatcacagggaaggtttttatgttttatgttttggaacttaggaccattaggagagagaaatcaataatcatcagctaaatatttgaaagag

SEQ ID NO: 189588 - DNA, 139 bp, Homo sapiens
ccacagggcagagctggagactgggctgttttgaaggaagaaggactggcagaccagctcttgggaaagctccattattgcctgtgggaggctggacctgaacttgcacctatgaacaaccctgccatttagagctttt

SEQ ID NO: 189589 - DNA, 405 bp, Homo sapiens
ggtgtgtaccaggaagtagggtaaccatgaagagtacagttttcctcatgtgataaaataatggaacctactatgctttttcctttctaaaagagaatcataaatattttgggggtatggggggtggtgatgacgaagcctcaaatattaaaagatgtataacaccatattccttctaacatggtaagttgagactatccagctggtaatgatataaaaatttgagtcaaatagatactttcataaagattattcctgtgtgccacaactgcctgaaagtattcaggcttaaagtgctctgacatacttggtatatttctgtcaattacttaatctcttctgtatatgctctcccaaggggaccagttattcccattaatttatgccataaaagggcagatgttt

SEQ ID NO: 189590 - DNA, 525 bp, Homo sapiens
tgaactcacatttactattatgtgccaggatttataatagatacaaatacttcattaaagtctcataacaacctgtaagataggtattagtatatttatttccacataaggaaacagattgagaggctaaataccctgcccaatacatacaactgtaagtggagaagctgtattccaacccatattctcctcaaatatccctgtagggacaagcaactctgaagagaaaaaagctgataaaagtctatgtaacagaaagaatgacacataaggctatgaagcattagaacaaaggaaaacgataaagtcacttacctagtatgtctttgtgagtgtaaaagcgtgtcttaagtggcttgtattcatggatccgtttgaaggtttttccaaaaggggctggtggaattattttattacaaacagcacagcaaacaaagtttttgtaatctgaatttctgatcatagttaaatttcagatgtcttctcctacttacagttaaaataatcttagaatcagaaaaagtc

SEQ ID NO: 189591 - DNA, 185 bp, Homo sapiens
agacactactgagttgtaagcagcctaatgctgccatcaatctccatttactaagaaaaagtaaaggataaaacaattcacatacaaggctaactcctgctaccgtggaatactgctgcatggatctacttatatgcagttttttttcaataaattcagtcacccctccgtatctgagtgttcca

SEQ ID NO: 189592 - DNA, 330 bp, Homo sapiens
tcatttagaggtctccagagcctacccataattcagagaatatactttaatacggttggcatgaattagctactgcacatgtaaacccatctggttaaaattgtataaaccatagttagcataaagtgaaaatagatgctacctttctcaaaaacatctgtgaatttttaatctttgatttggaagttatgaataaagtgtttttaaaagatggccctaaaaattccaatattaccaacccttgttctaagagaatgacaactcaataatgtggatttttaaattgtctttgaataactactagattcttgcctttccttataaacaccg

SEQ ID NO: 189593 - DNA, 150 bp, Homo sapiens
cgggactccatctcaagaaaagaaaaaaataaagtgtattcccagactgctcataagttgcaatggggaaaatattaatcacacagtgaacaaattgaataacacctgaccaaacaaaattaagattcccagtgaaggggatggccatca

SEQ ID NO: 189594 - DNA, 1256 bp, Homo sapiens
atttatacatgatcctttttccttaatttatacatgatccaggcacatttgaaatttggtaggcattgcaaacacatttgaatattgtgtatttcatactattctttaaaagtaatcttatgtcctttcctacatgtaaaatattttgttaatctatgccattagtagtattatatataaaatatagttccccgtcccccttttcattgagtttgatattcttcagtaaagctgaatgttgtaattcaccattcatactaatgttattgacttttgtaacttactaatagggatgttaaaagtaacaaaaccaagtcaaacttggtgtatttttattttaaatattaactctaaagcaggattactaaatttgattaatctggtcaatgagaatcaaatggaaacatatcattctggaggtgcacttactcttctacaatgtggccggatcatttgtcattcctgaataggtctttctctcaacctgcaagagctaaaccatcttcaaaacataaatcttgttcctttctcattggaagctttgaaaataatgataacactattagtagctagtagttactaaagtgctaaagtaattgtggggttttctgtattagcttatgaactgttgcttctacttagcccttttatagaaactctgagctgttactttggggaaattccacaatgtattagcagccacaaatttccactggtaaccaaagagtacctaagtagtttttcattattttaagttgaatttgaataaagattccagaaataaacatggagctcagtattcaggaagcttaatactgttttgatctacaagatccaaataattatccctatcttcagaattaacttagtctgtaatgtggcttcaaaaaaagaaaaaggcctttttggaaacaaaggcttaacacaattggactttttttaaaaaccaaattttttatcccaacaagggggagaaaaaaaccaccaaagaagggggggtatataaaaacccccgtgtgggggcgggggggggtgacagacacacaaaaaaaaaaaagaaaaaagaaaaaagaggaggggagaggggagggaagagaaggaagagagaaaatagttgtgattgtaaagaaaaaacactcttagctctactaaaaaaaagttgcctaagttttatattatatatgtaatatgactaaataaaaaatagaaaaaaaaagaaaagagtacattttattttttatatatgtaatagacag

SEQ ID NO: 189595 - DNA, 489 bp, Homo sapiens
gtctagagatcccctgtacggttgatgctgatgaattccatgaaagcaggcaatatacaccttctcttagcaacaattgggataatttttattttcagcttctttttttcccgttttctcctgtcatgtggttctgtcatttccaggccactctctcctattactgagattcccatgagtgaaagccagattgcaataatattatccttctagagaggaatttttatctctttggtgattatgtttgagcaactctgccatcatatcatggttatttaattctgttgtatttacaagcagttctccagcctgctgacagttgtcacttagaaaccttactggtggttttcctttcttctgctatactcatcaaatcctgctgccactgtacatcgtaatgttatcccaccagtatatggctaccttataaaaaggatttttgaagaaagaaacactgtctaattgagatttatatgtaccaagccttaa

SEQ ID NO: 189596 - DNA, 282 bp, Homo sapiens
cccctgcattgttcaagagtcagccatatttctatacagattatttttgtaatccttcgaattttttatgctttcattttatttttatcaaaaattgctgccaggcatgtctagagtttttgtttcatatcagttaagaatatttgtgcttcacttttgaagtccatcttcttctatagatactcttagaaccgtaaacagctactctatgtttaaataatatttttttctttttgatggaatttaggattaacttgaaaattgctcatggttagtagatgc

SEQ ID NO: 189597 - DNA, 298 bp, Homo sapiens
tagaggatcccccaggtcttagggagtagggtcttgggagagagtagtaacaaatacgaaaactagaaaagtaagcaaagacaagatcatcaagggccttacacataatgctaagaaatttgcatcttatttaaaagtaataggaagcagcaagatatcttaggaagtacacaggtttaggtattccaatggcctcaatctgtcacttacttgaccttcatcaaattctggccttcccctaaaggaacccgggggttaccggagccttcgaatttcgtaaattccatgggttcattag

SEQ ID NO: 189598 - DNA, 321 bp, Homo sapiens
ccaccgcacccaggctcttttatctctttaatgtagtttcattaatcagaatcagatgttcatattcttagaaatggggatagagataggaatcagctgtgttctggtttctgctaccaaggttggcaacctacttgataacaaaactaaggaatctgtgctaggcttgatagggctgcggctaattttttgtttatttacctacctgctgttaatctgatagaacccagcttattgactgaacaagacacaaagtggttcagccagatggggtgataacatgaatcaaaccggatatcttagttttgtgattacttttat

SEQ ID NO: 189599 - DNA, 328 bp, Homo sapiens
cagtttgccagcttctctatatttgtgaaaattaagcactgaaagcaaagctctctgttctcaatttaaaaagggaatctacctataagcccagcacatttaaattgtttgtatgacagaatgattaggtattattttctttgtatacttgacatacaaggcacatcatttattactaaaagtatttctaatgaccactaattttctttcctatagagtcacacaaaaaactttgagttgtttatctgacacaatgtgggtcacaccaattagacagaagccaatctttgcctctgtcctactggtgctgcctccaggagccagcctt

SEQ ID NO: 189600 - DNA, 269 bp, Homo sapiens
ataactttatcctatggcctcaatttcatcttgcaaaaaaatacggattagataatggcacttccttaaaaggtttgatgggatttcaatggaatattgcatagaaagtgcttgaggcattgtaagtacacagtaagtgaagtgttgaccattattaatatcatgatgataaagtgtgtaacttattttataagtaccatataattgaaatttgccaatagtaactcctcggagacttccagggaactctgtcaatcaaaaaaagcttt

SEQ ID NO: 189601 - DNA, 514 bp, Homo sapiens
tagaatggtggtcccttttgtttatttctaaactagctgctatgatccctgcttcccttctgcctctttacccctcccttatttgtcacccttctcctcacttctctattaggccggattcatctttggaattagtaaaaatcctgcctcttccaggaagcctatcctgactatccctatggaactctgattacttcttaatttgccacttactgcactcagttttgtatagttatattttattgttttatattgttctcaatgatggattaaaattattgttgttttgtagtcacttcaagttatatgtgcatattattttcccagcccagtgtcagagtactagcagatataagcagatataaactacgctttccctcccccgctgactttatccccacagctcatggctgtctccacgaagtaagtgattctgtctgagtaggtattttttttttttatttaacctaggatcagacctaagggagttttgttgttgtcgttgttgtttttg

SEQ ID NO: 189602 - DNA, 602 bp, Homo sapiens
taacacagaagtggtgagaagtgatcagaggcggatttcctggtgcattgaatatgggatgtgagataagcagaggagtcaggatggcttcccggactatggtccaaacagtggaaaggatgcagtggctgtaacctgaagcaggaagtctgcaggtgggacagaaatgtttgttaagggaagtgttttcagagtttggttttggatatgttaagtttgccagtgtaaatggacatactgtgtagacatttggaaatatgaatcttggaaatatgaggttctgggtatgagcagagtccaaggatgagcctagggattggagagctgaaaccagaaaaagaagctagaaggagaggccagttaagacagtgaaaagaagcgaggcatgaggatcacttgaggccagtagctcaacagcctgggcatcatagcgagaccctgtctcagcaacaacaacaaaacggacagtgaagagagtatttgaaggagaggggaacaggcagcgtattgcttattgctgaggggcaaagtgaagaccaaggatagactgctgggcttgacagcatggagggtgctgggggcctaggcaagtgcaatattca

SEQ ID NO: 189603 - DNA, 556 bp, Homo sapiens
taacacagaagtggtgagaagtgatcagaggcggatttcctggtgcattgaatatgggatgtgagataagcagaggagtcaggatggcttcccggactatggtccaaacagtggaaaggatgcagtggctgtaacctgaagcaggaagtctgcaggtgggacagaaatgtttgttaagggaagtgttttcagagtttggttttggatatgttaagtttgccagtgtaaatggacatactgtgtagacatttggaaatatgaatcttggaaatatgaggttctgggtatgagcagagtccaaggatgagcctagggattggagagctgaaaccagaaaaagaagctagaaggagaggccagttaagacagtgaaaagaagcgaggcatgaggatcacttgaggccagtagctcaacagcctgggcatcatagcgagaccctgtctcagcaacaacaacaaatcatcccggtagggtaggataaacgcggaggtaaagagatattctccatcatattggcccaagctgaaggaatgattccttcgcactggcgcaccc

SEQ ID NO: 189604 - DNA, 291 bp, Homo sapiens
gccaaggtcaccatttttgggaccacagtgacacccagaacagtggggcaggggcgatgagtggagctagaaggctgctgaaatgaaggctgaagaggtggacaccacaggtacaatttgctttgcacaaacctacagtatgaaaggccagatttgccaaaacagattagggatcagagtctacaaaagaactcttcacaggaggagccagcatggggaccctaaagggttctcctaggaagtaggggttctcctaggaacttttaaaagtcctagtgcctgggagcaaga

SEQ ID NO: 189605 - DNA, 582 bp, Homo sapiens
atgacttctcctcctgctgctgaggagtgacagattgtgaccaatgaggttaagatgactgtaggacaagtttgccctcagtgaggagaggcctgccaagttccactgacgtttggttggggaccacagaaagaaacatcaccattcaaggtatttggcccttattttgtcctagttcactaaatggcagatcctggggaggagattatttcaccagtggattcttcagaggtatgggggcagacagaacaggctttcttctccaaaagttcaagcttgctgactcaagcttcttactcatctctctggcatgtcactgcactcaggagaagatttgtgcaactatcaggtgcaaactcaagtatcaccaaagggatactttctgattaaatagagccatcgtgctctggggaccatctcaatatcagtggaatattgagggggtctattaatgtttataagttccttcgaaattcagcctttttctttgaaagctgtaaggcagcagttaagggcactcatactgctgctatggctgtgtgtgtatgtgatgggaaaggctggttgccaagcagcggagaa

SEQ ID NO: 189606 - DNA, 263 bp, Homo sapiens
tcccattgtcttttagttgtttgaccttggacagacttctgagctggacagtcacctatacaggaggagccatgaaattcaaagaaattagcatgaggataaaacaagaacacaaaaagaaaggaaaagattttgtaaaccaccaagctccatgcctggattcattatgattgtgtatcaaagtcaggacctttctcttctggtgagcgctcacttccagtacctgacaccatcgcgagatcatcacaatcacccacaaaggg

SEQ ID NO: 189607 - DNA, 598 bp, Homo sapiens
aaaggcgatctcacaatattgcaggggcaccggtgactgggtccccctggagtttttaactctcagacttgtctgcactgaaccttccagcaattcttcaattacagttcaggtgttcctaccccagtgttggttcctgcagcagtttttacttgtgcatctctgtcctggtaagctgtaactcactgtatttactggtctctttctccaatgtgaggggcagaagttgtccttccttgtcgcctttcttacagctccaagaacagctgttgattcttaagtttgttcagctttttacttcttgttaggatggaatggtgacttccaaactccttacatgtgaaactgaaaacaaagtctaaaaaccacttaaaaggaaaaaaaaagtaattggttttaaaattttttaaaccaacagagaaccctctttttttttttttttaaccaggatgagatttttaggtggtaccccaacacatgaaaaacatattaaatcagagctgcaggtgtcaaaggaaaggggaaagtttgatgcagggttccaggagctattggcttgacctgcccttccttgatcacttcttaactcccagagaat

SEQ ID NO: 189608 - DNA, 266 bp, Homo sapiens
tctaccggggattggctgactctctgttagggagtataggaattgtagcacagatgaagccagactacgtgatttaatgagaatgaaacaaatgactggacaagctgggcatcgtggctcacatctgtaatccctgtgctttgggaggccatggcaggaagatcgattgaggccaggattttgagaccagcctgggcaatgtggcaagaccctgtctctacaactaaacaaacaaaatccgcgggggtaccgagccctcgaattcg

SEQ ID NO: 189609 - DNA, 491 bp, Homo sapiens
tctaccggggattggctgactctctgttagggagtataggaattgtagcacagatgaagccagactacgtgatttaatgagaatgaaacaaatgactggacaagctgggcatcgtggctcacatctgtaatccctgtgctttgggaggccatggcaggaagatcgattgaggccaggattttgagaccagcctgggcaatgtggcaagaccctgtctctacaactaaacaaacaaaatcccaaatgactggacagaaagaggcttttgacttaagaagtttgtgagggcataaaaaggcagtgagtatggtgggatgccctaacagaagtcctgacaagtatgagatgtgcaaccctagaaaaacaacatcccttcacccttatttttttgatctgagaattaggaacaatagtcattgccctgcctacctctcatgtttgcttagagcaagtgcattgttaaatgccaacctgttgtgtaaactgtaaag

SEQ ID NO: 189610 - DNA, 173 bp, Homo sapiens
cttccagagtggggagtggacaaggaggagtcttacatcaaagggatgaaggtggcatttctgggagcaggaggtttttggaggtgggggcaggatctgagatcaccccacatgggctgtttcctatgtcacagctgcatgggaccagccctttgaatagattcccagctggt

SEQ ID NO: 189611 - DNA, 458 bp, Homo sapiens
cttttactgttggagaaagggattttgtaccttaatgatgccatcagaaacctttcaggtgacagaaataaacactttaaaggggatcaggtccactacattatctagatatggtctctaactgtcaatgacaatactattcttcattcccctagtttcttccaaagcaaaagcttgaaacatacgtaaagtgggccaatcattcattgcttcactcactgatcaatcttccaccaatcaatggtaatcggaaaactttggcttaaccttcgattcctgatccagtttaaagccaatgtgcacaggatgctccaaagccatgttattcttctggaaacaccttccagagttcggcttatacaaaaaagccagaaagttctacttttaacaccttcatctgcagatctgacaataactcttcagctctgcagaatgttaatgggtctctaaagaattgt

SEQ ID NO: 189612 - DNA, 411 bp, Homo sapiens
tatctaaggaatatagatagtgatatctaagaaatcactgcctgatctaggatcatgaagatttatgcctgttttctcctgggaattttatagtgttagctcctacatttagatatttgactcattttgttactttttatatatggggtgagttaggggcccaactttttattcttttgttgatggatatagagttgccctagcaccatttgttaaaaagactattctttccacattgaattgtcttggcaccagggacaatttcttcttatggctgatttcagctccatttaaaagtagcagaacaaacacataagcaaaaccattatatttcattactttaagtcattgaatgcacgcagtgaagaataagtgcatatgcatttgggaattaaaacactttttacttcc

SEQ ID NO: 189613 - DNA, 160 bp, Homo sapiens
ccccaaaaagaaacactgtatttattagcagtaactactccccattctctgcctcccctatgcactaaccactaatctacttgctgtctctatggatttgcctattctgaacatttcatataaatagactcatataacatcgttttttttgtctagcttc

SEQ ID NO: 189614 - DNA, 472 bp, Homo sapiens
gattacaggcgcctgccaccacgtgcccggctaattttgtatttttagagagacggggtttcaccgtgttggtcaggctcatcttgaactcctgacctcaagtgatccacctgcctcagcttcccaaagtgctgggattacaggtatgagccactgagcccggccgtatagtgttttctaaattttaactttgaaaatttttaaaagacataaatgtataaagacatgctagatgaagtagctgccagtgcctcaggaattcctacactgatagcctctgaggcccagcatggagaaggtctcagggaccaccacatgggcccagtcttgtgccacaaggtcaagtgctacctgtatagcaagtgacatcaaatcatcgacattccatcgttaaagaatttgtgactgtcatatggaaaaattatttggtggggaattcagataaaaataacagaaattgtgaccaacaagg

SEQ ID NO: 189615 - DNA, 567 bp, Homo sapiens
tgtctcttcagagacatcacataagacttctgggtttatctatctaggtttctggaggtaaagtgtaaacattttggctatgctagttcccaagtttggtaatggggttaccgtcttacagactccaaacttgtattccacagctttatcaaggtgcaaaaggcatttctgtttagggtactcttatacaagacaaaacattccaaggatactttgtacagatcacctgacataattcagttgccacagtgactcagtcagagagattgttaactggttttaaataaatctcaagtattgttactcttatacccactgtatataaagtcagctttaaattcattaacagctcatttatgttcttctaaactaagatttgaatgtttctgatatctttatttccaataattgtcatggcccttttgagagactgcaaaagctcttaaaccttgagcaaaaacaaatattttcattgttcaactcccctcctttctggttgcacattactcatgtccgcctcagagcatgaattagtttatgccagaatggatcttttctgtgatacct

SEQ ID NO: 189616 - DNA, 392 bp, Homo sapiens
atctcaggggatccagcgagtgaggagtactaggctcacaaccttacccatcacagcatcacccaggggtgaaatggactaataaaggcgtcagctttctgtgtgtctttttctgtggacataagcacttatctgtcttggttgtatgcctaggagtggaagtgctctaggtcatatgcttagctgtggtagaaactgccagacagttttcccaagtgctcatgccagcgtaaacacctgtcagcaacacgtgtcagcaatgtatcagttccagcttatcatgtccttgctgacacttggtactatttttttgtttttttttttaattttagaactctactcataggtatgtactcataaatgaaaacgtacatccacataaagacttatac

SEQ ID NO: 189617 - DNA, 260 bp, Homo sapiens
tcgtctagaggatctcaataaattgttggtcattgattattaatagttaattatccagttatctggactttttccaaaagagtttatctataaagagcatctactctatgaaatgtagaaataaactcaaaggatagtaaatcagtattcagtctgtaaatattacctcactgtgtccatgacatttgtgaacttagtaaccaaatttaaggatttaatgtgtttgcttgttgttaacatcaatgaccaacaatttattg

SEQ ID NO: 189618 - DNA, 320 bp, Homo sapiens
ggatccccccccttggcaagcttagggccttctcaggtctgccttgcaaaggctatagtcgatccagcattctaggtactgcttgcacagtattttgttttctatccttttactttaaacctatttgtgtctttaaatataaattttgtctcttgtagacaacatatagttagattatggttttttattcattctgccgatctctgctatttgtccatttacatttaatgtaattactaataaggtaggttttatgtctgccattttgttgttttctctgtgtattatgtcttcagttcctcgttgcacagaggcttaaa

SEQ ID NO: 189619 - DNA, 926 bp, Homo sapiens
ttactgtaaaggaaagagaaataaggcattttaaagaagagaaatgaggtcaagaggtttagggtcagggcagggaagtggagtttatttagaactcatgcaataagtggctcaatatatgacttctctaaagtcatatatcttttagttaattccttgagtaaaacagaaacaattgtctatcgtgacttttttcttcaagctctttaaaactctccccactcccaaactatatcactgtctaagaagaaaggagtttgaaaatcagtcttgttacatagcttaatttgaatacatccaaaaaatgacattgcattattttcatatttgctgaatctattttttggctggagtattttaaagtagatttttaaagtagatttcatctcttactacttcacatgcataggactttttctttatataaccacaatacttttatacacctaacaaaattaacaataatttcttaataccatataataaccaatctatgttccaatatccccatttgtccccaaggtgaatcaaaccaagattcagacaaggtgtacgtattacatattattatatctgcgaagccatttgttttttattcccatttacttgttgatgaaaccagttcagttgtcccataggaagtcctaccttctggatttgtctgataattttcctttggcgctatttgacttgttcttctttcttctgtatttcctaaaaactggaattgtgtatgacagcttgataatatacagaaccgactttccggactcagtgcacttctacctacaggtccattgagctcagactgcagggggctgggtaggtggagagctgaccgcaagatgctcaccacccgtagagggtgcgtataggtagagaaagggcggtctagggcctttctctgcactaagtggcgagacagc

SEQ ID NO: 189620 - DNA, 943 bp, Homo sapiens
ttactgtaaaggaaagagaaataaggcattttaaagaagagaaatgaggtcaagaggtttagggtcagggcagggaagtggagtttatttagaactcatgcaataagtggctcaatatatgacttctctaaagtcatatatcttttagttaattccttgagtaaaacagaaacaattgtctatcgtgacttttttcttcaagctctttaaaactctccccactcccaaactatatcactgtctaagaagaaaggagtttgaaaatcagtcttgttacatagcttaatttgaatacatccaaaaaatgacattgcattattttcatatttgctgaatctattttttggctggagtattttaaagtagatttttaaagtagatttcatctcttactacttcacatgcataggactttttctttatataaccacaatacttttatacacctaacaaaattaacaataatttcttaataccatataataaccaatctatgttccaatatccccatttgtccccaaggtgaatcaaaccaagattcagacaaggtgtacgtattacatattattatatctgcgaagccatttgttttttattcccatttacttgttgatgaaaccagttcagttgtcccataggaagtcctaccttctggatttgtctgataattttcctttggcgctatttgacttgttcttctttcttctgtatttcctaaaaactggaattgtgtatgacagcttgataatatacagattaaacattttgggcaagagataactaaaatcagagcagaactgaaggaaatagagacacaaaaagcccttcaaaaaattaatgattccaggagctggttttttgaaaggatcaacaaaattgatagaccgctagcaagactaagagaaaaaaagagagaagaatcaaatagacaagtagagccgag

SEQ ID NO: 189621 - DNA, 954 bp, Homo sapiens
  misc_feature (678)..(678): n is a, c, g, or t
  misc_feature (696)..(696): n is a, c, g, or t
  misc_feature (717)..(717): n is a, c, g, or t
  misc_feature (723)..(723): n is a, c, g, or t
ggcgggtcgggctctcccttgggtgcttagccccgcccccgtcccactctgccctgttgctgtcgcgccgctgctggttgctgtccctggacccctaccatggaggagaccatcaaagatccccccacatcagctgtcttgctggatcactgtcatttctctcaggtcatctttaacagtgtggagaagttctacatccctggaggggacgtcacatgtcattataccttcacccagcatttcatccctcgtcgaaaggattggattggcatctttagagtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtattcctttccaattccgtccagaaaatgaggaagacatcctggttgttaccactcagggagaggtggaagagattgagcagcacaacaaggagctttgcaaagaaaaccaggagctgaaggacagctgtatcagcctccaagaagcagaactcagacatgcaggctgagctccaaaagaagcaggaggagctagaaaccctacagagcatcaataagangttggaactgaaagtganagaacagaaggactattgggnagacanagctgttcaactgaaagaacaaaacagaagatgtctcagaaaaatgagaagatgggaatcagagtggattcagtttcaggcccagtgtcaactcaagagaacgaactggggaagctggttcagggagatcaagatacgacagagcagtagaagcagtgaaaagaggaagaccgaagaaagtcgaagcagacggtggagcaatgaagcgaatgaaactctgcatgggaacaa

SEQ ID NO: 189622 - DNA, 486 bp, Homo sapiens
tacatccactagtgtaggctggatctggcccataagccatggcttgctaacctctaaggtaaggcattccagcatcataaaacaaacattttccaataactgatgacaaaaatcaggaagaaactaagtttttaatttttaaggcacaacttttattactattgtttattactatttacttataggcaagagctcagtcagtataccactgactgcttcatgtaaatctttctaaatttgaagtatattttcccaaatcttaaatctaacacattatgtgtgtactcacgcatacccccatgaactctcccaaatgttctttattttcaaaatcgtgggtcaaaaatgtgtactttaaaacccacatcagatgctctgaacttggattacagtttccaagtacaaaaataatactgtttcattaaataaggcaacaaaactttagttagtaagaagggaaaaaggcactgggcctacactagtgga

SEQ ID NO: 189623 - DNA, 117 bp, Homo sapiens
ttacctggccctcagagagaagcatgtacattctaagagtttagagtgaaatcctggaatccttcccattctgtctccaaggggtgaaaattttgtctctttttaagaagaggaagg

SEQ ID NO: 189624 - DNA, 484 bp, Homo sapiens
agcacacccatcccagtatggtgacactcagcagctcaaactcagtaggtctgaaaagtgatcgctctccccttgacgctctccttcctgctgtgttccactcagcaaggcatccctccaggcacccacataagaaactggatgctctcccaggttcctcttttttttcttgtctcgtagctcatccagttctattgactctgtctctttaaaacccctcaaatgtatctacatctctctgttcctacagccgccccactggcttctcatccagagtattccaacagcctcttaactgggctcaacatcaggtcttcctctactttcaaccttttctaccactgcccagctgaaatgcagatgtcagttgtgtgaaatccttcggtgacccttcagctgctttcaggtaggctgcaaagtccttatcacggaatgcaaggctcatgcaatttcaccccacccatcttctcactcttgtctcttg

SEQ ID NO: 189625 - DNA, 424 bp, Homo sapiens
cccgtggggtgagggaggatggaggatgggaccggtgggccgggatgtgtctgactgagctgcccaggtcaccagctcaggcacagagggctgttctggtggaaggaagtctgggggaacacaccatcagctcattttggtgccagccgtggatggggtggaaatccagagtagggagcagcagctgaccggaagtgtgaccttcacagaagggtgaccgccacagcgtggccaaactccacgaggcagtctagagggagacagcgtgaccaggacagctcgcagcacacactgaagctgcagtcactctgcctcgccctgtggcccctggaccatgcccaggccaagctctgccctcctgccccacccttggggcatggttggtttcccagcctccctgagagctgccccctaggctgtgggg

SEQ ID NO: 189626 - DNA, 218 bp, Homo sapiens
ccatggagaataactccaccctaaaattttctcctagcaccacagactctgaaatctgtcaatcctttacttccccctaccaaaaaaaaatttttttttaaatgcaggggcataattttgatacactttcttttattgtcgtgcaatatataacttaaattttgccattttaaccattttaagtgtacaatgcagtggcattaattatattcacaatg

SEQ ID NO: 189627 - DNA, 277 bp, Homo sapiens
cttggccaggagtttcctttttaaatcagacccctcaatgagaggccccacagatgcagcctcttgcagacctgccagcccaattctggagccaggtttgttggattcatcctgtatgcaaacagcttctccttaaggctttcctctgaattcagctctggccccaccctcaaactgacttctaaatgatcccactcttgagcaggcgtctaagaggaatattttcgggaggtagttgtagttcatgttactgctgaaggccacccacctcacctcc

SEQ ID NO: 189628 - DNA, 517 bp, Homo sapiens
tcccgcatcctcaaaatgcccctctccctctgtgaccaggcatctcaaggatgtgcggctaccccggccaggactctccagggccccttcttaaagcagctcaggtcccttagtaacatgggcaacacagggtcacacctgctgccacggtcttcaggggagagtctgagccccagaaactcctcacaaacctcagagccaccaggtccaggcctggagccccttcccaagtctcacttcctgcacaactgtcctggggttgcctgtctaacgcgctccccagcccactgcctgctggttcggaggagcctggagagcaaggcccaggtgcatgggcctgccatggagtctgccccagtgccttgtgcagtcactgtccagctgagcaacttggagtggaggctgtgagacctgcctctgggcgaaaggccctgggatgaccttggggtgactgggagagagatgggggctgtggggaggagacgtggaggtgtaggcagggagagcggccggctgg

SEQ ID NO: 189629 - DNA, 406 bp, Homo sapiens
aaagtatatgatcagatagtttactaaaaagcagatacaagtgaatcttgtatttgtaaaaagccactcaacctcatccattataataaatatgtgtattaaaattataatagttttcatttctcagattggcaaacgcctgaatgtttaatgatatatttggttgaaaaaataagaaactgaaactgtcatacattattggtggccctgtaaattactacaaataatttggaggacaatttggtaataactactaaaattgcaaatgtcccttgacctagaattacacttctaggaatttatcctgtagaaatatccatacatggatgaaggaatgaatgcacaaagttattcaatgtggtgctgtttgtaactgaaaaacgttataaacaactttaatagggga

SEQ ID NO: 189630 - DNA, 640 bp, Homo sapiens
cccagtagattgtgcaagactaggggtggatgctgagttcccaacaggcactgagagacctgagctccaatggactgtgggaggccagggctggatggattgattggatggatggattgagaggcctgcatcccagtcgattgtgcaaaactgacgaccagggctggacgctgagttcccatcaggcgttgggaggcctgcaccccagtagattgtggggagctgatggccacagttaaatgctgagttcccatcagacactgagaggcctgcacctctacagactgtgggagctgatggccagggctggatgctgagttcctgtcaggcattgggaggccagtgccccatgagatggtggaggctagaggccagatacgagatgcacttctccgtgatgccttggagaaactcaacgctgtgggaggcaggcttgcctggtgccaagcactgtggggatagatgggagggggtcaaggagggcaatagtgggtttgagcaagaagtagacgcaggggtctccctaagtgggatgagtttctgtgtcctccacaagcatttcctgagcactcactgtgtgccaggctccgttccctgaaagcagcaatgaattttttttttttttttttttttttttttg

SEQ ID NO: 189631 - DNA, 543 bp, Homo sapiens
agccgtgttcatttacagataagaaaaccaaaggccaagattttcagacatttattcaaagtcagattctccatgttccacagcctccctcccattctgagtgcagctgatgttgcccatggtgggaagcctgtgtcactacacgttggttctctgtggggtctgttgggctgagtggtgcacacccatccagaccctgcctgcctcatccctggtgagggcagctccttggcttatttccttcagccagagccctgccctcaggtcttatagtcatgtctggtctgaggaaacggagactcagatcccttctggctaggattctgggctcagacactattctggctttgacatggcagggcctcctgcctcgttcctgtgtcccgtttccttctctgagtctcagttcttctaagaggcttctgtgttagttcctgttctgctaacgtgcctgatatccaggtcccgaattgggaccaagaccctgtcctgtccctttgttagtgataaccaggtgtggtggggagacatgggtttgaattc

SEQ ID NO: 189632 - DNA, 850 bp, Homo sapiens
gccgagcccaggcctgcaccctaggcaggcactgctccgtgatccaggaaccacctctctctacagctgggagtgagcagtcagagagggagacagccttgcccggtgctacccagcaagctagtcaccgagtgggcagagggaggagcggccctcaccggatgtcaagcagcctgggtccccagtccagctctgcctgtccctcgcaataacgcctcagatggggaaactgaagcccaatgtcacggaggtaggaaggggcagacgtagacttggaaggattctgtggcctgttcgaggttccgtgcatgagccgtgctccgtggagagccaggtctaccgttccagcctttgctctcccaggcccctggctgtccatgtcccacaccaccctgacacctgatacttgacacccgtgtcaccaacagctacagtgcaccacggccttggaacaccgcactcagtgctctgcctggatgagccctgtacccccatgacgaccccactgtggacattcttatgtccattttacagatgacgaaactgagacgggcggatgcagtgttgtgcacaagccacacagctggaaacgtgggctggggactggaacccaattacccgctttggctctataatcctctttttatttttatttaatttttttatgagatggagtgtagctctgtcgcacaggctggagtgcagtgacacgatctcagctcactgtaacctctgcctctcgggttcaacccattcttgtgtctcagcctcccaagaagctgggattacagttgtgtgtcaccacgcctggctaattttttgtatttttagtagagatggggtttcccca

SEQ ID NO: 189633 - DNA, 428 bp, Homo sapiens
caggcatgctccaggcactgggaacacagccttgaaccaacagacaaaaccgtctgcatgcatggagcttgcatcctgacaggagggacaagcaagaaacgaagaaataaatcgacagcattccattagttagcacctagataaaagagatatacctatagtgttcaaagcttgagctatgagaaataaaagagcaaaagatcgttttcatcaaaaggactatgaagcatgttatgttttacttaacaaaaccagtgctaaccatgttacatcctccagacttgaagtgtgtgggtgtgtttaacagacacaattttacctttttttcccttttaagttatccgtcaacatttttcagtctctctttaaagagcatcttaaatttgcataatagtcattcatcttaataaaaacattacactgttgtt

SEQ ID NO: 189634 - DNA, 161 bp, Homo sapiens
tcagttgaaaatccataagagcagaactgggacttctctgagaaggaagaaattctatctgtggactgtagctttagttcatgcctgagggttccagcctgctcttcctgatggcctgccctgtggatttaggacttgcctagctagccccatagtctcac

SEQ ID NO: 189635 - DNA, 626 bp, Homo sapiens
ttgtgacatgctctagtgtagtaccaggccataaagtgacactgttgtttagcaccctgaatttttccacacaggtagtaactgtccagaaacaatcaaaataagcaacaagtggtttgtccatttctaagaatcttagaatattagttggttgtaatgtaaagcattacctgtcactggaaagctggagagagtggccttaaccagaagtggccaacaatcaggtattattttaaggtctaaactttttcatctgtcagcaatagggaaacaacagttcaaattatctttgtagataagtacattgtttattacagggtaataagggaatgttatgaacaactttatgtcaataaatttaacagcctaaatgaaatggacaaattccttgaaagccaaaataccaaatgctcactcaaagagacagtctgaatagtcctatacatatttttaaaattgggcttgcagttaaaaaccttctcacaaagaaaactccaggcccagatgacttcactggtaatactaccatttaaggaaaagaactgaggtggagaaaatacttcccaagtcattttaagaggcaagcattaccctgatatgaaaagtggacagagactgtataagga

SEQ ID NO: 189636 - DNA, 188 bp, Homo sapiens
tataccagttcccagaaggctcggaactcagaccccacttccagaaagtagaagagttgcacacaggagtcaggttcggcaggatgtgagctcagtttgcagagcagaggttgtttttctcatttttcacattgtcggttggaacatgtttggggagaggcaggcagctaggatatcccggggcctca

SEQ ID NO: 189637 - DNA, 358 bp, Homo sapiens
agttttaaatataaaacaaaataaattaaaaaggttatttttcaatacgaattattttagatgtatccaatgatacaaattgccgtaatcagaaacccagttttacatttgtcttatttttttaagtctcagctttttactacgttatttttctagacagtgggtctcaatatttgtggtgattagaatcatctgtggaagtcatttaaatgaagattcctgggcatctagagattctaattcaaaaagttggggtgaaggatcaagaatctgccttttaaacaaacaccaaaatccagttattcagttagttaatccagttagtgtgctcacatcatagaaggagaaatgctgatct

SEQ ID NO: 189638 - DNA, 333 bp, Homo sapiens
atatatatcattttccttaacagtaatctatataattattatttaagattaaaaaatttttggcttgtattccaaatttctgaaacaatatttccaaatataaacctgacttagtgattggatttgattagaatagtagtctgcatataaggtgataatatgtctgtgaatgcaagagactatcttagataactgcttggttttcagatatcatgacagaatttatacatgtatgcatgtataggtgtttgcatgtatgcatttatttatttttaatagaaagcaaagggtaaagtaagctgtggtaaatgatattgacacagacaaaaccta

SEQ ID NO: 189639 - DNA, 635 bp, Homo sapiens
cctcctgagtagctggtattacaggcatgtgccaccaagctaatttttgtgtttttagtagagacggggttttatcatgttggccaagctggtctcgaactcctggcctcaagtgatctgaccacctcagcttcctgacatgctgggattacaggcatgaggcatcgtgccctgtgttcattccattttttgattttcgtttcttcgtctataaaatgggggaaatttcctatctatttggtaagcatatgctcagaatcaatttacataatgtttcagaatagtatcttgaaatactctgcaaaaatcttgcatactaattttctcagtaatatccaaatgcatttcagtttatttgcctctcgagtgtcatataccttttcaagtgtgattggatcagtgtgtatttaaaaactatgggaaatttcttatataactcatgctcagaagcaagaagtgctaagtaacatcatatccacttagtaatgttatatattcgtttttgtagtactgggtcctactctgttaggtctacctggggtagacctaacggtagacctaacccaggtagacctccaggtagacctaactagaagtgtgaaaacgtaggcttggattaaggggacagcgaattc

SEQ ID NO: 189640 - DNA, 380 bp, Homo sapiens
ctgcctcccacaaatcaggtttccttctgcctggatctgctttaaaactgtagcttgacagctgtatttaaggggcattgcagcacagggaccgctctgcacattcagtaagcctgctttgagcatcctttgtaaaacaggtgtggcacaggctacagacacagaagacaccagtattctgccctcccggaactcacagccgggggtggggacagatgggcattcccctgacagtcacacaaatgggaaaatgcaacctggggtaaccgcttcagaggaaaatcttaggggccaagaggaagaattagtacagcaggaaggctgagcctcctctggagcctctgcagaggtgagtttagagttgacaaaggtgggaacgg

SEQ ID NO: 189641 - DNA, 148 bp, Homo sapiens
gccaagcctggaggggggtggctcaggagcactgcagactcactctgcagggtggctgcctcagtgttcccatctgaaaaaggggaacaggtaagacggctcagattatttcagaggtgcttctagcagtgacctcctgccaagctgg

SEQ ID NO: 189642 - DNA, 464 bp, Homo sapiens
gtttcttgaacaaatatttattattaatcgtagtcaccatttactgagtgccaggcactgttttaagtacacattttttacttcatttaagcctcctgacaatgctgaggggaagaccatttcattttacagatgaaaaaatgtgcttagagaccttgaaacttcccaaagtcacatagtttgttagaagtagacctgggattttaactcagatctgcctgccacttcaagcccatatccttaataaacacttcattgcttactatgtgccaggctttgggaatagtgtagtgaataagtaaacaaaatagatacggttcttgtcctcccagagtctcttgtgtggaaaaagagaggaaaacaagctactattatatgttataataaatgctatggaagggaaatgcagaatggagtgctatgagagcacaaaagcaaacaaactagatttggggtgcaagggg

SEQ ID NO: 189643 - DNA, 335 bp, Homo sapiens
aaaacagttcagtgaatttcacgataccagatacaaagaacctaaactggctactctataaaatgtctactgtgacttggagtgatgacagtggattcattttggggatcgggggagatgtatcctgaaagaataaggggctcactttgtgagcaacttgtgaggaagccatctgggaagatacataacgttctgtcttggtgggcacctggcttatgcatgaggctagaacatggggtaatgcaaatacagctctccatttgggaacaaaaggacagcagtattgcatgcctcagattcaagcttgacttctctatggctagtgagttggggcc

SEQ ID NO: 189644 - DNA, 669 bp, Homo sapiens
ttacatagctgacttgtagggtggttgctcttggccatagttgttaggagcacagcaggtaatgttagactgacctgggttctattccagcttttccacttcctagcagtgagactttgcacaagtgactttacctgttcgaacttatccaagcctgaatttttgtactggtaaaataatagtactcacctctcaggattgtttagaggaaaaagtgagataacagttttaaatcacttagcatagtagtcacttgattgttgctactaattgttcccaacatcacagtttcattatgataattattattcgaaataataaataacttcctatctttgtggcctttatgaaaggtctctgggaacctctattggctacagcttagggtgaacagtttgctagattcatctcctcacatactcaggctaagttacttctatccaaggtaattgtcttctacaaatacaacctgcttaaaagttaggcattacaaccacaaagttatcagctatggaggtcaaagatactgaacatttcacttaggctgcatctcttttcacttctgaatctactccttcaattatctagaccggtggttttcaaaacttttgaacagcaacataccccttttgtatccaagtgaagtcatatacagaaccacaacacata

SEQ ID NO: 189645 - DNA, 130 bp, Homo sapiens
gcctccattcttccatctgctgccagggtcacctcctgtgactccttcttctcagcccaaccctgccaaaccacttgcaatccttgggacttaactatacgctgttaaactgccaaatctctactcgtgt

SEQ ID NO: 189646 - DNA, 113 bp, Homo sapiens
tgtttgaggcataacacctaagagagtaaagaaatctgcacaattagacctcacgttttagattaatatttaaaatccagctgcttattactggggagaaaaacttatcagta

SEQ ID NO: 189647 - DNA, 454 bp, Homo sapiens
tttccctcgtttagggagttatattcattctaaggagggcatggacagccttcctgagaaggaagcatttgagcagagtcttgaaaggggtgaggagggagtgagccttgaggctgccagggtggaggcggggcaggaagctgggcaggcagggaggccaagaaggttctagggggtggaggagcctgaggtgttggtttaaggagcagcgagagtgggtgagtcagagcccccacccccaccccaggaatcctccttcggagggagcggcccactgtggaccaggctgccactcctggaaccttcggaattcaccttgcgctcctctgcccaggcggctctgcagtgtctctctctctctttttctgtctctatgtcagtctcctttctacctctctctcagtctctttcttctccatttttactttttcttttattctaactccctttcctt

SEQ ID NO: 189648 - DNA, 901 bp, Homo sapiens
gtgtgagccactgtgcaagcctcgggcagttctttatagcagcgtgagaactgactataacaccacccaaatctaaattcataatctagatctttctccttcactgtactggcagacagtacaatgtagaggataagcacatagcctctgaagccagactgccagggtttgagatctcagctccagaactttactacctatggaatcttggtgatgatgttctttaccttctctatgcagcagtttcccatctgtaagacgggagcggcagcagctgctatctcaaaggattatggtgaggatgaagtgcgttgacatttgtaacggcctcgcacataatttgccctgagtaagcattagctggctgagcaccaaccccactaggttcaccacctgggtatctcatgcttacttcagactttcattatgtttaaaactgaactcgttttcaaacctactcttccttttaaatcccctgtcctaggtaatggccctcaccacagtcacctaaattgccaagccagttctgtaacttttctccctttctctcaaattctatcttactggaccctgaagttgtacctaactgccattgtaatttgcatgtatatgctcttctctttctccatggctgctgtcttggttcacatgtgtgtcgtcttcacccacactatgccagtagtctgactgggtctttttgcctccctactcacccctgcacactgctgtattcactggaaaagcaaatctcattgcttcttttgcttaaaaatattaaatggcttcctattgctatcaggttaaaaatctgacctgtgctcttcactgtgattttgccccccaggggacatttgacaatacgtggagattttattgttattgccagaagtgggaaagaggt

SEQ ID NO: 189649 - DNA, 139 bp, Homo sapiens
cactcctcacatcttttatgacagttcacaaagctaatttcaacctactcaggttagcaatctgagcaattccctgctcccaacattatttgcagtccaaataattcgcttaaagctcaagaagcaagataaagtctag

SEQ ID NO: 189650 - DNA, 606 bp, Homo sapiens
tcttagccttttgaggtttcataaggagcatggcgggttaattccagttaattactgaggaggaagggtttttcctttacagtcttaagttattcactctacccattatctcagaaagttggcacagattggagataagtttgtactttctccaaactttaggccagtttggctgccatctccactttgaagccaggacttcaatctgattccctgttgatgggcacattaccattggtaaaaacatttatgaggtatttgatggaggttattgtgtcttccttctgtataaggaacattaccattaaattagaacaagtgtatagtctaaccaagaggagttgccccatggtgggtacttagtcaaaaatgatcaaatttaaggacctgtcccaatgtgaaccaccaggagtacttgtttaaattgtggtttcttgagctaatagttgaagactgttgttgtaggctactgctttctcaaacgtacctgataaaaatcatttgtagtaactgtttagtatacaactttccaggctcctttccaaaagattgtgtttggtggatccaggatgtggcctaggaatttgatttttaacaaccatccca

SEQ ID NO: 189651 - DNA, 211 bp, Homo sapiens
aagagaacaagactagaagactactaccaacaactatcactatcattttaggtaagaatggattacttaacactaaacaagagcagtaagaacaggaaattaaggcagttcattcatttgaataaatttatctttagtgaaaaaatcatctcattagttttatttctctttttatcacagacaaatattttgaaattactaatatatttca

SEQ ID NO: 189652 - DNA, 156 bp, Homo sapiens
tctccacctgctgtaacacgcataacttcttccctcaatccagaaaacccgagcagtgaccctgctctttatcaagtgctatggcaaaataacttccctagaaggccaggacaccttaccctaggacatgggcgagaaatcaaaacacacatgtct

SEQ ID NO: 189653 - DNA, 394 bp, Homo sapiens
agtggtacccctcacggattactcaagtgatccacccaccttgtcctcccaaagtgctgggattacaggcttgagccaccatgcctggccagccaacctctttttcatgtggagtggtaccttctttagtacctctgagggtaccacagagataaaatagacatagtcctagttatgcagcttatagcctggaagaggaagtaattgaataatgaacaattgaacaaattaattaaataatgagataatttaagattgtaatgagggctccagagggtgatgtaagaatatgtaactggagaacttagagcctagtcatggacaataagggaggcttctcagaggatgtgacatttaggccaagcgttataggatgattggggttggctgggtg

SEQ ID NO: 189654 - DNA, 386 bp, Homo sapiens
ccgcacagcttctccgccccacagcttacataagagtcttacaaggtctccacttggaacagtcctaatattacttactagatccactgaaacaacccagaggagagaataacaatacaagatattattaaagaaatgctgcctttttttacagcatatttttgttgctttttgtatattaatagcttcttatataatacttattccactgagacctaaatatttatattttatgagtctatatattcattcaaaagtgattttatgccctttaataatattttgtaatttttttcataaaggtcatacaataagacttttgttagagttactgttaggaattcagaatctgtaacctttactcaaaaataattttaaggtgggtg

SEQ ID NO: 189655 - DNA, 124 bp, Homo sapiens
gcctcctcagagatctgtgtctctcgctgagttcccagtctcatgctctatgaaagtccttcctaaaagccaccattcaacatgagcttctagtcctgctgactcaaatgatgacatcttgtta

SEQ ID NO: 189656 - DNA, 141 bp, Homo sapiens
aaggaccctcctgtccagctggcaagaaggacttaatttttggtttcaatttctttaaagagaggagaaaagggcagcggggcctttttaatctctcgcatgacaactcacagagtgcttccaagtctttcatgtactctc

SEQ ID NO: 189657 - DNA, 935 bp, Homo sapiens
tgggtggctcatgcctgtaatcccaccactttgggaggccgaggcgggcagatcacgaggtcagattgagaccatcctggctaacgcagtgaaaccccatctctactaaaaatacaaaaaattagccgggtgtggtggcgggcgcctgtagtcccagctacacgggaggctgaggcaggagaatcgcttgaatccaggaggcggaggttgcagtgagccgagatcccgccactgcactccagccagggtgacagagcaagactccgtctcaaaaaaaaaaagaaaagaaaacacagtgctatgttcaaagcaataatcaaatatcactggtcaagatttcaaagtaaaaaacagaacttatatatacccatttccaaataacagctttttaaatatatataacattacatacattattaaactggtctatgcagatatttctgaccacaacctaataacttatttagataacagctgtattcattgagtgcagagcagagcaaaataacttgggtaggttctaacatcagttctcctgagaagcaaagttcagtacaacataagtaagcagcatgtagttaaaggtaaggtaaagatttcaagaagcaggaatcctgtactctctcaagcacagaactggatgtgtgacctatggcacacacttcagcaatccagtgaatagtcaatctactaatctaccctctgaaccagtttggtactatacccagtttggtgtcctcttttgtgatttttttttgttttgttttttcttttgaagacacagtctcactctgtagctcaggctggagttcaatggcaagatattggctcactacaacctccgcctcccaggtacaagtgattttccttcctctgcttccggagtagcttggattacaggcgtccgccaccatgcccagttaatttttgtattt

SEQ ID NO: 189658 - DNA, 177 bp, Homo sapiens
tcccatcacccgctgcacctcccctccttccggttcaggcccgagcaccctgaaatctggattctgtcccccagcgccccagctccatggcttctaaacctaaatccattgaaaccttttctgtcctctaaattgactgcctaggttccaataacaccatggtcacctccttccttt

SEQ ID NO: 189659 - DNA, 189 bp, Homo sapiens
ggtcacctgctacacgcaaaaagaaaacaaagcaaattaatacagtcaaaattcaacggcaccttcaatggtaaaatggctttaaattgtgacaaagccccaggggtccctaaggcatttctagggtttctttaaataaaaaaaaagtgtagtcaatcacagacatgtttgctttttctctgcaccgtt

SEQ ID NO: 189660 - DNA, 218 bp, Homo sapiens
tcaatttccacaccgaatgtagacatgcatggcatttattaagccctttatggtaagcttactctattcaatgttaactttgtttaagctgagaaaatttatgcaaactaaatccacaaggtgcaacccagcgacagatgcagcggacatcactttaaggctaaaaaaaagttgagctaaatgtgtggcagacactgcagcctgtgtgaaagttgaag

SEQ ID NO: 189661 - DNA, 549 bp, Homo sapiens
gagggcgggtctggcatgcaagggacagaagacacaaagcatccttttcttgggctttgtctgaatttgtcttctcacgttttttcctgtttacaaaagagggtcatgttcctagttagtcacactctctcatgtcttagaggcatgagcgctcctcctaagctgaagtgaaattgtgaattctgggatgcttaggtgactttgaggaggaagtcttcagtggttactcctctggtattctcagcgtgtggtgggtgtgaatgtcctccctctctgggctgagggaatctaaaataacaagtcctagaatcatagtctccagtttagatgagacccacaagatcccctagttcactgtcaggcactcgacttccctgcgatgtccctgtcaggtgcttgtgtggcctcctgctaatgctggaccacagctccatctgtaggctccgtggctcagtggaaaacccttccttctgtagagctgggcaacttccatgagacttccacagggttttctaagcagttattctgtcttcccttataagatccctt

SEQ ID NO: 189662 - DNA, 311 bp, Homo sapiens
aattcaaagtgaaatgggttctaccagccactcaaccagaccacagaggccctagggaggcagcaagctcaggatgggtcctgggcattgttttgcttggggaagtgaaactggcatcctttgcttcaaaggcttcatccctcctgacttgaaggtgtggccttgaccagagtgacaagattgcaaacactggggtgaagaaaatgtatcaggttgcagcctttttccttccagaatattctcaacttcctgttgctttttcaaatcagttacattttcagaagagactcttagtttaaagcagtgcccct

SEQ ID NO: 189663 - DNA, 762 bp, Homo sapiens
ggcttccgctgaggtggttgcaggcctggggcagagcctgggtggtcagaggccggggctagaggcagatggaagggaggcatttgctgacagaggacggggcacccgggctccccactgcagtcggccttgcctcctcctcctcctctacctccagtcaggctggacgggagggtagccttgtggctgagaggggtcagactaggtggcacaggggctcctggaaagacagcaggcttcctgctgggcgttcccttgttggagggaatagagtgggggtgggactctgcaggggtgtccttgtccactcgcacccctcgccgcccaccagggccatgctctgtgacttgggctgatccccaccctttctgggcctacagcaccacaggccgctgtacccccttagagctgcccctctctggcctggccggcaggcgtcttcttaactcctctgtcctctatattcagcatgttccttgtcagctgctgggccggccctgccttgcgctagcagagcctctcctggcagcttctcaggtctccctaatggagacaccaggctactaggacactggctggggccaccccctcctgcctaatgcctcaccttacagctggggaaactgaggcctggaatggcccagagtcaccaaggcaaagttggggctggtcccagcctgaggctccagctgatgccctcagctcccagagagggggtgccccatctagctgggtgcaggggtcactgcttgtcagctcagg

SEQ ID NO: 189664 - DNA, 288 bp, Homo sapiens
gaactcagaaattatttgtagttcttctcccccgctccaccctgcccaagaatgaggatatagagtcaaacactgtgttcagcagttgtttgtgttagctctatcccccttttgcaagattatgatatttatttgaaataaaattgggttactttatttagtttgctgtcagtgttaggttttctttttgttttcatttttgcctacttcccattcttactgattttttttgaatatgtggaacattaacatgcttccaaaaattaaaactatacaaaaatatatccc

SEQ ID NO: 189665 - DNA, 607 bp, Homo sapiens
caggggattacacaaaatgcgtatgtacacatagtcagcactcaataattggtggctactttattctcaccatgaatataatttgggatgcttttggctgcaggtaattcaacccaaactcaaaatgcataagcaataaatgcatttctcctcttgccttcacttctcctcctgcttctccttctcctgcttctcttaacaagaagtttagaatttgggcaattgaattagaggctcaacatcatcactagcttctttcttatttagtctgcctaggttaattagatttcttaaatctataaaatgttgtagttcgtcatttttggaagattgtcagttattatctctgttctttttcttctttccatttgagatctcaactgattgtatgttgcaatttctcgttgtatagtctatatttcttattattctagatatttttatctccctttgatgcattctagataatttcctctgacatatcctccagtttattctctttttagctgtgtctaatctgcaattaaatgtgttcactaacttcttaatttcaattattgtattttttagtgctaaaatcccttccctatttaattatttcccaaat

SEQ ID NO: 189666 - DNA, 190 bp, Homo sapiens
ccccctttgaggtccagtctaaaagtgtcagacatctctgaccttaggtgggcaccagtgttgctttgtatgttttccctccagaggcaatggcctaatatgagcttttctcttgtccctggatgaaggtctcagcttctagcttcctaccaatttagataggccatatcttcctgcattccttgcaaga

SEQ ID NO: 189667 - DNA, 195 bp, Homo sapiens
taagtctaaacagtgtgggacttgattagtcacctgttgctgcatgacaatattaccataaaatcagtggctccaacaacatgcatttactctctcatggtgtctttgggttaggagagaggcatgctttagctgagccttctgcaaggcttcactcagcctgtgagttgggctgcattctcatctggaggttca

SEQ ID NO: 189668 - DNA, 487 bp, Homo sapiens
gttctgaggatcccagaacgctgactcttatcactttattttttttattataacattgtgaattttttcacttatatctacatagtattttttccaatttttaattatgaaaaatttcagtcatacacaaaagtaaagaatactgatgcacacaatttcaaatcttatcaagatttcatcacatttcatctatctgtttttctgtttctttgctggaatatttaaagcaaatactagacatgtacataagtcttataaatatcacgtaagtgaatgtaccacacctgtgtgcacattcccccagttaaacatttgttacttccagttattcactgttgtatacagtgcaggcctgtcatgtcatataggtggcatgtctgagagtttcacccatgttcatgagccataacatttaggtgtcattaactattaccacagttcactgcgaagattttctcgggtagacagcgtgtctttccttagtgtg

SEQ ID NO: 189669 - DNA, 218 bp, Homo sapiens
gagaagtacttcctggatatatatggatccaggcaaagcttaaactaattcaccctaaaggaaaaataagcttaattctctcaagcataattttattttaagagattgcaagggttaacgtattatgaattagtgaaaaccatatgactgatactttaacaagtatctttggtggagccctttttattctaggcaatctacctccctggcacatcaga

SEQ ID NO: 189670 - DNA, 647 bp, Homo sapiens
aactgatatgtaacaataacctttgccaccaaggaacaattggtacagttcctctttggtcttggcacagagaagcagtcttaaacctccgtaacagtccttcacccctctaaaactcatgaagagtttttaacaaagtccccaaatacactagagctgatgctacaagggggacctttgggcaagtaaagcaaatttactatttccagttaactgcaggctgagtatttaaagaatctgacagtcttttctcaaaaaaaattagagttaaccctaactaggtttcagaacctacagaaatcctcagtacctaaaatagctatttaagtataagtaaggaatagtaagtaacaagtaagttacaagcagcatttcagcatctccttaaatatttaagaatatctcagggtggagttggacagttaaatcacataaataggcaaatgtatttgctaaaggagcaggccaaagctgaagagttaatgattctcaagtgtacaacattatctgtgtgtgtgtgatgggaaggtggtgtattttacttgccatgcctttttcttacagctttcaactgcttcttgtttcctcaagtgtggatatctgttactggcttgcatccctcttttttgaggtatctaaccattctg

SEQ ID NO: 189671 - DNA, 488 bp, Homo sapiens
agtgtggtccctgcactagcaacatcagcatcatctgagaaattgttagaaatgcgaattcttgagtctcaccccaggcctactgagtcagatactctggggtgtagcccagcaatctgtgttttaataagccctcctggagattttcatacatgttcaagagtaagaaccactgctctactaaaacctcaaggtataagtcagacgttaagaactcaaaggctcaccgaggccaagaaggacacatgaatgagggaaaggactggaaataagattatcaggagtgggaggaggaaactgtgttgaattggagagctgcccttgcttaatgggagcagctagtgattattctagacattggttcccatttaggaatgtgaagcaggtccaaatataattttccaaaagctgaaagaaagcatgactgtcttacaaatatacagtgaacgtgtcaaagattaatttaactcataataagaatttagtaa

SEQ ID NO: 189672 - DNA, 234 bp, Homo sapiens
tgtagatgggaatgtgaaatggtacaggcactttggagaacagctgggcagtttcttagcaggtgaaacatacacttaccatatgagccagtaaccccactcctcagttttcacgcaatgaactaaaaatttatgttccccaaaaaacctacaggtatataattatggtagctttattcataattgtcagaaactggaaacaacacaaacatccttcaacaggtgaatgggtaa

SEQ ID NO: 189673 - DNA, 102 bp, Homo sapiens
ggctgtgatgtgtcttttgggaagaagggtgggattataatctcactccggttagagaaatgatgggtaacctttaacaagttattcctcttttgggggctt

SEQ ID NO: 189674 - DNA, 267 bp, Homo sapiens
atttagtaacctcttctccagagtatataatatcaaatcagacttaagattattaatgtatttgacataattatttaagaacagtgagactgtataatctttccattctgttcatataacaacttcttaaaaattactttgcctttgctggggtaatacatgcttctagtctgtcatttttttttccatgctggccttcataagtaacattaagttctaaggtaacatagtttgttaagaagtctgtaaaagaaactgttcagccaa

SEQ ID NO: 189675 - DNA, 140 bp, Homo sapiens
tcaattttaggcactttaagtaatgcttccatgaacgttcttgtcaatgttgacaaatgcaagagctttccatggggtatgtaaaagggtgattaatatttccttccttgtattggtggggtgggcttatggacacagca

SEQ ID NO: 189676 - DNA, 372 bp, Homo sapiens
tgtcactttgtcgtccaggcaggagtacaatggcgcgatctcggctcgttgcaacctctgcctctggttcaagtgattctcatgcctcagcctccttagtagctgagattacaggcatgtgccaccatgcctggctaatttttgcatttttagtagagatggggttttgccgtgttggccaagctggtcttgaattcctgacctcaagtgatccacctgcctcagcctcccacagtgttgggattacaggcataagccactgtgcctggccaagacatttttattgggatgattttgccatttgattgtcaagtcaaaagttttcttcggctatcagtttttatcaaagattggtacttaggataaattttg

SEQ ID NO: 189677 - DNA, 250 bp, Homo sapiens
gtgaactgtgctgtgccaactcattgaagctgagaactcaatttcccagaatttcctccccatgtggttatggttagagatgaccaaaagaggaacatgagtgaaatttggagagtggagacaaagcagtggccgtgactctctgaaggtcactgtggtccggtgtgatggtgggtggtgtctcccgagatcacctcccaaaaacctttttttttttttttgagacagggtctcgctctgtcacccaggc

SEQ ID NO: 189678 - DNA, 308 bp, Homo sapiens
tcaagtttcagctgctcaccacccttcctgactatttcagtgtgtgtcaaattttgctttctccaaagtcataagaattgtaatatagtgcccaacaatagataacctggtagatagcctggcagtgctgattgtcttggtgtttagattggcacccaatctagattatgcaccttggcaggcagggacaccatctcatacttctcacgtgtctcttgcccatttctcctatcagtgaatttgttgagtgatcaatttactttgagttaggtctacctgggtaggttacctgggttaggtctacctgg

SEQ ID NO: 189679 - DNA, 247 bp, Homo sapiens
taccaatgatccttcagtctctccctgggcacttccaaagatggaaatttactacctcttcaagcagtctgttccattttagcaattctgatttactctatccccttaaatgtccatttattccataaaatatttactaaacatctactacatgacaagcatcatttcaggtgctaggaatatggcacagaacaaaacagtctggctctcaaggaacttacactcctatggagagaaacatataatc

SEQ ID NO: 189680 - DNA, 187 bp, Homo sapiens
cctaaatgtttctcatttcctccttacccttgcactactcagcttccaaggaaattgacttccagagcaagcaatatcaaggcacagaagctgacagaatgccttctatgaggacaagaagccagcctgccaaaggctcaggccctagtttttttgtttttgtttttgtttttgtttttgagacttg

SEQ ID NO: 189681 - DNA, 484 bp, Homo sapiens
cacatggtaaatgcccacgatgcgatgtgcgcggaatgtcagaaactgacaactagttcaggcctcaacgcagtaggaaaaggatgaaaaagaaactcattttaaatcaactaaacaagtgcaaaagccatacatatagaggagaggagatacgaatggcatcacaacataattcctttgccatcgaaaacttccatgcctttgaggttttaaatgaagacttccaaaactgatttacttaagactctacgtaaaacgcctgatctttaaacgcaagaaaagcaagatgaatgtattactttcctggaaaaaaaaagcattaaaggagaaaaaagagtaaagtgtactgatgggggtgggttctcacatcacagggcactgcagctgagacgtgcttgaacggcccccgttttctacccgcaaattctcaattgctagataaacaacataaccacactttattgggcgcacatcgtcaaaccct

SEQ ID NO: 189682 - DNA, 239 bp, Homo sapiens
ttaacctcttgttgtgtgttcttccagaccttttcctatgtatggatggagctgcatacattgtttttctttactgggttcagaaaaatgaaatcaagctattcatacttttctgtattttgcttgtgttcatttaaaaatatcatatagcaagctttcaaagcctgaacatatagatccacttcattattttcagcaattccattatttctataacaagacttaactatagtttaact

SEQ ID NO: 189683 - DNA, 240 bp, Homo sapiens
ggcacatgcctgtaatcctagctactcgggaggctgaggcaggagaattgcttgaacccaagaggtggaggttgtggtgagccaagatcgcgccaatacactccagcctgggcaacaagaacaaaactctgtctcagaaaaaaaagtaagcacagacttcttatattaaaatgtagaaattaagagagagagtgtgtatgtttatgcttgcttgtctagtgtttgcataaacactggaag

SEQ ID NO: 189684 - DNA, 291 bp, Homo sapiens
ttttccaaatctgatttaatgataagacactgagtgttgagagagcaccgaattcaatgaagaaggttaagtgcaaaacaccatgattttcttgagatgtgagtgtgttgagggagggggatggagagggagagcaggcaaagggagcagaagctggagaggggaggttgacgggatccagatcagcatatcttactaggttagtatttaatgaactggccagtatcagagtgatttggaggtgccaattaaaatgtgaggagcactgcaattttgtgtccagggttaagt

SEQ ID NO: 189685 - DNA, 321 bp, Homo sapiens
ctaaagacaaaacttaaaagggagttctggagggaggggcatgaacaggtggtaaggaattagcccagccagtctcactataggcaagcccactagtcaactggtgccatgttgtacccacagagcccctattttaaatatgactgtagacagtggctcactcctgtagtcccaatgctatgggaggccgaggcaggtggattgcctgtgctcaggagtttgagatcagcctgagcaacatggtgaaatcccatctctactaaaaatataaaaattagcagggtgtggtggcacatgcctgtagtcccagctacttgcggg

SEQ ID NO: 189686 - DNA, 518 bp, Homo sapiens
aatcatgggttctggttatgccaaagcactcactcttcaaaagtttccatccagagttggataatcccacacagaaggtgttctttcaacagaccagcatccaatagacccaatgcagcatttttcttcctggttccacattaatacatcctatctctgctatgcttaggtccctgatttataaatatttcagacatattttctcaggacacagggagtacttaaacttccacatagcagagatacgacatacaataagctgttatctggaaactcctagtgatgctttgagtactttacagtaatctttctggtcttcctctcaaccccattaagtttttctagaactagctgtgtggtcttagacaaatcatgtagcctctgtgagctccagttgcctcatccgaaaataggggtaatatttcctaccttagagagtgctgttatgattattgagataaagtattacagatgttaaatgtttaataaatgttaacatttattatttttctacattc

SEQ ID NO: 189687 - DNA, 526 bp, Homo sapiens
agtcgtgacgggagcgtgcaacacagtgaccctgcgcactcagaggaccagtcatccagtttatatcgtcgacactgggccattgtaccgctgactctcagctcttcaaaagggctcatcagaaggaaggaagaggcagaagttcaaaggacttatctcacccctcatttgttattctaatagacttcagggggagatgtgcagtgaaaatagaattggtgaccagctgggtgaccaggtgagaaaaaggcattacatagatgatccctttccctcagttccaaagagtaagcaagcactggagtgtggagtcctatgtgcaccatcatgtgatcctagcttgttcatgggaacctgcctttaaacctgacctctgacaactcctttccttcctcagcattaagaacttcagttctggccagatgcgatggctcatgcctgtaatcccagcactttgggaggccgaggtgggaggatcatgaggtcagtagttcgagaccaacctggccaatatagtgaaaccccg

SEQ ID NO: 189688 - DNA, 419 bp, Homo sapiens
aaatcaccccacacacactctcagatcacagaactataagaagacaagaatgcccactctcaccattcctattcaatatagtggtggaagtcttagccagaaaaatcaaggaagaaaaagaaatgaaagacatctaaaaatgaaaaaagaagtaaaaccatctgtcttcactgactatatgattatatacttagcaaaccctaaagactccaccaaaaggctcctggaagtgataaaggacttcagtaaagtttcaggatacaaaatcaatggacagaaatcagtagcatttctatacaccaattacattatagcagagaagcaaatcaagaatgcaatcccatttacaatagacacacacacacacacacacacacacacacacacacacacacaaagaaatgcctaagtatacatct

SEQ ID NO: 189689 - DNA, 271 bp, Homo sapiens
cttttggtactaatgggttgcaaatatgcattgggggtgaggaggccactggtgttggacgtggagctttgtagttggaacgatggacgtgccctttgtgtgggggtcatgcagtcacgtgctcggtggctttcatgcagtgtcttcgtagggtggggagggatggcaggcattcagttggtggcaggttgtgttgggtcctttccaagctttgcttcattcaggctttaagcaggacctggcccgtgaggcacttggtgcagagtgagaa

SEQ ID NO: 189690 - DNA, 179 bp, Homo sapiens
tgctgggattacaggcgtgagccaccactcccagcccaataatctgtaatttttatcacaagttcccctttgggagcggcagggtttttttccagtttttcacaccctggagagagactacacgcctgcttgaagggcaggccctggagttccaggctctttagggcagctgtttccac

SEQ ID NO: 189691 - DNA, 351 bp, Homo sapiens
ctgtccactggcgtttgttatagcctcgtccagcctcctccatcaggaaagccaactcatcgtttcagcggtgtatcctgggatgaagttgtttcgtgcagtctatccctgtttcccatttcttgaaattcattggtaactttgccccaacaagtgtcttgtaaccacttccctcgttctcattattgtttttcctttttatatttattatctttccagtagaatttagtgaagaaatatagtctgccatcttgaattgtggaacagcatgcatttaaattgtattttatttaatttctgcctgaaaatattgagttctcagtgatttacatcagttggtatgtgacagct

SEQ ID NO: 189692 - DNA, 377 bp, Homo sapiens
ggtgcgggtgcataattgcataatatattcctgttacaatacatctaagtagtcaaatatcagcaatggaatctgattcaaccaaatacataacaagatcgaaagggaagtgggaggatattgtcaacaggaggagaacatggcaagtagatgagaaagaagggaaactttttatcttttgctttgtaagaatctttactgcggaaagacttaaaaacagtgtttttcattatattgtataagtcctcaaagtccaaaaaaagataaaaaactatagagcattactcttacccaaaatgactcagaggtacactcttgggtctccattcaaatcaactccacagaatatgcagactccaggtctcctcagaaagctc

SEQ ID NO: 189693 - DNA, 2304 bp, Homo sapiens
  misc_feature (1644)..(1644): n is a, c, g, or t
  misc_feature (1918)..(1918): n is a, c, g, or t
  misc_feature (2302)..(2302): n is a, c, g, or t
aacctattatttcagataccattctgcttaggtattcagtattctcaagggatttttctccacaataagaaaacttgatgcttccagttcttacctcagtatgccactgataaagtaaaacagatctaaaagaatagtttcaaagagatgtaaaatgacaccttatgtcaacttgtcttttcctttttcatgactcctttttcttctttctaacttttggcatctgtaattgagatttccttccaagcatatttagctcaacttaaatatacttcattgaggctttggcaaaccttttcaagtataaggataatacagaattatctatttttctatagtttgttttattgctgctgttattgttgttttattttgtttgctataaagattagcctcttgttcaatggaaaatatgatcaaaaacagtgttcaaaaattatttaagggccccatcattacagcaatcattagtcctactgtgtatgaaatttctaagtatttctaaatgctcaaccctagacatgcccttcactgatatttttaatgtgctttcagtaccttggccatttaataacttatgttcttttttcaaatcttaggaagaaattgtgttttggaattgggccaacagtatgtgtttctccggtggataagcaaaatttcataagaacaaagatgattcaagcagatgtttatcatgaaactgccataaaaagcacccgaagtcacaaagataaacatcaaatccagtccttggaaatttcccccaccctacctgagcatcttttgaagtagatattcaattattttgaaggatttttaaagaattttctagatttcatctaaaagacacttttgaaatctgcgttaaaattcatggaaatatatcctagatgaatttggaggaatgtaagcaagtaggtacaaacctttattttatccctcagtgactcactcagttgtgaataggaagggctctctgtgatctggccacagcttatttcttgccacattcctattttcagtcctcttccaatcatgtggaacttccagcatctccttacacatgccatgttatttcacacttttgtgactttgctcatatttttctctctccctggaaagctccccgacaacctccactgccattacccactaggcaagtacatcctgttttcagaatcagcccaatatcatctttcctagggaatcttgtcagactgcccttcattaccaacagacaaaataactaccttatctttggttctgtcttcactctagacctatgtagcatgctacttataacactgcattggtttgttggcatttgtattttccactgagcaaccataacttatgtgtagacaaaaattgtattgctcacctttggattactaggacctagcagtgttctgattcagagtatgtactcaataaattcatcttgaaaagtgaatgaatgaataaatgaacgcctgcatctccatcattgatttactatttaatcagtgaagtttttaaattatattcccccatatcttgagatttgatcttgtgttaaatcagttgcacatattagacattactttgtccttttcacttctccttagcacatatgggctatataatctttataaaggttanagaaatatattgtaatatgttataacacaatcaagatacatctgaaacaacatagtgcaggcactatttccgatgttcaacatcatgctggagtaaaacttagagactcttggaaaaaagaaatacttaaataatgtcaccagtgtaatgtgctacattgtaatggtgttatgcttattacatgtgttatctagtaatgcacaaaaagcctaatggatttgctcatattttcctcatgtgcaaatgaaaacactgagtctcagagagattaaanaaattgccaaatgtcatgtcaagcgattttgatcctggtatttctaatataaaagcccatgttttaatttattaactgtttgacatataacaataatagatcattacatgttaatataaataacctatgtatgaagactaattatatttttacttctgcattcaatcaactgcaacatgtcattttggttgatgtgtacagaaaatactcaacatctcgcagatattgggttggaaaacagaggacatttttatatctgtttcagataaatgtatatatttttctttgatagtacaccaaaatttgacaagtgactatttcttaaagggtagttgcagcatgaaatccaaaataacatcaataaacttttcattctctgttacnct

SEQ ID NO: 189694 - DNA, 242 bp, Homo sapiens
ctcctttacccctccccttccacactcttccccgtcccttcatgcttctctccctccctcccacaccagatggtgactgagtgctcccatagattccacctctagccaggcaggttcacacatctgcaggagtaacggtgatacagcgtgatggggactataaccagagctttgttctttaaaaagaaaaaacgagggccaggcgtggtggctcttgcctgaaatcccagcactttgggagg

SEQ ID NO: 189695 - DNA, 280 bp, Homo sapiens
cattaacaacagtcactctcctcccaaggacagcgcaaaaaggaaacccacttaatgaaacagatgtgcttagtgtattttagctcatcccttaaacagtcactaaataccggcatcccattggatttgtctaggcttacatcaaggaagtttcttctcttaccaaatttcttacatcgcctgtaaagaaagcacattctttcactcaggtgtgtctcctcagctcctcttagctcagtcttcagtttgcttcttttttattccttgcccttggtttcca

SEQ ID NO: 189696 - DNA, 719 bp, Homo sapiens
agggctctggtttaaaaagcaaaaagtagataaactgtcagtgtggccaagaataactgatccattttattaactgataaatactatgatttaatgcttttgcctttaaatttcagtacattgattaaacctataggggtttatgaaaaggtgctataacgtggaagggaacaacaagcagattaaaaagattaagttcagatttaaaatattaagcaagatggctgattagagactcctggtgctcgtactcccaacaagaaaggaccacagcaatgaatgaacagctaagatttgactggcgtgttgaagggagagtactggagtgcagcagggaaggggaaatgtgtagtgactgaaaatccaggagggtagtgtgtaggcacctggcctctgcagctacatctcctgcaccccgatcaaatcttcccgtagtcaggagggacttcccgttctggggaaaaggtaagcagaagatccccaccagtcctcaccgccatcacaaacacctacagtccttaccacaggagaatcccatagtcctagcaagccctaagtcaaggtggacagctgctgggaattcaagcagttgcattgctccagatcatgagaataaggtatgcactctccaaccctcacccacctgtaggccaacctgccctgctgcagcatggcaccattgaggccagagccacctctgttgtgcgccccgctctgtg

SEQ ID NO: 189697 - DNA, 363 bp, Homo sapiens
gaggttaggaagcacctaaccctggcttgtggtcctgaggctgcggctccttcagcttccccatgtgggacctctgagcagaggcctcagtgtgccctgagggtccacggtgcagggggctcaggacacggctgtagaaccgctgacccccaaccctgctccagcgcgtgtcggggacttgggcacgaatcctggctgcagcaggttcatgggtggcctcgcacaggtatggtgctttagcatggggtccacacaaggacccggaggccctcagacttcgtggtgtggcctctgtggtgtttcctggcaagggctgggccaggctttgttgacttcctgtggctactaggaagagcccaatcc

SEQ ID NO: 189698 - DNA, 346 bp, Homo sapiens
gtggagtacgatgcaggagaaggaagaaagagtaaagaaagggggtgagaagagaagacagaccaggagaaagataagggccagggaaagagaccagccaggaagtggcccagaagtaaagtaagcttgaacttcacacctgggctcacttagccttccaggtctgcctgtggtcttggtattgtaatcggctcactaattgttcacagctcttggactgatttttttccttgtactttcagaggctttctctgaatgggctagccagagccatacagcagcttatagaaccagtagctgggtggtgttgtccccatgggtctggagaagggaggcctcccagttg

SEQ ID NO: 189699 - DNA, 363 bp, Homo sapiens
gcgattgattgagggatggtgcctgaccagtcacatccagtgagatagaggagatatctttctggggctgctgggaaagtaaagctttctttcgctgaagctttcagaagagaatcacacatcctgtggatggtgtagggtgaggacatgagttctatatgggagcagttttctttcataagaatcccacacatgtgcaggactggttactggttggaaccactaagtaacctattgggaggcagattggtaatgatgccatctaagctgttggaacaagacttcttagttaaataagccactaagccccctccattgcttaaaagccagtttgatcattgtttcttagaacatagtgacctg

SEQ ID NO: 189700 - DNA, 186 bp, Homo sapiens
tactgcctgttttgaaatttacatatatatattataaacataaattacataaggtataattcacatgtggtaaaacttgccagttttaagtgcacaattcaatgagttttgacaagtgtatagtcatgtaaaggctaccacaattaggacataaaacacttccatcctccctgaaatgttctcttg

SEQ ID NO: 189701 - DNA, 512 bp, Homo sapiens
cagcattattttatttttatcaatgaaccttaaaatctttaaaaacattttcccatgactgagatactgttagctcaatatgcttgtggccaccacctgagtttcctgattgttgccagacagaccgctatcaactcaccctctcaaagtgcagtgtgtgcttcagatttatccccactgaattatcttgtcagttttaagctattatttgtgcttcaggatattttacaatcttgattatttggtccaacatattaatgattcatcttatatttttatcatcttaaaattcataagaatatctccaaggtattgatggaaatgttaaacaagattgtatcaagggccgagttaagttaagcaatgctaacattcaaaacttaatgagaaatataatttagtaagaatggtactttgatgcttgtatttcctttaatcttgctctaatttatagcctattaaaatatactgtttatgctaataaatacaaattaaattttaaaatacatgtt

SEQ ID NO: 189702 - DNA, 324 bp, Homo sapiens
  misc_feature (242)..(242): n is a, c, g, or t
  misc_feature (248)..(249): n is a, c, g, or t
  misc_feature (261)..(261): n is a, c, g, or t
  misc_feature (263)..(263): n is a, c, g, or t
  misc_feature (266)..(266): n is a, c, g, or t
ttccagagtggccgtactatattatattcccaccagcaataagtgacctagtttttctaaatcctcaccagcatgtggtattgtcaaagtgatcttttcatctaaatgcatatatatacatatatatgtgtgtgtgtgtgtgtgtgtgtgtgtgtgtgtgtgtgtgtgtatatatagagacagggtctcactcacttgcccaggttgtagtgtagtggcataatcatagctcactgcagtantctttnnacgctccttgtncnttntatagtggtatactactgccccactacacccgacgcgtggcaaggggggactcctcta

SEQ ID NO: 189703 - DNA, 452 bp, Homo sapiens
gacaatctaggtgagaagatgagacatataagcacagagtacatggagagtttggaaactaagaacaagccatgagatctaagctgtatgggaaggggtatcccagcaccacaggtgatatagtgtcttcagatgtgactcagtacagtcccagtactggtgtccagaaggatactactggtgtcacccctctcccagctttagacagctcaacacacagagagagactgtttggaagaaagtaaggaaagagaacaagattctctgcctgttaatccagatacttcttgcagatcttatccaagaccaccaatgttgatctgaagccagcacatcactgggtcttacccacagcccattttaaccctacttgggtaccttgttgctattttcactcaaggccctaggaattagcaggttgcaaagccagccaggcttctgtccttcccttc

SEQ ID NO: 189704 - DNA, 374 bp, Homo sapiens
acagccggctgggggggcgctccaggtttggctgagacgttcccgccaccagccggctccgggcgccggcggcccagctgccgtaacatctcctcgcaggctgcgatggtgtccaggagctgccgctgccgctgctccaccgcgtccagcagctgctgggcgcgctcctcccggggcggctgtgggggtggcctcccgccgagccccagccccgccttcccgcggtccacgccggcagcctcccggtctccttcaatcctcctgggggtcgtacgattcttgaagacagttttatcacaggtgtacatcagcacaagagtcactaagcagtgtaaaattatatttactgcatgaaagtagaatgggttcatacc

SEQ ID NO: 189705 - DNA, 484 bp, Homo sapiens
tcccaattcaaagatatttgttcgaagccgttccactcaactgtcttaatctcttgagaggagtcttggtttattgtgaaacagtctcctaagattgcttgaaatgcctgtgacgggaacctggtctgtaacctagcagtgtaatggtcttaggtcctttcatgtcttttccaatgcttaatgataggtaacctatattccaaaattctcagtggatgtcgttcattcaaaatatataatacatataggttctagcaaacaatattttacctacaaaagaaaagcgaatgtgggctggaaacatccattgattttagatgtccatgtactaaagaggttgtattcagtgtagctcactcaattctgattgaatatccacatttttaaacctgctctgttagagctaacctatagaacttcagtttctctgttggcgaatggtaacagtagtgcctaccacaacagggatatcagcaaaattgca

SEQ ID NO: 189706 - DNA, 665 bp, Homo sapiens
agtttattcttcagattgataagattcgctttctttgaaataactcagtttatctccaaaccaccatgattcatactccttttgtgctccacagtaccaaaaacaaagctacgcacatgggtgggtacaaagagttacctactgatggaaattaatccaaagaattaaataagttacgaaaaaaaaatcaatgatgtcaagtaatagttaaaattcaagattttactttagtactggttattcataaatagattcttttatcccatattagaatattgtcaacacaagcttattggaaaggttgacttaactttgccccatttttcttctttcttgctgctaccctatgacagaattaccatctctttgatgaaaacaactcaataaagaattctctttcaccaaactcagcttttgttgaacttgttaccgcaaatctattccctatcttatccagtcacatgctgaaaaaaattccatcttttaaaaatctgttcatggataacttacggttctctgaaccaccctatcaggaaggcagatatagtattacgaactctggctgggcgcagtggctcacacctgtaaccccagcactttgggaagtgggcgaatcacaaggtcaggagtttgagacatcctgaagacagcatggtgaaaccccg

SEQ ID NO: 189707 - DNA, 334 bp, Homo sapiens
ccaggtaacataacacccttatttctaaaggaatgggactggtctgaactcctgagctcaaatgatcctctcgcccccaacctcccaaagtgctgggattacaggtgtcagccaccgcacccagcttcactttaggtagttctctgacaacttttccatttcttctatcttacacatattgaattaatttcaattttaacaaattttcctagggagtttttcattaaggttttcaaatttattgagttatttttagcatttttgttttctctgtatctcaggttatgctccctctctcatgggctttctctttttcttagttaggtctacctgg

SEQ ID NO: 189708 - DNA, 283 bp, Homo sapiens
agaagctcggacctagagagtgaacgacttgggcctcctgtctgcctgtttgctgacagctgtaccataagagagtaagagcaccataactgaagataagcctcttcctctgctatgaccttacagcaacaccccagtaccctctattgacaattaggctaacacttcagcagttgggaaaggagaaatgtttacagggtccagtcccgctaccaccaatagagcaaagatggatgcatttggagctgagaggaaatgggttgataactggcacaactagtat

SEQ ID NO: 189709 - DNA, 341 bp, Homo sapiens
actttaatttatttatttatttttaatttttaaattttatttaaaattttttatttatttattttgagactgggttatgaaactggctaatttttatatttttggtagagacagggttttgccatgttgcctaggctggtctgcaactcctaggctcaaacaatctgcctgcttgctgggattaggagccttgaaaccatggagtgttacatattatatatgtatcaattaactgcaaacattatttattttgatgtttgagctttccagcaagagctcctttaaactggctcctgtgaaccgtaaaaaaagttttaaattgtgctaaaatacacataaca

SEQ ID NO: 189710 - DNA, 111 bp, Homo sapiens
atgcctggccccctcctccaggctggctcttctaatccaccttgagggatcagaggtgagatgcaggatgaactgtgcccatggctcctgctgctgctcaaggggaagtgc

SEQ ID NO: 189711 - DNA, 275 bp, Homo sapiens
atttgacattaacgcagttataataatatttatgcagttagtaaaataattctttaaatcacaaagagaaatcctaaattaattgttaactaatttctgtatttaccaaagaatttctgtgaaataaatccaagtaaaaattttaaaaagaaagaaaggccataaacccaaattgcacttgattcagctcaccattcaactatgagatctttgcaaactgggccctcatctacatagcatctggtaaacaaatgctgttgagtgaaaacgcagtt

SEQ ID NO: 189712 - DNA, 445 bp, Homo sapiens
gccagggctcggatgggcatttttagtactgaaaaggaattaaattagctagttgaatgcagcatgaacccaagtccttgacttgattagtaacacaaagcacactgttagcagtgaaggaaaaaacgaatatgtaaggagtagttatttcaaatcattttctctgctcgttttcatttatggaaactaaatgggtaactgcttctgttcctatctgcacaataattttgacaacatattaatataatgttaacataggatggaaagtgggaattagcaatgattaacagatattcttcaaatatatgtactttcttcagaagttaacaaaggatttgaacataaattctaccatgtctcaaatagcaccattcaatagaaagcatctgcacaaaaattatctcaggttattttactagtactacatttatttctcttattactt

SEQ ID NO: 189713 - DNA, 274 bp, Homo sapiens
aacacaaatcctatattctattaagggaaaagcagaaatattttctagatcatatggattttatttggagtggaaaaagaagatggatcctgaaaacatatcttgcaaatattttgcctcgaatattctttgtcttcaggacactgaacttgtcgcattttcttcctctctaggcccttggcagcctcaatatttttgcccagattttctatgtgagtagagtttcgggattctctgctttttctgcacccagacaatatgatttctgctcatt

SEQ ID NO: 189714 - DNA, 337 bp, Homo sapiens
tggctaaatcccaccaatccttcaaggtctaattcaaatactacttcctccaaatctttgagcacccctctaggccacaataaatcttccagggttgactgttcatcccaggacatatttagcactttgtagctctttaaataacatgtaccaaatgaaagatctaaaaagttacatagaagtatagaaaacttaagacttgttaaacaattttacacttgtagatcatatgtagttactgccatcacaaaattaacagcagaaacaaagtgaaacaattttccttttacctgaggctttttctagaatattacaaagtgcaaaaagagctgtgtca

SEQ ID NO: 189715 - DNA, 276 bp, Homo sapiens
actctttctcttctagggattttccacagtgttatctgtaatttataacaatgattttgaggaacaaaatcatcaaacaaatatgcatgcacgcacacatgtgcacgcacgtacacacacgcacgtgcgcacacacacattcataccatatgctcaggatggtttcaatttttaaaaaaattgtatgtgaaagtccatgaatctaactattagctctcttaaaaaacagattaattaccctccaaaagtaagcccatccctaatcaatatgagata

SEQ ID NO: 189716 - DNA, 154 bp, Homo sapiens
actcatcacatttaggaaaaggcttttaaaaaaatcattacagaccacattatctgaacttggcatacctcttcagcttcttcacttattactcactccccattctccttccgtattacaccttctctacaatgcagtttttggcttctccaat

SEQ ID NO: 189717 - DNA, 434 bp, Homo sapiens
tggcttcagttcttttgcccaaacagaggaaaacttgcaggtgggaaacacccctttcctgactccctgattctgaactgggctgtccatcaacaatgcaaggtctgagttccaggggtccggtgggcaggccacatcgtgcatgtggtgtgagggcctgaaggtgcttccacaagacggatactcagagtcattttactctggttgaagccttcccacccagccagcatttgacaagcaccactaacaagcagtgaaattgactggctgattccatctctccatcctttcaaactcgtgctaatgagcaggcgaatcacaaacagggaaaagagggaagaggcaggatgctcggataatcccccaactggaacaccccttctgcaatcattgcaatcatgtggacatgcaccagctggatttaaaatcgatta

SEQ ID NO: 189718 - DNA, 551 bp, Homo sapiens
agcactttcccggtaaagcaaacctctaaagcatgtagcaattgctgtgtacttaactttttgcagaaaagggaaatgcaattggacgtgtagcttcttggagggaggttttggaaacagaatgaatatataaagatgccagcaggagccagctcgggggtagatgaggatggcaggtggcggcgaggtgggagtggtgaggggccatgaggaagagtggtgggaatgaggcggcagcacctccatcccaaggaactttgcacatagtgatgaaacagtctaccagtgatgatatagtctactgttctatgtcttgtactgaacttgcagttgaacagatggtacagttcctccctgtaggctgatgtcccaacttttgtgttagtctagtgtggctgacgtggggaaatattaaaagtaaagaactgtgaggagtcttgactccagggaccgctcaaaagccaccctgaccaatatccctgtttctgacattgcaaattctgtcctattcatcctcagtgtctgacacataatgaatgtttgttgatcaa

SEQ ID NO: 189719 - DNA, 326 bp, Homo sapiens
ctggagctgtctctgggaaaataggagatgtggagagggggtgcagatccccagtcctgaggttttgggagtccctgaaggagcagttggggggtggccccatcagcgggagcagggtagatgcaggatttcctcctgcttagcagctgtcgcactgcccttggttgcttgagagcccggccacctggccgggaactatgcaaacaatgcacaatgcgggcctcagctgtccaccggccctgaggaggcaaggccttgcctaacttgttttcctctcaccttagctaatactgagagttctctgcaagtttctccactctcactca

SEQ ID NO: 189720 - DNA, 532 bp, Homo sapiens
atgaattggtaattgttactgttattagaatgtctttctcgaggagctcaatggacttcaaacccttaactgaattctcagggcatattaataacatagaaagggccaagtacacagcagttaacattttacagatgaggaaaccaagaatggaataaataacggtcagaacatatgttgatgagtaagaaataaattttcattagactcctaataaaattgcaatttcttttaaaaccaccggccattctttaaaggaaaaggcatgcacagacgctggcaatgcgtggcattgctctgcatatacctgcagagagagctttctgtgtgttatctcagattctgtttaggaggaggtggggtatcactgaatacactgaaattgaatttccattccttgttcttccttagcttcggagtttgataggcggggagtggggtaggaagtatgctggccctgcctacactctcattctgctggtttttgctctgtgcacatctgtgcaaagccctgccaacctcacgtggctgt

SEQ ID NO: 189721 - DNA, 427 bp, Homo sapiens
atggcacttcctccatatacacatgtcataagaaaatgtaaaatattggtacagctgcacatgtagaacatttactttttaaatgaaaatatgacatttcaacattacacacaacgtggcttaatcaagaaaatatatgtgaattcaaaggtgacatcaaatttcacacatgcttaacttcatattcagtgtacttgtaggtacttatatgcacagaaaaatgtaattagcctaatttaaacacaaaaggtatggttcattttggcacaatcagatgcacaatgtgccatcatgctgtgttcactaatgtttatgtttaccaaattattgttactatccaagatacattctctgatgacaaaattattgatgacaacatatcataaatggcacttcctccatatacacatgtcatcagacaatgtat

SEQ ID NO: 189722 - DNA, 269 bp, Homo sapiens
ctgaaggacattagaggtttatattcaacctcctccttttccgagaaagaacctggagcccagaaggacagattttccccaaattgtacagcacatcagtacacagctaggcccaaagttcagggctcaccctgccctaggcagagctcttgctgagttaaagtctctgtagtccaatcttgggcatttaatatactggcctttgttgtccccatttcactaaaggcaatatcatgaaagaaaaaatgaattagatcactcgaagtccc

SEQ ID NO: 189723 - DNA, 220 bp, Homo sapiens
acaaaaaacaatcagaagtagtgcatctgtttcaattgaagcaacgtaaaagattggcaaagtactataaccttaataacaatagatattattccccttttcaaaaatagagagagatagactatacttattgagcacctacttatatcaaacaatgtaccaggctgggcacaccacagaggcaattcagaatggtcactgagagcatgggatctggaat

SEQ ID NO: 189724 - DNA, 462 bp, Homo sapiens
ataccagtgaaaccaccatctgcaatggtaaacattaaacgttgtttaatatttttcttctgttggggatgattcaggtccttaggggtctctccattctgaagcatcacctcttttttctcttcttcttctttcttctcttctacagaatatgaggaagaaaaatgtcagctcagccaaagcccagcaccatcgcccttacccagaacactgtatgctacaagaatccatccacctacaccccttctccacctgggtgtctctcagacccagaaaatggtgccattggcccactgacaactaaatgtggggacaggtacaggcttttatcttgggataaaatggctagatgagtctggagtttcggcgtgtgcatgcacacgccgagcatccatacaaatcttctataattatcctaaagaactgatgcatttgtttctgagatatgattccagaaggggt

SEQ ID NO: 189725 - DNA, 226 bp, Homo sapiens
ttacataccaggtagactaacagctagaagtacttatcattttagctgttaggtctaccccaggtaaacctaacatcttatttcacccataaatatttaggtatgtgtgtctaagaaggacttaagaaactataaccacaatgatatgattatttctaacaaaattaatagtaattccctaataacatctgatacttcatcttcagattttcctggtgcttttttt

SEQ ID NO: 189726 - DNA, 299 bp, Homo sapiens
acacttgtgtttcactggctgttggcagatccatgtccctcagtttatccaactatcgatggagtatgcttgtagtgcagatcgactcccttgttgaaatagtgtcagtgggaaagggcctcatgaatagtcctgacttttgagtgttctttcccagtgggtcttggatcctgcagaaaacacttgtgcctgctaagttttcacttgcactccctagggcttcctgatttggttttgaacttggctggcctctctaaaggtctttgctctgggcatgctcggagcactgagctagacaa

SEQ ID NO: 189727 - DNA, 363 bp, Homo sapiens
cagctggaaactatatgcaagtctgccagatatggcaaactgtgagtgtttggggagggggaaggctataaagctgttaaattgcctacagttctgatacagcacagaacatctggtctggagagcttgaggaaacaccattaaataggccgaaaagaaaaaaatctttgtgctaagaaacagtccaggttttgtacgctgttgtcagaggtataaaaaaaacttggcacaccgtattatgattggtcagtcacgtacagagccagacactctagcaatcggggtttgttagacatctggtctagttccaccagccccttcaatgagggaggggagatggaggaatagaaatgaagcagctac

SEQ ID NO: 189728 - DNA, 658 bp, Homo sapiens
tatattttaccaacccctggtttaaaacgtcctaaggagtatgaattattagcaattggtgactagcaacctggacttgggtaaaagtaaagctgctgcacctcaaaaatagcaattttgagtgagtggctctttgctttattgcaaggaggatattaggagtgtgtaagagaggcagttactcttgaaccataactaggtgtaattaagtactgcatctgtttaacattgtttaaattttatagctgtattcatagaacaatagctacagctataaatacaatgtatatttgaaatatatatttaaaatcttttaaggaaaaattttggcttttacaagtttgaactttgtagttgtaaatcccccatttcccaaggagattgttttttttttaaatacacttttttggtaaggcagagcttcctaggaacttaagtgctgtattgcagcagaacagttattactccttcacactcaggttcgctgcagcgcattatcactcgttcctaaaattttcttcacttgttttttttgacagtgtattgtctttttaaccctcatttaccctccctgctcttttcttttcagtcttcattgaagattcttccttttctacccatcttttaaaaattgtcataaaattatataatacaaaat

SEQ ID NO: 189729 - DNA, 895 bp, Homo sapiens
aataggtgcccattgggcatggtggaacaatcggtttttataaggttgagcaggaacaggaaaacaacatagtacaaaaatgtgggttaacatcaggttacttgaggttattttccttataagggttaaagcagagggaacttccttatgccagctcacactgtctgtctggggatttgggtatcttctttcctgaaggtaaggtaaacaatttagaagtttaacatgagtgactctattttggtttggtctgttagggtctaggagctcggtccaaattagtggccttccatagattctgtttaacactggaaggagggtccgtagtgttgcgtgtgttagggtgactgctgagagcactgctgaatcctggggaggggcctgcaccttagaactgatcagttctacagtgttagaaacagacctcttttgtcagaaattaagaattcagaaaagttcaaaggatataattaaagtttttttttttttgagacagagtctcgctctgttgcccaggctggagtgcagtggtgcgatctcagctcactgcaagctccgcctcccgggttcacgccattctgctgcctcagcctcccgagtagctgggactacaggcatgtgtcaccatgcccggctaactttttgtatttttagtagagacagtgtttcaccgtgttagccaggatggtctccatctgaccttgtgatctgcctgcctcggcctcccaaagtgctgggattacaggcgtgagccaccacgcccggcctaataaagttttaaaataaaaaagttagacatagctagggtcacttttatgattttggcatataaagagttggcacttataaaatgtacatggttatgtaaatatgttttgtgttttaaaaatttaat

SEQ ID NO: 189730 - DNA, 405 bp, Homo sapiens
aatttgaaataataatttcatttacagtggtaagggctgcatacctgccagttcatcctcagagagctatgctacgctttgcagggatggaatatttaaacagtatacacactggtggaaatcttaatccgattattaatacctgaaaagaacaatgtacaaattgctacagataacctcctcttttagaagttgagacagtctgaaaaattgctgcctttggctagcacaaggaaactgatttcttggcatgtgtgtttttctttccatgccaaaagtacttctacaatcatagcacagaacttccagatttcatactagactctttctgtcctcagagtttataaactgtctactatcagatttctagctcttttcactggaagcattgcacagcactttaat

SEQ ID NO: 189731 - DNA, 853 bp, Homo sapiens
agactacggctaggtagcgaggctgggtgttgatctgtcagaggtgggggccagtgagggagagggaggagatcaggaggagaactgacaagccagtagatttaaaggtgtgaaacttttttttttaaatttatttatttatttattttttattttattttttattgatcattcttgggtgtttctcgcagagggggatttggcagggtcataggacaatagtggagggaaggtcagcagataaacaagtgaacaaaggtttctggttttcctaggcagaggaccctgcggccttccgcagtgtttgtgtccctgggtacttgagattagggagtggtgatgactcttaacgagcatgctgccttcaagcatctgtttaacaaagcacatcttgcaccacccttaatccatttaaccctgagtggacacagcacatgtttcagagagcacagggttgggggcaaggtcatagatgaacagcatcccaaggcagaagaatctttcttagtacagaacaaaatggagtctcctatgtctacttctttctacacagacacagcaacaatctgatttctctatcttttccccacatttcccccttttctgttccacaaaactgccattgtcatcatggcccgttctcaatgagctgttgggtgcacctcccagacggggtggtggccgggcagaggggctcctcacttccagaagggcggcgggcagagggcccccaactccgacggggcggggcgggcggaggccgcaattcctccggaagggcgtggccggcgggggtggcccaactccctccgaaggggtagaagccggggaaaaccgtcatcccaaagggggg

SEQ ID NO: 189732 - DNA, 357 bp, Homo sapiens
actactagcacagcccagatttcatcatttagtacagataagtcatttatctgggggtaatgtgtcacacagatccatgttctggaacagggcaaataaattatccaatgttaactttgatagctcttagccatttcttagtcacctaaacctgtgtgctgaatcagtaaggtaagtgtgcctatgtgaagtacctagagaaatgctagctgtatgtatatatatgtgtgtatatatgtctgtctctcagattcacacacagtttccactaacaccacatcagaaggagaggagatatagctgttattaacagggagctattcacaggctccactatgtgtttgcaacattaataaa

SEQ ID NO: 189733 - DNA, 582 bp, Homo sapiens
tgcagctattgtaaaaggggttgagttcttgatgtgattctctacttggtcgccgttggtgtataaaagagctactgacttctgtacattaatcttgtatctggaaagtttgttttatattggctgtgggtttatcatagatggcttttattacactaaggtatgtcccttgtatgccattttgctgagagttttaatcataaagggatgctggattttgtcaaatgctttttctgcatctattgaaatgatcatgtgatttttgtttttaattctgtttacgtggtgtatcacatttattgacttgtgcatgttaaaccatccctgcatccctggtatgaaacccacttgatcatggtggattatctttttggtaatttgttggattcggttagcaagtattttgttaaggattttagcatctatgttcatcaaggatatccatctgtagttttcttttttggttatgtcctttcctggttttggtattagggtgatgctggcttcatagaatgaattagggagggttccttctttctctatcttgtggaataatgttaaaaagattggtaccaattcttc

SEQ ID NO: 189734 - DNA, 528 bp, Homo sapiens
tcgaatcgagctcggtaccgtacagtgggcagtagtgcttgagaactgctgagcctgaggatttgcctgggtctgcgcctgggcccccgcccttttacaaaaggtccacggcctctcaagagctggacatgaaggatgggccaagtccagtcttgatcggtaatgcccacttgacactcccaggagcagcatcctgagatacacgtaaatgaaaaattccaagtgtgatgagcagaacgtggttgtgtgaacaatcccatggtggtggggatgtggggggcaggtcaaggagcggatccctgaaccccagcagattaaatcctgcatccttctttcctatttcctggtttctctgctccattttcctctagtttccacttagttacttcttcctacctgctgtgaagctctgcaccctgctccatggggtggttcccaactgtgctttagagtcccctttagagctttctaaaaatacacggactggggcaccaccctcagagactgattcagttcaggcagagcctg

SEQ ID NO: 189735 - DNA, 193 bp, Homo sapiens
ccaccccagcctcccgagtagctgggattataggtgtgcactactacacctggcctaggtcatcatttttaaatgccactggtcttgctttttaattacaaattactgtgtataatttaaaaactaacagctttgccattgtcaacttagtttgttatggattgtttggttaatgctgtagagtgagttgtga

SEQ ID NO: 189736 - DNA, 272 bp, Homo sapiens
taggatactcctttgcaccatcttgtctctgcactggcttttcccatgcactctcatctatctgcacggctctaattataatccatatgctgagaacagccaaagccctgccgtcagtcagctctccttcctcagctttgcaaccagctctccactgaacatctccacctggatgtcactcagaaactgcaaactcaactggctcaaaggagacatacaatctcttccaaatctgctgttcttatggccttgattctaatgaatacccccca

SEQ ID NO: 189737 - DNA, 587 bp, Homo sapiens
actaagccaaaactccccttaagcattcaaatgtactaaagaaagccctcagcttgctgatttttttaattagcaaaaaagtaaggctatagactacatgtatgtgtccccccaaaactctcatgttaagattctagcctggaagcggtggctcatgcctgtaatcctagcactttgggaggctcgaggcgggcggattgcatgagctcaggatttccaaaccagcctgggcaacacggtgaaaccccgtctctattaaaaatataaaacaatttagccgggtgtagcggcgtgggcctgtagtcccagctactttggaggctgaggcaggagaattgctggaacccaggaggcggaggttgcagtgagccgaaatcgcgccactgcactccagcctgggcgacagagcaagactccgtctccaaaaagaaaagaaaagaaaagaaaagaaagaggcagatgagccaacttaaaggaccctatcattcaaggaaggtgcgaatcttccttagagactgtaccacttaagctaagcgccagggtagggcaaaagactggacctctagggttgacacgggcattcagca

SEQ ID NO: 189738 - DNA, 123 bp, Homo sapiens
caatagtatgcttaatctacatatgatattttataatatacttttaaaaattaatgcatgatataaagcttttcatatcaatagctatatgactacataatctcattatataaacataccata

SEQ ID NO: 189739 - DNA, 376 bp, Homo sapiens
tacagagaggagctcggttagagaaacagctatttggataaacagaggggttctgggctaggaacccggacacgtaggtccaacccagcttagcgcccctcaaaagcctgacaagtaacatgatctcctggacctcagtttccgctcctgtaaaaagtatgtatgtgaagggtctggattctccctccccaaccctgcagagcagaagctggggattctgtactccccttccccagtgtaggtctcagtagcagtgaacgtgcagcaaggccaggcagaggcaagggctggctgctgtagctgcttggtagaacttctctgaagcaggaaatttgggcagcaagtgccctggctagtctcaccctgaccaaagcct

SEQ ID NO: 189740 - DNA, 342 bp, Homo sapiens
atcacacaattataaagtaaaatggattaccacatatttatagcaggagaaataattttaaaatgagggtgtttttctattatatttatgtgggttttattttatagtcactagacagtaaaatccatcaagcattttataactgcttacatcacaagtattcagtaattatctgggtaacctcggacccaacactcaagcactttggttctcagttctttatatgtcaaataaatagatcagtcaagatctgtattatccaaatattagcatgtggctatttaaatgtaatacttcaaaattaaagtaaaaaattcagctttgaatttgagacacatttca

SEQ ID NO: 189741 - DNA, 940 bp, Homo sapiens
caagagctggccgtgggggaagagcaatggtgtgcggaggtgggggaggccctatctagggacaagcagaaaacttagggtgggcagatccccccgacccctgtgcaggggctgccggagaccaaaaaggctgctgtgtgacctggaccaagccccttgccctctcatgcctcagtttccccttctctccacggagggattgagcaggacatggagggccccttccagtagccattctgggactccctgcacctgtccccaggggagggtcctgagctggcctccacgtggctgctgttccccatagtggaaccttgtgtgtggagacggctggaaaggtcccgctggagcaagtgagccaacctcctgggcctggctgcttgggctgggtcatccctgggaacaggcctgtgaaccggtttggacgccgggcagtttttgtggcctccctggtgctgaccacagggccttgggggcccagtgagggccctgggctggccagctttccctacccctgcttggtcctgcgcctactcccacggggggccaccattgggcaaggggcccctcctcggcccctgtatctgggctcgcctggagttgtgtgaccctccccaccgcctggccttctccatgggggctggccttttctcggtggtgggcaccctgctgctgcccggcctggctgcgcttgtgcaggactggcgtcttctgcaggggctgggtgccctgatgagtggactcttgctgctcttttgggggttcccggccctgttccccgagtctccctgctggctgctggccacaggtcaggtagctcgagccaggaagatcctgtggcgctttgcagaagccagtggcgtgggccccggggacagttccttggaggagaactccctggctacagagctgaccatgctgtctgcacggagcccccagc

SEQ ID NO: 189742 - DNA, 520 bp, Homo sapiens
caggcctctgaggctcccttgccgagggccccgagctgcagggacagtgagcagtgagtcccttgggcatcccgctcctgggcaggtcaccaataggtcccccgcagttccccaatggaactgttccagtcctccccgaggcctccacttcaacctgtctgtgtctgcccaggcctggagttgtgtgaccctccccaccgcctggccttctccatgggggctggccttttctcggtggtgggcaccctgctgctgcccggcctggctgcgcttgtgcaggactggcgtcttctgcaggggctgggtgccctgatgagtggactcttgctgctcttttgggggttcccggccctgttccccgagtctccctgctggctgctggccacaggtcaggtagctcgagccaggaagatcctgtggcgctttgcagaagccagtggcgtgggccccggggacagttccttggaggagaactccctggctacagagctgaccatgctgtctgcacggagcccccagc

SEQ ID NO: 189743 - DNA, 156 bp, Homo sapiens
ctggcgtgtatagaggatccccgtcattttctacacccatacatgcatctacacctgcacctactcctatacccatacgtgcatctacacctgtacctaccctcacacctgcacctgcatctacacctgtacctccaaccacacctgcatctacac

SEQ ID NO: 189744 - DNA, 1317 bp, Homo sapiens
gatttgtagggcccccaagtcatttttacacatatatagtagtgaggacaggacaataatttagagatttgcaaaacaaggttcttttctgttttggtaactaacttgcagtgtgacaccaggccagtcacttgccctttttgggctgtgggagctggtctctaaagatggctcccaatgagtcatgcctcctggtgttatgcctttatgtggttccctctcacactgaatctgagtagctctgtgactagttttaaccaccagaatatggctaccatgacactgttcagtcctgggtctaaaccttgagcaatttccacattttatgtttttttggggagccccaagccactctgtaagaaatctggctacactgtcacatggaaaaactgtgtggagagacccttaggcaacagacaggggcctccagatgattccaaccacagctgcagaagaaccacccagctgagcccattcaacccagagaactagtagatataagatgattattattagaagatgctaagtcttggagtgttttgttaaacagcaatagataacttgaatataaaataaggaaatctataaaatgaggaaatgttactagatcagtctcttccaaagggctcctgacacattaatgaaagatgttacaacatctgtgtgttaaaaataccaatatataaagcatccattcaaacatttttctcctttaaaatggaataaagattcctgagtacatgacgagcgagcacaagggtcagtttgtgggaatcaggaaagcacgccatgacccaactacttcattacttaggaaataccaaactgcacaataattctgacttccgtatcttacaatgtgaggtttttagtcctagattagtttaatttatatccaaatggaccattggctaaagatgaaaaatgaaaagggtagtaaaggaggagctcaaaaataataattctgaaaaattcttcctaaatccaaagaaattagtgtttcaatattcccattttatgaatgaacaaactagtgaagaaggtacaaaatccttggctgaatgtaagaatgtgagaggctttttgtcttgctttgttttgtttttggtagatctgttttcttgccatttgcttcttttccccttccagtcctcatgaatccagtgatccgagagctgtggttattaaagacattcttaagcttctttcttgtgtatctgtgcatacctcatctcactctgtgcccctctcagctgcacttgaaccaaggtacttctgatctctcagtgtcagtttgctcatgtgtaaaatggggac

SEQ ID NO: 189745 - DNA, 348 bp, Homo sapiens
aggcgaagggcgcggacagataagaacttgggctaataccaagcgtgtggacagacccagaggggtagaatggaaggcagactctggaggaaaagggcgagagtgcaccgaccacccagctcgccagagggcaggggaggagggacggcttcctggggtgaggggctgcacgccggagccccaggaggttgcacactgttcctcccacctcgccactgcacccccaccaaggatggaattggaggcggggggcagattccagggtcagggctgtcaagagtgaatgaggcgaggagacattcaggagcagagaggtttcagacgcggaggttccgggcacgccctcaa

SEQ ID NO: 189746 - DNA, 243 bp, Homo sapiens
ttgcgccactgcactccaatctggtgacagagccagactccgtctcaaaaaaagaaaaaaagacttaaatgtcagacctgaaactataaaactactagaaaaacatagagaaaactcttcagaacatcggcttaggcagataatttatggatgaaatctcaaaagcacaggcaccaaaagcaaaaatagttgagtgggctataacttctgcacagcaaaagaatcaacacagtgaagagacag

SEQ ID NO: 189747 - DNA, 273 bp, Homo sapiens
aggcaaaatttaaacagaaaggtatttacaaagagaatttgcatagaattaatgctgagttttctggcaatcagttgccctcttttccttcacctgtgccctatagaaagggaaaagacatacttggaatgctagaatgagaccaagtggtcattaaagacttcctttggttcaagactggaatctgtgctgagatcttccaagagcgagtgctacctgccccagtaattaaagttcccagggaacaagattccatgtgctctctcactaatt

SEQ ID NO: 189748 - DNA, 282 bp, Homo sapiens
aggaacaggagggcaaaacatgttcttctggaagtgctgcccaaagacatggccaccggggaggaaaggaagaaagcagcacagagccaagtttgaagtcctggaagagaatctcctgagacattggctgaggaacacagaaagttacttgtggcagaatctttctggaatttttccattctgggatactctgagcccattttgtcacaggtcatcatgacttgatgaatgaatatcatattggttaattcctgcggcttaataaaatcctttgttcaagaa

SEQ ID NO: 189749 - DNA, 799 bp, Homo sapiens
tccaaagtgctgggattacaggtgtgagtcaccgcacgcatcctgtatatcacttgtaattatcttttttcttcttttttgagacggagtctccctctgtcgcccaggtggaggttgcagtgagcccagatcgcgttactacactccagcgttggcaacagagctagactttgtataaatatgtttaagtaattacaatttatatttttctcctgtgattgaaacacttgaaatggatcttatgattaatttatgtctggtatctttgctcctctacttttgataaggcttctaaatgtaactttggaaattttatatttgccaaagtaaaaagtggtgtttttaatgatcattttaatgtagcttattttaaagctttttaaaaacttttccctgtccctcgtcctacaactacaatccaatacatactaaatctcagttggccagcaaaaggaaacctaaagattgagatcaaggtttgtattttcttttttttatttcgagtttttatcaaagcttgtatataagattactttattcctgcctcttctcaattgtttcttccttgtatttgcccttttcctttcctacttggcgagatttggctttctgttcaggaatctttttgccgtctttgttcagttttatcctagtgagaaccacttgctgtggtgaatgtctacatggatagttgtaccattagccttttcccactgcactcattcagtgtagatgacatttcttcctgtaagcctggactactttgccaatttgctgacctttatagtgtcctcataca

SEQ ID NO: 189750 - DNA, 736 bp, Homo sapiens
gatacgtgggaggctgaggcaggagaatcgcttgaacctgggaggtggaggttgcagtgagcccagatcgcgttactacactccagcgttggcaacagagctagactttgtataaatatgtttaagtaattacaatttatatttttctcctgtgattgaaacacttgaaatggatcttatgattaatttatgtctggtatctttgctcctctacttttgataaggcttctaaatgtaactttggaaattttatatttgccaaagtaaaaagtggtgtttttaatgatcattttaatgtagcttattttaaagctttttaaaaacttttccctgtccctcgtcctacaactacaatccaatacatactaaatctcagttggccagcaaaaggaaacctaaagattgagatcaaggtttgtattttcttttttttatttcgagtttttatcaaagcttgtatataagattactttattcctgcctcttctcaattgtttcttccttgtatttgcccttttcctttcctacttggcgagatttggctttctgttcaggaatctttttgccgtctttgttcagttttatcctagtgagaaccacttgctgtggtgaatgtctacatggatagttgtaccattagccttttcccactgcactcattcagtgtagatgacatttcttcctgtaagcctggactactttgccaatttgctgacctttatagtgtcctcataca

SEQ ID NO: 189751 - DNA, 443 bp, Homo sapiens
gctggaaatacagcatgcagaccaaacaaaaatctccacagtcactgaactcatattctagtatagggagcccgaaaacatttacaagtgaatctacatcactttgatagagtaagaaggcaagtgtgaggaggccgaggggctttctagagtgatcaagcaaagccctacatttgaacagagacctaaagtggtgagcaatctatctatgcacaggtatctggaagagaacagcaagttgaaaggttcaaaggcaggagattatcaagtttcatagatgtgtttctcaaacttgagtaagaatcaactggagggcttattaaaacatacacctgggtcataagccctaattttgcctcagtaggcctgggctcttagaatttataattctaccaagttgctaggaggcgagcagactagaacatatagaatggaaaaagatg

SEQ ID NO: 189752 - DNA, 159 bp, Homo sapiens
cctctcccggcctcagagaaaatttccagggaaccgttttctggtgttaatttgttaagtcttcttactaagtgagaataacagctggtggggtggactctgacctgacattaaagttaattagaaatgtcatcctccagggaacatcgtcccctgagg

SEQ ID NO: 189753 - DNA, 146 bp, Homo sapiens
ttggattcaccctctccaaggcggttagaaccctctgagatcattcagggctttgaaagggcttggtaatggcgacctgtgtcctcactccacggagatttagaattaaggcagacctgcaacacaggagcaattattgagtacct

SEQ ID NO: 189754 - DNA, 424 bp, Homo sapiens
tactggcttcatagagtgagagggagtgaagaccctgatctcttgagaaagagaagaatgatgggtgctacaatcccagttcgattttccaagagtggaggctgccatcatttccttacaaaacacggaaggcaaacactttgaaacagcaaatatgatttcatttatttatctttaagagaacacaatttcacatgagaaaagcatttttctctcatcagcatgactttgaccctactcatttcaaagtaataaccttggcatcactgtctaggaagcatgtgattctgtcttctgtctgagtcctgaacaagtggaattcttcccaaataaattcttttcaaatatgactgacatatagtcccatgataggtcaggaaagatggttatactacaaatcacctcaataaacttatgtattcca

SEQ ID NO: 189755 - DNA, 327 bp, Homo sapiens
tattcatttaaaatgaattacaaccatatctatggtcactttaaatgaaagccatttgaatatattcttgttaggtgcaaattaatctaatttcttcaaaagtagtcaaagcaacagtagatacaacaataatgtctccttaagttctattttgccttcacagtgaggtctaaaaagaaaaggacattaaatttaagcaaacctttgaaaacaactcctgttttgaaaacaagtttttgaaagtttctaagtcaagactacctacattaaagagttatatgcagatgccatacaatcctcagtaggatcatatgcctctttaagagg

SEQ ID NO: 189756 - DNA, 396 bp, Homo sapiens
taacaaagatctgagctaattttatcactaggaatttttggaaaaatggggttagaccagggtttctcaaccacggtactaatgacatttttttgacatgcagtctcgctctgtcacccaggctggagtgcagtggcgcaatctcggctcactgcaagctccacctcctgggttcacaccattctcctgcctcagcctcccaaagtgctgggattacaggcatgagccaccgcgcccagcctaatttatttaaaacgttgactacttttccatatcaaattattgaaagagttttaaaaaatatttttattagtttctctgacaattagatgtggattcgagtaaaagagggaagagaacaagtgctcctttagattcttttattctcttcctgtg

SEQ ID NO: 189757 - DNA, 460 bp, Homo sapiens
gtaggtgtttgttaatttttgtatatatcatgttcaatggagtgaaattaagggaatcatctatattttgtgtaggcagatcaattccattttactatttctattgaatatttgattttgctcctcttactctcttctctgaggcagtatcatgagaaagaaaagttggttgtaaatagaccttctctctcttgcatccatcatctgccgtcacaaaggaaagtagtttaacaattaagtagccaaggatgacacctgtgtagtagaggttctgcattcagctgcaccctggatcctgggaacataattggacccaaggcctgccccattgtacaccaaagaatgttaataacatggctgcatgcatgcatgtgtgcacacacgatacactggctacacatttgtaaggatctgtttttttcaggaattatatgtatctaccaaagcagatagatacata

SEQ ID NO: 189758 - DNA, 264 bp, Homo sapiens
ttagcggatcctttagaggacaaggaggggcttaagaggggagactttcaaaactgcaaaagcaaaagcaaaccacctatcactgtgcacacaaggaaaacagagtccgccacagtccgggatatctgcttcagattcaaacaccttcctcctcggaactgtgaccggctccagcactggtcacagacgagcttggcttccaacacggtgagactgggcgagaaagattccttcacagcctgagcactgcctccttggtgctgg

SEQ ID NO: 189759 - DNA, 270 bp, Homo sapiens
caacagaacgagactccatctcaaaagaaaaaaaaagaaatagagataatcacacctactttgctacagagttgtggggagactccagtgttccccacaggcctggcgcacctcctggctcacggcaggtgcttggtgagtgatggttccccactgtttcctctggaaatttagggcaggaggtggtaacaataacagtcatgtaatcactcccagtgctaagcaccgtcagcccagatggtctcatgcccccttccctcggtgctcaca

SEQ ID NO: 189760 - DNA, 402 bp, Homo sapiens
agcctcccaaagcactggaattacaggcgccagccatcacacttggccgatagtgcgtaattgatcagtctgttgaatgaatgaatgaacaaatgaatttatcctctctgaaattctcagccttgagataccaatttctacttcagagattataaaaaagtgcttatgtctctccatattaaaacaagaattttccccaatcatccctgctttctcctctaggtatcctccctatttctcttcttcccaggcagacttctagaatgaaatcactatggtcggtctcttctccctcccctcaaatatactcttctgaaactgctctgtggtaaccaatgacctccacaaattgccactgcagaggattctttttagtccttttcttacctatttctacccttt

SEQ ID NO: 189761 - DNA, 127 bp, Homo sapiens
aaggatctggaattaaaattgtttggcttctcattagcaacaccggatgcagagagggagcagtcaccttcaaagtttgtagtgaaaattgttaccaacttagatacccagccaaactatcagttaa

SEQ ID NO: 189762 - DNA, 220 bp, Homo sapiens
catctcttctttgtctacaaatcatagtggctctgccatccaaaatacattcacaatttgaactaccagccactctcacttgccttcaccctagtccaagccactgacctatcttttttgcatttgcccttcagactgtttttcttatagcagccagagtgagcctcttaaaataaaagattatattattccactattcaaaatcttccagtcgtttccc

SEQ ID NO: 189763 - DNA, 260 bp, Homo sapiens
agtgagtaagtaatggagtctaagcacatacaaatcctgagttgtaatcctaccttgggaaagtcttccgggctacaagtctggttcccggacagtaaaaatgttagacatcgtgaatccctcaaaaccctagatttttgactctatttataatgtccattggttagggagatttagaaatggtaccactatattctggatttgataaacatgagcttgctaaatcagaaaatatccaagaatcaagtcaccaaccaagc

SEQ ID NO: 189764 - DNA, 901 bp, Homo sapiens
gtgcccctgaaaaagttattactctgtcccttcatgccctgtttcatttgtaacgtagggatactgttagcatctgctcatagggtatgttctgaaatttttcaaaaataaaacatgaaaagcatttagacagaacctgacatacagaaaacaataaatgttgttgctggtaaccacagtagttgtattactaaaaatgacccagtaaaaccccagctggaaaacttaattgtaatgcaaagctgaagctctgttacttccgattccaattttgtttcaattatttggaaagaaaacatttctttaaaaagtatgagatgttcctagccctataaactgattagaaaatgtagtttaggccaggcagtggctcatacctgtaatcccagcacttcggtaggccgagggaggaggatcacttgagcccaggggttcgagaccagtctgggcaacatagtaagaccttgcctttacaaacaataaaaaaattagccaggcatggtggtgtgcgcctgtggccccagctactcaggaggcttaggtaggaagattgcttgagcccataaggtcagggctgcagtgagccatgattgcaccactgcactccagcctgggtgacagagcaagaccccatctcaaaaaaaaaaagtagtttaaatttttcttggactccagattattctcttagagacaacagatttggaacgaagcttttgtagagctctccacatccagcagagtacatctggggaagtcgtgatcattcagattatgtttcctcatatataaaatgaaaatgtaccagtcctaccttcctgcagcactgaaagactgaaacaagataatatgtagaaaattagtaagagttctcaaaggccatgtggtatcatcgtcatcattc

SEQ ID NO: 189765 - DNA, 410 bp, Homo sapiens
cagcactttggcaggccgagtacggtggatcacaaggtcagagctcgagatcatcctggccaacatggtaaagccctgtctctactaaaaatacaaaaattagttggcttgcaagaaatctagttaaattcaataacaaccaaagtgagtcttcaaatggttgttgtgggtgatcattctaaactatgagctgcatatcacatatacatattttacatcttaaatgaacatgtattagataaagaatatctgacctgtttagttctcttagccatgagaggtggactctttgtaatgctattcccagtagggtgtctactaaaacaaagtttcaactcctgcggtctgtcaaaaagcttaaggtccagtcttggaaagtatttgtaactaaaataaaaaaaaaaatagaa

SEQ ID NO: 189766 - DNA, 359 bp, Homo sapiens
agatcagttaggagacagcctcccttacaagttagggaggacaatgactctgatgactagggcagtagtagagatggtggaaacatgcagattctggatatattctgaacgtacaaacgacaggactgcctgttaaattggatatggggtataacagaaaaggagtcataaggatgacttcatgttttttggcttgaaagaatggaggtggagaaagccatgagtggtaaagcttttggaaggagaatcagaaatgtagtactggacatattcagtctgagatgaattttggacatccaagtggtggggatgtcaagtgggcaatagggtatatgagtctggggttcaggagagatgtc

SEQ ID NO: 189767 - DNA, 943 bp, Homo sapiens
aatcctggtggcagaacttccaggcctaactagacaatgatgaagaactctcctgtcaacaaactgtcaatcacagtggtaaaatgatcacaatgggctcactgtggttgacagtttgttgagcaggacttggaaatcctggtggcagaacttccaggcctaactagacaatgatgaagaactctcctgtcaacgaacggaatctgttttcttagggcgccagatattctgccagggcatctttccactgcctccctcagagtccaggaattgttaagcccccgcctccaagaaggggaacactttagatcgcaaccctcttcccccgaactgtatgaatcatgttccaggtagtttcttcctgtggggcttggagggaaagcaatttattgaaacctcgatgcctgaaaggctcttacaagatggagaagttttactgggtctgtatttctgtaccaaatagcttcccatcaaggagagttgggctgtgcaggctgtttcccgtggggagccgcatcctccccaaagggattctgacaaggtgctaatgtaccacataagtgactgctaaggtcactgaggtgtccatttacacctgtcaggctgaaattcttcaggcaccacaagtgggatgagacacaggcttccccagtgctgggctgtcactgactcagtgccaccctccagggcctcttcagccctgcccttggcacgagatcaagctatggttccatttctgctgtctgcgttctgtggccaagcagacctactgaatacctgagatgaccagggaaatgacttgtagctcccttagggctaaatttcaacaacctgacaggaattaagttctgtggcctttaagtgggggctataaatgcctatctgactgggcagcttcagctcaagagaggcaagagaaacaagagtatgtctagactgtaca

SEQ ID NO: 189768 - DNA, 193 bp, Homo sapiens
atgctctataataagggcagtcaggctgtagcgtgtgtgctgactgctggttttggaactaagtgttgttagacccccaactgcctcgtttgttgatgtattgtgtggctgttttcactgtaaatggcagagatgaaagcagatagcccctgacttaggatggttcaacttgggacttttcgacttcatggta

SEQ ID NO: 189769 - DNA, 533 bp, Homo sapiens
tggggtgtccacataagtgtcatctcctgacatggggaagtggtgggtggcattcagacccagcttctctggacccttccttgactttggttcaccctgcaagtacggctgtgggccggcctgtggccaggtggtcttagctggaccacgagggctgtgtgctttgcaggccccagtaacagtgacaaaatccattcaggacatgctgaaggcaataaggtgatggctgggctcacagaaaaagaggcgggggccttcctggactaggaaggctgagtcatctcctggtgggtatctccaaggagtggaccagaccacaggagccccaaaagacccaaattctttgtgttcaatacccagccttcacatcaaccctgctccctccacccccaggttcctagtaagccctaagcatttgcaccaggctctggcatgcagtaagtgctcaggacatattttaagataaaggaatgagcgctgcctcctcactgggttacaagggccagcacctatttggtgtccccggagctgag

SEQ ID NO: 189770 - DNA, 350 bp, Homo sapiens
acttctggctgcctgctgctgacctctcagggccctgccgggctttcagagccctgctatcttgcaatggggtcctccctgactcatcccaccctggacgggggctcctgctcatattctctgctcacatcttacacttccaacatccagagactgcaggcagcttcgtactgtgagtgacgaagtcgtatcctcctgcttcagaagagaactcaaccaacagccaagtgtgcctgcagagcacacacggtgcttaagatatgtgccctaacggaaccaacaatcttcctcagaagccagtggttcgcaaagcagccctcagatggacccctccgtggttatgcctggca

SEQ ID NO: 189771 - DNA, 355 bp, Homo sapiens
ctggaaatgggaaacctgattcagatcacaggagaaggtagaaaaacatttggttcaacacaatactgccccccttcttttttttaaagggaggaaacatatttcaaacctaggaatagggaaaggattcaagacccatcgtggaataaaacacagaatttaaaatagcatccgatgtgacccaaaccagcaacaataacgagaaaaccacccagtccttccagagatgcaccttgtttctgctgcagtgttgctaatcaaaatcgatctgcccatccaagcaatttaaagaggaagggcggcatttgtagaaaatggtacatgttgataaagcatgacctgtcccacatagaga

SEQ ID NO: 189772 - DNA, 260 bp, Homo sapiens
tcgagctcgctaccatttctcattgcgaaatctctctctctagggggtagtaatttcccacacatactacaggacttggcacactaacagttaccaatatttaattagatgatcaaatatgtactactgtttgggattatacaacagtgtttccatattaggtaaaataattaaaacatcacaaaagctcaatcttgcccagttagtcattcaatcgtaggtcttactgtatatgctgctgctctagggacagtccagca

SEQ ID NO: 189773 - DNA, 402 bp, Homo sapiens
tctagttttccttctcagtcttattaatacctctaaaggggggtagcaataagtaataataaagacacttcatgtgtattagacattgttataagcactttcatacattaactttatcaacagcacaaagcaaaactgaagtcaatggtctattttaatgctgtagctatcaataatctggtgaggatgactgaaaagagcaaaatatctaatgaaccatactgcctattgtatttattctaattaacatgctctactcaaatttaaaaaaataataataatcctggtattggaaatcctggtccagaaaactattataataaaagcaataaaatagttaatagttcaattaactcatattttctggaatcatcaaaaggtttaagacacacaaaaatttaa

SEQ ID NO: 189774 - DNA, 906 bp, Homo sapiens
cattggttttatcagaaaaataaaatgggaagagtcacatctccctcagctaagaagatagattacttgtctggtccccctttcaaaagacttgaaggtactaagatttcctaggtccttcaccttatgactgtgtgccaatttgcaggcactagttgggacctctgttcatgagtcagcttcatggggatggttttctagcttgttccttcaccacatttgcaggttggatcccatttccctctcttcagccttgtcttggagacacagttctgtatgactgatgcacatcagaccctgccttcatttctgttttgcttccatcctgctcatatttccaatcccctcttccatcccatccaagtctccatcacttaccatatcttccttcaggacacaggagtcaataggccacacctggaaaccatctgatgctcaggactcatttgtgcttgcccaaaatatactaccctctgttgcatgttgctgcttctgttttattttctccctgaaaccttgctagcttttctaatttggccatctagttacctcagtttgagtctccattccttcactccactcaattcaagagtatcccatctgatatggtttggctccgtgtcctcaccaaatttcatgttgaattgtaattctcgatggtggagacagggcctggtggaaggtggttggatcatgggggtggtttcaaatgatttagcaccattcccctagtgctctctcatgatacagttttcatgagatctggttgtttcaaagtgtgtggcacctcccccaacccccactctcctgctggccatgtgaagatgtacttgctttcccttcgccttccacgacaattgtaagtttcctgaagccttcccagaagcagaagcctgtacagcccgc

SEQ ID NO: 189775 - DNA, 466 bp, Homo sapiens
ggtcgttagttatatagattatagtgtctttattaagttaggaaggctgggaatttctcttaagaattgagaagaaaatattccccaatggtaacatactcatttaaaatgggggctaaaattactgttactgtccctgagagacataggagaggagcctctggggtgaattgaatattttttttaagccgccagctgtgctattcactttgtttccccaatgattaattgcatagatgatcctgagctcaatagacacgcattgactgaattctcagaggggtatctcaagttgcttacactggggatgttttgatgaaaaagttctaagtgaacttttagcttgctgttgattttccctgctaacatccagcatcgaagagatttgtcttccaaaggtgaatgtgaccttttgacttaggtctttcttgataatacgacctttccttctagcacacctcttcag

SEQ ID NO: 189776 - DNA, 459 bp, Homo sapiens
tcatcttgggcaaatctcgcacctctctaccagttccctcatctgcaaaatgggagtgataatgcctagtcttggcaaaacttgttgtgaggtggaaaagggctagtaaatctaaaaatgctttgaaaactttggcagtgctattgacaagcaaggggtcactggagtctgtcgtttttagtacaacgactagtattttaatcagccaaatgtgtgtgactggtctatactggagcataggtcccttcagaatggaaagacttttccaattttattcataatttctttagacaatctacaggaagagattgtcaagtgtaaacagagtttccaagtaccacaaaaccacagaaagtgatgctgagatggaaaacgattttcctgccttcttccattccaactggatccctctcccatgtggaaaatgttgacacgtcaacattgaaaaataacttagaa

SEQ ID NO: 189777 - DNA, 469 bp, Homo sapiens
ttcctattaggcaactagatgtctagttatctcatttccaattgtttactacttgggcaaccttaggcaggtcatttaaactctctacacattgattttgtctgtaagatggtcacagttaatatcaacctgcctgaaagtggtcaatgcaggtattaatatacgtgaaaacactccataaagagttagatggcgtaaaacattgaatccaaggtctagtttagtacagcactttttgagattaacggatgtttgacaaatactaattttgacttttcaaatgtaaaaatatgtgatggattaatgaaaaaccaaaaacaaaggaacgctaatcatagctgtgaatatgaaaagcaaaaatcaccaggtagagtggctcacacacggaagagagaaatattctatatcttgattgtgcttatagtcacatgactataaacatttgcctaatgaactcatcaaactgtaa

SEQ ID NO: 189778 - DNA, 752 bp, Homo sapiens
gctcagcccctaacatgccctgggacagcagctgagccacctctaggtctgagtctgttcttcacctgctgaatgggagggaaggtaaatggcctgcaggtctggggtgttcaaaccacaggacctcagctccaaagaaatcaatgatgcctaggagtcccctggggagaggggcagcggctcaggcaccctcaggatgaccagccttggaatgacccttttctccccttggtctcatgagccctcatatttcctttcccacagtggggaccaaatctcatttgaggaccaaaaggggccagggccagagaagacgacttctccatgtgactacccacagctcctgcagaaaacagggagtgacctttgacccttagcatctgcctccacttcctctcttggcaagggggatcttgttgctgcaaacccacacaccttgagcagagggtaggagaggtggtaaggggcaaccatcacctagcaatgctttggaggacaccgtgtcgctctgcctgcctatctcatcagtatccaggaccacctaatgagggagaaatccttgaagcaattttgcggagaagaaaactgagtctcaaagtgacagcatttgcccactgttactagagagtaaggcaagagacccagccctgggcctggtccagggctttctggaggcagtttcaaacctaggcctccgatggccttagtgtcatgctcttctccagcccctgcctcggctggctgtcccacta

SEQ ID NO: 189779 - DNA, 672 bp, Homo sapiens
gctcagcccctaacatgccctgggacagcagctgagccacctctaggtctgagtctgttcttcacctgctgaatgggagggaaggtaaatggcctgcaggtctggggtgttcaaaccacaggacctcagctccaaagaaatcaatgatgcctaggagtcccctggggagaggggcagcggctcaggcaccctcaggatgaccagccttggaatgacccttttctccccttggtctcatgagccctcatatttcctttcccacagtggggaccaaatctcatttgaggaccaaaaggggccagggccagagaagacgacttctccatgtgactacccacagctcctgcagaaaacagggagtgacctttgacccttagcatctgcctccacttcctctcttggcaagggggatcttgttgctgcaaacccacacaccttgagcagagggtaggagaggtggtaaggggcaaccatcacctagcaatgctttggaggacaccgtgtcgctctgcctgcctatctcatcagtatccaggaccaccgcacagggggagaaaactcaggagcaatgttaaaaggagacagtgagcgacgtcctcatacgactcacaataggccagaattaggtacacgggcacccccatgagagctcagaccgctatcgatatgcca

SEQ ID NO: 189780 - DNA, 691 bp, Homo sapiens
gctcagcccctaacatgccctgggacagcagctgagccacctctaggtctgagtctgttcttcacctgctgaatgggagggaaggtaaatggcctgcaggtctggggtgttcaaaccacaggacctcagctccaaagaaatcaatgatgcctaggagtcccctggggagaggggcagcggctcaggcaccctcaggatgaccagccttggaatgacccttttctccccttggtctcatgagccctcatatttcctttcccacagtggggaccaaatctcatttgaggaccaaaaggggccagggccagagaagacgacttctccatgtgactacccacagctcctgcagaaaacagggagtgacctttgacccttagcatctgcctccacttcctctcttggcaagggggatcttgttgctgcaaacccacacaccttgagcagagggtaggagaggtggtaaggggcaaccatcacctagcaatgctttggaggacaccgtgtcgctctgcctgcctatctcatcagtatccaggaccacctaatgagggagaaatccttgaagcaattttgcggagaagaaaactgagtctcaaagtgacatcacagtcacgatgttagttagagaacgacccgagacaagctgccatgcctgcgttcactctatgatggaacccccttcaaatctagc

SEQ ID NO: 189781 - DNA, 153 bp, Homo sapiens
atattgtgtataggtggtggctattagaagactagtagttcttggaactgttcctttttttctcacaatagtagttaagctgtgtcattgggatacaaagggaaggagaaggctatttccattcttagaatagaaaaattggaaaatgccttg

SEQ ID NO: 189782 - DNA, 438 bp, Homo sapiens
aacaaataaacaaaagaaatacaggatgtgatgcagggagtgtacgtagttggaattaaagcacttaatgggatagggcacggcaagggggcagagaaggtgctatcggagctgaggcctgaacgaaatgaaaaacaaaacttcataaagagtggaggaacatgctccaggcagcagacacagcacgtacaaaggtcctgagggaggccccaaggcactggaggataagaaaagagatcaggaggtcaggcgcaatggctcacgcttgtaatcccagcactttgggaggccgagacgggttgatcgcttgatcccaggagttcaagaccagcctgggcaacatagcaaaaccctgtctttataaaaaatacaaaaattagctgggtgtggtggcgcaggtctgttgtcctagccactggggaggcagaggagaggaga

SEQ ID NO: 189783 - DNA, 266 bp, Homo sapiens
cctcatccccctcccctaccccatcacactaccaggggtgaccacttcaatagcctggcatctatttttctagacattttgctaagcacataagcacacacacagaattaacaaaaatgcttcataccatacatagttttctgaaggctgattcttttattcaacaaaatgtcaaggagattattccctgcctacacatacacctattttgttctttttaataactgcataagactccattataatgatgattccacaatctgcat

SEQ ID NO: 189784 - DNA, 103 bp, Homo sapiens
cctatttgaactcaatcaactctttacagacccaaatacagtaactatatgttaggacttcaacatacaaatttgcaagggtcacacttctgcccaaaacagg

SEQ ID NO: 189785 - DNA, 200 bp, Homo sapiens
aatactatccagcaatgaaaatggaccatagcgacacagaataacatggtggggaaaagaagaaagacccaaaaggatatttacactatgatttttttaatataaagattaaaacctgttaaaataaaaactgaactataagggaaagcaagagaaaaagcaagaggcctgtgcgttggctcatgcctgtaattccagaa

SEQ ID NO: 189786 - DNA, 623 bp, Homo sapiens
acaatttaaagaaaaaagtgctttataaaaaaagatcacatattgtaggtcacagacataagaagaaatggtgaggaaggtgcaggtatccttcaagaaaagtatctctaaatatttactgagtgtatacaataataacaataatattatcaaatctgaaggaagttaaataagatggggtggggtggagggcagaacgatttagccaatgacaagcaagaatatgtaatttatatatatataagaaagtatagaaagtactaaataagatagtgaaatcagtcaaaatacagctacaaccacaataaaagcaaatggggcaaaagttccagttataaaacagagtgttaaactagatttaaaaacaaaatttagctacatgatatttacaagggacctaaatataaacataaacctaaaatataaggctacaaaaaaattcaaaggaaaagataaacgcaacaaaatattgagaagataaacatgaacattaatcaagacaaagctctattaacatcagacaaaacaggttttaagatgaaaagcattattagatatcaagagggttaccaaacagtgataaagatgcaatttatttacttaattgaagagcttcaaaatat

SEQ ID NO: 189787 - DNA, 284 bp, Homo sapiens
gacttttgaagtccccttatatatatagacttataaaggcagctttaactgaagcatattttacacatgttctatttggttgaagatatgaaattaccatttttgtagataaaatgtatttgaatattaacactttcatatagccaacctaattgttaccaacacccgaaacattcacaattacttgacttggaaacttcaacattccagaacattcacaattacttaacttggaaacttcaaattccagaacattcacagttacttgacttggaaactccaac

SEQ ID NO: 189788 - DNA, 359 bp, Homo sapiens
ggatatgtacctgtaaggaagtgatgcatgtgggactgtgcaggcagatctcatctgcaatgcagttatgactgagacctcagctcatcctgtagggagtttggagctgggatgctctttggaattgtcacaaattaaggcaaagggggccaccctttgtgtctttgtatcagccagctattagctacttggcttcatcctggagggggctgtgtaacattgggtaagagtctggcctagtgagaggtacagctgtaaatagttagcaacaagaatgcccagcagctggggcaataagagcctcagccctgaaaaggggacatgggtggagcacaatagtatccactacaacatccact

SEQ ID NO: 189789 - DNA, 442 bp, Homo sapiens
tcttcaggcctctgctggcgggccataatgaaaagggagggagagaggcagccccaggaaagtggtagtatcggtttcccataagtggcaacaaattaacacaaacttagtggctcaaaacacagatttgggatattaaattgctagaggtctgaagggcaaaatgggtttcgctcggctaaaatgaaggtcttagcagggttgtattccttctgaaagctcaagaggcgaatccatttcctgcctcttccagcatctagaggccacctgcttccttggttcacagcctcctcctccatcagagccagcagtgtagcttctctcattctctctctgattcttctacttcccactcccaccttttttatttttatttttttatttttttgagatggagttttgctcttgttgtccaggctggagtgcagtggcacgatctcag

SEQ ID NO: 189790 - DNA, 146 bp, Homo sapiens
ttctaagcaaggtatcttaatcttcccacaaacaagcaagacacagttttattttattaaaagagaccactaagagctaagagagtgtttttttcacgatagatgtgttcttagttgaggactgttgcaaaaccaccatttgcttg

SEQ ID NO: 189791 - DNA, 339 bp, Homo sapiens
gaggtggagcaatgagctgtgatcataccactgcactctaacctggctgacagagcgagaccctgtatcaaaaaaagaaagaaagaaatccggtggtccagagagccaggtatcaaaaccagacaaagatatcacaaaaaaaggaaaaaaaagagagagagaagaaagaaagaaagaaaaacttcagaccaatacctctcataaaagtagatgaaaggccgagcacagtggctaacgcctgtaatcccagcactttgggaggccaaggcaggcagatgacctgaggtcaggagttcaagaccagcctggccaacgtggtgaaaccctgtctctaatttt

SEQ ID NO: 189792 - DNA, 436 bp, Homo sapiens
tgctacccttcctcccagctccccaggtacacttccccaaccttcaaatgtcatccagatttccaatttgacaggatgctgaggatcttgtatggcatgctgcctcaaattatttcactcctttttccttttccttcccaagaaggaagatgaacattcatgagctgactcaggccgagaatctttcccttccacttagggtgagccaatcaatagctctacccacagtcctcactgtgctgatgaccaacactgcattaatggcattgctatttagcagcgcaaaagaagggctcactagaaaataaatttattgtccccctccatctcccccttcagtgaatcccaccttactgcttcctgttagaaggctttggaaaccctgtgggttatcaaatagcaccatttcccttggcggtgttacactattgattga

SEQ ID NO: 189793 - DNA, 318 bp, Homo sapiens
ggaagtgaggccgactgggaaatgagacaggaccattagttacccttaagatgacctaaaaaatattttttacagatctgataaattcacactattatatagtttaatacacacacacacacacacacacgacttggagaaaagagctgagtctagtcttagttttagaaatctcatttttactaagttctccagtgacacaaaccgcaagctaaaaagtttcaaccaaaatttaagaaccactgctttaaacaattctgttcttgaaaaaacaaatgcaagaaataaagagaaagtaatccattttctaaataaagg

SEQ ID NO: 189794 - DNA, 218 bp, Homo sapiens
ggggctttcgtggactgcagttcgcatggcaggcataaggagcgctaatccagtgatgacagcatctttatgcctacctgggaagatgcagcagccagcacagccctaatatcagattaataccggggtgggggcatgaggcatggctggcacctgagaaggcaaaagggaattctgtgattggagaagaagcaaggcaggtgtgtcattaaggtcag

SEQ ID NO: 189795 - DNA, 329 bp, Homo sapiens
accaagatggtgccactgcactccagcctgggagacagagcaagactccgtctcaaagaaagtttttgttgaagctatctgcgtttgccttgcctggcatggttttggttcatgtttccttcccagctccctgagtgactctccctaaagcagggagaaagggagggaagaggtaaacagaatatggccaagggaaatcccacacatgtggttggcagacttaccatgagccagaccctggctagttaacgggtatccagttatgaccaaaacagacatggaccccttgtatttctccttctgactctaacctagtaatgcccagtcat

SEQ ID NO: 189796 - DNA, 123 bp, Homo sapiens
cagatctaattaagcctttccatccagctgccaattggcagtaaatacacaggaacatgctgaactgcacaatgagcctgcaatcagcaaaatctagactgtgggaaactacaagtaaatgac

SEQ ID NO: 189797 - DNA, 447 bp, Homo sapiens
ggaattacagctctcattcataatcttatggatgcgtcatcatctcacagtccattgttgaacaaaatgtcagtatgtagtacatgactatattttatctgtattattcatcatatagagtactgtggctgctctgtgaatatagttattgtatgtatttctttaagggaaaatgagttctgagatgcaaaataaccaagttaaaaatgaaaggcgtgagccaccgcgcccggcctaacctcatcttttaacagtcttactcttgagtccctcaagctacagtcacctgccttccactctcgtaaggtatgacacccccttcccacgtactgatctctctactggctgttccttgtgcctggagtatttttcccagtttatagtatagcagatacattcttatctttcaggtctctgcttgcttgttactgcttaagagcccttccc

SEQ ID NO: 189798 - DNA, 389 bp, Homo sapiens
tcttagaaaaccctgtcatttgtgtgactccttaacagtctctaagtgacagctgctagtttggcaaagaatctttcaaaatgaaaaatgagaaattctacaaactgtgtcagcaacaacttatttatttcaaattctagccagctgcaaaaaggaaaaagaacaatcatttcagttccagcctagagttgttcttccttcacagtttattcctggactcaggaaatcaactggaaaattaatgccagtgattctgagtcccaaggaaaacaatatctctgagaaccatttgctaaattcctcttgaccttcctggtttggctggtatgaggaataggctataaatgtaggaatgaggaggaagtctctgcaattgtggggacttgtca

SEQ ID NO: 189799 - DNA, 582 bp, Homo sapiens
aaatactacaaagttccaattattccatccagtgggaaggaacaagtaatgcaaagtaaatcactgtctggttttagaacatgtatttctacatcaatcttaagatagagacaaaagatctacgcagacacaagactgagtaaagtaacaaaattcgatcccaaagatctaatttcggaagtttacaagtgatttagctttctcactctaccctctaatgaaaaatttgctccccacttcaatgcaaaaatgggcaaccttaattcttaagccactgcaaagtatataaagcagaactcagctatttataaaatactgccagtttatacatttcctggttaattaaggtgacaagtaagtctatagtttagatgacgttcttttttctaagggaagttgaaattgatctatgttattgagtttaatcaagcaaagtaaggtaaaataaacattttgttaatttatagaatcgttctatagaaaattctagttgtaaaatttactgaattatgtttatatatgtacatgtatacagaagcaataacttcttgtatactaactgtgagattcttagataataag

SEQ ID NO: 189800 - DNA, 344 bp, Homo sapiens
ttggccctccatatccatggcttttgcatcatggattaaacccactgtggatcagaaatagagaaaaaataattgtgtctgtgctgaacatgtagacttttttcctgtccttattgtctaagtaatacagtataacaagtatttacatagaatttacttttattaagtattgtcatcttatataagggacttaagcatctgcagattttggtatccacaagggtgggtttggggagggaggtcctggaaccagtctcccacaaatactgaggcttaactgtacaaatgatgatgtgtggaaaccaaaattaaaaacaatttctttttataactcacctgtcaac

SEQ ID NO: 189801 - DNA, 500 bp, Homo sapiens
ataataatgatgatggcagaagtgtgaggctgtaggacacagggtcagggtggagcagccctgagggggaggggcaagggagggctctggcacttgggacccatatggcaaactgcattgtctgttgggaagggttgaagacaagcccgggcctgtcttcttgtgcagcctctgtcctgggctcgcacatttggtaggaggagccaatgaagtaaacggataggaaagtgtccacactctggctggcacgggtgtgtgctcactgacggctgggtcctttctctataacctttacctccctgaaaatctcagatggtgggtctccgcctgcctgcttctgagacggtgggtcctgggcctcagggagtgagagagagtgggcctgctctcctgcagaagggactggtctttgaaccccagaatcgggggttcttgtgtcatcaccaccatccacatgatattccttatcaccatcctatcctgatgtccccattgccgtc

SEQ ID NO: 189802 - DNA, 557 bp, Homo sapiens
caaatgggttcaaattccacttatagcttttcattattgtaatccagagccaagtcagggtctcattatggcttgggaacttgatcatttaaaaatgacttattcagtaactaaaagagagaagttttttgcgtttttttcaactattttcccaaaaataaatcaaattgtcacatgagaatatatatgaatttaaagaaaacgattttctgatgaagtacaatgatcatgatggtagaacttccttcttaatccctgacagttgctattggatagtgtcaatattgctttataaggtcaatagaaaatcagtttatttcactatagtacatttcctgaaacattttctgaacatcatgtttaccctccagaagtatcctgatatggtttggctgtgtccccactcaaatctcatcttgaatcataacttccacaattcccacatgtcatgggaggaacccagtgggaggtgactgagttacgggggcacgtctttcctgctctgctctcatcatagtgaatgagtctcacgagatatgatagtttaaaaaaaaaaa

SEQ ID NO: 189803 - DNA, 650 bp, Homo sapiens
gtaccagtgatattagatgaggaaatagtgggggagtggggcccccagataactgaagcttctaactaaggaatatatcaagttttgtaaatagtaagaaagtgatgaatttagttttgctcattattttgaagtattaatggaatttctaggtggaacagacagtttaatatataagaaagaaagaatatatagcttctatgtatatatatagacagtttaatataaaagaaagagaatatatatagctaaggaatatatcaagttttgtaaataataagaaagtgatgaatttagttttgctcattattttgaagtattaatgggatttctaggtggaatagacagtttaatatataagaaagaaagaatatgtagcttctatgtatatatatagacagtttaatatataagaaagaaagaatatatatagctaagaaatatatcaagttttgtaaataataagaaagtgatgaatttagttttgctcattattttgaagtattaatgggatttctaggtggaatagacagtttaatatataagaaagaagtgtgaatgtaatgtaaagaagtgtgaatgtaatgacaaaattctattaaacagtattaatcactaggtgataatttttagaggttatatgcaaaaga

SEQ ID NO: 189804 - DNA, 493 bp, Homo sapiens
acctcccacccagccagcagcccagctctcctttctcgtctgagcaggaaccaaaggtcctccattttgtaccctagaggagtgaagaaacagtcaccaaacaacacaaagcgtcagatctgttacttttccagccatgactcccaagcttctggctcaaagggtaccgagtggtcaacaccccgcctagtgcagggggcatctggtttctcacctagatcggggtctctcaaatgtacttcttctatcaatgatgaatgctcttggcatttagaaatggagtgataaggtggtcacttcgagtaccttacccttttttctcttgcgtcaaggctggctttccattagcagtgataatttaatatagatccagcccaaagggtgtttcatgagctgatactctgcctgtgacttatacatcacagcctcggccctactgattgattctttttcctgtcaaatttataggaaagtgcaagaactgtacaaagaa

SEQ ID NO: 189805 - DNA, 110 bp, Homo sapiens
acttgtatacacgtgattgtaggtagttttggtgcttaatgaaataataccttttatttaagcttttggtactatgttttgtttctttgaaaaggttgtgttggatatta

SEQ ID NO: 189806 - DNA, 357 bp, Homo sapiens
cagagttagtagatagaagagttgccacttgcaggcaggtctgcctggtgccagagcctttgattttcatcatgtgctgtacagcttccaagatgactttgtccagggagaaagtgagagggagggcaggagggatatatcactttatcttcatgtagagatcaccctttattttagcaaagttgatggatggatttaaaatacagtataattattgcaaagtgctatgagagtccagaagagggactcattctgccaagaggagggctttacaaagaagatatttgacctgggtttttttctaggctgagaggataaatctagccttttaatcatgtccaaaactgtactcggcat

SEQ ID NO: 189807 - DNA, 413 bp, Homo sapiens
gtcatcataaatctaaaatcagtacttaaccccaaaagatcagttgtagaatgattttaagaagatctctgggggatattacaaggttacagtgacatggctgccaaagaacttcaaatgtactctttaaaaaatatgtatatgactgggcgtagtggctcacgcctgtaatcccagcactttgggaggccgaggcaggcggatcatgaggtcaggagtttgagaccagcctggccaacatggtgaaactccatctctctaaaaatacaaaaattagctgagcatggtggttcattcctataatcccagctactcagctggctgaggaaggagaatcgcttgaacccgggaggcagaggttgcagtgagccaagatcgtgccactgcactccagcctgggcgactccgtctca

SEQ ID NO: 189808 - DNA, 228 bp, Homo sapiens
actaggaactaggggcaagctgttgtggggggaggcgtatcattttcaccatttcagaggtaataaaactggggcagaagggttgaatgaattttccaacattccagagtaagcctgtcccagagctacgatgagaacccccatcttagattcccagcccaaagcactctccagtggatcagctgccaaggctgtgagtaaacgtaaggacacacacacacacacaca

SEQ ID NO: 189809 - DNA, 251 bp, Homo sapiens
tctcacacacacacacacgcacactcacatacaaacacatttttgaagtttcttctacagaatcacaacaaatggcatgagggatcaaaatatttaccttaaagtttctccacttttatttagatccacttaaacatgttcatgttaactcagacagcgactgcactgctcttcacatcatcgaacgctggcatcaccatcactttcataaaatagaccattcgcctgtcaccatttgcctgccagcctca

SEQ ID NO: 189810 - DNA, 153 bp, Homo sapiens
ttagaaattgccaataagccaaaataactggaaagtgcccacagtttgccccttgccccagaggcatcgttgctgttttgccgtgccacttacctagagagtgtccatctgtgaaggttgggttgccccgaatatagctgtcaccactgtcct

SEQ ID NO: 189811 - DNA, 529 bp, Homo sapiens
acagattgctttggagaggtaagatggcaatgagggaatgaatggattcagctccactctatgtgtgggagttcagccagcatatctggttgaatttgttcagcctttaagcttgggctttttctctttcttgccacatcccttagaggcacaaaagatgagactgtagcctattggaaaccaaacctgagaagattcatcttacagagatgtgttccgcatgctacaggatgactgaagggacaggcaaatttagacctcaacttatcccatctttactgcccattagtctttctgagaggaaaaagacccacaaaaccatggagagtccattcaagctcttagcttcacacagagaaaagctcctctcgtgccaatgagctgtcttgaaggcatgtgtcgttgttcataagaaagtacaggttagagagcagatggcttagtccagctcatgactactattgtaaaatcatccttgcaccatgttcatttgcttaaagctggttgcctttcctctggtgaatgtact

SEQ ID NO: 189812 - DNA, 1482 bp, Homo sapiens
gctaggtaggaggcgcgggtgaatcggcgagggtgtcctctcttactacagtgagggaggctatctggcggtgatattttgaagtattcaacatctttcgttctaaatccatcctgaaatatttatgaagctcacggcagtgcttagtaaatatttgttgaaagaagtatttaagaggaaaatcaatgtgacgatgttggtagataggaaagtcaaggatacttcaaaagtatgaagttaacttgtgccatcacttaagagggcaaaaacacaagagcatattttcagtgagaagacagtgatttcaattctaggtatgttgtttgacattgctgggatgtggaaatagagaggtctgatacacatgctctgtgctcagtgatgaaaggcccccaggaataagattgtgaggaagttgggaacttgttttcttaattagtggttctcaaagtatgatcttcaggccagcaacatcagcaccactggggactttgtggaaatgtaaatttggggcccaggccacacctacttaattgaaaagtctgggatggggttcaactatcagtgttttaagaagtcctccaggtgatctgctataccatgaagttgaggaccactatcttaaaaattaatcagaactaccaagctctaatgctcaatgctatccagacttttggtgataaacctactaaggcatgctaacattgtgttctttgtacagccaggtcctccctaacaggggatctaagaggctataaataaaagcaatgaaagcttttactctatgcatttgaatgctagctataccactttctatttatgtgtcttaggaagtaaattgcttaacctttttgagcctagggtcctcatctgtaaaatgggaatgctaatggtacctatttcattgaattcttctgatgattaaatgagttcatatatgtaaagtgcttaaagctgtaataagtttgctgcttttaaaatctttactcatttagaaagtcacttgcccctggtccccccaacctttttttttttttttttttgagatggagtctcactctgttgcccaggatggagtgcagtggcgcgatctcagctcactgcaagctctgcctcccgggttcacgccattctcctgcctcagcctcccgagtagctaggactacaggcgcctgccaccacgcctggctaattttttgtatttttagtagagatggggtttcaccgtgttagccaggatggtctcaatctcctgacctcgtgatccacccgtctcagcctcccaaagtgctaggattacaggcctgagacaccgcgcccgccaccccccctcttttctttaactggcctaactaaatatttagtcttttcaagtttacctcaaacctctcacgtgtgaaagctctactggttagccctagagttaattatattgtattgcttggctcataggaggtatttaataaacacattagttgactg

SEQ ID NO: 189813 - DNA, 216 bp, Homo sapiens
tcaatttctacactaatatttataacagcatcatttgtgagcctcactcttagaaggcttagtttatgaccagtttgtaagagatctagtgaatacacatttttctaaatactgcattccaaatttaattgtatttaacagatacattccaaaggtcctaacaaaaacaaaaccaggaaataaaatgatgggatgaattggctcttctggtggttc

SEQ ID NO: 189814 - DNA, 464 bp, Homo sapiens
gaagtgagtgtcctcgaggtgcagagcgcagtctgagtcggcgcttgacgtctgcggtctgaggacggactagggtctgggcttggggctgggtcctgaagtcggggtctgagtctggagtcgatcttggggtagcattggaggtttggagactggggtccgccttatggcgtcttgggtctctggtattaagtccagggtcctgggtctaaagttctggatggaggtattgggggttgaggtcatgggactggggtcttgggtctggggtcttggggaactgcctctgaccagtcggtagagtcagggtgtgaggtctgggtctccagcctgggttccgcgtcttgagggaggaggacctggaagaaccagggctggagtgaacagactccattagttgagagaggtctgggatgacacaggggctcgggaagccactgcctcacacctccccattctgtggc

SEQ ID NO: 189815 - DNA, 313 bp, Homo sapiens
tgagcaccaaatgttagacattgccccagaactgtattgtagccctgccattgtttcccagtctggggaagacttaagcagaaactaggacttaattctgacattttagttatttctctgtaggggggaggttccagattgagcatctgggcattgggaaaaatctggttagaaatttgggccttcctgcagattgcgttctctgcagccttatggtaccagtcagttgcttttacaattttatttatttaagaaaatttttttgtaaatttttcaagtgcaattttgttacatggatatattgagtagtgga

SEQ ID NO: 189816 - DNA, 388 bp, Homo sapiens
cacaattagcataccaagactcatctgcaagtgaaagccactgtgtaaagtttggaagaggtgattgttctgccaggtgtaaagacattgatgcagaaacaaaaaggaaatacgaaagagcgagacaatatgatatcaacaaagaaacacgataattctccagtaactgaccccaaagaaaaggaaagttatgaatttcctgaaaaggaatttataatggtgtagaaattgaacctatcattgatggacatttgggtgggttccaagtctttgttatggtgaatagtgccacaataaacatacgtgtgcatgcatgttatagtagcatgatttataatcctttgggcatatacccagtaatgggatggctggatgtgtagaaattgaa

SEQ ID NO: 189817 - DNA, 333 bp, Homo sapiens
ttgttgagcccagacaatgatttgagggttggcaaagtgccttgtttactttcctggttaaaagaaggtaaactgcatcatctggtgtgaccagatggaaccaaagtgcctttaagtatgcaggtattgctttacttcaggattaccaacttatgcaactgtagtttcttctttggcaacatgctgattagtaaaaaatacctgggcacttactaatttcatctaattcaaagagaaagtttaggaggtcacaagttgtggactttgcatcttggttatcacaaaattaatgacccaaggcaatgaaggctttgacttcatgtgcagaagata

SEQ ID NO: 189818 - DNA, 792 bp, Homo sapiens
ctacccttgcccctcccagcctctgataatcagtattcttctctctacttccatgagatccactcgtttagctcccacataaatgagaacatgcaggattttcaagaccacatctttatcacaacctgcaatctctgccccatagcccctgttcagcatcatctaatgtaatgattcttgatcttgtgcttccagtgctctagactttctccaattcctgggcatcatcgtgtttcctctgctcctgggcccttgcacacacacctttaggttaacctggccttcctgtctcctctttcctgaggtgctagctcttcagatcttaatttgggtgtcaagtggctttggcaaggcctcaggcaagactttctgacctatttggattagacccaatatttgtagtaaatgctttatagtttcccatatttttaaaatagtatttattacagcctataatcacatagtttatagttatgtagtcattgttacttgattaatgtctccctcctccacaaaggcaaaaacagatccgttcactacttatcccagtgcctaccacagaatcagtgcacaaatctcttttagtatcacataaaaactgtggaccctttcatgagaacaaatgaaaatatagacacatccacagcatttccccccacagttttagggagtttgttccctgacccctagccttttccctttaaaccaggctttaaaactgctgccttgaagattattaataataaaatagctgattaacacacttgtggaattttcaaataattggtcttt

SEQ ID NO: 189819 - DNA, 466 bp, Homo sapiens
tgcagtgagcctgtggtcgatcactgtactccagcctgagtgacagagcaagcctgtctctaaaccaaaaatatttaagaagaaagaagaaagaggaagaggaagaagaagaagaagaagaagaagaagaagaagaagaaaaaaggaaggaaggaaggaaggaaggaaagaaaaagaaagaaagaaagaaagaaagaaagaaagaaagaaagacaaagaaagaaaggaaaaggaggaaaagagagagggagggaggaaggaaggaaaggacggaaggagaggaaaataaaaattgaggatccaatgcttatactgctgaattgttcaaaacatttaaagaggaacttatactaattatttacaaactgttccccaaaaaagtgaaaaggaggaaactcttccatactcattctatgaagacagaattaccttattccaaaatgcgacaagtacagtgatcgaccaa

SEQ ID NO: 189820 - DNA, 796 bp, Homo sapiens
atcaagtaacttcttcataaggcagcaggaaaagagagtacaagcgaaagaggaactgccaaacacttataaacccatcagatgttgtgagaactcaactcactatcatgagaacagcatgaaggaatccgcccgcatgataccatcacctcccaccaggtacctgcctcaacacgtggagattataattccaggtgatatttgggtggggccacagaaccaaaccatatcatagggttttaagtaaatgagtgatattatttgagttagagtagagaaatatcacacttctataaacaattactatatctcaggcactgtatatccaccttaggtccttttcctttaatcttcaccaatgaatgggtacaattattatcacttctcagattagtaaagtgaggcttagggaggaaaagcaacttgtttggagtcacatagtgactatatggcaaatctgaacctcaacccttgtcatctgcctccagttcctggctcaaaatactcattaaaggctcatttttattgccattgtttatgatgtttatttttctaacccttccaagagtgttttgtggattgcattattcttttcttctcaattttataaataaaagagactcgcctcaaaatcacaactgaaggaaaaaaataacaaacttgtagtttcctctaaagaacttcacggacacccagctcagaagaatttggcccggccagggatggggcggggagggaaggactggctgccgcaatgttttgggttcggccatcccatttgtgagaattaggaatg

SEQ ID NO: 189821 - DNA, 519 bp, Homo sapiens
tgcaggagggaagggagaagatatcaaggcacagtaggaagtgggggtgagctcaggtctgatggccatgattttctgagattactaaggaagacaaaatgatagccaacatgaacatttccgaaggctaggggtccgtacgctggagtgagccattctaagataaatgtaggctcggttctttttgtaaatgggactatagcagacatgtactgaaacagggctactgctaaattgttgagacagaatgcatatgtgaactagagaaatatactctgctccaagatatctgtggtttgcagacattgctaagtgattcctatgtcaaaattttaatatagtctcataacagcactttatctggctgaaactgactgcctttttcttcaaatacatgtttgcttagctatatattttgctacataaattagatattaatttgcaaagcacttgagatctaattaattatagtaaatttatttctgctttatctcaacaacagctccaaacaatacccta

SEQ ID NO: 189822 - DNA, 455 bp, Homo sapiens
cagtcacagaatctgatgattaatctacagtggggtcctgaagaaagtatgtgcatttccccatgactaacatgaaattatgggcaagcagatgttaaccacagctacactggtataggataaagctaatacaaacggaagggaggacgactgtggcttccagaggcttgtctgtgctgggtctgatcaggccctggagaaatgactaaaacaggaaaataggggcaggcaacgcagtttttcaagaggcttaaagcatattattttgagccttttctctacttttttacaagccctttctcttacagaacaaaaaaggtgctagagtagttatggtttgattcttgtacccaaattgtctgaaattttactggtgcttgaaatccaagtctgggattaactagtcttcagcactagatgggggcaggttgtatctgtttcatgtttctaaataa

SEQ ID NO: 189823 - DNA, 606 bp, Homo sapiens
tacatccgttaattcttaaagatgctcaaacacaaaataaaatatattttgaatgtagacaagtaggcatcatcaatttttttaccacagaaaaaggtagtattttatatactttttccacataaaagtctacctctgaatttaccttttcactcggcttttcatttttacttgtttttttagttttccatcataagccagtcttctattatatcaatacaaactttataaacttgtttacacttaatttttgtcttattctgccttgaataaaaatagtcatagtggatataaaaagaaaattctaatgatttaatttgatgtcagaaatacataaaaaattgtaaggggataaaaatctcactgcaatagctttctcacctttgcataaaaattatcactttgatttcagacaagtttttacaagctgtggttattaagaggtggatctcaccatgtgagacaaaaaaacacgtgtgtgccaattctaaattaatttccaaatatgaaatacatccgttaattcttaaagatgctcaaacacaaaataaaatatattttgaatgtagacaagtaggcatcatcaatttttttaccacagaaaaa

SEQ ID NO: 189824 - DNA, 401 bp, Homo sapiens
gagtaagctgggattacaggcgcctgccaccacgcccagctaatttttgtattttcaatagagacagggtttcaccatgctgatcagactggtctcaaactcctgacctcaggtgatccacccgcctcggcctcccaaagtgctgggattacaagcatgagccaccccatccagctgcaataatttacacaataatagataggtctaagatgaagactgagtgtttgcatttctaagaagttaccaggtaatgttgatcctgctgatgctggcaccacattttgagaaccactctcctatgaaatctcatcttctcccatggtttgaacaatcatctaccttttcagtgaggcctacagtgactctcctattgaatatttgtgtaaactgattccatccta

SEQ ID NO: 189825 - DNA, 662 bp, Homo sapiens
  misc_feature (464)..(464): n is a, c, g, or t
  misc_feature (469)..(469): n is a, c, g, or t
gtggtatgttggtgggacaggttttctgtgggtgtgtgtattgattacattgtttagttatagggaatgtgcacctgtttttgtcgtgtgttgtgtgttttcagctgggtgtggtggctcacgcctgtaatcccagcactttgggaggccaaggtgggtgaatcgccagaggtcaggagttcgagaccagcctggccaacatggcgaaaccgtgtctctactaaaaatacaaaaatccaccaggtgtggtggcatagatctgtaatcccagctactcgagaggccgaggcaggagaatagcttgaactcagggagtggaggttgcaggtaggtgggtagatgatgtgctgggaatttgtggaaactcccttcttattgcttttattttcctagtgagtgaggggataaggttgtcagctgaggcaggggaatcgtctgaacctgggagacagaggttgtagtangccgngatcgcgccactgcactccagcctgggtgaaaggctgcgactccatctccaaaaaaacccacaaatataacaaaataccacaaaaactacgtatctcacgactggttcccagttgatagacagtcactatctagagacagggtctcactttgtgattcgtactgtctcatactgactgatggcaacattttgc

SEQ ID NO: 189826 - DNA, 366 bp, Homo sapiens
agggttttccactctcattggtagggtggatttcagtggtatgtaatgataatgatttgcttccatgttacaacatgtgaacagcttatttatagatcatgagctgcatccctctttcctctttttgtgcatgtttgctttcaaggagaatatagtgacaaaaattttaatctgccttttagctcaatgctaggttcttggtaatttgttgagcaaattaatgactttcatgtacatttacagataatataagcaaagtatcataatattggcacaaaaaaacattaaggttcaacttaattctgtttttcaaaatatattttaataaaactatacatgtaaacatctgtacttgattttaatcat

SEQ ID NO: 189827 - DNA, 377 bp, Homo sapiens
cctcctcccaacagaaaaggatacattcctcttgagtctaagagcttttagtcccttctaggtcctcaaatgagacctggaacgtcatccttctttaaggcagagatgacctgaaatgtcactgttttgtagggctgaagttcctgtccccgctgctctctgggccactgggccaggctggccaatccaccactgaggaggaaggcaaccaatatctgttgggcacccgccaggcaccaggctttgtgagtgttatcacatttaatcttcacaactcttcaacagggtaactatgagccccctttcacagatgaagaggccaaggctcagagagatgtgatgagaagaaacagagactcggagaatagccaggtggc

SEQ ID NO: 189828 - DNA, 776 bp, Homo sapiens
tcaaagttcgaagtgggatgatcacgggcagacctgggtggttgggaacaggaagcatatggcatcttgcaggctataggcaccacaaaatggaacgcaggaggacaggggcttgggagagccacttcactgtcgggtaaaacaacggagcaagatgagtgcctccggatgcttggtttccccaccctccagtgtctgcttgctcttcaagtacctccaccaagctaatgacagtccactttaggacatcacgggcctcgaggttacaactttcccaggctttgttatttggttctctactgcacagaaatagatagaattctgacagccatcattgttaaacatcaggattttctaagaggacagacttaacagtaacatcatggcctcagcaggactccagctccttgctttcatcctggccttatctggggtctctggagtgctcacagccactctgctgcccaactggaaggtgaatgtggatgtggactccaacatcataacagccattgtacagctgcacgggctctggatggactgtacgtggtacagcactgggatgttcagctgtgccctgaaacactccattctgtccctccccatccacgtgcaggctgcgagagccaccatggtcctggcgtgtgttctgtctgctttggggatctgcacttccacagtaggaatgaaatgtactcgcttaggaggggacagagaaaccaagagccatgcttcctttgctggaggagtctgtttcatgtctgcaggaatctcta

SEQ ID NO: 189829 - DNA, 532 bp, Homo sapiens
ttcgctcaatcctggttttgccttttttccttaggctttgttatttggttctctactgcacagaaatagatagaattctgacagccatcattgttaaacatcaggattttctaagaggacagacttaacagtaacatcatggcctcagcaggactccagctccttgctttcatcctggccttatctggggtctctggagtgctcacagccactctgctgcccaactggaaggtgaatgtggatgtggactccaacatcataacagccattgtacagctgcacgggctctggatggactgtacgtggtacagcactgggatgttcagctgtgccctgaaacactccattctgtccctccccatccacgtgcaggctgcgagagccaccatggtcctggcgtgtgttctgtctgctttggggatctgcacttccacagtaggaatgaaatgtactcgcttaggaggggacagagaaaccaagagccatgcttcctttgctggaggagtctgtttcatgtctgcaggaatctcta

SEQ ID NO: 189830 - DNA, 208 bp, Homo sapiens
tttcttttagggcaagatctaaggaacctgaattaacataagatcattttctagtcccaaacttgtaaatatggtttaattttcccaagtacattttgatagagcaatgtaagaaatattatagatggatctaaataattgactttccaaaattaaagacccttattcatcaagctttttgctcttgaaaggaactgggtttcagaca

SEQ ID NO: 189831 - DNA, 350 bp, Homo sapiens
tggtgtacccctgtaatctaagctactcaggagactgaggtgggagaatcacctgagcccagggtgttgaggttgcagtgagccatgatctcacaactgcactctagcctgggtgacagagtgagaccctgtctctaaaaaaattaaaaattaaattaaattaaaaagaaaagagaagattggactttccggcattctaggcaggttgtgacttggaatcaaagtaatgtgaatattaatgaatatgatgttattttgtcctgatagaatggcaatctctgcactctctggttatacctctttaaattcaaccaagtgctatgtctatattttttagtaattttttaata

SEQ ID NO: 189832 - DNA, 696 bp, Homo sapiens
cagcccacctgcacccaggtgaaataaacagccatgttgctcacacaaagcctgtttggtggtctcttcacacagatgtgcatgaaatttggtgtggtgactcggatcgggggacctgcctcaggaaatcaatcccctgtcctcctgctctttgctccgtgagaaagatccacctacgacctcaggtcctcagaccgactagcccaagaaacatctcaccaatttcaaatctgccactcccagagcccgtggaactctggcccaaggctctctgactgactccttcttggcttagcggctgaagactgacactgcccgatcgcctcagaaaccccgtagaccatcacggacgccgagctttagttaactctcacagtggaggaatctaatttgaagcactgagaaggataaggcatccatttgaaaaggactcctatattgcaacatgaattctgctaaaattgaagcaagaacaaacatcaaatttatgatgaagtttgggtagaagaacgatgaaattagtgacgctttataaaaagtttattgggacaataccccaaatgaatcagcagtttaaaaatggataacttattttaagaagaaacaagatgatgttgaagatgaagcctgcaacggcagaccatctacatcaatttggaaggaaaaaattaatcttgttcatgccctaacggagga

SEQ ID NO: 189833 - DNA, 839 bp, Homo sapiens
cagcccacctgcacccaggtgaaataaacagccatgttgctcacacaaagcctgtttggtggtctcttcacacagatgtgcatgaaatttggtgtggtgactcggatcgggggacctgcctcaggaaatcaatcccctgtcctcctgctctttgctccgtgagaaagatccacctacgacctcaggtcctcagaccgactagcccaagaaacatctcaccaatttcaaatctgccactcccagagcccgtggaactctggcccaaggctctctgactgactccttcttggcttagcggctgaagactgacactgcccgatcgcctcagaaaccccgtagaccatcacggacgccgagctttagttaactctcacagtggaggaccttgcaagagggtccgagacatttgcatcatcattcagtgagacctgtaaacacagcatctgcctttgaccacatccatctggaagaacctgagagataatccattttatgaaattttccctaccctgaaatgggagaatgaatctaatttgaagcactgagaaggataaggcatccatttgaaaaggactcctatattgcaacatgaattctgctaaaattgaagcaagaacaaacatcaaatttatgatgaagtttgggtagaagaacgatgaaattagtgacgctttataaaaagtttattgggacaataccccaaatgaatcagcagtttaaaaatggataacttattttaagaagaaacaagatgatgttgaagatgaagcctgcaacggcagaccatctacatcaatttggaaggaaaaaattaatcttgttcatgccctaacggagga

SEQ ID NO: 189834 - DNA, 690 bp, Homo sapiens
cagcccacctgcacccaggtgaaataaacagccatgttgctcacacaaagcctgtttggtggtctcttcacacagatgtgcatgaaatttggtgtggtgactcggatcgggggacctgcctcaggaaatcaatcccctgtcctcctgctctttgctccgtgagaaagatccacctacgacctcaggtcctcagaccgactagcccaagaaacatctcaccaatttcaaatctgaccttgcaagagggtccgagacatttgcatcatcattcagtgagacctgtaaacacagcatctgcctttgaccacatccatctggaagaacctgagagataatccattttatgaaattttccctaccctgaaatgggagaatgaatctaatttgaagcactgagaaggataaggcatccatttgaaaaggactcctatattgcaacatgaattctgctaaaattgaagcaagaacaaacatcaaatttatgatgaagtttgggtagaagaacgatgaaattagtgacgctttataaaaagtttattgggacaataccccaaatgaatcagcagtttaaaaatggataacttattttaagaagaaacaagatgatgttgaagatgaagcctgcaacggcagaccatctacatcaatttggaaggaaaaaattaatcttgttcatgccctaacggagga

SEQ ID NO: 189835 - DNA, 137 bp, Homo sapiens
cttttattattatcgcatatatattaaatggcttctagtgtttatgattttattgtagctttttaagatctcatcacactgccatcttaagcaaaacttctaagaaaatcgacttgaacattttcatttttatttta

SEQ ID NO: 189836 - DNA, 247 bp, Homo sapiens
cttttaccttcatgaggaactctttggaccataaactccttctgccttcactcacatatgagaattgctgaacactgagaacttgccaggttctaggcttctggctgggcactgaggggtggcagggggatgaaaaatgcaacatgtagctttcagggggcacttagtctgctgagagacagataagaaaacaaagacagtaagttgcagggatgagggcttggacttgggttaggaggggatctct

SEQ ID NO: 189837 - DNA, 149 bp, Homo sapiens
tattgatattttgggctggataattgtgtgggacttggtgttgcaggatgtttagcagcatccatgggctctacccgttagatatcagtagcattcccccagtagtgactatcagatatgtctccagacatttgtgtgtgttttttttt

SEQ ID NO: 189838 - DNA, 373 bp, Homo sapiens
aatgactctttcatttgggagtgtatgctcttagagtgaggtctgcctttgcattttgaggcattggagcagcaccaagctcctactaaatgagttctgaagcaggtccccaggctgacatgtgtactttgggctggtgatcactatggtgagagggtatttctttttttgcaaacctctccatcctattactgtcattctgtctcctatggtcatagtccaagggtgcttaggaagctgatttctttacctcatcgacttccacccattagcggtgctaaggaaaacaaatgggattgaaaaggcaagttgccagatacataaaaataatctgggtgaggaccaagagtgagactgtctgtattcagcctgt

SEQ ID NO: 189839 - DNA, 809 bp, Homo sapiens
acttctcctttggatgtccccctgttagaaggcagtcaaggccaagttaattataccagtagtgctgaaatgaacatttgggcctaaacctttgtccacatttctgcttaggatagatttcccggagatgaattaagggtcaaaggtcaagggcattcttaagactcttgacccacgttaccaaactgctttcagaaagtttgcacaaattttcataatcaccagcaggagttaagaggtccagcttgactgaatccatgctaatattgacatcagtttgattttcaaaatttcatctttgctgtagtgaagtcaaggaaaaaaatactatctctgaatggttctaatgtgcatttcttttatttttagtcaagccgtatatagttcatgtgtactttttacaaatgaattttcaggccgaactgttcaaccaccaattagaaacagataaaggaatctcattggtgttatatttccagaacacatgcattaactagttagatacctgtgggctgggagtctggccaacacttgtcaaaagctttaaagagaaatcattctgagatccaaacaatggattcaccaacacactttcagaacttacagtagtggttgccagttcctgggttctgatccttgctgcttgccatcttgcaagtcatttatattttgttcatatgtaaaatggggtggttagcctatgtaaccctatacgctcttaaaaaacaaaaagaggtatttgtgccccttggccttgactgttctcacaggggccacgagagcttctgaaggacacgttggggctgtga

SEQ ID NO: 189840 - DNA, 330 bp, Homo sapiens
tttcttcttaacgtttcaccccatttcattcagacctgttttttgtcagagctgtgcctattgttagagaaacttaactcggagaggttttaataatatactgattacaggagcagaaggttttttggaagctactccagaagttaggggtgtttagccccagccccaggtatactaagagcaggacttgatggttggggtttttatctccatctgccccaggatttctgtgaatgcattagcccaaagcagtcagaactttgtggcagtcctgaccagaccacttaaactattctgtgcctcactttctccagctgcgaaatgagtaaa

SEQ ID NO: 189841 - DNA, 692 bp, Homo sapiens
aaaggattatgaaagtaccatggatagacacttaggataggaggtggtgagagtgttggtagttatctgagaaaattttatagaggaaataatatttgagaactgtgagttaggaagaagatacacttattaactagaatagccttatagaagcctataggcataaaagcaaatttgaattgagaggactctaagtagattgttattccacagatatttctatattctaggcactaagctagacactgttgatacactggttaacgttatagagatcctcccctcaaagagctagatgaataacacatacagatacttaagcaatgtgacaagtgctaaaataggaaatgtaaagggcacagcaaacaggattacagaggataagccctaagtgtatttttcttaagttttcaaaattagttttcagataaagtggtcttgaaggtgagtgtggggaacgagaagtggggttatttcctgcaaaggaaacagcttgtgcaatgatgctgaagatgatgtatagcctattcagggactctccagcagttttagtggagctgacatacaaaatgcttctttatgtgtgttggttttggttgttcttttcacgtgcttcgttttacagggagttgacaagagatgaggaagcaggtactacattatgaatgatatcctcagccatactgggggag

SEQ ID NO: 189842 - DNA, 541 bp, Homo sapiens
aacctccacctcccaggttccagcaattctcctgcctcagcctcccaagtagctgggattacaggcacgcaccaccacacctggctaattttggtatttttagtagaaacagggattcgtcatgttggccaggctggtctcgaactcctaacctcaggtgatccatctgtctcggcccaccaaagtgctgggattacaggcatgagccaccgcgcctggccaagttaatggttttgagatgagattatcctggactacctggtaagccatatatgctgtcacaagtgtccttataaattagaggcagagggaggttgcacacagaagaggagaaggcaaaatcactccagaggcagagattggagtgatgcagccacaagccaaggaatgctggcagcctccagaagccaggagaggcaatgaatggctcccccgagcctccagaaggcaggcagtccttccgctcctttgactccagcccagtgaaactgattttagactctggcctccagagcagcaagagaataaatgtgtttgaagg

SEQ ID NO: 189843 - DNA, 468 bp, Homo sapiens
tctcttgaataattagaaatggaatggatgaatcgtatggcatcttcacatttactttgaaagaaactgcccaattgtcttccaaagtagttgatccattacacattcctatcgtcagtgtatgagagttccagatgatcctccattcttgtcaccatgtgactaatcctattcattacaaccattttaactggaataaaagttgtatctcattatagttttgatttgcatttctctgatgatcaacgatattgagcaccttttcatatgcctgcttgccattagtatgccttcttttgagaaatgtctattgaaatcttttgtgaaaggctttatttttttcctgcgcttttgaagttattcactgagggtaacatttaattttggggaggctctgatttctcagcaattgtcatgcatagtctgaaattccaacagaatgagaaaagccagtctacaaataatttc

SEQ ID NO: 189844 - DNA, 333 bp, Homo sapiens
ccaggttcaagtgattctcctgccctagcttcctgagtagctgagactacaggtgtgtgctaccatgcccagctaagttttatatttttagtcacgatggggtttcaccatattggccaagctggtcttgaactcctgacctcaagtgatctgcccaccttggcctcccagagtgctgggattataggtgtgagccactgcacccagctttcaaattcttttatgtcgtctttaatttctttcaatgttgttttgttgttttcagtgtacaggttttgcacatgtatgccatttttcttgctaatgtaaatggtgttttattgtcaatatata

SEQ ID NO: 189845 - DNA, 609 bp, Homo sapiens
  misc_feature (99)..(99): n is a, c, g, or t
  misc_feature (108)..(108): n is a, c, g, or t
ccaagctggtttcaaagtgctgggattacaggcgtgaaccaccgtgcccggcccctgaatcctatttttaagtataaaaagtcttttttcaagttggcncaaaatacnacattttcctgctgagcaatttagtctaggttaagtcatacttgaccatatgccctagtttagcgtccagtttgtgaacattctttacctgagttattgtaattctaatctcttatgtaaaactgcaggtagtcagccctttgtctccttcagttctacatctgcggattccttcaactacagattaagaatatttggggggaaaaacagtaaaaaaaaattacaatacaacaataaagacaacaaatttaaaaactagtataacaactttttatacagcatttgtattgggtattgtaagctagagatggctgaaagtctatgagacgatgtgcatacgttatatgcaagcgctgccattttattgcagagacttgagcatccaaggattttgtatccgtgggagtcctggaaccaatcccccttggatactgagggatgactgtatttacaacatgtctagattttcgacaacttgaattaaaccagaaagaatatgaa

SEQ ID NO: 189846 - DNA, 428 bp, Homo sapiens
gctctagagtatctccgaggagatgtggagaagagagctagtgatggtggcatcatcatagatgtggagaatgtatagtatgttgtttttagattaagagttttgtaggactgtttgtccaagtgttgagtttagatcctgagttatttgtaaattttctgccctattcttcatagccgaatacacaaacattattataataaacaccctctccactacaatcttcctaggaacaacatatgacgcactctcccctgaactctacacaacatatgttgtcaccaagaccctacttctaacctccctgttcttatgaattcgaacagcatacccccgattccgctacgaccaactcatacacctcctatgaaaaaacttcctaccactcaccctagcattacttatatgatatgtctccacagggtacc

SEQ ID NO: 189847 - DNA, 214 bp, Homo sapiens
cccaccacttcgagtttctaataaaatatgcctattctgacctgtcagctttccatggaaaaaactaaaaggtgagggaaggcagaataatctatagagacattctgggcacattttttcacttacactgaagagctggaggaaaatggaaactctccagcaaaggctatacaaagtacgtggttttacacaaagcgttacacaagtacatgga

SEQ ID NO: 189848 - DNA, 407 bp, Homo sapiens
ctgcagagctgtagttggctttaaaaagaaatcaaatatattatttctcttaattattcaattcacttatataagaatttaagaactcagcataatactcactcccagctgttcctaggttgtcccaaatggttgtacactggggaagggactacccaccctgtccaagtcagaggttttatgttaaattctaatggtcttctgaatgcattttgtaatacttcttcaataaactaaaaacaaagaaccatagaactacacaagcaatatagccacatctctgaaaacttacaatactgagaaaaaaaaaatcactcaattcacattccacagttgtgttcccatcctttcagccacctctcttccttccataataaatgaggcctgaagaagcctgtgaacattaa

SEQ ID NO: 189849 - DNA, 133 bp, Homo sapiens
ttatatattctttaatttatttcattagacttttatagttttcctcatatagattttgcacatattttattagatttatacccatgtatttcatttttaattggagctaatgtaaatagtgttgtgttgaaat

SEQ ID NO: 189850 - DNA, 348 bp, Homo sapiens
ctgacagctaacatttttggagctctgagtacctgtcaggtgctgtgcaaaacactgacttaaatgattcctggtctcaatccaatgggagaggagccagcgttatccccattttataaaaaatgataaaactgtgtgccgggtttgaactgttcctggatcacaaagctagaaagtggtagagactgggttggaactccactgattccagagccagaggaggcatctgaataatcagactaagccaacttctcagcagaaaaatcccttcactcagcagccaagtatccctgattccggtgctggccccgcatctcacgggatgtgtggccttgggcaagccccgcc

SEQ ID NO: 189851 - DNA, 551 bp, Homo sapiens
agtgatctgaatcagtattgtgggctccgctcctactcaagtgtggctgcagatcttggcttggcactcccaggctgcagccctggggtgagctaaggctttatgttctctcccagcttggaggcagcaggggaagggaccttggcagtggctatggcagagggcctttcccttgtctctggggtccaccccagtagaaatagcagaactgctgccagtcggtgtgattggctttgagtaggacagctgcgttgtgggctcaagctggggggatcctgggggagacagactgacctcttcttagggccgtggcagcttgctggaggtgtggttaaagcactctgggtctttgctcctttcctagtacaagggtagcaagggcagtaccactgcagtggcagtggcagaggggctttcggttgcctctgggagctccactgcagaaacacagatccgttgctactgggatgttcagccagggggtggggcagctgtgctgctggcctgagccgggagccccaccgggtgaaaggtggggtgccgagggctca

SEQ ID NO: 189852 - DNA, 146 bp, Homo sapiens
gaggtgggagggaacacagctatccttggacacacatggtcttcttgcttcagctctgacctctgatgccccccaacccagcctggattccctgccagggccccccggctctgtcctggtggaatctgccatcttgcccagctctt

SEQ ID NO: 189853 - DNA, 415 bp, Homo sapiens
acctcctaccccacgctgtttggcaaagggccagtagagaacagtgtgttcccccttgcacactttctcacccaccttccacctcacacactccacctttccctgaagctgcctccaaaagcctaggtttatgtctccttcaacagctctgacagagtctggttgacccaagccatgtgggtaattggtgggggcagacagccatgctacccatcccctcaacaccctggaagatgagcaggcagcagacaggtgggggctacactgggctcctcctcccaggcaggcccatgtgagaggtttcacaaagtgacctagaggcacttaggaagcccagggccttcttccacatcactgcccacggggaactgctctgagttgctaggcctaaatctgcttcagaaaaagcatggct

SEQ ID NO: 189854 - DNA, 1050 bp, Homo sapiens
atgctaaggtagagattacatgatgcatagtctcgcttatttttgtagaatcaggaaatcaaggattggcgtggcattgctttgacaagtacttgctgttgtcttcacagaggtctcactgaagaataatctcaaaggaacatttggtctccctatacatctgttaatgcccattagccactagcaaatgcttttaattaccaggaaaacatcaaccactttgggtttggcctgctccagggagcccaatgaaggtttcttccagttgtttccatagctctattgctgaagcacccctcttggttgggtgaatgttcatgaagccatttctggaaccagcttaggaggctaaggcctcctggagcctgtgacatggaagctttggaagtggatgatatcagcccagccttagaagttacggaggaattctttagtactttggatagtaatctagaaaaggctgtgcagcaggcagaggtttatgggatccaggaagtccctgaactggtggggcatgaggtactcagtaacataacagacaatggtgctatgagaaatgtcacctccctgggcaaggggggcatgatttgggaccactgtaagagcaggctcttagaaaccaaagctcaaaatgtcttccctgccaaagaacagtttatggtccagagagggacaaccccagataatctttcctggatggaacaaaaggaagcatcaacctttaatttcttcaatatctgtcagcgtcggagggaccggcctcgttctgtaaatgacttactggatgagacctcaactttcaagccagggcatgctcgatcacgatcagatattacccaagtggactggagggtagtcctcaaaaccacgcctttgcagcagcagcaacagcagcagccattgcttcaaggcccgcatgtcaccaggccatcttttctgttgccctcaccaaataagatagaagatgctcaaggaaatactgaacacaagcagacattcccaaacattctaaagaagggttacctggagattagaaaggaccatgacagt

SEQ ID NO: 189855 - DNA, 808 bp, Homo sapiens
attccatttattaatggaaattctccagttttgtcttctaagtctttgcatatattaatcagctattcattttttccaactttatttcttttaaccttttagaaatacaccttataaagccctactccttaaacttttccacttgtatcttgtaagaacaaggacatttttctaaaataaactaaaatgttgtcactctcaagaaatttgacattgatatgatggtattatcagtctgtattcaaattttcctaattgctctagttatagatttcaagctttctaaaattttattttctctaatctaggatccttcaagggtaatgcttttcttttggttgttatgtctctagttacctgggtatttttttttcttttatgatgatgatattaaaaaacaaatccaagacaggtacggtggtgcacacctgtagccccagctacacaggaggctgaggtgggagggttgcttgagcccaggaggccagactgggcaaccatgtcaagaccctgtccctttaaaacatatacacacagctgggtgcggtggctaacgcctataatcccagcactttgggaggccgaggtgggcggatcatgaggtcaggagttcaagaccagcctggccaatatggtgaaacccccgtctctattaaaaatacaaaaattagccgggtgtggtggcaggcgcctggagtcccagctactcgggaggctgaggcaggagaatcacttgaatccgggaggcggtgattacagtgagctgagatcacaccactgcattcctgcctgggtgacagaaggagat

SEQ ID NO: 189856 - DNA, 765 bp, Homo sapiens
attccatttattaatggaaattctccagttttgtcttctaagtctttgcatatattaatcagctattcattttttccaactttatttcttttaaccttttagaaatacaccttataaagccctactccttaaacttttccacttgtatcttgtaagaacaaggacatttttctaaaataaactaaaatgttgtcactctcaagaaatttgacattgatatgatggtattatcagtctgtattcaaattttcctaattgctctagttatagatttcaagctttctaaaattttattttctctaatctaggatccttcaagggtaatgcttttcttttggttgttatgtctctagttacctgggtatttttttttcttttatgatgatgatattaaaaaacaaatccaagacaggtacggtggtgcacacctgtagccccagctacacaggaggctgaggtgggagggttgcttgagcccaggaggccagactgggcaaccatgtcaagaccctgtccctttaaaacatatacacacagctgggtgcggtggctaacgcctataatcccagcactttgggaggccgaggtgggcggatcatgaggtcaggagttcaagaccagcctggccaatatggtgaaacccccgtctctattaaaatgcaaattgcggtgtgtgggggctgggtccagtggtcggaggtgagaggaaatcatggatcggaggggatacggagtggatgacatgtctgctggtgaaagatttcc

SEQ ID NO: 189857 - DNA, 157 bp, Homo sapiens
gggaaagtcattgacttagcagagaaagagcaggtttcaagaactggggatttttctgtcatcttggttttgaattcgtagcctaaaatgtgtattacctctgggtataatattctccctgttcacgaggaggtgaccaaaggagaatctggagcag

SEQ ID NO: 189858 - DNA, 237 bp, Homo sapiens
gattttcaactgcacgtgggggtggttcccctaatccctactatggtcaaaagtcaactgtgtaagcaaaaaatgttgcatacaattttagggagttaactgtgagtattaaacttacccatgaagatatgtgattaaattgttaattcactccaactgctcttacaagacttccaaggtaatgctgtgtaatgtattcatcacagtaatgaagtacttttcaaagtgactctgact

SEQ ID NO: 189859 - DNA, 690 bp, Homo sapiens
cctaattgtgagattcctaataaatggcaagacatgttctgaaaacgtgaaacataaatgaggctgaagaaattgtgaaaagtttagcagaggaggaatagttcgtcaggttctttaaatacaagtaaaggggaaaggaaggaaccatttttaagtttagatattccaagggttagtggtgaggttgattatggtatgtcttctcgttgatgagggaggagactggtgaatagtggaaaataaagttaaatggctagggtggggccaaattatgggctttaataaaagccaggcatagaaatttagattgggatggtagaaaaaggaaagctttaaaagtttttgagccaatgaatgacatcatacaagttctatgagcaatgatttcaggatgggagagaatggcatcaggaagacccacttgaatgctggtaagtaatgttaccaacagtgccattagtaacattaatgttactagggcctggactgatatgctgatggaagtgagaatgaaagagattaactaagcctgcttgccatggacagcaatggggttgctagaagattagctgtggggaaaaagttatgcatttacctttgggcataattaaatgcaattgactctccatattcatgggttctgcatccactgattcaaacaactgtggaacaaaattgtcagaaaaaaca

SEQ ID NO: 189860 - DNA, 477 bp, Homo sapiens
aatgatccagtaataaaaacgtagtaaagctaaagttgctgcaagtgagagaacatttatgaatgagatttgtctcactgcactaacatcagtaagtgaatcattccacctcccactagccagaaattcctcccgtcagatctgcaggattcaccatccaacagtttttatatccagttgggaaacaggaagacgggtcccctatagtggatgttaaaataaacaaggtctggaagcatgaggaacctcttgtagctctaagaagctgagacagagaaggaagtgcctgagcaccccgtgcagcatttttatacgttgccttgatatataagtcaaactcaatttacaaattatgacatgaatgctaatacccatttctacacaaagatgcaacactcttttctgtttttttttaagagtttatattgctattcactacagatgagaagacaggaaccgagaaaataaaatgtcatg

SEQ ID NO: 189861 - DNA, 404 bp, Homo sapiens
ctggcatactagccccaggaaaattttttcataattttagagacatatcttggccagagaaaatatttaactctttatacttctttctatatacatttcattcattttgacctttaataactaattcactatcaacatttaaaatctagaaaactactattttttaaattgggtacttttcactctaatacacgctaactaacatgtaacaagaaagcaacattttcagatgggtattaatacaattgccttcaatttgtatgtttttaagtgctagttaatcgttaaggctataaactaatggtctaataattgcaacttatcaaaacttacttgtatctgatggctctttttcttaaagctcttttttttttgagacagtattgctctgttgcaaaggctgg

SEQ ID NO: 189862 - DNA, 353 bp, Homo sapiens
ccaggaggcgcaggttgcagtgagtcgagattgtgccgctgcactccagcctgggcaacagggtgagaacttgtctcaaaaaagaaagaaagaaaagtcacttataattatgtgggctttaaaaaacctgactgatagtgctctgtttttagtttcaccaaaagataggtagtacttccatcctctttcatgaaactacagtatgtctattctcaatgtttcaaaaccttgtaagactcagagggaagaaatagtttctcattaagaaaaatttagtcaacagtataattatgtattaagtgcttcaggaaaagcaatgggggaaagtatttcctacagtattaggtctctca

SEQ ID NO: 189863 - DNA, 164 bp, Homo sapiens
ctgtttcaggctgtttgctcagttacaaaatgggaaggaaggacaacagcacccacctcacaggctaagcgtctaagaggctgtgtgtgaaaagcccacagcacagggtctggcacgcgtggacgtgcgggatgggaggaggggatttcccagctcctaatctc

SEQ ID NO: 189864 - DNA, 197 bp, Homo sapiens
ctggtgagctcgcctcgtccatttacattacctgtctgagttttgtaggcatctaagtttgcaacctgttatttagaccatggactctcaaagcccagtctgcacaacaagatttgccctgtccagaccttagaggcctgtcttccagtagacaccagttgcattgacaccattgttgattcctcaaatcctgccct

SEQ ID NO: 189865 - DNA, 341 bp, Homo sapiens
cattacattataaataaattaaccacagatttcattcaaatagatagtgatgagcacaggtatttttaaagcctatttcatctacatgagaatttcttaaaagggtttccttgattagaatccttaaaactgtcaaaagaatatgattaaacttacatttcgctcatgaggcatgttttaagttatatctgtaaatggccacgtttttctccttatcaacaacttgataatgatcaaataaaaatgagagataaagaatgcctttattcattcactgaacaaatctttactgaatgcctactatgtgccaaaaattattctatggggtagctgcaaatttc

SEQ ID NO: 189866 - DNA, 408 bp, Homo sapiens
tcgagctcgcgtaccatatggttggacgaatcccaaaaccctttcggctcttcctgtctctgcttctgacctctgggcggtgttcagccccctgcctttctccctctgtgctggtgaagctggttcttagttagggctcttggtccccctgtcatccgactccaggccctcttaccaacagaggcctcactgaccccagtgacacatcgtggggaggtgcgtcgtcctccgttaggtcaaggttaagaattagccaggcttctcttctgagccttttatgggctggccattcataaatttgcccaaaccctcagtggtcctgccaaggtcaccttctggcgtaatgagtccatgtttgttacctgccgggtgaggccatgcttccttctcagtggcagcctcgtccac

SEQ ID NO: 189867 - DNA, 322 bp, Homo sapiens
tgaaacagtacacccatataatcctttcttatttattagtagttgagaatagactttgaagtacttcagcaaaaacactttctttttagtattactaccacaaagatgtgatctctttgtaaagctgtgttctcttatttttaaaaagtggaaagttgggataactttctaatttccatggagcagaattagataaagtagaaaaatctaaaaataaatacaggaatgtctaaaggtaatctatattcattatctagggagatgctggagaaagcaaagacaaattcaacaaaacattttagcagaaaccttattttagaat

SEQ ID NO: 189868 - DNA, 568 bp, Homo sapiens
ttggcctcaaacagctctcccgcctcaacctctcgagtcactgggattacagatgtgagccaccatgcccagttggatgctctaaacattaaattctaagcaaagagatgatgaggctgggcttggatcaggatttgagcagttcatgtgatcagacttgatacattttgaaggctttggtgatgcattgattgtggaatgtgagaaaaggaaagacagagcaaatgttagactatagttaccatccatttactgccatggtgaagactgcaagaggagagagtttgaaggagtagagatacacgtgctattttcttgctgaaatctgtctcatgctagattttaattcttcagtagttagcaggtaagagagttgcttcctaactctggaaatttgctactgtggaaagaaaattgagttgggatccctaaggtgaaattttaagacctgactctctcactttcagagacttggccagatcacttcacttttttgagcctcttcaggctctgtttctttaatcataaaataaattgcttggcccaggttgtctctaatgtttcttca

SEQ ID NO: 189869 - DNA, 157 bp, Homo sapiens
tgctatttgaggctgctagggacatcagtgagttgactttctcttcaggaaaaagaaaatgagagcgagagaaagagagtgcactacaaaactcttattagcactgaaaccttggaatctttccaagtgacaagagtagggacattccaaatatcaa

SEQ ID NO: 189870 - DNA, 211 bp, Homo sapiens
ctcatgtgatccacccaccttggcctcccaaagtgctgggattacagccaccgtgcccagctgcctgcatcttttaaaagaacaaagaaattatttccagaaggtctccaacagattttgccttaattcttatggttagaacatcatttattatgtgcttatttccaaagcagtcgagggaactggaattacaataataggcttaacaaat

SEQ ID NO: 189871 - DNA, 558 bp, Homo sapiens
gtggaggacggatttgctctaaagctctttagaaggagaaagagaagcattctgcaggaaccctagaaatgaaacgcaaccagcaagctgccatttgtccagagaagctcacactccctgggaaatggaatattgggtctcaacctgaagagtagctggacagagacaggaattcacaaataaaagctttaaaagataatgcggtctacttgcttcctaccttgcccacgggaagtataggtttgccctatcttttgactcctaatgtcaaggctcagtacccctgaaatatctagggcctaattaggctgccatgaagaagttctaaaggaggagctctccaagcagctccagctcctctccaccatccaggaaatagggggctggcagtggcaggagcaagataagccactgcctttagactgaactgtgccaaggataacgtgtttatgagaacctctttaaaactcagaaatcggccaggcacggtggctcacgcctgtaatcccagcactctgggaggccgaggcaggcggatcacggtcaggagatcgagac

SEQ ID NO: 189872 - DNA, 113 bp, Homo sapiens
agaagtcaggaaagacttagagaagataaggatgagtgagaaagtgtgacttccctttctcctgggtaattcctcttttagtgttagggtgcctggagaaggtcttctgtaaa

SEQ ID NO: 189873 - DNA, 519 bp, Homo sapiens
aatttttgtatttttagtagagatggggtttcaccatgttggccgggctggtctcaaacacctgatcttaggtgatccacctgcctctgcctcccaaagtgctgggattacgggcgtgagccaccatgccctgccttggttttgttttgttttgttttgttttgtttttttcaagagatgaggtctcacttgcccaggctggtctcaaagtttcgaactactggattcaagtaattctcccaccctcgcatcccaaagtgctgggatctgtgatctgtggcatgagccatcgtgcctggtcttaccttaccttttagctactatgattcatgttgctgtgaacactaatgtacataatggtctttatgtgtggatgtatattttcccttctcttggccacatacctaggaagggaattgctgggtcatatggtaattctatatttaacattttgaggaactgccaagctactttccaaagcagctgcacccttttacacttccaccggcaatgtggcaa

SEQ ID NO: 189874 - DNA, 325 bp, Homo sapiens
ttgatagattagtccaatgtatgacatgagcaagagagggaagtgaagggaagtgtgtggcacttacttgccatctctggcccagctttttacattgcttagtgtatgttcatttggaaggtgggatgcacgatgggcgagcacactccaaccagaagtgaagggatggatcatagctgcccacactgtgcccttgactagaataatctcaggcaagcaaggatgtaggagccattccagcttcctccccggagctctgccggcagaccatgcctttgttttgggacagcaactcttatcatttgccctcatgtaaaagttctag

SEQ ID NO: 189875 - DNA, 489 bp, Homo sapiens
gtttgaaaagtttttaagcaattagaataaaaatctttgctgtgacaagtaaggtcgactagggcaagtttgtattacaggtcactcctagtgctttgttgcctgcttccgatttgccagtgagaaacagagtatccttcttatgctatttaatagtgatattacaaacagcagcaacatcaaaaaagaatgtgtcaggcacataatgaataataatgctgatagcaggcatgcgttgtgcatattattgttaatcttcacactagcctttcaaagtggttactgtatttctgatgagaaaatgaagccttgttcagtaactctagaatcacttagctgataagtggtcaatctgggattcaaatccatatctatttggcttgaaaagttgggtgttcttgtcactaaatttgggaatgagcaggcaaaaagaaacacatggaaggaatcatctcgtttgagggattcagtactctcttagcagtacag

SEQ ID NO: 189876 - DNA, 331 bp, Homo sapiens
ctgaagggcctggggaagattgcgtcttcgtgcagcttgatttggttcagccttctcttagcaaattccctttctgggtggccgactcacatttctgacaatctgagctgctcatggttgcttaggagatggataatgcattcctttagctaagtcacttgggaaacatttagcaccacttgtacatgggcgatcacatgtctcttagggcattgatacttctgacaagtttcttgaggcttctcctatccctggcttctacaatgcagccaggaacagcaaatgccatttggctcacttaatagcaaggcatctgtaggactgcgcctgt

SEQ ID NO: 189877 - DNA, 454 bp, Homo sapiens
tactggctacaccctaaactctggatgaaggagatgttgtatagttagcatgaacctctctgtttacatccagggtggagaacgtccctacagatgtgggtcataaccagggggataggttgtgagagatcctctttttcattgaaatgtaactgcatacctattatatttggcagtagcattctaaaagtaccaacaaatacagtttcaatagtcaaagtgagaagtggacaagccagttctccttcacactaactttgagccaatctatgtaagaaggtacatacttacaaatacaataagctgtcacttaatgtcattgataagttcttggaagctgtaagcaaaatgatatataatgataacaattttaccataggctaattgatataaaattggcataaataagaattaagttcctatgagatatttctggttgcaaaaacatcaccaa

SEQ ID NO: 189878 - DNA, 648 bp, Homo sapiens
ttaaaatttaacttgtgtctagagtttcaaagcaaactttatgaactgcataaatctgggaaatagagaaaatacagccaaaggctattgaaaactatgctctttgacatttggtggttatggacacctttgagaatatgatgaaaaactgtcaacccttttctaaggaaagggcacattagcttatctacacaaagttttgcatacattttcaatacactttcagagaatccgtgtaccttgctgcttgccccaccttccactgttaagaatacttggctttatttttaaatttttaaatttttttattttattgagacagagtcttgctctgttgcccaggctgtggtcagtggtgtgatcttggctcgttgcaacctccgcttcccaggttcaagcaattctcccacctcagccttccaagtagctgggactacagacatgcaccatcacgcccggctaattttgtatttttagtagagatggggtttcaccatgttggccaggctggtcttgaactcctgacctcaagcagtctgccaaccttggcctcctcaagtgctgggattataggcatgagctaccactcccggccaagaatacttggctttaggtataaaaaatataaatatgtaagtgtgtgtgagt

SEQ ID NO: 189879 - DNA, 395 bp, Homo sapiens
agactggtcttcctgtaacagtaactttcctttcttttctatacacaatctgagaacttagtgtatgatataaagtcataattacagatgtcctcttaaaggatgacatttaaagccaggtgtggtagctcatgcctgtaaacccataattttgggaggccaaggttacccaccttgggtaaccttgggtagatcacttgaggctaggcatttgagaccaagctggccaacatggcaaaaccccatctgtagtaaaaaatacaaaaattagccgggtgtggtggcgtgtgcctgtggtccaagctactcaggaggctgaggtgggaggatcacttaaagatgggaggcagaggttgcagttatcgtgccactgcactctagcctgggtgacaaag

SEQ ID NO: 189880 - DNA, 322 bp, Homo sapiens
aagacctgacgggtgttcagggccttctactgcagcagacacgcctgtgctgtggtggtcggtgatgagcaagagccctgctcccctcctccgggcagtgagaagaaccaagccagcacccaccctgcccagcagtgtggctggggctatcccgctgcggagagtgggactgttgttctgggttggtgagagtggtgctggtgggccctgagccttgccccactgcttccctctgaccaacaccacatgttactacgcactagcaggatgtcctggggccatctgtagctaggcagtagtgaaagaggggtacccttcccag

SEQ ID NO: 189881 - DNA, 833 bp, Homo sapiens
acagtcaaactgcaagaatgctgcttgaaacatcaacaatctcaatttctctggcttcgtaagagaccagcatcctttccatcatatcccaccccacaagatactctaatttctacaggtcattgttctaggaacaccaacagtatggcccagtgagtatgcagatggaggacaaattaccctttgttattcactttgtacaactatctaaatgtccctggatagagcaaataccctctagaaaggaggaaaacaatggtccaactccttttccttctgtaaaataaaatctccacctaccacatctccagttttacaacttaaccacagttacaggatccaggagaaccctacctagggacaagggttctatcccaccctctaataaagagctatgtgccctgagtcttcttgtccataaaatagatacagctagattacctctaagttccttctaacaataaaaaaaaattcaggttagctatgattactgacagcagcaaaagttgagagcagtcgaaatccgagattagagaaacaaaatgggatgactgtcttcttcagaagcgccctccatcttcagaagctttccttgctagagctaaatcccctcttaactgccaaagccacccatccttttgtaacccccttttgggggtactagaagcagtctgaggtttcttggaattgtcctgtttcttattcctccctagttatcttggcttaatctctgctacttcatcaggatccagtttttgtggtttgatattcagagattctggacttcaaagctgaagggatgaaagcctcaactcaatgttgggactcaggat

SEQ ID NO: 189882 - DNA, 542 bp, Homo sapiens
actgcagagaaactttgagtgtaaggaatgtgggaaagccttctgttatcacagttcccttcaaagacatgaaaggactcacaacggagaaaagttgtgtggatataaaaaatgtaaagccggctgggtgcggtggctgacgcctgtaatcccagcactttgggaggccaaggcgggcggatcatgaggtcaagagattgagaccatcatggccaacatggtaaaaccccatctctactaaaaatacaaaaattagctgggcgtggtggcatgtgcctgtagtaccacctcccaaccagctgggattacaggtgcccgccaccacacccggctaatttttgtatttttagaagagatggggtttcaccatgttggccaggctggtcttgaactcctgacgtcgtgatctgcccaccttgacctcccaaagtgctgggactacaggaatgagccaccctgcccggccagaattttctttcaggacatcaggaggatcctctgctggaagaaccaacatctgattgcagatgttgcctctttgg

SEQ ID NO: 189883 - DNA, 570 bp, Homo sapiens
atttcatctagtttgagttacatctggtatgtaaatacgagagaaccagattttagaaaagcattttacataagtaaatctgtaatacaataggtattaccttatatgtaccaatctcccttcgcccattatttctcctctgagctagttctaaatgctgctgcaataaacctcctccctgcagacatgctgaggaaccatgtcattcgaaattctttccttgctcttttagaagtctggcctcagttccctactaacgggccctcctcacctccaacttccctaccacttcctactacagagcaactggatggccactcaaggtccccacacagagactgctgtttgtcagtctcctgccacgactttgttgaaactgaaggaggcagagaggaggctcagcaacatgccacacgatggaacattttggttaccatcacagtaaacgagtacagggaatggtctcagcagggcatggtggctcacacctgtaatcccagcaatttgggaggccgaggcaggaggatcgcttgaagtcaagggttcaaagaccagcctggccaacatggc

SEQ ID NO: 189884 - DNA, 221 bp, Homo sapiens
tgttgggattagaagtgtgagccaccatgcccagccagcaacatttcacaaagtgaaatacagaaactggacagtgagagaataaggaaaggaaactcgaaacaaatgaaaggttatgcttcactttgtaaggccaagattttagcaaagaagggtaaaacaagccagaggtgtgaagatgaactaatcaaagggcagtgcaacactgaagataagaccgt

SEQ ID NO: 189885 - DNA, 671 bp, Homo sapiens
  misc_feature (655)..(655): n is a, c, g, or t
caggtggctgaccctaaaaggttgtgcttgggccaggcatggtggctcacgcctgtaatcccagcactttcggaggccaaggcgggtggatcacctgaggtcaggagttccaggccagcctcctggccaacatggtgaaaccctgtctctactaaaatgacaaaaattagccaggcatggtggtgcacgcctgtggtcctagctactcgggaggctgaggcaggataatcacttgaacctgggaggcagaggttgcagtgagctgagattgtaccactgcacactccagactgggtgacagaatgagactctgtcttaaaaaaaaaaaaaaaaaaaaaaaaagaggttgtgcttggcccttgcttcctccatttaggtgggctgagttactctcagaatcaagggaagctccctatcttggaatcatgtgagtgagctggcaaagatcttaccaggcatttaggtgtgtatggaatagtggggagggcatgctctcggaagcctctttttcctgcgcccactctgtcccttcgtactgcttctttcaacctagacaggtctcagtttaacccctgcccatctggatggcatgaactcccaggatgagtgccctctcagtcagcatgaaagcatgaaaatgtgacagaatgagacnttgcttaaaaaaaaaa

SEQ ID NO: 189886 - DNA, 209 bp, Homo sapiens
atgctgctatattttactctatgagacttacaaaaatgaaaaatagatcttgctctgatatagtatatagattagtaagggagagtgtgtatatagtaactaaaacataagaaaggcataagtgccacaggagaggtataaatgatgtgtggaagtttagagaaaggagagatgacttttagccagattgtttagtgagagttttatag

SEQ ID NO: 189887 - DNA, 438 bp, Homo sapiens
tgtactcaagaggcttggaattcagtggaagacagggctcacagccatgagcacatggagtcaaatgcagagggttctgccaagggagtgggcagcactgcagacaggccatcctagaagagccttgaaaccaaagcattctagattatttttgtttttctgagacggagtcttgttctgtcacccaagctgtagtgccatggtgtgatctcgggtcactgcaacctccgcctcccaggttcaagcgattctccagcctcccaagtagctgggattacaggtgcatgccaccatgaccagctaattttttgttctttctttttttttagtagagacagggtttcaccatgttggccaggctggtctcaaactcctaacctcaagtcatccacccgcctcggcttcccaaagtgctgggattacaggcatgagccaccg

SEQ ID NO: 189888 - DNA, 245 bp, Homo sapiens
aacaaacaaacaaaacactccaatatgcaatacaacttcacagctagctcagaactagttctctgcaggtctcataatttttaataattcctgcttggaagccagaaggcctgttcctctattgtcaccatagccaaaaagcataatcttcaaggcctgattcatccttacctcctccaggaagtcttctctgcctgttccagcctatttttctgtccccttattgtacttcctgccagtgcttg

SEQ ID NO: 189889 - DNA, 734 bp, Homo sapiens
atgctccataattagccataaatattattctttctggagtgagtttgtagctccaagtaagagaatgaaaatgtctatagtgaagaaatggcagtctgcatgtggagagaacatctgttaccaggctgcaaaactgactcattctgaatttaaagagaacctctgattttattttctaattatctttagttttggaatatctttatggtttattcccagctatgtatgcctcacaccccttcttctttgtgttatggctacagtcttctcactgttctctttttgccatgtaatttcatacagactttctatgttctgattagaagtttgaaatttttcagtgtggtaaattgtttttaactggagtgtttgaggttatttatagcttatcaatgcaatgtttagatcacttaattgagataagtactttactgtctgcaggggcattggtggaacatgaagtgaaacaccaggacctggttctggagttatggagggcaactccaatccccagtgtgggccccagcctctggcacactggtgcatgccaaaaagtactcctcaggccaccactactctaatcagtgcccttgctaccatcactgttgtcatctgtgcttgcattcccctggtgcctggaagttctgttctccaggtggcagatgactgctcccggcattcacacgtttttattccatctgtggaggagtactttataattctgactgtcttct

SEQ ID NO: 189890 - DNA, 601 bp, Homo sapiens
tctcaaagtgctgggattacaggcatgagccactgtacccggctgtactgtgtctttaaaaaagaaaaaaaaaagtacattacattcaattttttaatccttttttacttaaaattgttttattgtggcaaatatacataatataaaatgtaccatcttaaccattttaagtatatagttcagcagcatgaggtacattcacatcgttatgcaaccatcaccatcagccatctgcagaatgttttcctcttcccaaattgaagctctgtgctcattaaacactaacttccccttccctccttcctccccaccctcaacccctagaaaccaccattttactttctctccctgtgaactgattactctaggtgcctcctattagtggaatcatacagtacatgtccttttgtgataaacctaatttttataagcaatctcttttttcccttttttatgtttttctttctttttttttactgtcagtgatcatatttaaatgtaagcagtttcttttaatatgttaggagtacttgtgtaaagaaatctaccaggtaccttgtatgaattaactaattctgctataatgggaatattcctctcc

SEQ ID NO: 189891 - DNA, 364 bp, Homo sapiens
tggaaactgcagagaaagaaaccaatcttaccactcaagtgagctctcttttaaggccgaaatcatcctgttgataaagggattaaaatttatttgagtttaatgaaattatcctagtgctaacactattgggatctgtgcagaatgatagttctttgtgggtaaccaggacagaagtactgtattgtgcagtattttgaaaagaaggaaagaggaatgttaggtcttttaagacagatgtttagtcttgtattgaaggagagtgaacacctagatgtatcctacgtattagacaatactgtcttgtcctttgacttttactagtctcttgagaagttaatattttaaataggctactggtact

SEQ ID NO: 189892 - DNA, 740 bp, Homo sapiens
gagatcattcatttgtttattcaataaatgtgaatttatatacctacgttgggttagatactctactgagtgctaggtctatagaagtagtaaaacattgccctagtccttaaggtgttcacattctaatagggaaaataaacataataaacataattataatgcaaagtgtattgttagagatggtaccaccttcacttggttgctcagactgaaacctagaggctttattttctttttacttttattattatggaaaatttcaaacatacaaaaggagacaataacatcatgaacccccttgtacttgtcactcagtttcagcagttaccaactcatggacaattttgttccatttctctttccaccaacttccttccaatattattttaaagcaagatgtcatatcatttcatctgtaaacatttcagtgtgtagatctgtaagataatgtctgttttaaaaaaccattctcacaatactgtcatcactcctaaaacaattcacaaaaattcctaaatgtcaccaagtaatgggagtcattttaaactcttgtttctctcttctcaagtcttgtctattccatcagcaagtcctattggtcaacttccaggcaggtcactttaccacccctgctattaccaccctacttctgcagtcacatctctgtagatactagagtttaaaccaacagtttacttctgctcttggttttccaaagctagttttattaataactg

SEQ ID NO: 189893 - DNA, 494 bp, Homo sapiens
tctctccaggttgaaatttctcatgattactcaggtttgatttgttcctgaaggcttttttccactgactgcatttctatggcttcagtatgtgtttaacaataatgaatgacatttgaactctggttgaaagaccatccacaaagtcaactgaatgtgaaaagaaaaaaaaaaaaagaaagaaagaccatccatgatcactacattcatagagtttatctctgctaatgaattatttgatgttaataagatctgaagcttggccaaaggctcttcaatgctcttcacacattttctcaccatcatggccttttcgtgctgatttatagtctctgaaattggtctgaagctatggtcatgtgacccacactatgggtgtgggtgtgggtttgtcctatgtatggtttcatcctcccgtaggatgtctgagattagagcacaattactctaacacttactatagtcttggaagccccctggctgggaaccaatcc

SEQ ID NO: 189894 - DNA, 622 bp, Homo sapiens
gtgaataccaggaggctgggatcattgaggccatcttggaggccagctacaataatactcacttaaatttagcgaactcagaaaaaattagaatcctaatagagcggaaacaaaaagctctatattctctattatttgaaatacagttttatgatttaagaaaatgggctcatagaaattagtccttttattcattctgttgcttatgtggctatagaatattttcaaatcaagggcttctataaggaaggtctgttaacgggtgactgattataagtatataccttacatatgaccaagtcagagcacagaattttataatccttcaaatatatttgaaacttttatacccaggtacctggtgagctgtctacattggctcttaataaggatctttctcagaaatgatttaaactaataacagtataatagaaagagctctagatttgagtcaagacagtcataactattttccttaacatgtaaatgaggatcagaatgtctgccctattcatgtgcctcatgtgagaattaaatgtagtaccagaatatgtgaaaatgccttttaaattgtaaacccctgtctacagttaggcaatttgatggttctgtagggtgagat

SEQ ID NO: 189895 - DNA, 390 bp, Homo sapiens
tgtttgttagtctgtcacttatatgtgttttccaaagtgtctcctctttcctgcctccttcctcagagtcattttcctcacacgtccgtttctgagaagcaacctgctatggtagttagatacctgagctctggagtcacacaactggattcagagctggcttagcccgtccttactgtgtgactagagaaaatgatgtggcattcccgtgcctcagtttctatgtaaaatagagtttcaaagtcatacttgctttatagggttgttgttaagaataaatgacagtgtcagaaagaagagcctttggcacatgagaattaggcaaatcagagtgtaaataggaattcaccaggtagtcaaggtgggatggggccaggagccaaaagagga

SEQ ID NO: 189896 - DNA, 656 bp, Homo sapiens
cttttgattgccctaatttcctaaggtaactttcttcacgtcttttcttcccagacctcaggtcatgtgttgcatgtctcatttgtactctttgaccccaggtgtctggatagtttttgggcaatgccaaccacttccagcctggatgagttttgagttttaagcatgaaccttgtcaagtatccctgacaggttggaatggagtcactaaaaatttatgaatgcgttctacttgttcctattggaaccagggaccagggtcccattcttggaatatgggctgccatcacactgggaggagatagggcaaaggcaaataagaatgccgtaaagctttcctatcctttgaagttcttgattcagtgttcagttggttgctgtaagcatttcactgttttccagagttctgacaaagttagttctgacagttggtgcttgttttttgatggtttaggtgcagggaggtgtatgggcacttggaattgtctactctgacattttttcgacatctcccagtcagccttgttctcttgcagtagtccatttaaaaacccacagaagcctttccttctaccaccgccacacacgctgcaggccacagatgccaccttacttgtcataccctcttcctgtatctccctggcaatcacctcaat

SEQ ID NO: 189897 - DNA, 302 bp, Homo sapiens
agtattgtcaagctgctttccaaagggtaaaggaaaccagtttacaccatcaccagcagtcgttctggtcatatatttcccaatatttttccctgaaaaatcatttacattttaatttcagttataatacattttcatgtgcaaaatctaatcaaattatgaaaattgacagcaagcttaaaaatatcatttctatattagtatcatacaatttttaagtagttgaatactgactatagcacctaacagttcaatggcattttagcctttttaaaaagttttatccaatccctacaattatg

SEQ ID NO: 189898 - DNA, 424 bp, Homo sapiens
ggcttggaatacttatggtgaataaaactgcccaggttcttggtctcatagagcttacattgaacggaatataggaaacaacgtgaaatgcacaaataaacaaagaatcaaaataattcagatagtgataaaaattatgaagaaaacaaaacctctgtaatgggataacatgatgggagatttcgcgagagaaggagatcagtcatgtgtgtctgctctagttagggtagacaggcaggtctctccaggaggtgatatttgagctgaatcctgtacgacaagaataatgcagccaagcaaaatgctagggaatccaacccgtgtgggttgctgatggggaaataaagaagcaaaggagggatgactggccccgaggtcatcctgttagttaaagcctggacccgaatgggggtctcctgtcact

SEQ ID NO: 189899 - DNA, 187 bp, Homo sapiens
ggaagctttctaacaagtttttgcctgctcagcttttgctcatctttcaattcctgcttaaatgtcttttcaagggaaataattctccttgatcctctgagattaggttaggcttccgtttatacataaaagacaacaccctgaatcttttattgcacttatcacaattgtaattaaacattattta

SEQ ID NO: 189900 - DNA, 147 bp, Homo sapiens
ctatgctgggtgtcttcggccaatcacagggcatctctgtaatgagtccattccaagtctaccagtgagaaagtaggcggtaggaatgatgctggagaggcaccaccaattgactgctaccctttgcccttcattaactctaatcct

SEQ ID NO: 189901 - DNA, 301 bp, Homo sapiens
attttagagaagcaggaatatgtcatccattgaacaagaaagaaggaaaatatgagacgtcagaggaaatagttattagcgatggtaaaattcagagtgtgatcatatgaggtagtagtaggaggtaaaaggaagaagatatatcctttccccctttctctcacctctacagcctgtcataatacagcaattgccttcccaacaggttagggagagatcaaaggaacaatctatttttcacagataccaattacccacttgtgacatcagttatttctgactcagtcgtccgtcttactta

SEQ ID NO: 189902 - DNA, 215 bp, Homo sapiens
ctgtgcgggcaccgtgcgggctgtgagggcaccgtgtgtgctgtgtgtgctgtgtgggcaccgtgcgggctgtgagggcaccgtgtgggctgtgcgggcaccgtgtgtgctgtgtgggctgtgcgggcaccgtgtgtgctgtgcaggctgtgagggtaaaggatgagggcaatttcatgttaagtgtattttaccaccacttaactgatttttga

SEQ ID NO: 189903 - DNA, 144 bp, Homo sapiens
gagaagacaaatcaagacattctctgatctgaggagataagagctagaaaggaggcacagggtgtcctattactatggagaaagatcagctgccctcttatcaaaatggcccctgtgactccacctccacccccagattacaat

SEQ ID NO: 189904 - DNA, 515 bp, Homo sapiens
gcagcaagaaggccctggccagatgctgacaccttagtattagactttccaaccttcagaactataagccaataaatttctgttaattataaattatctagtcccaggtattctgttataccagcacaaaacagactaagacaccatcttaccctacagccagtaccaggattttgaatgacagaatgatgacctcatcatcctttgtttttgctggccagttccatattttgaatgaaaatcacctggctcctgtgagttcttttgtatcctctctaacttatccttcagtatcaaatttgaaggattgttttgagggggtctgaaattctcagtttttgctctatcttgtttctcctttttccatttgctcccattgacacacatggagtctcaattgtactttcatcccagtcagcagctgccctaaacaagaagacatgccccatcattagtggtgccaggtgctggctttagcagaacatattctaaatgtaactgatcaatggcttata

SEQ ID NO: 189905 - DNA, 500 bp, Homo sapiens
ataattgctggagttgttaccagacagagggaaccagaaaggtgaaatgtcatggctggaaaatgagatgctcaacattgtgactttggagggggacattgacagcagaatcatcctttacaggtatgtgaacccaagatatcccaacagacaatttgcctgtagggtaagcactgctatacttaccataaacaagccccctgaggacagagatcatttccatcttttcagccccatatatttagcatagcgcttagtattaacaattaatacatacttgtttgtataatttttgaagtgtatttctgttccagaagaggttaaaggacattgttcacattctgtgcaatgcgaaatcttagagaagagtataatgtgtgagcagaccacatcctcggaaatgaatgcttattgtgaagaaggagaggcaagaaagacggctaaccagtttaaacagtttcattagacggtttcattatgaaacaaaatactcaacacgc

SEQ ID NO: 189906 - DNA, 225 bp, Homo sapiens
agaacctggatgggggagcacagacagaccaccagagagaaagccagaaggataactcgatgccaagatctccatgggtaacagggacatcagcacacacagaagtgagagaaggtacacacctggtggtgtcaggtataggactagccaactactttacccttggtgctggaagagtaacagatgtccaaattcaaagcacccaggtgctcacaaaagcagaat

SEQ ID NO: 189907 - DNA, 122 bp, Homo sapiens
gacgacagcccacacgtgcatgtctgtggcgggtagacttcaaaaggacatgtccagtcacttcatgcctcagaatactacacccccttctacaaagctttggcctatgccaccgagctcag

SEQ ID NO: 189908 - DNA, 1196 bp, Homo sapiens
tcaatattcccatgagggaggcagtctttgactttttatttatgataaagattattaaagtgcttaaagttttttattgtatagcgtgttttatcatcaaacaggttttagttttttaagttaaactgatcaaaaataataaaagctgatggctctatgacacttgcatttgagagaacaagaatagggagcaatatttcaagaaaatcattcttactgtttttcaaaactgtttagtgtcagagatgccccaagaccactcctaggtttattgtttcgatagaaggacttacaggattagtatatagttgcactcctgactaagatttattatagcaaaagaatacacagcaagattagcaaaggaaaaaggtgcatgggaccaagtctggaggaaatgagtctcgaactcctgacctcaggtgatctgccagccttggcctcccaaagtgctgggattacaggcatgtgccactgcacccagcctgaaagtattacttttaagaattgttattatactttacttgaaagaaataaccactgctatagtattatatcataccaaagcatatattttataatttgggctacctagaattattattttttttttggaaatgatgttatatgtagttataaatcacaaatgacttggtaataaaggccatatgatcttcaaaaccaaactggaactagcatagataagacctgctgtttaaacaggtaactcttggttgagagaagataatggcagtcttgtctcttttttccctttattatgaatgcataacactgggtgttctgttaggcaagggttgtttcttgtttattgttttgtggccagtgcatagcacaaccaacgtttggcatatagtaggtgcttaaatatttatgaatgagtgagtatgtgagtagaaggagtaactgggctgggaatgatggctcacacctgtaatcccagtgctttcggaaactgaagttggatgattgcttgaggccaggagttcaagaccagcctgaggagcatagtgagacccctgtgtctacaaaaaaaaaaaaaaaaaaaaagtagaagaagaaaaagagtaactggtaagggctgaggtgtcagggagacttttatcatttaaaatgattaactgtgtaaattttcagtagcctaatttctcatggtagaccttttagaaagaattttc

SEQ ID NO: 189909 - DNA, 328 bp, Homo sapiens
ctagatatctgaaaataaagggtatgctcttacagcattcattcactaactttttattttaatttttttaaaaattagagacagagtttcatcatgtcgcacaggctcgtctcaaactcctgggctctagcgatccactcactttgacctcccaaagtgctgggattacagatgtgaagacatggtacctggccacattccctaactttcttcctgtatttgtatttattctccaaagccccatcttttgtaaaatgctagttgtttaaacaaattaaaaccaatcaaagcactcattttacattctaatatctgtggaaaaaagaat

SEQ ID NO: 189910 - DNA, 398 bp, Homo sapiens
tcttcagcgacaccattcacatgctgatcccttggtacacgttcccttgaggctgagcacaagcttatgagacttacggaatcttccctctgtatttgggatcctgataacgtttgtccgaatctcagtggcgtgaggtccttgttttctcaggggtggacgaatctgcctctggagacatcatactgggttgaaggcttgttcttggttccagctccacgaggcctctgcctttgctccacttcactcacctgacttctttcttgacccctttgaccatcagtgcccagccttttcctcacatcagactcctgctgaatctattgactcctgtctctctgctcctgcttgagcctccgtctgagctccgtccatctcgccttgtgtaaagttggctg

SEQ ID NO: 189911 - DNA, 302 bp, Homo sapiens
ctagtgattccgatgcatgctggcattagagagccattgctaaaggaaagacccaccaaatacaatcgtcagcagccacttgaaataaatgcagtgacggctgctctgatagaaaatgaggcttccaggccaggcgcggtggctcacgcctgtaatctcagcactttgggaggccgaggtgggcggatcacgaggtcaggagatcaagaccatcctggctaactcagtgaaacctcttctctactaaaaataaaaaaaaaattggaccatcctggctaactcagtgaaacctcttctctact

SEQ ID NO: 189912 - DNA, 383 bp, Homo sapiens
atggttacagttgctgttatggtcattttgcactcaaccctactgtgatatgcattttccccgttatggattttgaccatcaaaattaatgttttctttagctttttccacttcaaaagtctttattgccaagatggaggttatgctcaaggtatattttacccccagtattaaatttaaagccacattttaaggtggaaattggtaaaatgaggaaggtaggaaaactctatctaggaagttctcgacctttttgagtaggagggccttttaacagcagagctttctgagcacaccctcatggttgtagctactgagtgagaaaacagtgtatagattgggaagcccttgtaatatctcttggttgaaactcaccagtatgt

SEQ ID NO: 189913 - DNA, 278 bp, Homo sapiens
tcaactgaggaagctgataagggaatcagttgggaataaagattctcaagtttccatgaggcatatacgtagctaaaggacaaactgagcactttttaaagattttcatgatttatctcatgtagaaatgtaaggaactatgaaaaaaagaacatctttaccctgtattttcccaaatcaagtccaaggaggcaaaggtttcagggcacagtatcactaacaagacagactggaactgttaattagtatcagcagattccatataacatttttttttc

SEQ ID NO: 189914 - DNA, 621 bp, Homo sapiens
aaacaaaaaggcagagtatcaccttggtcagcctcagttggcaacatgcatattggatgactcaaatttttcacagctctgtgcatgtctgcaaaggcctgcaaaagcaccataagtattgggattacacataaattttagtgaataggcaaatttgcaaatgtggaatatgcaaataatgaatgactataattcacatatacaattgacctattaaagtatacagtatttttagtattcacagggttgtgcaaaaatcacaggttgtgtttgtggcattaaccacaatcaatctgagaacattttcatcaccccccaaaagtcctgtaccacgccacttttccctttagccccacctccagtcctatgcaaccactaagctattttctgtctttacagatttgcctattctgggtagtctatgtaaaggagaccatgaaagatgtggcctttcgtgactggcttctttcacttagcatgtgttttcaaaatccattgatgtagcatatagcagtactttgttcctattcattgctgaaaaatattccattttgtgcatatagcacattttatttatcaattcatctattgatggaagtttggcttatttcttcttggctg

SEQ ID NO: 189915 - DNA, 530 bp, Homo sapiens
tgaggatccccctgcatcccggggagccatcagagcagtggctgtgacctgaaatcacgggggtaaacataggccaaaaagaaacagacctcacccacctggaaactataaaggaacaaaagggagcaggtgcacagcttgggctaaggagatgaagtagatgcaaaatcaagacatcaacagcagaaccaacatatgacaatttgtttgcctccttgtccccacatgtattagttcattctcacgctgctgataaagacatacctgagactgggcaatttacaaaagaaagaggtctaatggactcacacttccacatggcttagggagaggcctcacaatcatggcagaaggcaaggagcagcaagtcacatcttacatggatggaagcaggcaaagagagagagagcatttgcaggggaactcctctttttaaaacctagatctcatgagacttattcactatcatgagaacagcatgggaaagacttgcctccatcattcaattacctccccgggatccctcccac

SEQ ID NO: 189916 - DNA, 420 bp, Homo sapiens
cggaccctaccctgagccagtaggatgattttaaataatctgccatgtttctgttatcctcacaactgtacccttacacaatctatctctacctagaaaacgtatttcagatggctataagagtacagtctgagccggtcacggtggctgacgcctgtaatcccagcactctgggagggcggggcagatggatcacgaggtcaggagattgagaccattgtggctaatatggtgaaaccccttctctactaaaaatacaaaaaattagccaggcgtggtggcaggcacctgtaatcccagctactcgggaggctgaggcaggggaatcacttgaacctgggaggcggaggttgcagtgagccaagatcacgtcattgcactccagcctgggtgacacagcgagactccatctcagaaaaa

SEQ ID NO: 189917 - DNA, 384 bp, Homo sapiens
gtggtcccagctcctcagaaggctgaggtgggaggattgcttgagcgtgggaggcagaggttgcagtgagctgagattgtgccactgtactccaaactgggcaacagagggagaccctatctcaaaaaacaaaacaaaacaaaacaaaaaaacaaaaaagattttcatgctctggtaaaataagtattaaaattaggaaactatggatgaattgaatgttttggtctggtcgaagtactgtgcattaaatttttggttacattttactttgataagcagtgacggttcagtaattttgatgatagtctatacatcatgtaacttgacttatttagttgtcaacaaatatcttttttttttgagacctgagtcttgctctgttgc

SEQ ID NO: 189918 - DNA, 640 bp, Homo sapiens
cataccattgctggtttgtgggaagggttggtattgggaagggctcttctgggcctcctagttaattctacctggttcccgccccccaacccctgaggactttgacccgtatgttgatagtggttgtgtggaaaagaatcacaggccgaacgggcagcccgttgtggactctggatgggaaattctaaactcagttcacttggcctggagaccgtcaccgcacctgcggttcttctccaggctgcctttgtaatccagtgtggcttaaacactcaagcaaagcgtgaggcgtttggaagcatgatgttctttaaaggcatctagaatgcggccacgtggctgttattagcagtttatgttaattacagaagaatggcatgtgccactgtttacgattctggccttcatctctatctctctatagaacttgtggaaaacatgagaattaatcctatcagatcaaacccatgcatttaggagccagtgtggcaagggagggagtggctgtgcccttcccgaagacagctttgtggccggttgtgggccggtgtccctggccacctgggtggggagaggcagaggcccctttgcagccttcacgattttacgtgcattcaacctcaaatctccatgcagtctg

SEQ ID NO: 189919 - DNA, 474 bp, Homo sapiens
caggtgatctgcccacctcgaccttccaaagtgctgggattataggtgtgagccactgtgcccggcctcttcctccttctggagccctgagagagcaggcaatgaggagcggaccccactgcagagtccatccttcccccgcctcccgggctgatgataactgcccttccttgggccaggggacaccttcaagcgtcaataagtgctggccggagcaatgctgcttgtctctgtcttggcagcctgggtgccttgacaaggggtaacgtcctgtcctcatgctccccacttcgagcttcagtgaccagagaggagtggagaaggggacttccccagcctgcctggagctccctcagcctctcaggtgccttccacacagggtcctgggtacaggagaccccagacatgctcagcacttagcagaggcatcaaccccacatccttctggggggctccgcaagacacccaatgctt

SEQ ID NO: 189920 - DNA, 374 bp, Homo sapiens
caggtcttgctagaaatacagcttccctgatccgacattagctcttcttatcttgttaccctgcttggaaaagagacaacactgcccgataagaaaaaatttctggtaatcactgtaaggcgttcctcactccctcacccttctctgttgggttgctcacaggctgtatggatttcactgcttaaagcagctgatgtaacttaggatttcttggaggaagttgtgtggtttaggttcccttgtgaatattcttaaaaatcttctgtcagtgattctccagctgtgtagaaatatttgtctacaggactgaatacactgtagaaagatgctatgcaattttttttttttaagcacacaagtgacttcttaaactt

SEQ ID NO: 189921 - DNA, 333 bp, Homo sapiens
ctcagcaaatgccattgcggccacctctcaggatctggcttcagagcttggggccgtgggagcgcccagtgggtctgtggcatcggaggggttggagtgtcttccccagctgctgcctgctgaccaccgcagccccttgtagccatttcattttacaagcacgttcccccgtgccctctgcatgggccctcagccctcagcagccccgtgagaggggctgaggctcaggtgggagatggcggctgtgtccctgttctgcggcttggaggcattctgtccggtgtgcgtctgtacaatttagactgatgacaataaacatgttccaaagcatcg

SEQ ID NO: 189922 - DNA, 444 bp, Homo sapiens
cccaggcccagcactttcccagcttgcccacttcctgcactcccttagggcttcatcccttaaggcccagggaagccaacactttcagctcccttccttggcaggctcccaggcggatccagattttgtgggtcctgaagcttatatacttttggaggtcttctttaagaaagagttaaaaaagaaatcccagcactttgggaggccaaggtgggaggatcatgtgacccaggagttggcgaccagcccaaacaatacagggagacctcctctctgtgaaaaaaaaaaaaaaaaatagccaggcatggtggcatgcatttgtggtccctgccacttgagaggctgaggtgggaggattgcttgagcctaggaagtcaaggctacagtgagctgagattgtgccagcgcactccagcctgagcaacagagcaagaacctattaaa

SEQ ID NO: 189923 - DNA, 486 bp, Homo sapiens
tttgtacctcaacttggggtatatgaaggcttttggtctctctgagagtggctggaggcagccagggcttacctgtactctgactcgaggagagttggataaaagtgcacaccttaaaaaaaattgaatgaggaagcacagtatttcagtacagtggacagcttagcatgttgacaactgagaataaaatgctcagttctgaactggacagtgtaagacacaacgaggaaacactggaaatggaaattcaattacgtcattgtagactggctactgctctacatgattgtgaccaaagtcagatagctgaaagagacttctttccagagaacaagacatgagcaggtttatttacagaagacaatgaattctcatttatctcacctaaaatataacagattccttctcaacaagtctaatgaagacagtaaaatcaacaggctaaaaattaagctccatgaaacaagataaaactctgagagaaaa

SEQ ID NO: 189924 - DNA, 184 bp, Homo sapiens
tatccacctgagacctggctgcaaggctctgaccacttctgattactgacatagaatttactctaaagataatcctaacctgactgcctcatttatatttctagcttgtgcttcctcctggcaaaccagacaaatgatgcatgtggtaaggggctggctcatctggtctctctctattcagcag

SEQ ID NO: 189925 - DNA, 311 bp, Homo sapiens
taaaataagcatgtagagcctatcatctctaaggttctttccagcttgagaaatctttatatttgcatataagctattggttagccttgtaaacttcatcttcaaatctgaaagtgttaatattttgaacagttaaatgagagggcttggtaaattttgtaaatatttgttaaagtctttgtgttaaatcattgatattttaatagaattcaaatgatgatcagcaagccaattgaattcttcactgtcactgggttgattttcctgttgggtaacgaatctcattttgtaaacaaagttaattctttcaa

SEQ ID NO: 189926 - DNA, 421 bp, Homo sapiens
ctggccatcttgcccagaaagaaggcactggaacaaggtcctaaagtttgagataaggcagctaccagaaattaattagggagtgccccatgttgacagaggatcatatttttaaattgaaactcttttcctgctgagactgttctgtgttacaattcacgtgtgaccatgaggttcacagaacaggcagtggcatctagtaaactaagcttcagggtaaatagaatgttggcgccagccacttcaacttgcactagtgaatatgtcaagacttgtcctccatttattaaccattagctagaatggaagcgtgtgcctatctgagcctgtgtggctgacatttaagctgtggctcatcatgggattccatagctgatcctgacatcagctagagtttcatggacatctggaaagtcggagt

SEQ ID NO: 189927 - DNA, 345 bp, Homo sapiens
tccctcccctgacacttggggattacaacttgacatgagatttgggtggggacacagagccaaaccataacaaatggcatctaaaaaattcaacagcaaacttcattttctttttcggccctactgggagtcaagcaaacatcatgtttagtagtaaaatattaggctccttccttttaatattattaacaagataagaatgcccactattatggctttttttaaacagatggtagaagtcctagacagattttacaagaaagaaaaaagacataagataggacaggcaaaaacaacaccttaattttgatatcatcttaatgatgagactgtctacatagaaaa

SEQ ID NO: 189928 - DNA, 578 bp, Homo sapiens
acataaaccacctttcttctataactgaagtgagatgtgtccctaagggaagctacttggagagttacgggaatgaccaggtatctattccatctagttgaccccagagagagaaactatttaaagcctatgttgtgtgtgcagcttcactctgcactgacgtctaccaacattgccccgtggccactagatgttagtctagggccactggtaaagaaactgaacttcataaaaagtagaaccaatccagtggttgtcagaatagaaaaccaagtatcacacgttctcacttacaagtgggagctaaatgaagggaactcatgaacacaaagaagggaacaacagacactggggcctacttgagggtggagggagggaagggggagaggagcagaaaaaacaactattgggtactaggcttagtacctgggtgatgaaataatctgtacaacaaattcccatgacccgagtttacctaaataacaaacctgcatatgtacccccgaaccttaaataaaagttgttttaaaaagtagaaccaggccaggcacggtggctcacgtctgtaatcccagcac

SEQ ID NO: 189929 - DNA, 163 bp, Homo sapiens
cttaacttgttcttgctttcagtggtttgcttgcagtccttgtcacggccgatcccagaccatatgacaacatggtatgtgatttccctccacacatctcctgcccacactaacatacctttctacatggcattcactggtttcccttcagccccagaggaag

SEQ ID NO: 189930 - DNA, 259 bp, Homo sapiens
ctggcgacctaacctttagaaaaattcaattcttcatatgttctttggtggattctgctcctggatactgtgcgtataggaatgaagtatttactgttacttttgatctgcttagttacagaagttatttaaatttggaaaaaaaaaaactgattctggtatttgccatgacttgcttaccaggtttacaaaaataattacaaaacaaaaacagtatgtttcagtttttagtcgttagtcattcttttttttttttttt

SEQ ID NO: 189931 - DNA, 394 bp, Homo sapiens
cttcggaaggcagaaaacaaatgcttttgggtgtgcacccatctctcccctttaagaccaagtcttctccccagccacaatctgctgtagctttggccccagccagaaactgggccatctctttctttaacttaatcttgtggtgccctttctggtgctgggtccagtccctaactgaaggcaggcccacatagcagtccctgattctcaccacttgaggagttagtgggtcccaggctgattgggtgacagaagggggcggcaaagagcagtggcccttggactctcctagggagggagcaagaacttctaggtaggctgatgccaaggatctctaaacttgggatcagactggaggagccaaaagttggggtatgaactgtaggaaaggtcg

SEQ ID NO: 189932 - DNA, 269 bp, Homo sapiens
agggaaactgcctgctatggcgtgccctgccccagccaaatactgggaacactgggaacctgtgtggtgcgccggagtcctgaggagaagccttgtgttcagtaggatcacgggtgccagccccgacaatcatggggcctgcatttacactctttcccacaaacctcacagagttaaacttcctttctttaactctttgctgtcaccttctgctaagctctggggattctacttgtgtcctaggaaaaagtcttccttactcctttcct

SEQ ID NO: 189933 - DNA, 566 bp, Homo sapiens
ctggaactagataattaatttcactgcaaattagaatcattctagaaaggaaaaaaacaagaaatgtaaattaagatttacctcatttcagagatataatcctgcaaaactgtacatataactttctaaagcccttgattttcactcttttcaattttgctgatccacttatttgagaccaatgaaacgcctgcttcccactttagaccttggaattgcctgtcggttaatttctggtagttcctgcagtttgccttactgacaggccagtgccatctaatggtaaaaaaggacagtctgaagctcttggttttcttaaactgcccagtgaaaagaaatcattttcttcattttacttttcagttcaggaatatattgcagcaaaagagtggagacaacctataatttttgtttatcaaattttgtgaagtctgttatacagctttatttatattttgcctaattccaaaagcatttgtggccattacagaaaacacctaccaataaaagagtaaaatattttttacatgtctagtcatttaataaatgctattttgaattgaaat

SEQ ID NO: 189934 - DNA, 286 bp, Homo sapiens
atattctgtttcaaaaatagtatgttcacagtattattaatagaactgtcccctgtctggtttcagcatgtctgagtggagtaacatgctatagagtttgtcattagcacatatttacttgtttgtggcattctgccttttgtcatcttttgttaaaatatgagataatgatggtagcataagcaggttagaatcacagcaaatgtctgagcatgtattacaatgtgtagttcactgtgataggactggaggttcagatggggaataaggtaaccatccttctcaa

SEQ ID NO: 189935 - DNA, 105 bp, Homo sapiens
gtgtgggatgaggggcaggaggttcgggggaacagagatggagctagggctgcagccaggaggtagagtccccctctacccccagtcccagcctcacgtcaattc

SEQ ID NO: 189936 - DNA, 291 bp, Homo sapiens
atgaagatatctgaggctcagggaggctaaatatcctgcccaaaatcacgcagctaaaaagtgacatggctgaggttagaacacagtttttgttcctgtaagtagagcatactgcctcttgctgtcaagtggaaacttccattttactttctttagctgccagaaatgggggtatgttagggtagcttatttctgtgtttcagtaaactgcagaagaattcatgttagaaggaagaactaggttgatctgtgggcttggaagaatcatttgacaagggctttaatttattc

SEQ ID NO: 189937 - DNA, 475 bp, Homo sapiens
gcgaacagccgagcggtgggtgttccccagctacttaagagggacaacgtacattgttactgagctactagatctcgagattccgcttagtcagggtcatatcctcgtcaacttgttggaaaggagagacatgtccagggtatcgaggcatcataatacgtgtcatgtgtcaatatcttgccccctcgtgtgccagtggactgttcagagatgcagtagcttcacatagttacatgaagatgtcccacaagaccaagcaatcatcctctcatgaagctatagtcaacttataagcaatctcttgttatgttctccctccttccctttctccccattcctgcttccctgggatgactcttgcaaatgaagtgtacgcttttgcctctccctctaatttatattttcaaggactctagactaagacacctaccttgtgacaggtactgttctggatgttgggtagacagtcccgtcc

SEQ ID NO: 189938 - DNA, 672 bp, Homo sapiens
atggccttgttcaaagactggaagaggaagagccatacttcttattgtgtctgttttgacagagtagaagatccttcaccaaagtccctaacaacccacttttggtgtcattggttcctacctggtgattcctttagatggggggatggaattgtcacaattggctaaaacaaatcaacattcactctgggccaaggtggggtcagcttccgtaggcacataatcacaccagggctctgccactgagacaggcaaggggagagtgagggaactgatggacaccaacaatgactggcacagctttatggctactttcaattctttatgcaacaaagacatttcatgagactcacaaattataccaaaggaattcatttttgtgtaaatgactgtaatttcaacgtcaagtaaaagtcttaagactatgataatactacattgtctctctctctctctttttctttctttctttattttattttatttttttgactgagtctcactctgttgcctaggctggagtgcagtggtatgatgtcagctcactgaaacctccgcctcccaggttcaactgattctcctgcctcagcctcccaagtagcttaatcactctaagcctcagtttccacatctttaaaatagggagaaaaagtatctacctttaagggatgt

SEQ ID NO: 189939 - DNA, 654 bp, Homo sapiens
agagtgagaagtgaaggaaagcaaagatagctgaaatggagagaggggagggtgaagcccagaaaggcaggcagggaaatgacccttgatggatacaataaggcatgtttgcactttatactaaggcaatggaaactatgaaaatatcttggggagactattagaacaatgcaggaattgtgagcaacattgtgttatggcaagaatgaaggcagaaagagcagttaggaggctatcaacatagcccagatagaaaacggtggtgacatggtccatggaactggcaatgatggggaacagcgaacagatcctttgtagatgaaggcatctttcatgggatgcaaacactggaggatgagcaggctgggcgaaggaagagaagaggatatgcttagctgtagacaggccgagtctgaagtgcttcctaggaaactggatcatgggtttagagcccagtgaaagttatggactaaagacaaatacttggtatttgtgagcctcagacatacaggttcccactgtggtagccactagccacatgttgtctatggtgcacctgggatacagctagggcaaagtgaaatgtactataaataagatacatgctacatttccaagacagtatgaaaagggaatgtaagatctcaattttta

SEQ ID NO: 189940 - DNA, 189 bp, Homo sapiens
ctcagcaactactgtctttccagattttacagaggaactggctgggggataaatcagatgatgatggagatcatgacaatcttactgcagcttgaacaggttttacaaataagcagaaaggaacctaatcttctttatcccgcccaggtgatattataaaccagcgcacacacacacacacacacacac

SEQ ID NO: 189941 - DNA, 832 bp, Homo sapiens
ctgcctcagcctcccaagtagctggaactacaggcgctcaccaccatgcctggctaatttttgtattttttaataaagacagagtttcaccatgttggcaaggctggtcttgaactcccaaagtgttgggattacagacatgcaccacagcgcccagcattaattgcatttagtaacttaaagtttgatatacaatgtagactactctgcattttcttacgttattaaaaatgagcatttttacttcccatggcaccccttctaccttaaactttctacataatacatcatctactttatttcctaatcagatgagttttcccttcaactacatttatgttaagtaaaaaagaaataaaaagctttttaagtaaatgattggcatatcacaggtaaaagaaaaccactaggtgtcattatagaccagatactatctaggtatcattttactgtgacattttggtttcctgaaagatagatgctaaataaatttgtttaataaaatgaaactttcaaaatatttaggaagctgactccttttgttgcaacagagtctcactctgttgcccaggctgtagtgcagtggcatgatctcagttcactgtaacctctgcctcccgggttcaagcaatttttgtgcctcagcctcccgagtagctgggattacaggcatgcaccaccatgtctggctaatttttgttttttttagtagagacggggtttcaccatgtcggccaggctggtctcaaactccaggcttcaagtgatctgtctgccttccaaagtgctgggattacaggcgggagccagtgcattctgcctgctgactttg

SEQ ID NO: 189942 - DNA, 257 bp, Homo sapiens
gttcaaacagctagcaggaagatattaaatttcccaatacaaagaaatgataaatgtttaagatgatgaaatgctaattatcctgacctgatcactatacattatatgtattaaaacatcactatgtagcccatgaatatgtacagttatctgtcaatcataaaataaattttaaaaacatatcattatatatcaatgtgactacatagaaaaatatataagtagcagcagcaactactgtcattataaaaacactg

SEQ ID NO: 189943 - DNA, 757 bp, Homo sapiens
actccctgtcccctcctcgagccatcgggaaggcctgcgtcctggcaggctccagtctctgcggctgcccctccggcaggccgccgagaatcagcgcggcattgggccaggcacggtttccacgagcttcctccttctgatcctcccctccgccccccccaccaagctccccaaaatctctcactcacaccccaaatcacctgggccccccacctcaaaccagaggccatcggggcagaacccagcaattgtcaccgccctctcacgaagcgtcccgtgccccccggagcacatgtccacagcgaggcccttcacggctctcagatcagctccccgcctgcaggtcccagccggccctgctgtcgctgcaggttgagcttctcatgagtgaaggccccggtcactctgacgccgccaaatagtggagacaacaccaagctctaaagattttcaaagggagagagacaaaaaaaaatgaaggccaggtgtggtggctcacacctttaatcccagcactttgggaggctgcgtggggagcctcgagctcaggagttcgggaccagcctgggcaacaaagtgtctctacaaaacaatatgaaaattaaccgggtgtggtggtgtatgtctgtggtcccagctagggaggtagagctaggctgaggcaagaggactgcttgagcccgggaggcagaggttgcagtcagcccagatcacgcctctgcactccatcctgggcagcagagcaagactccatctc

SEQ ID NO: 189944 - DNA, 437 bp, Homo sapiens
atggagtgcagtggcaatcgtagctcactgcagcctcaaactcctgggatcaagtgatcctccacctcagcctccctaatagttgggactacaggcatgtaccaacacaccttgctatttaaaaaatgtttctgtagacatgtattctcactatcttgcctggctggttttggccatttttgaactcttttgattctcacacgttttatagagttttccctaaagtgcatagctctttattccttagggggatcttaaaatagggagatccctattttattgtgatgaggtcagtgttcctgtgactaatcactgagttacatatgtcactgaggaaaactgttcctctaagctacagagattcctgacattgggaaggagacatatagagttagccttaagcctgttagaataaagagtgtaagccttctgtattg

SEQ ID NO: 189945 - DNA, 220 bp, Homo sapiens
gtctagagtacccggtcactgctacaccccatccctcccctttcctcctttgtctggattattagaagaggttgaattcagaaatgtgactaatttttacagattgtgtttttacagactagtttttagaaatgtgacagtttttacagattgactcccttcactgaagaaggaactttctttgtagtctagatttttttagttttatgatacatgtcta

SEQ ID NO: 189946 - DNA, 315 bp, Homo sapiens
ggattatggaactttatggaaaagccgtagctgagtgctatttgtgttgtacttaactagttttctaccaggatgactgtgcagtctggagaaaccactgtgtaacataaaagaaaaaagtgctattctgtttaaaagtgttttgaaatgttcagaaaggaagaggccagaatctcttagaagacagacttggaaggagttgggcccttcaaaaggtggtaaatatgtgattctcatcatttaatatatgttaacttatttgaaactcaaatttgtacaaaaagctgaccagcttctttttctactaaatttgtc

SEQ ID NO: 189947 - DNA, 164 bp, Homo sapiens
tttagaaactacaccttcaaaactggattgcttctgatcaagtcaaattaataaatagcgatgaaaagggcctcagctgtaaagagcttctagaaatccctcccacccaggagaactctctgctctctacctccccggtagccagccgagaggaacttccagtt

SEQ ID NO: 189948 - DNA, 934 bp, Homo sapiens
ataatctttatgtttgacatgggagctattccatattaagggtactgtgtaacattttcttctatcatattaaacataatggaaaaagtaggcacattttcttcgtttgaatggtgcttataagaaattccaaattctgtttcttttcattccatctgctactttgcatttatacttttgcttcatattgggattctcagatgatactaagggagtgaaaaggcaacctacagggtgggagaaaatatttgcaacacataaagctgacaaagggttcatatgcagaatacagacaacaccttcaaataaagaaggacaatctattagaaagctggatgagagttgaactgtacaaaaaagtctttttaaatgaccagtaaatatatgaaaagggactcaactgcaatgagatgccagtaggcacctatcagaatggctaaaaaaatctttaagatggacaatagctaagcattggccaaggcgtgaaacaattggaattctcatacattgctgataaaagtgtaaattgataaaagaacttcagaaaactgatgcccatttaaattcagcctgcacatacccttatgaccacaaattccacccaactgaaatgaatgtaagtgtggatatgacaactctagttacaaagaatcaggccgggcgcagtggctcatgcctgtaaatccagcactttgggaggccaaggctggcggattacgaggtcaggagatcgagaccgttctggctaacatggtgaaaccctgtctctactaaaacaaaaaatcagctgggtgtgatggcatgcaccctgtagtcccagctacttgggaggctgaggcaggagaatcgcttgaacccaggaggtggaggttgcagtgagccaagattgtgccactgcactccagcctgggtgacagagcaagactccatctca

SEQ ID NO: 189949 - DNA, 550 bp, Homo sapiens
aaccaaacaagaataaacataatatagaatccaagaggagaatagtgcaagggagttaaagcccagaatgaaatgaaactgaagaggaaacgtcaaaagagactggtaggttcaaaggaagataataaacagggaatgcaagggaagggctcagtgctgcaatggatcggatgatgttaaaaatcccctagggttcctaagctccataaggcagaacctgtatcatcgttacctttgtacaccctgcagccagcacagcaagtgacacaggtaagacatcccatcaaacttacttaaaccaagttaacagaggaagaagtcaattctttaactcatgcttgtcttttctgtagggataaaatattttcacaatggaaaacgcgcaatcaacagcataaatgaagaaactgaaatgactacacttaatgacaaaattaaaagggaaaatttttagtataagaaagtacttgctaatgatagatgcagaaggccaataagggggagggtcctcagagaatctccaaccagcttgtgcactgggagaactggg

SEQ ID NO: 189950 - DNA, 151 bp, Homo sapiens
aagtgtattcctaattttaaattttggttttttttgcagctgttgtgaaaggggttgagttctttatttgattctcagcttggtcagcagctgaagcatttgaataagtgtgtacagatcactgctttgagcagatgggtggaggagcagg

SEQ ID NO: 189951 - DNA, 328 bp, Homo sapiens
tttttctgaaagttcttctagagtgaagttggaatttagtttgagcaagttgcgatgtggcgagtgcggagttagaactgagcaagttagtgtcaccctgtgatctgatctgtgcaccctctggaagtgtggcgtctagagtcaggccagactaggccaatgctccagtccaatattgctgaccagtcagcctcttatggccccttggtggtccttgcgtacatgtccccttctggtctctggctggaggcctgagctcctgtgggggcagcgttgctgcccttgctatgagcttatgtctttgtactgccacctgcatggccaaaac

SEQ ID NO: 189952 - DNA, 418 bp, Homo sapiens
ctcctgtttcagttcagcatgtacaaagcatcatattttggggtatcggtttctgagccccaacacaggcatcgcagtcttcactgaagaaggaggagcagaggctactgtgcacagttcgtcccagggaatgagaagttgagcccaactctgcctccaaggcccctcagcccctccagctttcatcttctgctctattctcaatgtgctggaccacattctaggtgccgtcttagtctggagagcaaaggagaaacagaccctgactttgacaaagttaacatcaatacagaccgaaaaatgtaactaatctcataaatgaatatttgcaaactactatgagttgatttcatctgagttttgaatgtagccttgagttgaaatctgaaggacaattaggaatttcagcaaagagtga

SEQ ID NO: 189953 - DNA, 524 bp, Homo sapiens
ctcccaagtccaggcaacaaactaaaagaagtaatgccctatgcgctggaggggaaagaggtcatggctcctcccatttccgtgcccaccactccctcctctttcaaccccaagccaaaggcaggaacagaagggacacagttgaggaggggcatcacctggaattacaaagtacattacaaagtgactcaagcacaaggatgtagcgcattctctcccaccttgacacccaggagcagcacaggtccttgtggctggtgagaggaaccacttccgcctcttcctgcctaggtcaccagagcctgcggcacccaagtctgggagccaagccagctttccccaaactctgttcccatgaacatatatccacctcggggaccgggggtggggtgagggaagatgcgagttatttccaggtttcctggccataattagcatctcactagtacttaatcccaaaatcatttttagtaagaaaatcagatttttttttcaggtaatatcttgctctaattccactttca

SEQ ID NO: 189954 - DNA, 478 bp, Homo sapiens
agcttggctgaatgatagtagtttgaattagaaatgaggaggtagtataattcctgtgttgacactcttgctttgtagtttaggtcaagtcactattaaaaatgaaaccataatctacttgaacttgctggaaatcttgttaaacggtgcctcagatgttagtactgtgcaaatattttaataaaacatctatatacaggccgggcgtggtggcaggcacctgtaatcccagctacttgggaggctgaggcagaagaatcgcttgaacccgggagacagaagttgcagtgagtcgagatcataccattgcacaccagactgggtgacagagtgagattccatctcaaaaaaaaaaaaaaaaagagaatgtttacataaaacccagtgtgctatgattatgttctaggttcacgattctgtcatgaggataaacagatggcattaggatagagttacaccttacgatcctgaccaaata

SEQ ID NO: 189955 - DNA, 435 bp, Homo sapiens
ctttgagccttggtttcctcactgggaaaaatacacctgtcctgaattttagcctctagcagttggcttagctactcgtagcacctctcctcttctctgcaatataattctgcgaatttatttcctcctgaataaaatataattttttaatgctttactgggattacaggaaattgggaaagtctccaaagccaccttccccaccaaaaaaagggaaacaaacattgagtcaaaactagctaggagaggcaaacagtaagcaagcaggaagaacaggcttttgtccttagtgcaagtgttgctagcgtaggttggaccatataaaattgtggatattcaactggtttgaccccaaaaaagcaacattttcacatagatcaacctaatagtagttccattcaggatgccaaccctgagtctctaccttaaggcaga

SEQ ID NO: 189956 - DNA, 300 bp, Homo sapiens
tttcaagaccctgggacataacctcaggacaccagcccctgagaggctgctgggaagagctggagcgcagtgctgctgtgtgaccccaaatctgctcctctccatcaccttggttttagaaatttcccgttgctgtggttgtaaggatacatgattctggcacacggcctcttagcacagttttgatggacagtagcagcttctggctagtctccctgtttcagttctctgtcctctccaatctagtctctttgtaatagccagtgagctgcggacaagatctgatcattttatttcttt

SEQ ID NO: 189957 - DNA, 538 bp, Homo sapiens
tatgtgcatgcgtggacatgtgtatgtgtttgcatgtgtatgtgtgcacacatgcctgtgtatgcacatgtgtgtatatgtgtgcatttgtgcatatgtgcatgtgtgttcatgtgtgcatgtgtatgggcgtgtggtggtgatgatggttgaacagtcctgcagccctggtcccatatggcctattcccagcttggactggcttcctggggtggacatggacaggaaaagatgccagactcatagagaaccccttcttcctccacaccagattgggcagggggtggggaggctttcaccttagcaataggcaatggttgaaatatcatttccagggtgacatgacatgatgtttgggatttacttcgaaagaacaggggtggagcgggagatacagatgaaacaagactggctcagttgataattgttgaagctggctgttgggtaccaggggttccactaaactattttctctacttctgtgtatgtttgaaatgtcctggaacaacaataaaacacttatgtcatctccagtgat

SEQ ID NO: 189958 - DNA, 408 bp, Homo sapiens
cccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgatttgtgactttttaaaattgtagccttctgaaactaagcgaaaaaaaaatatgacccaaaaaagggaaagtaaaaatagacaagcaagcaaaacaaaggctgtacatgtacataggaaatataacacaaatcaagtagtactggtggaattactggttggggggaataatttttaacaaactggtagcagacaaggcaagtggttagacagagtaatttttgtcataattttaaaacatttcataatgagcgaagtttaaggaat

SEQ ID NO: 189959 - DNA, 334 bp, Homo sapiens
cccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgatttgtgactttttaaaattgtagccttctgaaactaagcgaaaaaaaaatatgaggtgaatttttgaaaggcctaaacgaagaaaaatgagatcccaacttgtctctcatgtaagggaggtaaagaaaagtaagtgttgaatgccaggtgtagtagtctgctctttatttgagtcgagactaagaagcaat

SEQ ID NO: 189960 - DNA, 604 bp, Homo sapiens
gccctagaggttcccgcgttatccgtaccatcagagaatgttataaacacctctacgcaaataaactagaaaatctaggagaaatgggtaaattcctggacatatacatcccccacaagactaaacaaggaagaagttgaatctctgaatagaccaataacaggttctgaaattgaggcaataattaatagcctaccaaccaaaacaagtcgaggaccagacggattcacagctacattctaccagaggtacaaaggggagctggtaccaacccttctgaaactattccaatcaatggaaaaagagggaatcctctctaactcattttatgagaccagcatcatcctgataccaaagtctgggaaagacacaacaaaaagagaaaattttaagccaatatttctcatgaacatcgatgcgaacattctcaataaaatactggggaaacgaatcagggaggacttcaaaaagcttaaccaccaagatcaagtgtgcttaatccctgggatgccggttcaacatatgcatatcagtaaacataatccatcacataaacagaacaaattgacgaaaaccacatgattatctcaatagatgcggaaaa

SEQ ID NO: 189961 - DNA, 338 bp, Homo sapiens
ttgtttaatatctctaactctgaacttccacaacctttctatcagatattcaggtaagtgctgagaagcagaaattctaaaaataatttctactgaatcttttggagaccccggagcaaactatttgaatccattccccttctttttgcatagtttttctttgtctatttgaacagtgctctcatgggtcagaaagattgagtttctagtcccataccttaaattgctttataattgccttactttataagggagacatatcctggcacagtgaagcctgcaaatattccagagaaattaatctgaacctattagaagtgggaggagggaaagaaact

SEQ ID NO: 189962 - DNA, 385 bp, Homo sapiens
tcccccaaatttccaccaaccgtgattgctcctgagcgactccaaactcctggaatatcctggttttgacccataaatagtgaactgattttctatctgacatagtttggaaatttgtccccacccaaatctcatgttgaaatgtaatccccaatgttggaggtgggccctggtgggaggtgctttggtccttggggtgcatccctcatggcttggtgctgtccttgcaatagtgagtacttgtgatatctggttaagtgtttgatccaccccccatccctcttgcttctgcttttgccatgtgacatgcaagctcctgcttcaccttctgccctgagtaaaagctccctgaggcctccccagaagcagagcaaatgccagtgtt

SEQ ID NO: 189963 - DNA, 658 bp, Homo sapiens
aacaggaacatgcggcattgttgctggtaatgataaatgtgcagccactgggcaaacaattttgtggttcctctctaagttaaaaataatggctgggcgtggtggctcacacctgtaatcccagcactttgggaggctgaggtggatggatcacctgaggtcaggaattcgagactagcctgaccaacatggtgaaaccccatctctactaaaaaatataaaaaattagcccagctactcaggaggctgacgcaggagaatcccttgaacctgggaggcagaggttgcagtgagccgagatcccaccactgcactccagcctgggcatgacagagcaagactccatctcaaaaaaaagaaaaaaaaaaaaccctcggagggcgactcataatggacggggggcggggaaacaaagagggtaactggaacaggtgggcccgaggggctcaatagcgcgggttctccgtgacccgagcattttcgtggttaccacaggggggggtagaaactcgtggcggggatctactcacctttatatagagagcgaagcctccgcctatatataaattttctgcggcgatatagagccgcgacgagagtgtattaacccgcgtggggaatattataaaggaagatacatgcgggggcgggatacgat

SEQ ID NO: 189964 - DNA, 353 bp, Homo sapiens
cacgcctatcactgacagcccaaaaaaagtgtactttaattacagggagcatccagggagggggagctgtgcagctccttctttgttgacaggaaaaaattcagctagcattaaaggcaggtcagtagtgtcaacctgttttcctgcccacacctcccaaggccatccagtctcctggctttactgggtggagaggtgctcagcagcttctgtcactagctctgaatggcctgtctcctggacaaagaagctttcacggactactctgcagggaggtgacattggaccagagctgactccacctgggggaaagagtaattctctggttctttataggtgcctgtgtagaaaga

SEQ ID NO: 189965 - DNA, 200 bp, Homo sapiens
  misc_feature (180)..(180): n is a, c, g, or t
  misc_feature (194)..(194): n is a, c, g, or t
gagtaagtacaagagagagagataagaggatgttgagactaagatggatttttggaggatgggaaagatgagtctttaatgctaaaaaaatttccaatgactcttaatttcttctttgagcacctactatatgccaggcattgtaccagatagaccctggaacgattgctatggtggggnggatccttctagcnagtcga

SEQ ID NO: 189966 - DNA, 260 bp, Homo sapiens
ggaggctgaggcaggaggattgcttgagcacaggactttgagggctgtagtgagctgtgattgtgcctgtgaatagccattgtgctccagcctgggcaacatagcaagaccctgataccttgggtttttaaaaaacaaaacaagatacatgctgacatttctggtttggcaggcagagcttgttctgctccccaccctcccttttcccatagtaaccatttataggacatctcactgttgtctactctgtgttgcctctg

SEQ ID NO: 189967 - DNA, 336 bp, Homo sapiens
taattttgtccagtgcaatccaatacatgtgcattgatttgagtcaacattgttgaaaacggttctgtttttcaaaatgaaaagttacacatacattttcacatctcaattacactagaatgtcatacgttgatattgtgatgtaacaaattttaaaatgaaggttataggctgggcgcagtggctcaatcctataatcccagcactttgggaggccaaggcaggcggaatcacttgaggtcaggagttggagaccaggctggcccaacatggtgaaaccccatctctactaaaaatacaaaagtcagccaggtgtggtggcatgcgcctgtagtc

SEQ ID NO: 189968 - DNA, 265 bp, Homo sapiens
attcagaaaatgttagctcttttttgattagtatttgttattatttatctgaatattaatcatttgaatatccttccctctctcaccccctagaaatacaagaagaaaataacagattctagtccatctgaggggaggagaggggctaggaaggatggctgtttctgcttgtttagaagagataagcagtggatgtgacattaactgaaagtaaatggaaaattattagggaaaattgtacttgactttgagtccccagatacac

SEQ ID NO: 189969 - DNA, 367 bp, Homo sapiens
gtttagctctatacacaaatagagtccaaaggcatgcacttggtgtgattaaatgatgacaaactcatttgatacacattttctcaaatagcccatgttctacagaaaagctctttttcttgattaattttggaagaaagaacaggtcaaaatgcaaatgtgttattctattagcatggaggagcttcttagattataaacttgatctcatcttatacctgatatcagggtcttgagagatacaattaagtctcaactcaggagagcaagtatgaaaagtcaacagcaggtgagtattgccaaaggagggttaatgtgcttgggacatgaaggtcatagtcctgggcagttggaaatccttgagtat

SEQ ID NO: 189970 - DNA, 419 bp, Homo sapiens
ggtccttcctacaacatgtgggaattatgggagtacaattcaagatgagatttgggtgagggcacagccaaaccatatcaccattttaaacagatgaggaaatgaaggcactgagaagttaaataacttgcccatggccccacagcaagtgacagcagagattcagatgtaggtaggctaattgcaaaaccattgttcttaactgttgtgttatgctacctctggaatatcaaatgtatagctttacttgttcagtcattgctggattcagggcccaaacaaggttattgggattctctctcatgttgtattttggctcagtttttctctgggttgattttatcctcaggcaggcattgccggtgaagtgacagtatagctgctgggatgagaactgcatattcataatttagcaattt

SEQ ID NO: 189971 - DNA, 662 bp, Homo sapiens
atactgatatttccctttctctcctcaaaatacctttggcatttatttattcaacaattatttattgtttattgtgggccaggcaatctactaagtgtcagggttaccaagaccaatagcacagtcctaaagaacttgacagtataaataagagattaaaaatactgagaatactttccgaataccctcaaaggtaccacagcattgcctaaaatataactgtaaagactgggaacttcactttagggtcaatagattctcagagattgggagtgtaagtccacaacaatggaccctccttcaacctggagactttttcttattttctattgtattctgagccagaacagagactcacaagagatatttattggctattagtgagcaaggagctggagccatctagaataatgacttagccatgcatgaatcttctctatttttatttccagcgctagcttatttagcttttctttgacagcattacttcacagagtagcccattccatttttgaccagctctgtcaggaaattcttcctcattttgtgcagaaatatatccccctccaagttccacccacagaggtgcattctgtcctccctctgggactcccaggaacacacacaacagttctctccactgtgtccttctattttgaaat

SEQ ID NO: 189972 - DNA, 458 bp, Homo sapiens
aatatagtgaaactctgtctccactaaaaattagctgggcctggtggcgggtgcctgtagtcccaggtgctcaggaggctgaggcaggagaattgcttgaacatgggaggcggaggctgcagtgagttgagatggtgccactgcacttcagcctgggcaacagagtgagactccatctcaaaaacaaacaaactaacaaaaaaatgtaattgacaagaaaaatagctgtttagatataaggagaaataaaagatactatagtagcagaacctgatctagctgggtcacgggtggggtctagaagcattcctgaggaagttacacttaagctgagacaggtagaaattatctagttaacaaagggctgtcctaattactctagttggataaccgctcccaaaacttagtggcataaaacaattattttattatgctcatggattctgagagtcagaggt

SEQ ID NO: 189973 - DNA, 410 bp, Homo sapiens
tgccacatcccatcttgccctacaattcaacttgcttactcctacaccttcaagattcccccactttcagtcaatcaatcatgtgaagagccatgctgtaattttgtgcttttcacatcctcaacttatgttacaatgagatttcgaggtgctttttgctggctcaagctgataagagaaaatatgtaagagtgttggcttcttgagctaacatcagtgttgtgagttatataatgaaacctgtctggatcggaatcctaaagctattatctttctagaactgagataggacacttaaggagccatttagaatctcttagccacttataggttgggaaatcaggttcttttcctcttaaaaaaggtttgttgagggtagcttaccatattgtcagcattttgccttatca

SEQ ID NO: 189974 - DNA, 611 bp, Homo sapiens
tgagagcaaggagaagtcctctttggttaggtaaggcccctgagaaaatgagcagaggatgagaaggcaccagctgtgtaaggggaaagaacatcccaggccaaaggtatatgtgcaaaggtgtctgaatttagaaagagtctggcatgctttaggaactgaaagaaggccaggtactatatgatagtttgtgcttccctcatttcttcatattatactgtctccttcactagaataattgttcttcaagggtggtgatgacatctgacttcttcccagctgttttcctcatacctgtcacaggttggcacagaattagtatttattagatgcttgataaaaaattaagcgcctgttgcttgctcaacaactactatgtaagttctaagatatcataattttatttttgggcttatatcagtgagtttcatgaaatacaaaattcacgcttaaaaaatttaacatatttaactgttttatatctctaactgtaccattaagttcaaactactttgatgggctgggttaaatgctacataggatgatcctggtttatgcctgttgtcctgtgtccaatcctatttcacaatggtctcctttcactctaagtg

SEQ ID NO: 189975 - DNA, 191 bp, Homo sapiens
gattgacgatttatgagactgggtgacagagcaagacctgtctcaaaaatcgatcaatcaataaatacataggtacatacagaaggatattcttcagttttcctgatccgcttaaggaggtggctaagaattccaaggccagccagttatctcagaagcaatttgactgacagcgaagacacgataaataa

SEQ ID NO: 189976 - DNA, 461 bp, Homo sapiens
ttagtacagacagggtttctccattttggtcgggctgatctcaaactcccgacctcaggtgatctgcccgcctcggcctcccaaagtgctgcgattacaggcgtgagccaccgtgcctggccatctttaattgccttaatgaagtcacgggttggaaaatataagttttaaaatgtcaggcacctatgggggctacgtaatattatatttttgcctaaggatgtctctctcagaagcctgggcactatagttcctaaatatcccccaacaaccctgaaatgacttagtatcatcaatataataataaagcaaccatgaataacattaataacaagcatttgttcctcatttttttatttagggtctgacatttttactgtattttctcacctgtagttaccaacaacctacaccatagagaaaatagcaaaggctttggctcctaacacatctgatgcttc

SEQ ID NO: 189977 - DNA, 356 bp, Homo sapiens
ggagaagctgaaagccattcccatctaagaactcagaggtgtcagttgtttgcctgccgacgctctcatgtgaactaagagaatggaaccggacattcgtgaagtgctcagagacctaagttgcctaggctcgtctcaaactcctggcctcaagtgatccttctatctcagcctctcaaaattctgggattacagtagcataccttggaagtttcaggcctcttgaatgcagaatcatagaatttttagccctggaaggagccttaaagtcattgaatccagtcctttaagtttgcaagtggagacacagagactaaggtgacagtgccatgctgggccactccgtttggggtgag

SEQ ID NO: 189978 - DNA, 198 bp, Homo sapiens
acttttccccataagtagaagtaacttgagtgtgcacaaagtaactcttttgtgattttggagaaatgtatttccagtccaaagtggagtttctgttcaatgaatttcctaaatttagtatctctgtttctcactctttcactctcttctctcttgatgaaactacatttctactgggaatcataaacaatcatcttt

SEQ ID NO: 189979 - DNA, 553 bp, Homo sapiens
ttaaaccatttattccatatcctactcaaatcccccagtcaagcagatgagagacctaaccctcttcccacatttccattatttaagacaaaaggaaactagatttaagcctattagtcattcacgaaatctagctattactacatgtattaactggtgacaacttggtgtaaagggcaaagagaaatgtctcaatctgctgaaaatcacttctgactagggtcaatcatgaatattaactataataccaagcaacagccagcatctacttttccagctgtttgtaattttaatgaagtctcatacgccctctgttggttctctagcatatcttacaaccagaataggcaaagggttttcactgatctattttaacatggaaggtcagaatgttatcttgcaaccagtgcactacgttccttgcataatggaaaataaggcatatttaattttgcatatgcaaaaatcaccacagacacgattataaatgttttataagaaatttttgaaaaaattcataccacgaaccaggcaagtatattaaaccaaaaca

SEQ ID NO: 189980 - DNA, 366 bp, Homo sapiens
ctatgactgcaacgctgtactccaaccctgggcacagagactctgtctcaacaaacaaaaccaaaccagtagaataaattgtagtgtactcataacatgcaatagtatgcaattatgaaaatgaacaaactactgctacacataatgtggataaactttataaacatgttgaacaaaagaaaccagatgtaaaggaatacatactatatgatttcattaacataaattcaaaaataggcaaaaccaacctatagtgtcaggaaggagtttgctgccgggacaaaaggagaggatagtgattagaaaaggggctgctgagagagtgttagtaattcatctgatggtggttacacaaatgtgttcact

SEQ ID NO: 189981 - DNA, 799 bp, Homo sapiens
ggggggaggagccaagatggccgaataggaacagctccggtctacagctcccagcgtgagcgacgcaaagacgggtgatttctgcatttccatctgaggatgattaacagcattcaaggtggtggctacacatcacatcagcctggattctcaagtaggaagatacgcaacagagcatccagctgaccttcactggatatgttgtatgaacaagaacatgcagcaatatggtggggacgcatactacagctgagctctggacaggaagttttccattttatgagaaactcaaaccaccaagaaaaccagcttatctcacaaaatatttttatacttctctagaactcagtaagaggccctcaacggattggatgatgcctctccacggtccacatcggtgagggtgattgtctttactcagcctattgattcaaacactaatctcttctggaaacactctcagactcacccagaagtaatgtttggccagccatcggagcatcctctggcttagtcaagttaacacatagaattaaccatcacagaaggcaacagaaaaacctttaaagaatcaatagaaaatatgtgcatcagaaaatattgctggttacccaaaagctatttcccttttgttccttactaacaactcttactttgtttatatttggaggaagtaatgtacttaaggaagttttgtctctaacccagcattcaagaatgcgaagacaatcacgttaatcccatttcctctaccagtgattggtgtggaggtgggcatatcactcacttataaccaaaa

SEQ ID NO: 189982 - DNA, 681 bp, Homo sapiens
ggggggaggagccaagatggccgaataggaacagctccggtctacagctcccagcgtgagcgacgcaaagacgggtgatttctgcatttccatctgagcatgcagcaatatggtggggacgcatactacagctgagctctggacaggaagttttccattttatgagaaactcaaaccaccaagaaaaccagcttatctcacaaaatatttttatacttctctagaactcagtaagaggccctcaacggattggatgatgcctctccacggtccacatcggtgagggtgattgtctttactcagcctattgattcaaacactaatctcttctggaaacactctcagactcacccagaagtaatgtttggccagccatcggagcatcctctggcttagtcaagttaacacatagaattaaccatcacagaaggcaacagaaaaacctttaaagaatcaatagaaaatatgtgcatcagaaaatattgctggttacccaaaagctatttcccttttgttccttactaacaactcttactttgtttatatttggaggaagtaatgtacttaaggaagttttgtctctaacccagcattcaagaatgcgaagacaatcacgttaatcccatttcctctaccagtgattggtgtggaggtgggcatatcactcacttataaccaaaa

SEQ ID NO: 189983 - DNA, 344 bp, Homo sapiens
tgctaggattacaggcatgagccaccgcgccgcatttgggtttctacatcaaaacctgacaccaccagagcctgtgagagtttcttagggtcagagctagatatggcaattacggttataacattcattaccttcctaagcccactgatcatctgttgtacagcctcatagtctctgggaaataagtccataaatcaaggagggcaatgaagaagtagaaataaggactgaactaaaagtcccttaataactgaatattgaatgcttctggtgaaaagaatgtattttaagaaaattttatgggaatcaccattgagatgtatataggacttggactgtatatt

SEQ ID NO: 189984 - DNA, 452 bp, Homo sapiens
ggaaaaaccattccagtccttctgagagaagctggcgcagtccgtctcagagaaatcactgcagtccccccgagaggagctgtcacagtctctctgaaaggggccttcacagtccctctcagaggagccatcgcgtccctctcagagaagacatcacagtccagcccctcagagagaagccatcacagtccctcagagagaagccatcgcagttcctctgagagaagacatcgcagtccctcccagaggagccatcgcgctccctcagagagaagccattgcagtccctctgagagaagacatcgcagtccctctcagaggagccatcgtggtccctctgagagaagacatcacagtccctctaagagaagccatcgcagtcccgctcggaggagccctcgcagtccctcagagaaaagccatcacagtccctctgagagaagccatcacag

SEQ ID NO: 189985 - DNA, 523 bp, Homo sapiens
ccccgtccctaccaaaaaacgtacaaaaaaaatcagctgggcgtggtggcgggttcctgtagtcccagctacttgggaggctgaggcaggagaattgcttgaaagaaactgcggaggttgcagtgtgctgagatcgtgccactgcactccagcctgggcaacacagcaagactctgtctcaaaaaaagaaaaaaatgtaatggttaagatttaaattctaaagttttgaaatttaattctggagttgtgctgaggttaaaatcctgggaaccaatcctaacaagttttgagacttcaggctcattacttaaccttcttgtgcagttcattttcctcatctgaaaaatggagataaaatttctaccccatttgcaggtttattatgatggttaatatatgttaatatatgtaaagtacttaaaaccgtgcttgacacattctgttctggtggttgttagtggctgagggtataccatctgacttagggtctcagtctaggaggggccgtgcacaagtcaacagg

SEQ ID NO: 189986 - DNA, 483 bp, Homo sapiens
ggcgatgaacactacatgccgtgtagtcacagctactagggaggctgaggtgggaggctgacttgagccccagagataagaggctgcagaagctatgctcactgcactccagcctgggcaacacagcaagactctgtctcaaaaaaagaaaaaaatgtaatggttaagatttaaattctaaagttttgaaatttaattctggagttgtgctgaggttaaaatcctgggaaccaatcctaacaagttttgagacttcaggctcattacttaaccttcttgtgcagttcattttcctcatctgaaaaatggagataaaatttctaccccatttgcaggtttattatgatggttaatatatgttaatatatgtaaagtacttaaaaccgtgcttgacacattctgttctggtggttgttagtggctgagggtataccatctgacttagggtctcagtctaggaggggccgtgcacaagtcaacagg

SEQ ID NO: 189987 - DNA, 430 bp, Homo sapiens
atcgtggacatgtatcatcatcttgctaagcttctgttacatcatctgtaagatgaggatagtaacactgatcccacagacggttttaaggattgagtgagaaggtatatgatagtctcagcaccggtctaatgctcaggaatggctcagaaacgggggcgtttttaatgaaaatattaacaaggctttgtttcccaatcccattcaatttgtcttggaactgctaagtcgattcattctgatttctaaatcctaatcctgaaatgtctgaggcaaagatcaccctgtgttttaattgggcacttgtctcatatttctcctctgctgcatgagtgtttatgctcatgtacccaggaagcacctggggaacacagccaggtctgtgtgattctctacagagagcaagcagcagagttgcaatcaattaggt

SEQ ID NO: 189988 - DNA, 554 bp, Homo sapiens
gttgcagtgagccgagatcacaccactgcacctgtaagctgattgtggctgatttaatcctctatctggaccactaaatcttttgatgcagggaaggcaaactccagaattggggcttagccctggagggttcttggctccacacaggaaataattcaagggtgagccagtggtgttagacagcaacttttattgaagtggaagtatgcagcagcagaggtactgctccttgtggagcagggatacttgaaaacaggtgcccagagtagcagctcagaggcagttttgcagtcatatttatacccacttttaattatacatatacttagggtcagattatgcagcagtttctaaaacaagggtggtaacttccaggtgattgggttgttgctatagaaaggagtgataacttttttttttttttttttttttgacacagagtcttgctctgtcacccaggctggagtgcagtgacaccatcttggctcactgcaacctctgcctcccaggctcaagcattcttgtgcctcagccctgcaagtaggtgggattac

SEQ ID NO: 189989 - DNA, 525 bp, Homo sapiens
cggggcaatgagaaactgagttttggccaaaatggaaggtatttttatcccgctcagtgcgcgggctactttgatttcacgtggaggtgttaatcggggtcccctgcagctccggttcttttaattctcaatgcctttctgcggggggtcgagagctgttggctgcggggcactctggaatgaactcgttttccgtcgttttggggattggcgattgtcctgaggcgtgttactggaagtcgagagctgtgatgaatggttccacaaggatgggacatcttttgggcctgacacctgggggccctttccctggctcctggtgtagctacttaagtataaaggagggattggccctggaaaggtttctttgtgagtagtctgttgttggggcgggtgacatttcagagccaggccgatctaggcaagttgtgttcaccaagcatgtgtctttgtgcctagcacagttcgcaatgttttgcgtagttcagttaaccatattcctgaggcagttactggtatccttgt

SEQ ID NO: 189990 - DNA, 328 bp, Homo sapiens
ccaattccagcaactcagaactcctggggagtgaccgacttggcgaataacgtcctctcacacaaacctgctcttcttcaattattaaaagatacccgctgtggtaggcttgaaagtgcccccccccccaaatatattaatatcttaatcaccagaacctgtgaatgttaccttatatggcaaaagggactttgtagggcatgactgacttaaggattttgaggtgggggagttattctggattatctgggtaggttctaaatgcaatcacagggtctaagaggaagacaaggtcaaagaagaaagaggctgatgccacagtcccact

SEQ ID NO: 189991 - DNA, 298 bp, Homo sapiens
cttctccctgagacctactctgacctattgaaactgtgactgtacccctgtcttccctagcattcccaatcccccttactctgctgggtttttttaatagcagttacctcctaatatgttgtaaaatgtagatatttagtatgcatttctttaattgtctgcctgtctcctgcccccaactagaatttaagatccacaagtgaggagatttttgtctgttttgtttactaacgtacatcaagcaccaataacagtgattgtcacatagtaaagcactgaaaaaatatttaggattact

SEQ ID NO: 189992 - DNA, 219 bp, Homo sapiens
ctaaaataaaataacaaaaggagatgacttattgttcatggtaatttgtactgtatttattactagctagagaatatacattcctaatataagcatccctatacattttcagagaataatgcatattcctaaggtgccatgaagattgacccatcgttctacttacttgaatgtgtctctgggccacaacttgattcatctgatcttttcaatactatg

SEQ ID NO: 189993 - DNA, 683 bp, Homo sapiens
tgattgtcacactgatgcttttttaaaaagggtatacagtaaaaataagtcttcattttctatccccagatgcaacctctgttacattgcttagatctcattcttgggataatctgtgaatatataagcatatatttcacatatgttcaacaaatagtcttttgatgaattaattcatgaatcactcttattacaaacccattgtgacagtttttcatgggggcaattagatgagagcttctcattctgttcataaaactgtgttgagtaagccttacctaggcaacaacaacaaaaaacccataatttagccagctcaggaaaaataaaacacaaaaacaaaccttttcatattgaatctttttgtctttgtttatagctctggatcagaaaatcaacaatgattatagaatgtcacccaactcctacaaagaaaggagaattctttaatgaggtaaccaaaaagattttctttccacagaagagataattctgttcttagactttattttagcaacagaagctacctggtgaaataggaacctttcaggtttggttttgttttgttttcccgagacagagtctccctctgttgcccaggttggagtgcaatggcacaatctcggctcactgcaccctgcgcctctggggctcaagcgattctcctgcctcagcctcccaag

SEQ ID NO: 189994 - DNA, 505 bp, Homo sapiens
ggtctctttttcacagcatttcacttgacctcccctaaggcatcactgtgctgttttgtgtacttcaatcacttgtatttttaagtcccctgctaaactataagctttctgaagacaggatgcatctcataattcttagctctagcccactcactgccaaacttagtgccttacccacagcggatagagaagctatgtcttttttatgttctttgttaagagggaaggaggacagagaggtttagactattttagagagaatggtaagcaaaaaatgaaaaactaggccaaagatgactagcaaactcctcacaagtgattacttttctacctcctttggtatttctcattgtacacagtattttatgatgcttaataaatactgaatgaatgaatacaagcaaaatgtgaactaaattcaggtctccttcttcaggtccctggacataagggaggcaggcagcagagtttattctgatgaacaccaagaaaggttatatacact

SEQ ID NO: 189995 - DNA, 323 bp, Homo sapiens
acctcaggtgatccacctgcctcagcctcccaaagtgctgggattacaggcgtgagccaacatgcctggcctttatttggtatttcttaaaaaggcatttgtattttgttccatagtactgtatggtgttaggtctctagattacaggcgtgagccaccacgtctggcctttatttggtatttcttaaagaggcatttgtattttgttccatagtactgtatagtgttaagtctccagatgtttttgacttaggtagagacaaagcttaaggttaagggttgaaaacaatacaggtggtaaagactattgagggaatccagga

SEQ ID NO: 189996 - DNA, 246 bp, Homo sapiens
aaggccatgggaaatgtgtgcacaaaagtcgatcatcactctgcattaagagaaggattctgtaagtttcggttaaaactgaatcacagggacagttctcacaatgacagcactagaacaccaagctaataaagaatcccaatctaaggaagattttgaaactgtccagtatttatgtgcttgaggcttatttctccttcacagtaaaatctaaaactcccctggaagtatttataatgcactgtg

SEQ ID NO: 189997 - DNA, 554 bp, Homo sapiens
aattatattagcatagtcagaggttttcttcaacataaatttgttcatttaacaaatatttatgagtacccaagtatcagactctgttcttaggtactggagatacagcagggaacaaaggaagcagagtccattctctcaaggaacttacattctagtgggaggagacgtttcatagtggtgttataaagaaaaacaagcaaaatggggtaggaatgggttctattttacacaaggcaacctgagacatcctctcttctgacattcaatcagaaacccaaagaaggtaaaggagaaagaaggtcatgagagaatagtagtacagggcacaagcaaaggcccttcggcaggacaaggttaggggagttccaggaatagctagcaggccagtgtggttgaagctaaaccaggaaagaaagaaaaaaagaaaggtagaaaataagatcaaaggtagcaaggagcagatcatgggtctgatgaacagttatatgctttctacagagagcttacagttctacaaacttagggcatgagtcaaatgatgctaatgacac

SEQ ID NO: 189998 - DNA, 381 bp, Homo sapiens
tgcaggggctgcctccttttccttcattcccttctgctttcttctgcctgctcagattgccaactgtgtgccccactccagtttttaaaaacagtttttcttttgaagtattaggtattcagttattgactgaaggaaaaggagacgtgaatcctgaaaggaaagtataatcatttgaaaagacaagtattatgtgcatgaaataattgccaaaactgctattgccccacatataccagtctcctatccctctggccattgaagtcccttcttcgctcacagatatttactaaacatctcctctgtgctggcccaggatatacaaagagcccaagaacctgcaacttaacagtctctgtgggaaattcttaagtcatagga

SEQ ID NO: 189999 - DNA, 304 bp, Homo sapiens
gtctttggctccagccaaacttcaaagtccagctcacattcatcctctgtaccctccttgactctggcattccccacaaacactgaatacaaacgctgacctaaggcattacttcatctaggaaattatccctatcctttaggctaatttagatacctgctctagatgctcacataaaatctcttctatatcaatcacactcatttataggtctctccagcggactattaagtctccagagaaacagtacttagtagtccctgcaccagacaaagagcattcaacaactgcagtttcagggaat

SEQ ID NO: 190000 - DNA, 417 bp, Homo sapiens
cagtgagactatgactcacattctccagcccctctgcctcttgggctctggctttctcacatacttttcctctaaactacaaggagccacctcttcaagttccatgtcaaaacttaaacaggccttcatgagtaaacaccagttcagcaacttccagatttcagggcttttctatatctttgaagtcttgatctctacctcaagcttcttatcaaagtacgttcccaataaagatcattctcccctgattgcaggttgtgctatttaacataaaaagtgttctcctaccttttcacacatccacgatgtgtatcctcagatcagattcctaagcagaaatgaaattactatataagtacagttgatctttgaataactcaggggttaggtggattgaccttcccaccccagcaggca

SEQ ID NO: 190001 - DNA, 384 bp, Homo sapiens
tatgccaccctgacaccatccggtctatcaccaatgcctcaggtacccatgcagagcttgtggtggtgggtgccagaccaagcttctgtgtggtctctgcagtacccaggtccctccttgagtactcgtgcccctcattgagacttccatctcaatgtcttctccctccattgccatctgctccctgtcttggtgttctgggcaccactggggctccaagaggcctcaattcagggccctttctggaaggaacccccatgcttaaggacacgggtctagacagagacatttccagcctcatagggtcaggaatgggcaagagagatatgggtatgacaacacagagaactgggtgtctgctggggcaggctggaatgtttcctg

SEQ ID NO: 190002 - DNA, 473 bp, Homo sapiens
ggttaatgatcaatcgttaaaatgttccaataaaaccagcagctattgatacacatggtttatgtgttctgggttttgatgtatattgtgaatgtcatatagtcgtaagtaatttgtgctgtagctctgatcgttattacttcactatgaggcccaaggagattgctgtgtgtcaaatgtattctgtggtattaaaataaatcataagactaaataataacaaaagtttaaaatctgagacaggtaagtacatagagacagcactaaggttctttgaattactttgactaattctgagtctgaacagctccttctccacagaggtgtaagtgcacactactataatctttgtgaagttggtaagataggttggggttaccaaaataccagaaacgagatgtctcaaatttttaaaaggcacagatttttaaaaagctgtatcagcaaattagatgtgatcgcccagcggaagt

SEQ ID NO: 190003 - DNA, 1246 bp, Homo sapiens
tatggtggctcatgcctgtaatcctagcagtttgggaggtggaggcgggcagattacttgagctcaggagttcagaccagcatgggcaacatggtgagaccccgtctctacaaaaaatacaaaaattagctgggcatggtggcatgcgcctgtaggcccagctacttggggagctgaggctggagaatggcttgaatctgggaggttgaagctgcagtgagccaagtttgtgccactgcactccagcctgggtgacagagtgaggctgtcaaaaaaaaaaatagtacattactgtattattttatggtttatgaaacattcatgagtaatactgcatttgatcctcaacaactctaacaacagtatgtcatcattctcactgaggaggcaaggaggttggaaagcttcagaaggaaagtacacattttgctttaaaaaagtcattgtagtgatggcattacggatgatactcattttcttctttatacttttctatattttaaacattggtaagaacgtcaaaaagacatatttgaactcagccaatcttataaatacaaatcagtacactatctcaagtttgttaatttcaagagcagtaggagaaaacaacagataacatatgttatatatctcatcctatccctcaattcaagattccagaggaattcctgcattttgctattgtattgagaagcttgtggataacttagaagcatcagccacaaatatgttggcacaatgtagtaataggattccacattctaactgcaactttaaaacacaaggtaacaaacagctggatgcaacatacataccttttggcgcataaaaactaagtaaaaatagattatatatatagtccttattttattgataccctttcagttctattaactgagaacttagaaagtccctgaatttagtataaagtaactttgaaaaatatattctaatgtgaggataaattttagaatacacagataattataatttcattttacccagcattttccatttcctttccagaagctttcaccaaaaattgctactaaatagacaaaacatgtttcctttcatctttttcccttcctacaaggcaaagaaaaaggaaacaggtagaggcaatccaccacttcggcaatcagttcactgtatatttttaaaataaagttacttagtgaaatgctgggccaggcacagtggctcatgcctataatcccagcacttgggaggccaagatggg

SEQ ID NO: 190004 - DNA, 659 bp, Homo sapiens
tgaaacttgatatctatctgggatggccatttgatttctaagaggaattttgtatactccacagaactcctgtctatagtaaaattgattttcagttttaaatgtgggcaaaaagacattttctccaagatttcaaaactaattcttatttttaaatggtttaccaaaatttgtcagtacattttacatgtagaagcattttaaaaataatttctagcaagcacttgacaagctcccctctttgaataaaataatttctcataattaagcagcagaagatctatctttacaaagtatgagggatgccagatgttgataaacttactctttcttaatctggacaaagtaaacttaacagatttttctgatgagcatgttttatgaatcttccattgtgctccattctatcacatgtgcatttttcatgttaaactgcaattacttaatctcttcccctatccttctaaattaattttctgaagttggagtgtagtcttttcccccttaggctacgcattaatcaaagctttcttttcaccatgattttataacgtctagtacataatatttctacttcccacatctttgctttacacagtcaccttgcccttcctcccaccacctaacaaaaaaagatgtgggaagtataaagcgtggag

SEQ ID NO: 190005 - DNA, 246 bp, Homo sapiens
caacgctttatacttcctcaacgctttatacttctcaacgctttatccttctaaattaattttctgaagttggagtgtagtcttttcccccttaggctacgcattaatcaaagctttcttttcaccatgattttataacgtctagtacataatatttctacttcccacatctttgctttacacagtcaccttgcccttcctcccaccacctaacaaaaaaagatgtgggaagtataaagcgtggag

SEQ ID NO: 190006 - DNA, 510 bp, Homo sapiens
aaccatataatttattatttgaaacatcaatatttatgataatttaataatcaactgttcacacagtttgattcaaaatggaaagagtctaaaactagccatgtagcacaatgtggtcaggacaaatcttctaagaaatggctttggtaaatgtggtgaacttcttatcatagcctataattaaacgactctcaaagccagtctggaaaatgtattcagaaactgcagtaacatgctgtgaaggactctcctctttccccctcctcactctttctttctgctttattaccacgtttcccttcctctctttaaaaagagtgtaaccagataatctcaacaatgttcaaaacctgataaaggtgaaaagtatttatcacttaatccctttttggatctgacttttttcccttttttttttgtagatacagagttttgctatgttgcccaggctggcattgaagtcctgggctcaagcaatccttccacctcaacctcccgaagtgttgggat

SEQ ID NO: 190007 - DNA, 575 bp, Homo sapiens
tcacctgtaacaggaaccctactaaaatggcttaaccaaataaggatttgtttttcttttaaggggaggcatgtgagggctagttcagcagccccacaattctatcagagacctaattttctctctcttgttcatcatccttaccatgtagcttttttccttatagtcataagatggatgctttacctccatgcatttttctgcattctaagcagaaagaataaagaaggggcaaaggtgtgtgtgatctgagtttgtccctttttataggaaaataatagcttgcccagggcctcacctggtaaggttttgcatacaaattattgggtaaactacgtcacacagccttaactgtaaaagaatctggggaagtgagaaattttaactgggcacgtagttgtcccagacaaatccaggtaaggaaaaaaggggaaacggatattggtaaagaaccagtgtttattcagtttgtgtttccagttcttataagtatcccctgagacaaactagtgtgtacaactaccttgtatttaaattccatgtactactgttgtaaaataaagattctaaataat

SEQ ID NO: 190008 - DNA, 776 bp, Homo sapiens
ggttgccgctggtactgtggggattgtgaggccagtgctctgcagcatgtatagctgggctgacccaggttcctaaagtcccacgccagacgccctggagcagcattattcatcccctgtgcctctgggaggttgcccacagtgacctccgtcaatcctctactagaccacaagtgcccatgacgatttgtggaagccggggtcctgctgccaccatggcatgatgcacacttgggcttggacccagcaggggactaatgcactgagcagcaggaggccatgataatgtcttcctggccaacggaagtacacgcagtcagcgccttggaggctgaactggtggggcaaggccctgggtgccagcagccatcttgaagcattcttgcctcaagccaaaagtgcttctgggaatgtggtggccggcactgacggcgaatgagctggagcatttgtttgcaagttcctcggccttggcttccgggatggtcgtcctgttcaactctctttttcacttttctattgagcttccagcagtccccctctatcacagtttcgctttcggaggtttcagttacttgcagtcaaccccggtgtgacaactagtgattccataaatggtcattatagacgaaactgcgaatgaacaaagctgccatcataattacggccaggttgcactgatcacatctaagtgtcttaggctgatactgacccacattgtctggtctctctgggtattgcgacgactcaacccgctggggggcaaggcactaccg

SEQ ID NO: 190009 - DNA, 166 bp, Homo sapiens
cttccgggagccgcaagtccaggctcccccgcagcgggacccgagcctgaggcgcagggctgaggcagcgcacgtgtgagcgccgctgaggaagctgcgagaggtcgggcgggtgtcgctccgggggcagcccaggctcgcgcggacgagaggaaggtccgggacg

SEQ ID NO: 190010 - DNA, 643 bp, Homo sapiens
agggaaaatgcctgctcatgcaacttatcccaagggaaggtttagaagcaggggtaactgcagagaaaaatttcacaaactgtggcatttttgccattggcaaaataagccacccaactcaacgatttaaatgattagaataagcacaattgaggcttcaatgtgggaccatttgtcttcctgccagaaaatgaacaaatggcagattcagttactaccattttaatgacagccatattgtttccttttatttgaagcgtttgaatgtttggagtcccaagcttaaattaccctaatcatgatagagcaaataagcacattttagtgatattgacacttcccacaaccatagccctcagcaatttcaatagccagatctgaagagtgagagccaaactttaaaaacttcattaactacagagcacaatcaagttgaaattcctaagtgttaaggcttgatatctttacttccttgagagatcatttgattatttcaactggcttcttggtgtgtccgatgagatcatattttacttgcctttatggaagtggctgagggattcaaggttatagcattccaaatgaaacctggaagggaattcaccagctgctgaattataaggagagtgataggatttgggat

SEQ ID NO: 190011 - DNA, 408 bp, Homo sapiens
agtattcttaaataaacttaaattttaatcatttttgtgtatacttaagatgatttcaaaataaaggttttatgatttaatgtgctattacatttcaaagagttaaagacttacgccattctacaatattcattttaactggtatacttgaggtttatgaactgtgaggttttgtgtgtctttctaatccctgttaatccatttggcttttcaaactggaacaagattcttcaatattctaaatcctattttaagattccttagccagttcagctcatgtaaagaaatcatccaaaaggaatattaacaatgtaatatttatattgtgtttgtttttacacactgtgcttttgtggttttactttatatgcttagggtgtgctttcagcaggggatactctagagctg

SEQ ID NO: 190012 - DNA, 500 bp, Homo sapiens
tgttcacttcacaacttctgtgaataagacacttgtacaaaaaatatcattttcaaaaggaccccttattaagtacaatcagtattaaaggtgacttagtccacctgcagtctgattcggatgctttctacactacttatctgtgctctcatcttcatttaaaggaaaaagacaagatctggggatgatgttcaagccacaatgactgttaagccacacagcattactttttatttttctaaaagtaaaacaagtagacattattccaaccttttagagaactcagattgacaactacatctcgttgacaaaaggaaaatctcaactccattaatttcccagaaccctggacaaccagtgacatcatttttaatgttttcattataatattcttttctatacaatattgtaccaatgaacctcattctgtctttagtctccagccttatccagcaatcaatgcaggtatataagcagagttgcttcatcaatctgaagtg

SEQ ID NO: 190013 - DNA, 396 bp, Homo sapiens
ttatgaatgaagcctaacctccttcaagctatagggaactttttagatacttttccctggatttggagtgagcatggactgaacaaacttatttcaagacagcaccatattttcggtaccagctgagggcagcaaggagacatagtccttatttttacaaattttagttagggctttagtaagaaagaaataacagagtacctttcttgtcattctgctaagcacaagttttcctaaatctagtgttgccatgagtgccgttttgtttgtgaggacagccaagtgaagctcatctcccactgggaactggagaaggcagatcactgacagaatctaaggaaattagattatgggatgattggaaataaaacgtaataaaggaatgcctgtgtaaac

SEQ ID NO: 190014 - DNA, 394 bp, Homo sapiens
acaatggaactctcaaaggatccaatccttcctgccagacatcaggtctcttgtcacaatggatgcactccacttccagtcatgaaggccataagcagcacagatcacaaactttacctataattcgaggcaaaaatgcactttctaaccccaaactcttacagatgttagacaataccatgaccagcaactccaatgaaatagacatcgtgcatcatgtagacactgaggccaatatagctacggaggtttgcctcactattctggacctgttatccctcttcacacagactcatcagagacaactccaacaatgtgactgtcaaaattcattgatgaaaagggtctttgatacctacatgctctttttccaagtcaatcagtcagccacagc

SEQ ID NO: 190015 - DNA, 113 bp, Homo sapiens
aaaaagaatacagtacattatttttttctatttggtctatgaattaagggaaaggtgatgtgttaaaacataagaaatgttattaactatactctacccatgggagaagcaaa

SEQ ID NO: 190016 - DNA, 357 bp, Homo sapiens
ataattttaaaaaaaagatggctattacaaaaaagacaacagatgacaagtattggcaaggatatggggaaaagggaatccttgtatactgttagtgagaatgtatattggtacagctattatggaaaatatggaattttctgaaaaaattaaaaaatagaactgccatatgacccagccatctcacttctgagtatatctaaaggaaatgaaaccagtgtccaagagatatttgcacttccgtcttcattgcagcatgattcacaatagtcaagatgtggaaacaatttaaatgtccaacagatgcatagataaattatgacatataaatacaatgtagtatttttcagccttaac

SEQ ID NO: 190017 - DNA, 386 bp, Homo sapiens
  misc_feature (264)..(264): n is a, c, g, or t
gggggccctgcggagtaatctctgtgggtgggggcctggcccagactggcttcctgagactggctagatagcagttctagagatggagaatgaagagaagccagagttgagttgtgtttagggagtaaagggggcctcagtgctggctgggaagtttggatttgactccctgggagcctgcaaatcatgtggcctggaaagctagaaaaatgcccatgatggggccctaccccagaccaatcaagggggagccagtaatttttnagaagtgcccccagttaattctcatagtctgtgtgggttgagaagctgagctgtgtgcttggaggagcctctgggagtgtcagggattggaaggggaaaattgaagccagaagaagcctttg

SEQ ID NO: 190018 - DNA, 157 bp, Homo sapiens
ttgacggggccatcgaatgcacagatatttcgttgaaaattatttctggttccaacacagagatgagaaatgtttgagatgatcgatatgctaattactctgatccggtcactgtatattatatgtactgatatatcactatgtaccccatgaatat

SEQ ID NO: 190019 - DNA, 297 bp, Homo sapiens
taagatcccagacctctgaagaggacacaggtttccactaaagcaaggttgatactttcaaggaatatttttcctaacagctaaaacggtttaacacatagcatcttgtatcaattacacaaacaccattaaagccactctggttccctgggaaaggaccgcaactgaaatcccttctggcttcagctgtcccctcctgccgagtttgacagcacatccaaggcgcccaaacaccagccactaggctcccccccagcgccctcctctcgcagcaaaccgccaaggctcccgggccaa

SEQ ID NO: 190020 - DNA, 317 bp, Homo sapiens
gctctcttcctctgtgagcctcaggccctaccagggctgtgcagcatcaagggccccagacttgggagtgacaagaccagggcccaaatcctggatccgcattcactcactcggttcccctatctgtaagacagagacgctgggtcttttaccttctcccagaacccagtcaaggataaacaggggaactaactaaaggcacttgctgaactacacaatttcttgcttttcctttttttagagacagggtctcaccccatcacccaggctggagtgtagtggtgcgatcatggctcactgcagcctccaactcctca

SEQ ID NO: 190021 - DNA, 256 bp, Homo sapiens
tgaatgtacaaagactattaaatttacactttaaagtggagaatattatggtacgtgaattatctctcaataaaaagaggggggatgttccaaagcaaaatattcattaccagagacacagtcacgacctcagagatagaataaagaggcgacgggtgaggggtggggtgcaataggggtgaagggtggggtgcgatagaggtgaggggtggggtgctgtggcccagggcctccccttcccactccatgtacccag

SEQ ID NO: 190022 - DNA, 520 bp, Homo sapiens
tgttcctgctctgcattccaccatgattggaagcttcctgaggcacccccaagaagcagaagccactatgcttcctgtacagcctgctgaactatgaaccaattaaacctcttttctttataaattacccagtctcaggtgtttgtttatagcaatgcaaggatgaactaatacaccagacatcatagtatagagtggagtgtcgatgccacatatgctttgtcaggtgctaattcaatcttcagactattaaacaaataaatgcatgcagtagagtgtgactctttgaaaagaatatggcatatggcaagttatggaatatatcactttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgg

SEQ ID NO: 190023 - DNA, 183 bp, Homo sapiens
tttaaaaggatatagaagttagcttgaaggagctttttttcctgttgagatagggccgcactctattgcccaggctggagtacactggcaaaatcagggcccactacagccttgacctcccgggctcaagcgatcctcccacctcagtctccagagtagctgtgactacaggtgaatgccacc

SEQ ID NO: 190024 - DNA, 309 bp, Homo sapiens
gccttgataagggacatttatccaatgttatccaaattaaagataactatagggaatctctttctaaattgtagaatagtctcatcaagatgtgtgataaaatgttaaggacatgctatttataaccagtacctcacaagggttttgatgtggatcataattaaaattcacttggggttgcatgaacctaagtaatatgctcattatttgtacagagaataacactattgtccaacaccaaaggaagacaaaatattgtcagataatatcaattttcatgacaacagcacttgtatctgatcatcacat

SEQ ID NO: 190025 - DNA, 563 bp, Homo sapiens
ttgagcaatttaattgtctttaaaattacagctttcaaagccccatctgaagccaaataagaatctgccaggaataaagcccaggaatctgatttttttttaaagactagtcttttagagcagtttaagattcacagcaaaattgagtggaagatacagagattttgcacataccccttagcctaacacatgcatagcctcctccattatcaaggtcccccacagagtggtatattggttacaatcagtgaatctacattgacacgttatcatcaccaagagtccatagttcacattagggttcagtcttggtgttgtacattctctaggaattctacatatataataacatgtatccaccattatagtatcataaagaatattttcacagccctgaacatcctgcttgttccatctgtaagaacttgattttaatacagctctcaggtcatgtcgatgagtagccaagtttggaaatcactggtctagacacagccccagctatgttggcagtgagatacaaaaggggtagtgttgatgaaacaaggctttttggcataagt

SEQ ID NO: 190026 - DNA, 385 bp, Homo sapiens
tgcagtaggtttcaagcatgaattaggggaaggggccaacagggtaacgtggtaatgaaggagatggcaaagtgaaaagcaagttgctttaaccctgaaagaaagtatttctctagcaaacagcaatgctttgaaagcaattgacagaaagctggcttaatccttgttctggagatacttacagctgcccgtggtttttaattaatacactgggctccctaacaaaggggaggaggttggagagcattaacagatttactcacccaagccaaggaaagtgctttggaagaaatgccctggccgcccatgggccgggatcttcctagccctcccttccctgcatggcaaggcacgaaggtggtctgatgtggattccagggtgaag

SEQ ID NO: 190027 - DNA, 207 bp, Homo sapiens
aatatggtgaacagattggaagagagtgaaactggatatatcggtagatgaaacaagtagctaagtaatgtaacttcctagaaactccaaaggctggggaaacagaaggtactcatggtgaggatgcaggagtagctgaaaaacttctttctataaatgttcagtataagaaaagaacaaataatgcatggtgttatatgcactgcg

SEQ ID NO: 190028 - DNA, 213 bp, Homo sapiens
gaaaatgcaaatcaaaacaataacatgacagttttcatatatcatattggcaaatatctaaaaaatgagaatgcccaatattggcatgggcacagggaacccaatattctcttccattactggtggaatttttaataacatgggaaaacagttgtgatatgtttttggtttttggttttttttttttttttgagacagtctcactctgtcacc

SEQ ID NO: 190029 - DNA, 1108 bp, Homo sapiens
ctggagtggtaagatggcggacgagcagctgcagcagctccgtgcggtgctacagggggaggggaaggtggtttctcctgacacaagctggaggccggagcctgtggcaccctggcttgcctcactgaagctggtggctgtgacagggactgcacggctgctggagtggtagaaaggcagcccaggtaggaagccatcattctgtagaaggcagtgacggaacagtaccagcagaaattgaaggaccagcagaagggatcatggccaaagttgcagtgtccccccgctcgttgaagatgaggagttctcagagagcgggatgtttgtgacattcctcatgtcagctctcgagtccatgactctcactcggtcgtccaggctggagtgcagtggcaccatcttggctcattgcaacatctggctcccaggttcaatcgattcttctgcctcagccttctgagtagctggaattaacaggtgtatgccaacttatctggctaattttgttgtgtatttttctttcagtacagactgggtttcaccatgttggccatgctggtcttgagctcctcacctcaggtgatccacatgcctcagcctcctaaagtgctgggattataggcgtcagccaccgcttctggcctagatcattaacatatcactatgatactaaaattccctctgccaaagaaaatcttgccattttgtgacatgagttgtataaagatgtatgtttatatgcactgaacctgtgcacctagagttccaccctgctcatgctaacgttgttctccctccccgtacctagttcttaaaaactccatgccttccatttttcagggaaagggtgtctttagagcaagaactcttttcttctccatcccaggcagggaaaaaacccacttggccttgtttctgattgggttttcttgctttgcgactaatacaaagcaggaaaaaactccctttatcagtgataaaaacaagtaagattattatttacccacctattctagctaggggtcatgggtggccggagtctctcctagcaactcagggcgctaggcagaaccagccctggatctggaatagggtgccatcatatggc

SEQ ID NO: 190030 - DNA, 335 bp, Homo sapiens
tctgaattataacaactggcctcatgcagaattctatccttacctacaacaaagttgtcttctaaaaatcaggtaaccatgtaatttattgacccattcaaatcacaacttagcaagaaaggggaagctattacacgtggtcaacccatctgaaatggaagtcagatcatgtccttcttttgctcaaaacctgccaatggcttctgagctcgagtaaaagccaaggtcttctgatggctcccaagacctgccagatctgtgaaggcatacctacctcacctcttgtcactttccccttagtgggtctgtctcagctcttctatacttgctatgct

SEQ ID NO: 190031 - DNA, 480 bp, Homo sapiens
cggccaggaggttacacttttcctttaccaatggtcagatatttaaatatttcacacatactttattcttacttaaaacctcattctatggcctggcacagtggctcttagctaattttctatgtcattttaaatgagaagcattcagacagtatcttcttaccactaaatctaatgttctataataagtaaatgattaaatgaaccctaatttttttaaagttctcctttgacccctcatctccctccagctacctgctatttccctgctcaccacttcagggtaaattatcttgaaaaagttgttgtctatatctgtctcaatttcttcacttctcattttcttcaatctactcaaaacaaagtttccaagccctccactccattaaatcaacttatcaaggtctactacttccacatttatctgacctcttagcaggattcaacaaagctgacaatcttcttaaaacattctcttct

SEQ ID NO: 190032 - DNA, 869 bp, Homo sapiens
ccggtggttctcaaccctggatccagtctaggaggggcttttcaacgttacaggcgcgcggttcccattccagaccaacagaatcagaatatctattagtggggctgggcctccgtgtcttttccgcagcgtcccaggtgattgcgaagtggagttcaggttaagaatcgcggctcgccgggcgtggtggctcacgcctgtaatcccagcactttgggattacaccgaggcgggtggatcacttgaggtcaggtgttcgagaccagccttactaacatggcgaaaccccgtctctactaaaaatataaaaaattagccaggcgcggtggcaggtgcctgtagtcccagctacctgggaggctgaggcatgagaattgctttaacccgggggcagaggttgcagtagccaagattgtgccactgcactccagtctgggccaacagagcgagagactctgtcttaaaaaaaaagaaagaaagaaagaaccgcggctggattatatcaccgagcatttcccatacattcctgggggacacgaaggcaaagggtagatggactacaagccccaggatccactgggctccgcctccgcgagaaagttcaaagacaacgcccaggcgtgtctgggggccatttcaaaatgaagaaattcagatctcaagcctttcttggacacctttagaggcaataattccttggggcccactcagagaggaacataagactcttaggggacccccgggatgctaacggctacggctggagagtccctggaagagcgatcggcctcacctgcggtccatcccgcggctccctccgcgcttccggccgctctgctccttcacccaacaggccccgcgcgcatctc

SEQ ID NO: 190033 - DNA, 996 bp, Homo sapiens
ccggtggttctcaaccctggatccagtctaggaggggcttttcaacgttacaggcgcgcggttcccattccagaccaacagaatcagaatatctattagtggggctgggcctccgtgtcttttccgcagcgtcccaggtgattgcgaagtggagttcaggttaagaatcgcggctcgccgggcgtggtggctcacgcctgtaatcccagcactttgggattacaccgaggcgggtggatcacttgaggtcaggtgttcgagaccagccttactaacatggcgaaaccccgtctctactaaaaatataaaaaattagccaggcgcggtggcaggtgcctgtagtcccagctacctgggaggctgaggcatgagaattgctttaacccgggggcagaggttgcagtagccaagattgtgccactgcactccagtctgggccaacagagcgagagactctgtcttaaaaaaaaagaaagaaagaaagaaccgcggctggattatatcaccgagcatttcccatacattcctgggggacacgaaggcaaagggtagatggactacaagccccaggatccactgggctccgcctccgcgagaaagttcaaagacaacgcccaggcgtgtctgggggccatttcaaaatgaagaaattcagatctcaagcctttcttggacacctttagaggcaataattccttggggcccactcagagaggaacataagactcttaggggacccccgggatgctaacggctacggctggagaggccaacggctgtggagcatgttgggaattgtagttccagtgcggtggagccctagcgactccagaccgtatccagcccgtcctaggctgtgctgctctcgccgttggtcctccccagcctcctgtagtccctggaagagcgatcggcctcacctgcggtccatcccgcggctccctccgcgcttccggccgctctgctccttcacccaacaggccccgcgcgcatctc

SEQ ID NO: 190034 - DNA, 421 bp, Homo sapiens
ggggagggggtggacattttcatttatatatagtacttgtgctttcaagaaaatcacaaagttgcatagtaggcagttgtgaaattcagtccctgaagtaaaatatcacacatagtccaaagaagcctagaaaagtcctactgaagcaaccagaaagtacacacatgtaatgaatatgagtgtgtgtgtgtgtgtgtgtataaaatttatattccaactttggaaatgataaccatttctcagctgaacactggatactattgtcagttcatatggaaggatgacactgtgaaaaacatgtctctctaaaccctagatgcactcagtgtgacatgcccgcatgacgagggccactcaggaactgaatcttcacactgtgctcatgtcagggctgtggatgcaacagtctgcattattgcaa

SEQ ID NO: 190035 - DNA, 285 bp, Homo sapiens
gcatgttaagaggaggatgaagtgaccactgaatttaacaatgtggaaaatatctggtgaacttgactagaaagtttctgtagagcagtgaaataaaaaggcacctggcttaagaaccgtggagccagaaattaagacttttaaattaaactgatcactgaattcaaaagggtaactgagccacttttactacatgttgcttcaaatcttaaagcgtgggcattaaactctctgtgcctgagtccccatctgtaagaagggggttatatcgctacctgtctacct

SEQ ID NO: 190036 - DNA, 518 bp, Homo sapiens
gtctcgatcttttgaccttgtgatccgcccgccttggccttccaaagtgctgggattacaggtgtgagccactgcgcctggccagaagagtcatcttatatatctttgtaatattttaatttgtttttgtaatatttaaaggttgttctcgaattgagttttttctttgttatgtttttatttcttttttttttcattttattagccaggagatattctcatctgataatctagttttttattgtgtatatgcagttcaattatctcttaatttagggattcttagatcttaaaagcataaatgttataaatctttttttaaattatggaaagaggatctattaaagaggcccttttctatctgctaggaataataataagaataatataaaaaggtgactagtaaggtctaataggttaaacagccctataaataagcaccgtaactacaacacaacaaatatagaatggagcaaaatatgctgcaggagcagagggaaacacttgtgtagtgtgga

SEQ ID NO: 190037 - DNA, 236 bp, Homo sapiens
tctggctgtcttatgtataaccagaaggggtttcttctcaaagccacaggcaagcagaaggcactgtgcagagggctcagaggtacacggcacagggcggctccgtgagccccggaggccaggaccactgtcctgacagcaagggagggagagacgccacagggcgggcctcaggggctttgcagggtgggcttgtgccagagtagggtatgctcagggagggtgctgagggattt

SEQ ID NO: 190038 - DNA, 319 bp, Homo sapiens
tgttagggggagcccagcagaggggagttgaggaaaggctttaggaacccacatctgtcctgagcagagaggaaggaccctcaggcagatgccgggccaggagaacattgacccagggacccaggaaagggactgaggacccaaggaaggaaacagaccacgagggtttgcctgagaggaagggtcaagtccccagaggcaaagcagggccacgtgtgcaggacacggaggggaccgcaagtgtcttggattctcctggaactcagtgtccctgctgtggccagaccctgcactcagggctggtgatgctgaaatagga

SEQ ID NO: 190039 - DNA, 273 bp, Homo sapiens
agcacaatcattatcaagtgttgctttagtgcctcactgtgaaggcaaatgtacctaccaaagatgaattgggtgttaaatgtaagttcagagattaaaggactgagttcagttttcacagtgacacagaagttgctttacttttaggagcaaatgtgacataagagttatcatcacaagcaaatctgggtctgaagagggtgacaaagtagaatctagttattgaacaaaaaaaccagttaatgatgcccatgaaaaccactgtctgttgga

SEQ ID NO: 190040 - DNA, 560 bp, Homo sapiens
atataaaaagctgagtgctgatagctttttctttttatttgatacagagtctcgctctgtcgcccaggctggagtgcagtggcgtgatcttggctcactgcaggctccgcctcccaggttcatgccattctcctgcctcaacctccggagtagctgggactacaggcacccgccaccacacctggctaattttttgtatttttagtagagacagggtttcaccgtgttagccaggatggtctcgatctcctgaccttgtgatccgcctgccttggcctcccaggctgatagctttttctactccttcgtggcatagctggtttcattaattcctaggaaagggcttcagaaaataagtagggaagagattgttgagagatgggaaatgcatcattttcttgtctatacttgggggcatggtggctattaatgagccaaagggtaacgacgctctgaggtgactcagcactgacgggaagagaaaatcatctgagagtcatcttggcccagagtcagactctagttcccatattatacattttagaaagaaatgaaaagag

SEQ ID NO: 190041 - DNA, 204 bp, Homo sapiens
caggagaatggcgtgaacctgggaggcagagcttgcagtgagccgagatcacgctactgcactccagcctgggtgacagagcgagactccatctcaacaacaacaacaacaaaaaaaaggaattttaaaaaagacaaacagtttaaaaaatatgaaacaaaacaaacaaaacaaatgtatttacaaaaacaggcagctgaccca

SEQ ID NO: 190042 - DNA, 394 bp, Homo sapiens
ctgcccccctccttctccctttcacacacgtctccccaatagcaagacctccacaaagttggggaagggaatgggtgacctttctatgataggagaagagttctgatttcttcatttttgagacaaaaaaagtgttgaattaagtcaaggaaatactcaagagaagcaaattcatcatcaaattggaacatcactggaacacgggagagaagttgggtggagggagggggtctgggcaggaggtgggaaagagcatctctgagcaggggtgacagactggggactccagtccaaagacctaactctgaattttagtcctgctacaacccttagtgttgttacgaataagaattctaaagtcagagccctaggttttgttcctggccctgccacc

SEQ ID NO: 190043 - DNA, 361 bp, Homo sapiens
caatagtcccttaaactattgtcttgtatccctttgcttactgcatttgccaaattattggccagaaaacactagctcctcaagatattactaagtattgtgtgaaaaatcagtggtttagtaagttgggcaaatgcaggcttaaacagaggaaaatggggctctttcctgtgattaatctccaggaaggactgtactaggcagtgtttccccaaaagatagagcgtgggagccttatttgagaaacctatgtcaacatccaggttgggaaatgttggagtacttgctgctgcttcaaatcacttctctttcactagcccgaaaggaagcgtgcatctgcttttcagtgtggtagtgtggc

SEQ ID NO: 190044 - DNA, 915 bp, Homo sapiens
  misc_feature (705)..(705): n is a, c, g, or t
  misc_feature (755)..(755): n is a, c, g, or t
  misc_feature (769)..(769): n is a, c, g, or t
  misc_feature (802)..(802): n is a, c, g, or t
  misc_feature (806)..(806): n is a, c, g, or t
  misc_feature (850)..(850): n is a, c, g, or t
ttgcctatgctggtcttgaactcctggcctcaagcaatccttctgcttggccttccagagtgctgaaattacagaattcatcctctgaatcctttatcagaaccacttcccacagacttggtgttatggtaaactgaggaacagagatactgatatgggaacacaggaagatattcattttaagaatcagtgccgcggtcccttgcttccctcacctactcttatcccaagtggcggtggcggcagcgcagagcagcttctgaaggtccaggagctcttttgttcctcctctgcaaagcaaaggtgccacagggcgcggctttccgagaaagcgtactccgcacggtgcacctctccgtctgcaggcgctgagcccccggaggaggagggggcaggctcgcggagcccctaccctggggcggggccaaggcgtcctcccagcccggctttgcagagcagagatctggtgtctccagtttacggaggcactttcagaactgatcagaagccaccccgcttatcagcagatctcaggagagtgttcagtggaggccctgccggtctgcacagctcacctccctgggaactgctcgcctgagcgtcggagccggccctggccccctgcagccagaaagttgcagccgcaggagccccggaggcccaggacgcagggggaggaaccggagagaagagtgtggctcctangaaatctagcacggagaaagactgtcttgaactcctgacctcggataccnagcattggaggcgnggcaagcggatatgagtcggacctcgaacatcnggtnaccgggaacccgtctctataaatacaaaaaaaaaaccgggcctnccgcgggaaaggagagggcggcatgggcgagcacttggaaagggaagcggccaagggaacaacgc

SEQ ID NO: 190045 - DNA, 768 bp, Homo sapiens
  misc_feature (558)..(558): n is a, c, g, or t
  misc_feature (608)..(608): n is a, c, g, or t
  misc_feature (622)..(622): n is a, c, g, or t
  misc_feature (655)..(655): n is a, c, g, or t
  misc_feature (659)..(659): n is a, c, g, or t
  misc_feature (703)..(703): n is a, c, g, or t
atgatggtcaggcttcgctcgaactcccaatgctcagaatcagtgccgcggtcccttgcttccctcacctactcttatcccaagtggcggtggcggcagcgcagagcagcttctgaaggtccaggagctcttttgttcctcctctgcaaagcaaaggtgccacagggcgcggctttccgagaaagcgtactccgcacggtgcacctctccgtctgcaggcgctgagcccccggaggaggagggggcaggctcgcggagcccctaccctggggcggggccaaggcgtcctcccagcccggctttgcagagcagagatctggtgtctccagtttacggaggcactttcagaactgatcagaagccaccccgcttatcagcagatctcaggagagtgttcagtggaggccctgccggtctgcacagctcacctccctgggaactgctcgcctgagcgtcggagccggccctggccccctgcagccagaaagttgcagccgcaggagccccggaggcccaggacgcagggggaggaaccggagagaagagtgtggctcctangaaatctagcacggagaaagactgtcttgaactcctgacctcggataccnagcattggaggcgnggcaagcggatatgagtcggacctcgaacatcnggtnaccgggaacccgtctctataaatacaaaaaaaaaaccgggcctnccgcgggaaaggagagggcggcatgggcgagcacttggaaagggaagcggccaagggaacaacgc

SEQ ID NO: 190046 - DNA, 362 bp, Homo sapiens
taacaattactgttagaagagcctccaaaaagtaaacagacacatgacatctgccaacatatggaaaattttcactaaaatggcttaaaaaatcaatttacttgattgtgaaagctctactgggaaggcaaaagtcactgtattttattctggtatgatttaaatgaaaatggatgaagttttcagactgtaatactgtaatactaatgtttcaaatcaaagagattgtatagtggaaaaggctccaaaataatccaagacttaggccaagttcaaactttgcccaaagccagctgggtgaccttggctagttcctttcactctgaggctctatttcctgacaaaaaaaatgtatagtttcc

SEQ ID NO: 190047 - DNA, 330 bp, Homo sapiens
tttttttttgggagccaaagatttatttcttcatttcttgcatttgaaatactcttcgatgacatccttggcctgagactccttgccatagtccttaactactacacaactgtaaccaaccactttatggggtttcccctctctgtcaattttacagaggctacccattctcctagtttcttgttggcatcaaccttaattaggttgatttggtgttcagcacaaagggcctccaccaacttgacatacataggctcatcacagttggatgcaagcacacaaagatgggcttggcgcttgtctaagactttggcagcttcgcgaattcca

SEQ ID NO: 190048 - DNA, 773 bp, Homo sapiens
catcacattgcactccagaaatacaggcaattattatttgccgattaaaaaaaaactaaacaaagaatgccctgaatacatatacaagtcacagtgcacttattttatctgggaagggagtgaatgaggtgttaagctacaggtaagggcttttgggaataaggcgttaatgatggctattagccaacagaaaactacacagcaggaggatgttggcgtggcaggagcacagtgatgaacaccaaacaaaataattatcgtgtatttcagcatggctagaaaagagacttgaaatgttcccaacacaaagaaatgatgaatgaggatggataccctgaacgccctgatgtggtcattgcacatcgcctgcatgtatcagaatatcacaggtactccgtaaatgtgaaccatcattatgtatccataaaaaagagatggaaacaaggtaagtaacatttagaaaccaagtaaaaagtaccaacgcgttccggtacctgtggtacaaagactcatcagaaattcctggacggtgctaactaaaatagttagtttcagttaaattgttcggttaattagaaagctgattgcaatttgggctgagataaaagctcctttaacagccattcctttcccttggctcatcctcctatcagaggaactaaattaattaggctcctggaacttggacttctagaaattcacaaagaagtattgatgagtgagcactgaagctttgcagaaagagggttcagaagagggggcgtgaatcttct

SEQ ID NO: 190049 - DNA, 121 bp, Homo sapiens
tactttgagaaattgctgcagacaatcaagaagtttgtaacttgcacattagaatcacctgaggatcttttaaaatgaccagtactcaagccagactccagatcgattaaaccagaacctc

SEQ ID NO: 190050 - DNA, 169 bp, Homo sapiens
ctgtcactggaaatgagttagttctgcccccaacatctctactacccccaacatgcctccactcccagctcagtctccttcaaaaaattcaatggtaatggtttccagttaggacgacaggctatttattatcgtacttattatacttaaaacattggtcatctatcat

SEQ ID NO: 190051 - DNA, 658 bp, Homo sapiens
  misc_feature (20)..(20): n is a, c, g, or t
cggccctacttaccacaggnggtgtgtgaatatcctgatggaaccaagtctttgaaactgggagactttgggcttgcgactgtggtagaaggccctttatacacagtctgtggcacacccacttatgtggctccagaaatcattgctgaaactggctatggcctgaaggtggacatttgggcagctggtgtgatcacatacatacttctctgtggattcccaccattccgaagtgagaacaatctccaggaagatctcttcgaccagatcttggctgggaagctggagtttccggccccctactgggataacatcacggactctgccaaggaattaatcagtcaaatgcttcaggtaaatgttgaagctcggtgtaccgcgggacaaatcctgagtcacccctgggtgtcagatgatgcctcccaggagaataacatgcaagctgaggtgacaggtaaactaaaacagcactttaataatgcgctccccaaacagaacagcactaccaccggggtctccgtcatcatgaacacggctctagataaggaggggcagattttctgcagcaagcactgtcaagacagcggcaggcctgggatggagcccatctctccagttcctccctcagtggaggagatcctgtgcctggggaagcagt

SEQ ID NO: 190052 - DNA, 357 bp, Homo sapiens
tgtgtatacagtgcctcctgtgaaggtggagaatggaaagaagtgagagtctgttgcctgcaccatgattttgacctcaggaagcagattttatgcttacctggccagagccctggcctggacttgtgttctaaggccactcttgagagtatggcagtagtcaccaagactgtggttaggttggcagaaacagatgcctttttctaaagtgtgattcattcatctctatgtgaaatgaaatgaataatttaacactaaaataatccttttcctaacaaataaaggcaatactccagtaccatggaagggtcttgggagccatcagttctctccccctcacccactttgttttcctag

SEQ ID NO: 190053 - DNA, 287 bp, Homo sapiens
cccggtgggttcccgaaaccattactctcctgtgaggcttctgttagaagcttggcgttatttctcctcttctgtttctgaggcccgtgcatgctctgttgtgctctctgctcgtggcagctgggacccgagcctgggcccgggtaatgtgttgtctctgctgtttcctcctcagaacacggctctagataaggaggggcagattttctgcagcaagcactgtcaagacagcggcaggcctgggatggagcccatctctccagttcctccctcagtggaggagatcc

SEQ ID NO: 190054 - DNA, 162 bp, Homo sapiens
catcatatctaggtgttcttcaggtttttaagcctctgccatctgaatgaaaggctgaaataaaaactttggccattgatcttcactgtctcacccactggataagagtggccaccactgttctcatcctgaaaattacttatatgtacaaagaatcctgta

SEQ ID NO: 190055 - DNA, 486 bp, Homo sapiens
  misc_feature (444)..(444): n is a, c, g, or t
ctgaccagggaaaaagctatgacaatgctgagcggccatctgctatacagctttctgcctctgaggtgttcttagagtgggaagtgttgtagggaggtgtttgggggttcccaagactaccctcaacttcactgattcactggaaggatgcacagaactgttacacgtatggtgatggtttcttacaatgaaaagatgctgattaaaaccatcaaatgaaaaaagtgcatagggcagcgtccaggggaaaccaggcacaagcttccagttgtcctctccccatggagtcatgtggacaacacttctccaagcagtgcgtgacaacacacacagagtattgtcaaccaaggaccctcacttaagcctgggtgtccagagttttttggggagtctgtcacataggcatggctgagtatagtctccaaccccaccagagtcataagngtgtttccggggggaactctagaatcactatagatatcacga

SEQ ID NO: 190056 - DNA, 515 bp, Homo sapiens
ccaggcaaggtggcgcatgcctgtagtctaagctacttgggaggctgaggcaggagaatcacttgaacccgggaggcggaggttgcagggagccgagattgtgccattgcactccagcctgggtgacaagagtgaaactccatctaaaaaaaaaaacagagaatacatgttccaaaacttcaccaagcactttatgggtattatctaatacccccaactgtacattaaaccatcttatatatggaaaaaacaaggcttggagaggtaaggtaaattgccacaggtcacacagctaatgttagatggagttggaattaaaatcaagatctgaaacagactaaatcataccactgcattcaactttcattgcttcttttttgggttctagcataaatcttctatctgctgtctctgtgtccactgcctgtctccctccactccgtcttctacactgctgccataaagatctttttctaaacacctgatcttgtaactctcatgatttcacatcacct

SEQ ID NO: 190057 - DNA, 556 bp, Homo sapiens
aggatgggtcagctttggccatgctgattgtgagtctgtggttcccagggagcagctgagtaggctgttgggtgagtggttctcaagctcagagctgagctgggggcatccatttgaaggttatgggaagatggaaagcacgccctggaggtgggtgggtgagctcacccaggaccacggtgtggcctgagaagtcggcctgcgatagaacccggggaatcccagtgtttccagggtgggcagaggaagaggaggctgggaagggaatttgtttctctggccagagctgttgctcagcgactgttggctggtgaggatgaggctcatgaacagatgtggaaacatcgtgggatgatctcatggtgggtgggacttgtcgccgtcatgcactcagcactctctggcctttattggtcaagctgcctgctgtgtttctggtgcccaaatgttctgggcacactgttgtttggggaagaatcgcagggactctccttcactcttagatagtggcagcgcttgcctcgctgcatctcgtgttctcaaaatcagcacatgc

SEQ ID NO: 190058 - DNA, 540 bp, Homo sapiens
tgtcggagaagtagaagagactgaatcaaatgtttagagaacatagcttgattaattcaaaactgaagccctggcctctctagtctcatgttccacagcaataatttctccttggccagaagcctaagcatctgtgtccaaatctcatactctttcctaaatggattcatcaagtcagaccttgagttgcttggttttttctgaaccaccccctaatttaagttaaacttaaaaatgggagccattaaatagcaaaacaaacaaatacaacaataataacaggacattatgtcctggccctcagaggtcaatttaatgtgattagcagcataaaacttcacaacgcctttcactggaagattaccagaagcaacatcattcagtatgttgccatgcactgccattctttcactttggcattatttattgattgtagcagaaacacaatatttgtacctcttaagcattttagtttcctttaggcttttctctagtaaatgtggaactgcatcattttgttaaactgttctgaagtctaaa

SEQ ID NO: 190059 - DNA, 204 bp, Homo sapiens
ctagttttggacattactatttgcacagtattttttaaagtcattgatcgcttcctttttcccttgggtaaaaatctgactttaaatttcttgtgtatatatcagatcttcttccaaatagactatattcagaaatgttgtattctttcacatggcatccaaatagtagtatttctagataggggatttttaaaaggagagtgc

SEQ ID NO: 190060 - DNA, 407 bp, Homo sapiens
atgagacattcaagacaatgaataattctgtatgagcactttctcagcccctctatctttgaatttgtcatttcatagtgaaaggactttattgtgcactctttgctttgctggcaggagcaagagagcctaactgaacccttcagtcagtcagccagcaagaccatacagagggtctattaggccatcagcactgtgggagacggagcagcagcagaagaaatggcccttgtcctcgaggagtttacaaggggttttagaagacagacacacaagaacctttcaaagacaatatgcttaatttagtgagaattgtgtggtatacagcagatgtgctgtaggagttcagggaaggggggcaggagtcgtcatggagacatgggaatttgtgttggatctgagatggc

SEQ ID NO: 190061 - DNA, 197 bp, Homo sapiens
cgtcagaataagagacttgtatgaaataattgactttggtatatgtcatggatactaacatatgggtataatataatacagtaattcaacctgctttggcaagtgggattgtaaacttgccgatggaagatgtgcagggctaattgtagttaaagacatgtattttagtctgcgtggatatactttggagccttgtg

SEQ ID NO: 190062 - DNA, 197 bp, Homo sapiens
tctttcccaaaggtgcagaatttcagaaccacagaggtctctcagaactttgtaaacaggcaaacttaaaaaaaaagaaaaaagaaaaaaaatctctggaccaaatattcttagacatatatttaatctctgatgaaaggatccacaagttcaaataatttggggtattaagtggggcttggataaaatcttcaagg

SEQ ID NO: 190063 - DNA, 253 bp, Homo sapiens
gtgttcttgcgttagctccaccacatctgccacacccgctgttgaaagggatctgttttgggagtggagggaagccttgccttatatttaacgctatctcatatacttactcaagatcattgaaaaaacaaaaaccatttactatggaaaatgacaaacacgcatctatctaagaaggcagagtgtaatgaaccccgtgtgctcacctagggtgccacctggggtgcccacctgggcctcattaccagcttcc

SEQ ID NO: 190064 - DNA, 458 bp, Homo sapiens
aatttgacttcatcaaaatttaaaacttctgcttatcaaatggctgttaagaaaatgagtagacaagtcacagatttggggaaaacatctgcaaaacatgcatctgacaaagaacttatgtccagaatatataaagatcttctataactcaacagtaaaaaaaatccaatgccaaaaatgagcaaaagatctgaacagacacttcacaatggaagttatacaaatagccaataagcatattaaaaagtgctcaacatcatcaggcataagggaaacaggttaaaatgtaaatgacgtgccggagtgtctaaaattaaaatggctgacaaaaatgttggcaaggatataaacaaatgaaacagctataaagtgggggtataaattttatactccaaaaggaacgtttagaacaaggtttagtggtttcttatcagggtaaacatgctcgtgttctatga

SEQ ID NO: 190065 - DNA, 172 bp, Homo sapiens
ctcaatttcccaaagaaaagactctaataaggacgtgctcactttgaataatgtctaaaacacaaataaattattttaaattagatgaacaggatatgatttatatcacaggcttttaggaattacgatattccaaccatgtgatgtctttaattctgatactcattatatg

SEQ ID NO: 190066 - DNA, 315 bp, Homo sapiens
atctaaggcagacatcaggccccaggtggacatacaggtctgaggtggaattcaccctgagggggacattcggccccaggtacgcatcaggcctcagctgaataaccagtccccaggtggacattaacccacaggtcaaccacagtccccaggttgatacctggtccccaggtggctactcaatctgcagggtaacattagtcccctgtaggatcccaggccccaagtggattcctaggcccctggtgaacatcaggtgcaggtgtccaagtaggccctgggtggacataactgtgtacaggtaaggagttgacc

SEQ ID NO: 190067 - DNA, 281 bp, Homo sapiens
ttgggcaaaatgtctaaggagttagtttaacagggacccaggtgaggtcatggtggggtggccaaggccagccatgctacttctacacacatgcaaatctacacccatgcatatgtgaagccagcctggtcattcaactgctcgaggtcctggggttgtgatcctcagcagagagatgagaagcccattggccacagtgtgggctgagatcacagaaactactgagcggctctaagaaattggacgcttgagctagagcctggcttgggggtgccagcagc

SEQ ID NO: 190068 - DNA, 540 bp, Homo sapiens
accatctatgcacccatccatttaactgcctacctgtccatccacctaactgcctacctgtccatccacctacctgcctgtccatgcacctatcttcctgtctgtttattcatctacccagtccatccatccatccatccacccacctacctgcctgcctgtctacccacccataggaagtttatctatatgtctgtctgtccatccattcattcatccatccacttgcctaccggtccattcacctgcttgtcctgtcatgcatccatctgtttgtccttcaatccatcttcctgttctgtttattgatccacccaatttacccatacacttgcctgcccatccacccacctgctcatccacccatcccctacccacacgcctgttcccccattccctgagggcctgtttagtgccaggccctgaactgcatgggatgttaagttgatccaacatagctcttgctttcagggagctctcagtctgtgcccactgttctcctagtgacgtgtggtcttgcagggccacagtgaaacgtgt

SEQ ID NO: 190069 - DNA, 362 bp, Homo sapiens
aggccacccacatcatgaaaaggtgtgtgtcatcggaaacccacagccattatgcggcattactcaaatactaaatgacaagctcaaattagaactacatcttgtcttttacctactcttcatttttacccaagtgcctggctcaaaatggaaactgtattttacatgatggctattgtattagtctgttctcacactgctataaaaaaatacctggccgggcgcaatggctcagacctgtaatcccgacactttgggaggtaggggacagacaagctagaaggaaatatttattgatcacctatcatgtgccagacactttcacaaatatgagcttgtaatcttcgcaactttctgaacta

SEQ ID NO: 190070 - DNA, 254 bp, Homo sapiens
gatatttttttcatattttttgtgtttataatttattaagtattcattatgtgagttgctcaggtattctaagaatttttataaaatttactaatgcacgcaaaataatttttcaatgttatttcacaatgagtgtattaacttatatttcttttgttgctttcttttttcttttttttttttttgagatggtgtctcactctgtcactcaggctagagtgcagtggtgggatctcagctcactacaaccccca

SEQ ID NO: 190071 - DNA, 544 bp, Homo sapiens
aattggagatgtcacacacagtaaaaacacagcttttccaggacccagtaagcttgccattaccaaggaattaaggtattctcctctggtaggaaaagaatttgactccttggcccagcacagtttcaaagctgcatgaagtcacgtttgcctcattacaattcctttggttaaagatgcttttctaagtacttcagaaaatgtatgcaaaaatattttttggtgcggaggccaccaaacctgctggactcacgttcctgcttttggcaagcaaagcaaaagaaccttctgggttcccttcctgcctttcctactgagatcaagctgaaggtggaatttttctatatatccagtccagcctttgtgacctctgcctttaacacaaacaccttgtttaaaaagtagacttgagggagggcacttgagttcagaagccaaaagaaatgggtattgctctttccgcgctaagcagttctgaacctagaccatatccttgggagaccagagcagctgtaagcagcaaactgcctcttttctgcctccc

SEQ ID NO: 190072 - DNA, 393 bp, Homo sapiens
cagtaagatgggagtgaagccctgtaaacgctgacttagatattcatggaatatgggtctatcatttttggtcaacaattcagaatgtgatagctatcctggacatcactaagagacttccattccagcaatagtttattgcaatgtatttagtcaaatgaattatcaattcacaacataatgaatacacagaaagtatccaagcacaagtgaaatttatgttttaaaacagaaaaaagtttgttatttcttttatcacattatagtttaaacagtagaaaatgtatagttgtgcatctcttaggttggtgcacaagtaattgcagttttggcgatggtgttacactatttactgtggggtgaaacactggtgaaacactatttactatgggg

SEQ ID NO: 190073 - DNA, 543 bp, Homo sapiens
tttttaagggttattcctttattctctctataagttcttttgaagtgtggtgttagggaaccatgcctcagtttccttattaactcttccggtgtttattagatcattttttccctatgctatgtcatcttaaacatcttaagcaattcattgacattttctgtttcttttgtattttcattgactatatttccagttctagattagctgattaatgtacaaattgaattattttgcatatccttggtgatataggctgttgatgccaaaggaggaaaaacaaatagacttgaaaactggtcgaatgcgtcagaaagccatttttggagatgattctgtgcgaacgtcttctctcctttcttgatctcttaatttttttttcttatccaaatatataccagctgattttgtctttctagaagatccaagatctttggtttagagatatattctcttaatgttaactggtattagaatactcttttctgtattttatttcaatgcattttaaaaatagaaatgattgtattttcttttaacttg

SEQ ID NO: 190074 - DNA, 344 bp, Homo sapiens
tagatcttctggaaagctgattaatttctaagctaaaaacgcatgatccttaagagaaatggctgagtccaggaggaaaaacaaatagacttgaaaactggtcgaatgcgtcagaaagccatttttggagatgattctgtgcgaacgtcttctctcctttcttgatctcttaatttttttttcttatccaaatatataccagctgattttgtctttctagaagatccaagatctttggtttagagatatattctcttaatgttaactggtattagaatactcttttctgtattttatttcaatgcattttaaaaatagaaatgattgtattttcttttaacttg

SEQ ID NO: 190075 - DNA, 483 bp, Homo sapiens
agtaggattccttggccaccttataaagtataaatgtatgtgcttcctttgtatcctagagctgttgagatgcgaactgtctcataaggtagcagaaagcactgtgatggaagcttctgtttcatcggtgtcctggaatctgctccatccccttctctaggcagcaatatggtcctgcttccttctgggtttaggtcctgggagcctgtcacaattctgtcacacaaaaagagaattccgtaatgaccagcacagctgtatcatttcaaggttctatgctaaaaatgtgcagatcaccaaatagttggccactgagagagcctgtaccacagagggtttcctaatgcgaatgcctgccccaaacactgcagacagcactttctggacttcatcctccatgttcattaactttccactgatttaacagttctaaccagagttattcttgatctttgatgaagtagatttttgaacctcgggtgt

SEQ ID NO: 190076 - DNA, 443 bp, Homo sapiens
ttttcatttagtctaatgccataatctaacaaggagtgtatttaaatgaagaaggatcacatcgcttattagttacagaatatgtaccagaaaattaacagattattgattgtttaatacatataagctattattatgattatgtactctgtgccaggcactacagagataactgtgttgtaaagaaaagttgagaaccactgctatcaaatacattgctttcccattataggtataaaaatgtattaataaagacatttatttcttggtggatgtggggaaaggagaaattctagtgttgtgtggagatacttaaaaacttgcttggtgctataaaggctttccttgactcactttcactattttctcttctacaatgaactttaagagttaaagataaatctgcgatagtaagagatacagaaataaaaattacaaagaaa

SEQ ID NO: 190077 - DNA, 526 bp, Homo sapiens
taaaaagcagcttcttcagggcctccacaaacgcaaaggactaaaaagacatctaagtcaagttattttacacaggcacctaatctcttttgggaagccttccaaaaaagtcaaaggaaagaatagtttaattttgaaattttaggggatcctctagagtcaaactttagccatgtgtaaaatctggtacagtagactctccttatccaaggggacttcgttccaagacctccagtggatgcctgaaaccgcaggtagtacctaacctgattaccgtaaatcagaacgtttctgttcacgttaagatgccttttccatgactaagacttatcatgcactgtggccatttgcagtttgaagtacaacagcaaatcaagcatacatttatttttcattcttcacaatttcatggacagaagattcattcataccatagatttagcaacctcagcatatgtttttttttcttgccttaagtcaagcactttcaccttttctcttaaagggagcagtttgcagcttcttt

SEQ ID NO: 190078 - DNA, 196 bp, Homo sapiens
agaaaagtggaggtctagaggagggggtggtcaactcaccactgggcaggggcaggttaggaaggatttgcgagaggaaaagctcaaatggtgtttgatggatgatgacagtttgggggtgtgtggttgtggaacttgctggcagagggaatgactaagcaaaggtatgggagggtgaatggtgtggcctgttcag

SEQ ID NO: 190079 - DNA, 525 bp, Homo sapiens
accctgtgttctggagccttcattcccctcaccaggcacacggccatgcaattaggcacttgacacatgatgccaatgttgacagccgagaatagaacccaagagtgggaggttagtctgctcagccgtgctgtgggatgaagaggtttgtggttgccacctcagcttgaggctgagcagagaccagagctcagagtggacgaagcatcagacaggagccccaggtgtgggctgtaaagccatgggagagagtccaggggtgcttgaccttcaaagcccattcaggtctaaagtcctcagaacccaagacctagacccagacaacagggagctgtagagtgggttcaggccaggccaatctgggcaggaccaataggcttggctgcccccaccccaactagtgccattggccgttctgggagggagcagtctttggagacttctggtgatcatcactggtgtcagcagatcttgtccaaattgattcctgtgggcttcttgaggttgggactaaaatgtgtctga

SEQ ID NO: 190080 - DNA, 478 bp, Homo sapiens
tttttttttttcctgagatggagtctcactctgtcgcccaggctggagtgcagtggcatgatctcggctcaccgcaacctccacctcccgggttcaagcgattcccctgcctcagcttcccaaatagctgggattacaggcatgagctaccacacccagccaagatttccaatttctgtacgtcctcaccaacacttgttttctgcatttcaggataaatatttatcaagtgatgtctctataccaagcacttgggtggtatgttgagagagttaaaaatcagagccttctcatttcaaaataatatgacgttttataaaaatacctagaaataagaaatccaccagatatatgcaaagaaacattaataaaatgcaactaagggacataaaagaaggcttgaatttggaaagcttacctaggaaaactcagtatttaaaggcttgtaatcttcccattctgtatatttaccacaatg

SEQ ID NO: 190081 - DNA, 351 bp, Homo sapiens
aaatttccctatccttagactgcctgaagccagacaagagtttctcccattagaatcgctggagcttgccaggagtctctcacattagaatgtctggggtcactcaggtgtctctatcattaaaatgattggggtggcccacttgtccccatcattagattgtcagggtttggccaggagtctgattaaaatgccttgggtcgcctgggagtctcttttattagaaagcgtggggtcgcttaggtgtctcttatttagactgcctggggtttcccaggtgtctctatcattagactgcctggggttgcacaggtatccctatcactagaatgcctgcggtggtctgagagt

SEQ ID NO: 190082 - DNA, 370 bp, Homo sapiens
ctctgagctggggaggatgggaggaggatggagctttcagaactcttgcccgtcaagctgttttcctttgtgggtcccttcatgaagatggcaatgaacatgcctcgcaggtcatgaaagaagtgctgaggctaaactccctgtcccaccccatccctcctggactgtcagtcccccatcaccaccatgaccatcagcctggaggggcttggcctccaactgcagcctagaatgcagtccaccccttaccggtgagccttgtcctgggccaggtgtgggactgagggagccagctggaagtcagatgggcaagaccagctggtggggtcacagatagcccatggaggtccggcaggacacagccaggccg

SEQ ID NO: 190083 - DNA, 242 bp, Homo sapiens
tatattttggctgaacagtggcaaatgctttgggccctaatcaagggcctagtcttatataaaacttttgtgtggcaattactaaaaacacaagatcttaattactgtagcacaacaattatcctactcattgtatcttataagaaggattgtgatagcaatgttgccaggttaatatatttccctatgcaaagaattaatctgcaaatatattgttaggaactttcttgtatattaggaag

SEQ ID NO: 190084 - DNA, 255 bp, Homo sapiens
ttcgtcacttttttttttgatctgcactcacctgctccaggtgagaacttgttctaatggcatgtctggatcagggccagcaatgaaaaggttagaccctgggcttggcaccagcttatgcagcagagacattaattgtcatgtccagtcagattatgctttttccttccattctgaatgttgcgtcttctctgacattgtatatccacaccttcattctcccatgtgaacagagcctcccacaaataaataaag

SEQ ID NO: 190085 - DNA, 510 bp, Homo sapiens
tgtgtgtgtgtgtgttgagaaaggaggggaatatagtgaatgtgggaccactagctctagggctagtggggaggaggagtgctgccaaaggcacagagtccagtcttttggtagcatgggattaagaactggcaaggatggagaagacaaagacaaaacataaccagcatttcctacgttaacaattttactcaagacaaatcttacattcatttgtttttcttccattagctgatatagatttcactttaggatcaacattagatttgtatcaataccccattatgtactttgaaataacttcttattagtgtcttaaactttttcatgctatccactgagtctagacaaaagatttcatgttcattgtatcactatgtctcatattccaatggaaaataaattaatgatgagtaacacagtgcacgttcaagttatgagtgtacgtatctatttagcaataaagatatggctgatttgtgtcaaaaggcagagcaaactggttgaagt

SEQ ID NO: 190086 - DNA, 707 bp, Homo sapiens
ccatacctgtgattaaactgttccctacccatagggctcatctcagtaccaacctcaacccagaacaacagtgaatatccacatatgactcacccttctatacccattttaatgaccagctcctccttatgagacactttgcagttacaatctctccatccctgaatgcttacaatacattgtctaatatcgctctgctggcatttacccacttcctaccctgtataattattttcaatgtgcacatcttgtctgacctattagaatgttccttgagggcagtttctaggtctgattcatctttattatcacttccactacttctaaggcactcctattagaatggcaaaactccaatgacaacataaaatgctggtgcagatctggagcaacagggactctcattccttgctggtgggaatgtgaaatggtatagccactttggaagacagcttcctagtttctaacaaaactaaacatactctatcatataatctggcaatcaagcacctaggtatttatccaaatgaattgaaaacacatgttcacacaaaacccacacatgaatggtaccagcagctttattaatcattgccaaaacttggaagcaccaagacatccttcagcagatttaaaaaaatgtaatattattcagcactaaaaagaaatcagctataaagccaagacacagaggagctttaaatgca

SEQ ID NO: 190087 - DNA, 149 bp, Homo sapiens
gtgataatatatctctccatagacatatctatataaaatatatacaattaatatagatatctatagagagacaaagtataaaaaattcacaaagctgcgtatggtatgacactcagataagtgtcaaagaaaccaagcttattaaactt

SEQ ID NO: 190088 - DNA, 499 bp, Homo sapiens
aaagatgtggggtaaatatactgacccaagtaaattttaaaattaaaggcattaaggaactgtgcataagcactatattctaattgggaaggcaatagagaaagttaaatgagtagtatataaaatctttatataacctctttgcaacttttttgtaaatttaaaaatgctctaaaataaaatatttattaaaaatgaagaaaacattatgccaagtgaatgaagcttataattaaaggtttcatgctgaagtgcaggtgtatccaaaaggatctttgcattgaaacaggattcaccatctaatctgtcaaagaaactctagtgctagacatttaaaaaataacatcctgaagaatgaagagagcgcttccaaaatggccgaataggatcagctacagtctgcggctcccagtaagacggatgcagaagacgagtgattcctgcatttccaactgaaatacctggttcatctcattgggactggttggatagtaggtgc

SEQ ID NO: 190089 - DNA, 177 bp, Homo sapiens
cctgagtttgcctttggccttaccctaaatttggctacaattaaagtatgtaatgagaaataatcttcttcaaacaagcagataaaacttcatgtaggccattgaaacacagtgattttggaatctctactgagatgcttcaaggaaaatgtaaaataatcagtattgtgttttggg

SEQ ID NO: 190090 - DNA, 465 bp, Homo sapiens
cctgaccttcatctcctcccacctccccagccattactagaattccagtcacactgaactcgtcatggtctttcagctgtccggttctccaggtccttgcacctgtagtagtctctgcctggaaatcccttttccggattccctatgtagctaaataaatatttcaagagttagcctcccatttcctcctggaaccctgggcacctggctcaggtatttctccactgtgctcttgtagccctgtgctatgcactatgacactgtaagccatccctcatttacttgtctatttcctctcccactgtaaactccagaagaactgtattctttgccacaaaggctatctcattaaaatgtgcctcatacatattaaggtcttaataaacgtctggtggggccgggcacggtggatcatgcccgtaatcccagcactttgggaggccgaggtgggaggagaggaagagg

SEQ ID NO: 190091 - DNA, 454 bp, Homo sapiens
ttacagttgtgagccaccgtgcccccctttggtacctcattcttgcataacatgagacccacctcttctctgtgtggtgtcagaaacctccttccgatgcttgcaacagaatctgtgccttcagcttctgccacaccccagcaagcaattctgctgaagccccaccaataagccttgtccacagctaaccaggcgaggtcaagccgtagtccaggatatgggccagctcctggggctggctggctgaaaccagtagtggtgctggtaggtgtctgcaagagctccattagattcccttggaatgatcccctgttcaaggatcgtgctgaactggcacatctcaccaccttatgtatgggacaggagctccatcagactacagcgcaatctctgaaacatcctgacatgttcatgaaacctaggatatactaaccccccaataagagtgggaatt

SEQ ID NO: 190092 - DNA, 561 bp, Homo sapiens
ccccccatttcctcacgtcagtgccatttccacttgccctttagccagtcccctggaacccaggacactctaactctcctctcttattctaattttcaattctcaatttccccttcaaaatctctcttgggttcttacctttctatccctactccacgatcttggctgaagccattttccatccataacagaagaactctaacagtctatgtggtgtccatacctccaatctcccttcatccagtcatcatacacacaaatctgcaacagcaataccacccaaaccatgtagatcactccacaacccgctatggctccctactgctgcttggataaagtgcactctgttctagtattcccagactgcaggagtctcacccctagctgcagctgtcccagctcactctgcacagatccctgctttggctcagtccaccccctctctgttgcctgcccgagttgggctcatttccacctccgcgtggctccacatacagtcccctggcctggactgccctcatcctccgaggatccagaaattctcgagtagtactactagta

SEQ ID NO: 190093 - DNA, 709 bp, Homo sapiens
ccccccatttcctcacgtcagtgccatttccacttgccctttagccagtcccctggaacccaggacactctaactctcctctcttattctaattttcaattctcaatttccccttcaaaatctctcttgggttcttacctttctatccctactccacgatcttggctgaagccattttccatccataacagaagaactctaacagtctatgtggtgtccatacctccaatctcccttcatccagtcatcatacacacaaatctgcaacagcaataccacccaaaccatgtagatcactccacaacccgctatggctccctactgctgcttggataaagtgcactctgttctagtattcccagactgcaggagtctcacccctagctgcagctgtcccagctcactctgcacagatccctgctttggctcagtccaccccctctctgttgcctgcccgagttgggctcatttccacctccgcgtggctccacatacagtcccctggcctggactgccctcatcctccttccctttccatctgggtgacaacaggccttccagaatggtcccaaggccagccacagaatctgtggatcgttctaaactgcacagattgagaatgtacatgctgccattgtttctctgcagatgccatcaaacaacaggcctctcttggtagctggtgtctcttgctcaccaacaggatgcc

SEQ ID NO: 190094 - DNA, 704 bp, Homo sapiens
cttaaggactcaacatggattttacatcatttggatgcaccttcctcaatgccacttccattctagaaaagaaaaggcatgtttctcttagaggcagatgatgaggttttcgtatcttacataatattaattttgtgaatgccaacaaaaagttcatgttcctagaaaggaacacagacacggagctggtcacaaatggtttgtctgcgtaatcagggctgatgaggctgcctgaccccccaggccctccttgcagcaggacgtctgtcctgtagctgaacaaacttttggttggtgactacaaagagaattccccattttttctctcaaggaacacagacttttcaaacatttacgtggctattttttatcgtaggatatcccagacatgtaatgaaaaatgttcctggatagctgtttacttagaaaattaatcattatcagttaatccatcttaggcatggtattgtcttaggtgctatagaagaatcaaaagaattccagctggagggctagcacgcacagtgcaacccctgatagcttcttttttttaaacagagcagcatcaacaaggacagattattgtaatgcagggtttacagcccctgccctgttgccagataattccttgttgtgggccccgcacccccacccctgtgtattgcagggtattgagcagcatccccaccttctacccactagaa

SEQ ID NO: 190095 - DNA, 158 bp, Homo sapiens
caattgaattcactgagcctgaatccaaatcagggaaactggtggttcacggactacatttcatttgtgcattggaaaccagggaatacaacacaaacatccggattgctgatttttcttgagagttggtagttctaccaacactgggacctgatctt

SEQ ID NO: 190096 - DNA, 481 bp, Homo sapiens
tacaggtgtgagccaccgtgcctggccgccatttctatttttaagaaggtaagattcagagcaaaaatactcactgcttataaaaagagttatttagtcaggattataagaagaaacctatttttgccttcatttaactgcaaaaaaatgtaagctgtaactcattatctttcttgagttcttttttttctttagtaaatcttgtcacattttagcattgtttcttatttcagccgtgtattctttgtataagccttgctcagtctgcatgccattagtgttttcagcctgctttgtattgatagcttcttacatttcagtgtttataattgacagcgctctttaattaactagttcagatcaaattgaatggtgttatttctataacataattagaaatcttttcagaggttccttccatgatttctagttttagtttatgaaacatttacagtataaaatatttgtttttcttttttct

SEQ ID NO: 190097 - DNA, 304 bp, Homo sapiens
ggaagggacctcagctttccttaggacttctcttctgcggtcctgcggctactctcctgcgtcctcctgcccgcccccagttggactgtgaagccagcgagagcatgggggcctggctgtcctgccccagccttcctcggggtgtcctggctctgtcccgtgagctgcgtgacacaggcccacccacaagtggcgtgacgcaggcccagagccacaggctggacagctccactccccaggactcacgccgtggatgtcacgaagcttcacttgtctccacagaataaaatccagcccgaaaaaa

SEQ ID NO: 190098 - DNA, 249 bp, Homo sapiens
taatggcagaatggaaagaatcccagctttggagttaaaatatctcacttaaaacttgtcttcgctgcaggctacttggttgtacttgagtaatttactcaagattctcttcagcccagtttccttatctgtaaaatccttccactgttgttaggaggataagaaagccagtattggtaaaaacatatatcagagtccttttgactgtttagaaagtgttaatttactccacgattatccattcaacat

SEQ ID NO: 190099 - DNA, 490 bp, Homo sapiens
caccgcacctggccagtccattctttttcaatgtaaccttattgcataatacacatgtattaggccattcttccactgctataaacaaatgcctgagggggtgcagccaagatggccaaataggaaccgctccaatctacagctcccagtgtgggcgacgcagaagacgggtgatttctgcatttccaactgaggtacaaggctcatctcactggggagtgtcggaaagtgggtgcaggacagtaggtgcagtgcacccagcaggagccgaagctgggtgaggcattgcctcacacgggaaccgcaaggagtcagggaattcccttttctagtcaaacaaaggggtgacagatggcacctggaacatcaggtccctcccaccctaatactgtgcttttctaacggtcttagcaaatggcacaccaggagattatatcccgcacctggctcggagggtcctccgcccacagagcctcgctcattgctagca

SEQ ID NO: 190100 - DNA, 591 bp, Homo sapiens
aaaatggcatcagatggacaatgacaagggcaacttaaagacagtgcaattggttgatgtctgcaaagcagcccgggaccaggcccctgggcattcctttacttaaattattcctttgctcattcatttgttccctccttcattcctatctttatttgttcattcatttattcattcattcttctgctgagtgacatcgtagcataacgatggatagcatggactctgaagccagtttgcctgggtttgaagcccagctctgccatttagttctgtgaccctgacaagtaccttgacttctccgtgcctctgtttcctgatctgtaatcagtgtctggcatttggaaagtgctacatacatgtttgcaattattgtttgtttattctttcaccatttgctagaagatggctatgtgacaggcactgggctgggtggccaccagcgaatcaggggaagtcacaaagggttaaataggtaattactaagtcatgtggtcagcgttgtggtgcgggtaagcacagggtgctatggaaatgcagaggaagggcacctaacctggatgggttgggctagagaggaggagtgttcca

SEQ ID NO: 190101 - DNA, 156 bp, Homo sapiens
cagagggtgtgatgagggcaaaggccagggtggctagagcagagtccactaggacagggtactatcagataaagtcagaaaggtcacaggccaaatcacaccctctgccttccccatagatctgcatgatttgctcctcgtggacacgaatgttca

SEQ ID NO: 190102 - DNA, 489 bp, Homo sapiens
cctgctccgagtgtcagtgtgttgtaaagcatggtttaaaaatcttggttacagaagatttaactcatgatagaaacaaatgtctgcgggtcagtgatgttaagccactagtaagaggagggctatggtggggaatgtggctgaatgtcctatcacaagagcatattcagttgcttttatctctgacctgttactgatgtgcagaagcttacccagacttgaaaaatcgattttttccctcagattttatgttcaaattgtcaagtatcttaaattttaccagctaatttggatgcttttaagacattgcctgcgctaaacaaaatctaacttagggcattactactagtttaggattctaatactagaccaatctccccattttaaagatgggtaaattgaaccctcaacccccatgattagttgcttatccaagggagcacttttacaagtgctattgtcccaacctgaatctaaattgcttttagt

SEQ ID NO: 190103 - DNA, 685 bp, Homo sapiens
agggtgggagagtgggaaggatagcttgaacccaggagtttgagacctgcctggggaatatagtgaggcactgttctccacaaaaaggaaaaagaagagaagagaagaggagaagggaggggaggggaggggaaaagaaaagaaaagaaaatcaccatcggcataccatagtaatcattgttgcaggcaagatccaccgatggatgctaaaattaatgtgaaaaagcttggggagaaacaggatatttgcagagtttcaaagtatctctctcaaggtatttattaattacaaaagaaaaacattttacagggaagaaggttggcagacaccactttcacctactggtcaacattaacatcaccagtgttgagtcatatagaagtctctgtggaaataagcactcgttcctcttgggtgtatatatctaggagtgtcattcttggaacacggggtagctgtatgcttactttattaaaaactgccaggctgttttccaaagtgaacgtacaatttcatatttgcaccagtagtgtacaaggagttccagtggctccattctaacatgtaatatttcttaattttagtaatttacgtgggtgtgttatgatatctcattgggatttgcatttccctgatgactaatgatgcagagcacttttcactggctatttagatatcttcttt

SEQ ID NO: 190104 - DNA, 317 bp, Homo sapiens
aactggcaggaggatgcccatggctcttcccaaaggtctgaggatagaaaatctgtttcttcctctttcctcctccttgcaacgagtatggctcagggaactgagcctcaacccattgaatactgcactgattatccggaagcagaacagagagggttggggtgtgactgcactcatgaagaggcaggaggaagccagggacactggcatcctctgctgcctgactcttgtcctgcgtgtaacagttttctacaatcagctctggcctgtggcctgtgctcacacactcttgctcacaacaacctcaatgacttgga

SEQ ID NO: 190105 - DNA, 621 bp, Homo sapiens
gtgttgtggggtgcatactaggaagaagtgctctcgacttgtatcagtggagtgtctgcggtgaaggggtagggaggttgctactaaggagactccaggcttagacccgaatgtccatccacctgtcactgtccccaagctgcagtcagtctcctttgggtccgaccctgtcgtctccctggtagcccagcaagcacagtgcgaatcagtttcccctggacgctgatcctggtcgccatatgtggggaggcgacagcctgtacacctccacagacaggactaagtcagggctgtctggtggcaagggacagaaatcccaactccaacaagctttagaaaaaaattgtttaaaatgagttgctcttaggccgggcgcggtggctcacgcctgtaatcccagcacttcgggaggccaaggtgggcagatcacgaggtcaggagattgagaccatcctggctaacacagtgaaaccccgtctctactaaaaatacaaaaaattagccaggcatggtggcgggcgcctgtagtcccagctacttgggaggctgaggcaggagaatggtgtgaactcgagaggcggagcttgcagtgagctgatatcgcgccactgcactccagcc

SEQ ID NO: 190106 - DNA, 286 bp, Homo sapiens
cgaaggcatttttatgcccagccttgttcccttatttgagtgagttggaggtttgtgcaagattttatccaagtggaggtttttccatctgtgtagccacgggcatgtctccaggcacaacgccacgtgctagttcccttactggttcctgcagcctgatttccccccaccccaggctgctttctattttatgtggggataaggctctgaccttgggccgggggctctccagggactcttcccttgctgtctacctaaggcaagctaactcctttcagtccccccg

SEQ ID NO: 190107 - DNA, 198 bp, Homo sapiens
attacaataataaaatcagctgtatttttaagtaattctcttttagaattagaaacgcggttatagaaaaaaatggtataaatcacttatttttattggttggttgtttttaatttaaaaccattagcgttgagatgactattaaagggattacattagcacataaactacaatagattaatttgtgaaaagcattta

SEQ ID NO: 190108 - DNA, 496 bp, Homo sapiens
cagaagtggtgtcctttattactaaagtgtcaaattagtaggttcattgggtctggttgtctctcctcctgtaagcttgaaattgatcactgtatttcagtgttgtcaccctgatccatccattataaaatttccagtagcatttcatcataagatgtttgaacctctgaagtagacacccaaaacctatttaataaactaattagatgtagacataggagtatgcaaggaaacaaaactatgtatatgacctgtccatctttttgtaaacatgaatttttcaaagagagttgtggtcatgctgtacttattgtttcattatctactttgaggaaaattttgtttctgtttatacaaattatgccttttcattggaagaaatacagaatgctctcacctggtgcccagagtcagaattgcagaaattaaagtcaaccaagagcttggaaaggggtaggagatttgagtggagtaagggaggcacatgtattctatt

SEQ ID NO: 190109 - DNA, 676 bp, Homo sapiens
tagctttgcccaacctcccccactcaattagatctttttgtgtcaagatgaccaaagacccccagtactcccagccaattatcaggcttcattttacttgacctatccagagcatttgatattgtctttcaacccatcccttacacaatttattcacttgtttcttgggatgtggctattttgttggcatccctgctacctcactaaaactcctcagcatctttggtaggtgcctgctcatcttctaacctctaactattggcattttctaggaattcttcaacttcttctctcttctatctagagtcaccccatggaggatccttgagccttagagaaaggagagtttctgcccagggtgctctgagcactggagtcatctaagaattatagctggaataataatgtaaaagtaaaaacaaatagatgtaaaataagtaaaacagctttcacttttcaaaactaggtatttatattctcaaactttatttccacaggaaagcagatgatttcagaacatactttgagtgaagaaatataaaattcctattaatttttatttttattttctggctaaacataaagcaccatgtccttctttagtagggtgtcttatgtgtagaatagagagatgggccaattgtaaaccccaccttcacccatggcaatcaatata

SEQ ID NO: 190110 - DNA, 463 bp, Homo sapiens
tagctttgcccaacctcccccactcaattagatctttttgtgtcaagatgaccaaagacccccagtactcccagccaattatcaggcttcattttacttgacctatccagagcatttgatattgtctttcaacccatcccttacacaatttattcacttgtttcttgggatgtggctattttgttggcatccctgctacctcactaaaactcctcagcatctttggtaggtgcctgctcatcttctaacctctaactattggcattttctaggaattcttcaacttcttctctcaaagtatgttctgaaatcatctgctttcctgtggaaataaagtttgagaatataaatacctagttttgaaaagtgaaagctgttttacttatttacatctatttgtttattactttacacttagttaattccatgctataattcttagatgactccagttgctcaggca

SEQ ID NO: 190111 - DNA, 177 bp, Homo sapiens
agtgctgggattacaggcgtgagccactgcgctcggagtccttggcctttagatgatttatagatcaaaactgtgaggctgcgtgaattgatcaagagaacaggcgagggcggggaagaggtgtgaaacctgagccctagggcttccagtcctcagaggtgggtgaggaatgggcca

SEQ ID NO: 190112 - DNA, 100 bp, Homo sapiens
ccacaaaaatgttacgtctgtattgtaagaaaactagaatacgctgataaacatgaggaagaaaataagaatcactttaattacactacccagagctgcc

SEQ ID NO: 190113 - DNA, 171 bp, Homo sapiens
gatagaatgttaaatggtgaaagaaactttataagctagtagttcctttttttggtagtagaaccccagtatatagtacaaaaataaaaaatgtggatggttgcagtggctcatacctgtattcctggcactttgggaggccaaggcaggcagatcacttgaggtcaagag

SEQ ID NO: 190114 - DNA, 400 bp, Homo sapiens
atgggcagggttcctcatattggctcagaatatatctcttcatatattttagagagtttggttcttttcatcgacatgagaagagctggagcaaaattacctgctactttatagtttctgcagtaagatgaaatttacagaatacatatattctccacctatgcattcattcattctttcattctaccattcatttattcatcaaacatgaatggtcattataataaagggacttggccaggtgcagtggctcacacctgttatcccaacaactcaagagactaaggcaggaggattgatgaggccagaagttcaagaccagcccaggcaacacagcaagaccccaactctacaaaaatgataataaataataaagggatttggggaatgccaagagaac

SEQ ID NO: 190115 - DNA, 129 bp, Homo sapiens
tttaaattggacacacagattaactgaggtgggttcccaagggaaggagggatgtcaacactggacttccttgaaaaacctccagcttcccttttgatccgaatctttctcctcttctgctgactacct

SEQ ID NO: 190116 - DNA, 462 bp, Homo sapiens
atcagggatattggcttctagttttttgtagttgttgcatccttgtctggttttggtctcaaggtaatgctggcctcttagaatgagctagggagaatcccttctcttcaatttttgggaatagtttgagaattggtgttagttcttcgaaagtttggtagaatttgcagtgaagcaccaagtcctggactttttctttgttgggagacttttaattactgattcaatatatttgaatcattattggtcttacacattattggtctgttcaggttttgtatttctccctgatttaatctgagtaaattatatgtatccaggaatttatccatttcccctaggttttccagtttgttagtgtatagttattcactgtagtctctgatgatctttggtatttctgtggtatcagttataatacacttctggttttgtttatttggttcttttattttttcttgg

SEQ ID NO: 190117 - DNA, 679 bp, Homo sapiens
cttcaggcctatggagaaaatggcattttctttcatgtattctttgtttgacaccagttctaaaacctcaacacactgactagaaacttgattacagattctagaaaaactcctagagtcagaaaacaggttttagtctttattctgccataattcaagtgtcttatcctggatgaacaccttaggctctgtgtaaaattcagatgttttatccataaaatgagagctatattagaatattttccagctctataactactttatttttgagacaagggtctcattccgtctcaaaaataaataaataaataaaataaaggatttggatagacaagaaaatatacaaatggacaacaggcacatgaaaagatgctcaacaccattagtcaatagggaaatgcaaatcaaaattataatgaatataacttaatacccagtaggatggctattattttaaaaatggaaaataacatgtgttggcaagggtataaagaaactgaaagccttatacattgtaaatgtaaaatggtgtggctgctgtaggattaaaaaaaatagtggttcctcaaaaagttgaacatggaggctgggcttggtggctcacgcctgcaatcccagcactttctatttccaaaagttttcatcaccaaaataaactctattaagtatactatcattc

SEQ ID NO: 190118 - DNA, 658 bp, Homo sapiens
caatattgaagctcttatcttttctttattggtgctttgaaacttcatgctgctttgtctagggaatggtcttttcattcattttccagatacctggtggacccttctcatctgaagactgttgtcttaggctaggtgtcctagtacgcagcacctgaggtaaaaatttattattaggaagtttaataaccaagaagcaggaatgagagaaaatcagagtgaggcactgaaagagggagaaaaatactgaggccacagctttgtgaaaagctgacgactgctgagtggacaaggcagcttcagaaaggaagtttaaagatatgcttctccacacagtccttctaaaaagaagaaagtgtgatttgcccagtctcatctccttctgggcaaagattgcaccatggaataattcctatacacttacaggttgcatagttattggtgtcaagagagtcctcagcaacaatgagtccccagggtagaaagcaaaagatcctgcaggggcaggaggcaagatattgtcaggtcatgtccttaggtgacacgagggaccaaaggcagctgccacagcaggcccctttcagcagcagcggcagaagcagtgacctgacttcatcaccatgggaacagcagctgtcactgctagattcagtcactg

SEQ ID NO: 190119 - DNA, 1000 bp, Homo sapiens
aaataaatctacttaaaaagaagtgagatcgtaccactcctttgctcaaagtctcctgtggcttcccaacacaagtaaaaaccaaagtcctaacgatggctttaaaatcctcccctcattacctctttgaccccacagactgtttacccagctttgtattcccagaaagctctccacaagctgccaacctcatagtctttgcagttgtggtttcctctgcttagaacactcttccccatcatgctccctccatatgtgctcagatgtccaactcttcagtcagtccctctacttgtcagcatattttaagtcatgatgtttccattcccaatatttcatatttcctcctttactttttaatacttatcacagtgtaatggataatttattttacttactaatcttcatcatatttctcatcacattaggacgcaagacacaggaggccaggaatgtgtgttctgttttgtatctcaactgccaggaatagtgcctgacacacttaaagaggttctctgtaaatatgtgttacatgaatgagtaaatgaatgaatgaatgaatgaatacacacatggccgggcagtagctcacgcctgtaatcccaggactttaggaggccgaagtgggcggatcacgaggtcagtagatcaagaccaccgtggctaacacagtgaaaccctgtctctactaaaaacacaaaaaaattagctgggcatggtggcacgcgcctgtaatcccagctactcgggaggctgaggcaggagaatcgcttgaacctgggaggcggaagttgcccgagatcgtgtcactgcactccagcctgcactgcaacagagcaagactccgtctcaaaaaaaccccaaaaaccacatttgtgtatgtgagtgtgtatatatatccccatttatatatatatatgaatatatatatatctccatttatatatatatatgaatatatccccatttgtatatatatatgaataaaagtgaacttctc

SEQ ID NO: 190120 - DNA, 320 bp, Homo sapiens
ttttgtatttttagtagagacagggtttcaccatgttggtcaggctggtctcaaactcctgacctcatgatctgcccacctcggtctcccaaagtgctgggattacaggcgtgagccaccgcaccaggccatggagacaatctttatagtcaaagatacaatgaggctgaaagttaaagaatagaaaaagtacaccatgtaaacagtagccataagagaccccaggtgatccccatagggtcctggaaacaggacttgtcctaaacctagtttagcagcatggatgcaggcaccaccagacattcacagagctctagtca

SEQ ID NO: 190121 - DNA, 300 bp, Homo sapiens
ttttgtatttttagtagagacagggtttcaccatgttggtcaggctggtctcaaactcctgacctcatgatctgcccacctcggtctcccaaagtgctgggattacaggcgtgagccaccgcaccaggccatggagacaatctttatagtcaaagatacaatgaggctgaaagttaaagaatagaaaaagtacaccatgtaaacagtagccataagtgaaaacaggacaatgcaccacatctctggcgatttgtccaccctggtgagctgcctgtctcttggtcctggctttctgcacct

SEQ ID NO: 190122 - DNA, 260 bp, Homo sapiens
ttaaatagttttcttttaaaaatcatctaataagatttttaaaacacttttcttatgtgaactgtaatttttaaatgtggtaataacaaatggatgatgaaaaacacttcctctattccatccagtgtttctacctggctatagaaaatgctcagtcacagcttgcaatcatactgtagctgaggcacatgaaagatggtcttggttatgacacctcaaagtcagaccacaaaagtgttgccaggaagcacagaggcagc

SEQ ID NO: 190123 - DNA, 348 bp, Homo sapiens
catccctgcaggtttccttagcacttggtacctatccctgtagtggcacatgtttgcattgttactgcatatttacttgctttttctcctccactaaattgcattccttgagagttggcatgtgttgcatatgtgtgtagagaagaggcatttaatattggttgaatttctgactgaacaagtaggtgaagaaatggagaggttgggggaggaatggataaatgtctgggccttgagtcagcaggcagggacactttgaccagcttatgagatggggagacttaggcaagggcctgaggtctgtcgtcctcccctgcaacccatgagccctatagcattgacccccgt

SEQ ID NO: 190124 - DNA, 320 bp, Homo sapiens
agtgagttatgattgccccactgccctccagcctggatgacacagcgagactctgtctcaaaaataataataataagtaaaccaataaataaaaagaagtgtgggggcttcaaccacattggcctctgggttttcaaaaacctgtcaccccaagccttggccttatggtgagcagggcagatttacaggcccgagctgcctcagagggcacaaggagctaaaggctgaactcctcacgaaagcaactcagacaatggagggttagctcccctgcaacctggcaaatccacactgtaaattaggtcaagtttattgaggta

SEQ ID NO: 190125 - DNA, 200 bp, Homo sapiens
tggtgtcttgagacgctgagctagggagcatggtgggctcaccagcactgtaatactaccattatccccaacttacaatccccaagtgagagacctgcaggagatctgcttgtggcctgagtgaacaagtagcttgccaaaagtctcatggccgataagagatacgaagtccatcatactctcagaaacactcccctcaa

SEQ ID NO: 190126 - DNA, 463 bp, Homo sapiens
cagacattcaaatgagagcttccctagccttcaaggggctcacaatcaaatgggtatagctgacataaaaacaactataagacaagtaagcaattataacataaactctaaaaaatggttatgaactagtgaccacaatcctagttctcggtattctgtttatatacataaatatacttatctttattagtgtaacaccattatttttattagtgtcacacatggatcagcagcccaatccttcactttactccaattcttaacactggcatagcaaacccatctagttcctcttttatcactcagctcgctgagacttcgcgagctagatagcctccccatcctgaataagcaaagtaaaaccatggactgagtccttcctcttaggatatctggaggaggaaaagaatcagaactgctgcccaaaatagtgaagctgcccagaagtagtgatcctgaaagc

SEQ ID NO: 190127 - DNA, 219 bp, Homo sapiens
gacaaggacactgggtccctcctgggagagcacggaggggtcatctcccttaggagccaccctcacagcttcccggggctggggctggggcccgattcagaggagctcctgaatcagccctgtcacttgtggttcctctgccccatctttcttcctggaggtggaaacctacatggaaacctccacacagcactcaggaacactccccggctgcagaca

SEQ ID NO: 190128 - DNA, 472 bp, Homo sapiens
cagtctcttgctactcccagggtcggccacacatgacagcatcagcttcccaaaggggcttgctagaaacgcagagcctcagacctcaccccagaccagctgaatcagaatctccatttcatccagggacttgtaaagatgcccaggtgatttgtaggcatctcaaaatttgagaagccatgagctggttcagtcttccctccatcctgtccatgagaaacagctggccacttctctgactgctcctttcctatctggcaaagaagttcttgtagcaatagtgaccatttgtttctaaatagaatatgagtagcaaggggagggagaattctcccacagaaaacacttatttctcagtatggatggtaggagacacaggaatggacaggaagtacttgagtaaatgtgggctgcagctattgatcagacctgctgttcatcccttgattctgtggcagccccatgtggtgtg

SEQ ID NO: 190129 - DNA, 234 bp, Homo sapiens
aaaaattcacacaagtgattgtgactttgactagtgatacaattattggtattaacaacaatggaaatcgtgagcttcttcctgcatacattttcactttctcaatgtttaaatgaaaatttgttcagaatacaaaacaaaatagcacattgtaagaactaagaatttccctttggctagaatggacaagtagaaaaacaaatataaaagtatactttgttttatgtattcaat

SEQ ID NO: 190130 - DNA, 436 bp, Homo sapiens
tggaggcggcggatgcagtgagcagagatcgagtctactgcactccagtgctgtgatgacacagtgagactccgtttcaagaagaagcatgtcagctggatgcggaggctcacgcctgtaatcctagcactttgggaggccaaggtcaggtggatcacctgcggccaggctggtctcaaacttctggcctcaagtgatctgcccgcctcggcctcccaaagtgctgggattttgggtgtgaaccaccgcactcacagagtttttttctttttttaataaatttttatttgaaattatttagatttgcagaaaaagtgcaaactaatacaaagagttcctatatattgccatacccaatttaccctaatgctaacatcttacactagcatatttgtcaaaatcatcagtgtaccaattcatatactgtacattacta

SEQ ID NO: 190131 - DNA, 497 bp, Homo sapiens
aaaccattaattgaggccctgcagtgcgcccagggctgcctaggaccgtgagaggctataggagaggaacaggtctgcacctgacccatgtgggacccctgatcctccacctcccgccctcctgcgtggcacacagtaggtgcctgggcagtgccgtgacgctgccatccctgattcagggcaggtgaaggcctcccaggtaccagaaagaagctagggagccccagctcatcccacccatagctgagcccctgatatgtgcttcactgggtgctcaactctgggaggggggccacctgccccacagccccgatgggggagaaaaccagctggccattctgttattccgcaaatatttgttgagcacctgctaggtgacaggtcctgtgtggtagtaaacaagacggagagatggatacaatccttgtcctcacagagcttctggtgtctgggggagggggcagacactaaatggcaaaatccagcatgccgttatt

SEQ ID NO: 190132 - DNA, 367 bp, Homo sapiens
atgcccgctgagaggcttagggaatgaatccatgtactgtgaacagttatgtccaagatgtgacttggtccacatcacagatagggttcgattgctttatccttaccctttcctgcatctggggagctgttttgtttgcaagaatgatggcacatcttgtggaatccactgtgaggacagttaatagtcatatggtgggctaacagtgctctactatgaatagagaaaagaggagtcaccgtatcggggtgaggcagaggtcacagagccaaaaggactatgggaaaaggattttcagttagaaaaacaaagtggggagctccagatgggattcctggctgtggtccttccagacagttgctttctc

SEQ ID NO: 190133 - DNA, 314 bp, Homo sapiens
tcatttttccccttttgactctggccttacgggaggagagagttcctgggagggctgcaatttgacagtaagatgtccattcctgtgtcagctgggcagtgtagtgtagtctcgagacaagagccctggccctgccacctcctcaccagtgacttttggaaagccactttccctttctggttttggtttcatcatctctgaaatatcccaagttagaataggtgatctctgaggtctcttcacagctctgatatcctacacttctgtgatattttgtatatagctgtgatacacaccataggtgatgaagattc

SEQ ID NO: 190134 - DNA, 330 bp, Homo sapiens
ctgccgcgccccctccctctccagggccgcgcaggtgggggagccgggccgcccttatggccggaggcggggagccgccctctgctccgagcgcccgctcggtcctaggcacggccagttaagcagattgtgtgcggagcgacggggaaggggggggtcccaccagactctggaggctgcgtccaggtccctggatcggttcacaccagcctcctccacaggaagacctaagtgacccccaaaatccaggggattaagaagtacccccgaagttatggagcgcggtcccacttggggagactttttccagcaccaagtaaacgggggacc

SEQ ID NO: 190135 - DNA, 280 bp, Homo sapiens
tcatctattaatacatagggaaaaccaaagtgctatgtcctcaagtgccacattgataaatcaagtaatattagcctatttggggatttctgtgtaatcagatttgcccagagtccttttcatggtttattgttacttcttatgtatagtttatattttatgtatcaaaacagcacaatcacaagtgtgtagttaaggattaatatatgtagccactttaccataaaactcttacgtgtttactgtaaagaaatatcatttcatttcaactttatatgtt

SEQ ID NO: 190136 - DNA, 296 bp, Homo sapiens
caaccctaacattaagcaagaggatctttgtggagaatttactgttaatattgtttgcatatttacccaaacagcttgatataagggtttgtttttttgttgttgttgttcttaaattaccattttgagatctagaaatttttcccagcccaaataacaacaaaatcgtttactcattttaaaactttattgtttaaaaaaaccccactaacaaccctaaaatgaatgactccgtagttatttttaccttctttttatgaattccctcagctgaaattaggataatgttagtgttt

SEQ ID NO: 190137 - DNA, 700 bp, Homo sapiens
tgtggctttgcaggcttcagcccccatggctgctcccatgggctgggctggtgtggagtgcctgtagcctttccatactgagggtgcgagctgttggtgggcttatgaatctggggtctggaggatggtggcctcctgtgtgggggctccaagcccatattttccttctgcactgccatagtggaagtttcccaagaggctctgcctctgcaggaggcttctgcctggcaacagtgggtggtggtatgggcggtggttccttcaccaatggttaatcttcttgatgctgatctcctgatagtgggttctcttgagatctggttgtataacaggatgtagcacctccttcctctctctgtcttgctcctactcctgccatatgaaatatctcattgtcgcttggtcttctggtatagttaggagggccctgatcagtgtgggcctcgtcagtggacctagtcagttgggacttggtcagtgaggcctatttattgggggcgtggtcagcaggggtctgcttagagagggtctcattagggggatctagtagtggggtcttggtgagtggggacctagtggcagccacttgtttggtgtctggtcagtgtaaaactaggctgcaggactttgtcagtggagacctggtcagctggggcttagtggtggccttgtcagcatgagctgggtcactggtgaccag

SEQ ID NO: 190138 - DNA, 184 bp, Homo sapiens
tgtctgaatctttcacctagaccttgttccttgtgatgagtggggaggggcgtgtgtggggctcacaggctgctctgatgaggaatgatgccagcgcgttcttgatggcaagtggtgtccatgaatcagacttgcagatgtgcaagccacctggcttcaagcagtcagctctcttaagacattt

SEQ ID NO: 190139 - DNA, 309 bp, Homo sapiens
taaaggagccatcataaaaacatgatctcacccttacagatttgcagtttagttgggaagatgagatgtactcatatgaaatgtggaatactgagataggaaccctgagcttctggaaagcttgtgcatgggactagatttctctcctcccacactactacaaggacagcagagagagccatcgagacacttggtgccaatggaagtcccaggaggcttacttcccattgtcttctttttttcccgttaagggactctgagcacacgccccaatccacatgtccttcacacttccatagctcatatcag

SEQ ID NO: 190140 - DNA, 572 bp, Homo sapiens
ttctgtgagcgcccgcgggcgatcagcttcattgatccaaactccagaaggaagggaggagaacagaacacacataagtcccagataagcccaaacctcaccatggctgtgtgttccggctccttttctctttcctctccttccaaccacaaacagccaaaggcaggaaatagaagggcgggaaaggaaggaggcacagtcagccagtctagagaacagaagcaacgacaggattctcatagctatctgggacttggaaaacctcaatgacttgttctacatcaccctgtgctggattctgaacgtggagttaggaagtcacacaaacggaaatcaaaatcaatgcaaggagaggatatcctttcagcttctcggtacctgctcagcccgttacttctaagccttccaagcatttcaagcctcaggttacgaccatttttacaaggccactccctccctgaaggtttcatgaagaacacctgagggctctgtgggctaaaataggcccaatcacttctgacgggtctacaagagcgggccaggctctccttgatcgccagcggctttctctt

SEQ ID NO: 190141 - DNA, 172 bp, Homo sapiens
catccaatattatatctgacagacctactagggtaactataatttatcatccaaaccagaacagttttgagagtgaaacggggctctattcataattatgccagaacagcaaacataaactaggactatcccagaaaaattggaaagtatagacaacctaattatataaggg

SEQ ID NO: 190142 - DNA, 647 bp, Homo sapiens
gacaagcaaatgctgagagattttgtcaccaccaggcctgcgctgcaagagctcctgaaggaagcactaaacatggaaaggaacaactggtaccaaccactggcccaatttgggacaatttgagcaccaacatgcataaggaatgacactaatgaattataatgcattgaataaaaaaatgaatcccaggagtctacagtgataatttaaagaagtgtgtggtgggagtttctcttcagagaagcatgtcaagctacaaatggagaatggaagatagaactgtaaaatctcccttaattatgaagagtaagatatatctttaaaatggaaaaactgtagagacatcaagcggacaacttaggacagcaatactgggacaagctggcaccatgaacctctggaaccgatgcaacgggaaggccaccacctctcccatgtggtacttttgccaaaaatgtttgaccttaatctaataatgagtgaacaattgcacaaacctcacactgagggacattctacaaagtgactggcctgtactcttaacggatgataatgtcaagaaaaacaaagcaacagtaacaacaaaaaggccgggggctggtcattaaaagagataaaagagccaatgtccccagtaattaattttt

SEQ ID NO: 190143 - DNA, 326 bp, Homo sapiens
cttgtgttccctagagcacccagcacctcacctggtgctgagcagaaagtcactataggtctgctcactgagctaaactagtccactggtgcaaacaattcatccctttgggataatgtttttctgaaagttgtcaagcggaccaatgctaagggcagaaaattacttctctgggccgggcacggtggctcacgtctataatcccagcactttgacaaaatcaatttaaaaataccaaagcccagctaggcacaatggctcatacctacaatcccagcactttgggaggctgagtcaggagaatagcttacacccaggagaacgcg

SEQ ID NO: 190144 - DNA, 478 bp, Homo sapiens
tgataaattaatcttcaaaaagctttagttctctgttctttgtttcttatgaccaacttccttgtacttccttgtctcctagctacctgttctgtaaacaaccttctcgcctttgcggtgcttagatagacaagtccttctggcctagtaaaggacagtccctcttccttcccatctaatagaccctattcagtttaaaccttagcttagattgtgaagtccaacctcagccaatggggaaaggacacagaagtgctaggaactgcgttagggataaaacccctgccctcccccgctcagtgtgctcttgcagtcatgactggtgcaagctgcacctttctgcagaagtaaatttggcttgctgagaaatcttttgtttgagtgctcattttctttatgactctgagctcttatttctaacaccacctttccaggccaaaccaatgtacatcgtacacatattgattgatgtctcata

SEQ ID NO: 190145 - DNA, 168 bp, Homo sapiens
gcctgaagttagataaagcctttacagccattgatttatagaacatacagaagaatgggctaaacaataccataggaattcagtcagcaaaattcagcctgggaaactaccaggacaaaaattcaggacaaacaacctggctttttcaacataaaaattgcagttaaa

SEQ ID NO: 190146 - DNA, 364 bp, Homo sapiens
tgttttaaatcacagatggctgtttactgtataacctgtcctgcaccttgctttttcacttaatttgtcaagaatcatcccatatctgcacaccattcctaaagcaacacaattttccattatgatcattagctagttcccactgacgaggacctgcgctcctcccgaacctggccatcacaaatgcggctgcaagcagtgtccttgtttttaggtgtttctgcatatgtgtaattgtagccgtcagattgctgacatagatttgctggtcacagggtagtgcatctgtttgaaatgttggtggctgttgtcacactaccctttaaggtgatgtcaggctgtgctctgactagccatacatggg

SEQ ID NO: 190147 - DNA, 460 bp, Homo sapiens
ctcggtacccctccataatgtgtgcccactgcttcacgaccatgtgaaattacacacaaggatggttccaacaactttagctggaaaccagtctcgtacatcacggtttcattttttaacctttttttcttaaatttttagagatggcatctcattatttttcccaagctggactcgaactcctgggctcaaggaatctcctacctcagcctccccagtagctggcattacaggggtacaccaccatgcctggcttagtatgtgatgtttttatgtgtatttaaaaagactccttaacttcttctaagtgacctgtgtgtaggtgtgcctgtgtatgaactctgtccaaagtaatcaaagaacactcattacaaacaaactgctgtagcgccgtgtaatgatagtgggtccaggtcaccagcacacaccgatccaatctgctgtgccactcccatgcctg

SEQ ID NO: 190148 - DNA, 700 bp, Homo sapiens
  misc_feature (3)..(3): n is a, c, g, or t
  misc_feature (5)..(5): n is a, c, g, or t
  misc_feature (7)..(7): n is a, c, g, or t
  misc_feature (10)..(11): n is a, c, g, or t
ccnangngtnngcttctatcttgttggtattctgtctccctggtgcttctcatgtgctgagcttgatagagaaggtgacctggcaaggaactgaaggacatctggcaatgtactgagtgaggaactgaggcccacagtccagcagtctccaaggaatcaaatcccacaacagccatgtgagtgagcatggaagtagatcttccccggtcaagcccccagaaggacccagccctgcggacaccttgaccgaaacctgtgagagctccggaaatagaggaaccagcattccctctggaatacatcagcactgttgcctttgaggctggcctgcttgaatgcacacctgagctccggattcacagtggaggaagccagatgccatgtcatgagggtgctcaagcaactttttggagatgtatgtatggagagaaactgaggcctcctgccaacagccagcactaacttggcaagcatgtttgagagccacctgggaagtggagccttcagccccagttaagccttcagatgagactgcagtcctggccaccatctggactgcaacttcacaagagctcctaagccagagccatgcagatggattcttggcccccagaaattgtgccactacattttgggaaatttattatgcagccatagattaccaatacactcactatttcttttttctgatgccatacta

SEQ ID NO: 190149 - DNA, 623 bp, Homo sapiens
tgtgatttcatctggaattactggaatcacactgtctcctgtcagctttctctccctcccccggccctcctgctgatgagagacaggagcgatggatggtctgagttagcggggtcccggcaccacccagcgcaaaggcactgcactcacgcacgccatgcacatgctggctcacctcctccatcccatgcctcccctgtctccagcattccctctggaatacatcagcactgttgcctttgaggctggcctgcttgaatgcacacctgagctccggattcacagtggaggaagccagatgccatgtcatgagggtgctcaagcaactttttggagatgtatgtatggagagaaactgaggcctcctgccaacagccagcactaacttggcaagcatgtttgagagccacctgggaagtggagccttcagccccagttaagccttcagatgagactgcagtcctggccaccatctggactgcaacttcacaagagctcctaagccagagccatgcagatggattcttggcccccagaaattgtgccactacattttgggaaatttattatgcagccatagattaccaatacactcactatttcttttttctgatgccatacta

SEQ ID NO: 190150 - DNA, 627 bp, Homo sapiens
tgtgatttcatctggaattactggaatcacactgtctcctgtcagctttctctccctcccccggccctcctgctgatgagagacaggagcgatggatggtctgagttagcggggtcccggcaccacccagcgcaaaggcactgcactcacgcacgccatgcacatgctggctcacctcctccatcccatgcctcccctgtctccagcattccctctggaatacatcagcactgttgcctttgaggctggcctgcttgaatgcacacctgagctccggattcacagagtctcactctatcgccaggctggagtggtgcagtggcaagatctcggctcactacagtctccacctccagggttcaagccattctcttgcctcagcctcccaagtagctgggactacagttacacaccaccacatccagctaatttttgtatttttagtagagatggggtttcaccatgttgcccaggatggtctcgatctcctgacctcatgatctgcccaccttggcctcccaaagtgctgggattacaggcgtgagccaccgcacccagctgataaaaccatcttgaatgaccttcatcactgtgaacagtgatgcagtggctttataaactctagaa

SEQ ID NO: 190151 - DNA, 688 bp, Homo sapiens
ccacaccttcttgtttccaaacatgacaagctcactcccacctctaggcctttgtccttgcagatcttctccctgggaggctctttccaaagactttgacagcatctacttgtcacatcattctggccttctggcactctttgtggtggttttaaaatatgtcattacattctttgacactcctcccttcaaaaggcaatgattcattcccctctccttgagtgtgggctggactttttgacttgctcttggagaatagaatgtggtggagagggatggtgtgtgacctctgagattaggtcataagtgaaatttcggcctcccccagcaatttcttggatgattcacagtggaggaagccagatgccatgtcatgagggtgctcaagcaactttttggagatgtatgtatggagagaaactgaggcctcctgccaacagccagcactaacttggcaagcatgtttgagagccacctgggaagtggagccttcagccccagttaagccttcagatgagactgcagtcctggccaccatctggactgcaacttcacaagagctcctaagccagagccatgcagatggattcttggcccccagaaattgtgccactacattttgggaaatttattatgcagccatagattaccaatacactcactatttcttttttctgatgccatacta

SEQ ID NO: 190152 - DNA, 570 bp, Homo sapiens
ctagaattaaatatgaaaagactctccaaatcatagaactcagttgagtcacacagtcacatacggaagagtttttcaatcttggcactattactgttttggaatggctgactctttgttgtggggagctatcctgtgcatttaaagatgctttgcacaatcattggcctctgcacaccagataccagtagcatctcacaacccaaggttatggcaaccaaaatatcttccagacattgctaaatgtcccctcaaggcaaaatcactccctgttgaggaccatggatatacagtatattaaaattactggtctagtgtgtggcttatgcctgtaattccaacactttgagaagccaagggcaggaggatcacttgagcccaggagttcaagaccagcataagtaacgtagtgagaccccatctccacaaaaaagttttaaaaaaattagccaggcatggtggcacacgcccgcaatcccaaccacttgggaagctgaggcaggaggatcgcttgagcctgggaggtcaagactgcaatgagtgccactgcatcccagcctgggttacaaa

SEQ ID NO: 190153 - DNA, 148 bp, Homo sapiens
ctagcagggagaaaacacctgacataaaccagtaaagcaagtgagctagataatttcagagaggatgacattcaagaaggaaagacaccatgtaaaataacagagaggttgggagtttgtgacatcatgtttttatcttctcaccact

SEQ ID NO: 190154 - DNA, 370 bp, Homo sapiens
aggagagaccccagggacacagaaaaacctcctgtctgtcccaggggggattgcgaaagccatctttctggaaggaaggtggctttaaggactggatgaacttctttagagaatttggctgaagccctcataaggcccctctggagaccctcccagtttcccccttgcatggcgagggctgtctgaggagctggtggacctgttcctctttcagcttggtggttgggaaagggctgccactaagcaagagggttggctttgattggtccccttaaataaatccccaggttaaagctggcagcaagataggaaggttcacctacccaggtgggaggcctgacagggtcctcagtagcaggcagcgtgaggc

SEQ ID NO: 190155 - DNA, 227 bp, Homo sapiens
gttggacctagataaactgggacagctgggctgagcttgttctcattcaatctggaaaaggtgaagttgattgagctctaacttgccattccttttagatgggaaagggggaagagagggcatctggaaatcccaggagtcttgggctgaaggcagccattctgttctcacctttagaggagacagaggcttagaagcaggtagggggctggggtggggggcaggag

SEQ ID NO: 190156 - DNA, 232 bp, Homo sapiens
gtgaagttttactgatagttattacaatgttaactagactccacatactttttaaatcaaagcatatttttaaaattgttaatttaatggtgggttgatgttctttcttaataccttttcattttctttttggcaacattttactttccagacgtggattagtcgctatcaaaattttattcctaaaatgtttggaaagtggaaatagctgtggaaactgtgaatagtcagt

SEQ ID NO: 190157 - DNA, 240 bp, Homo sapiens
gggtacaaacgagtcctggccttgtctgtggagacggattacaccttcccactcttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagca

SEQ ID NO: 190158 - DNA, 438 bp, Homo sapiens
gtatcatagaatcttaaaaattatttgattcaagtgtatacataattttcatatccctgatagatattgccaaatatttaccagaagtgaatcaagtagtttttctaccaacattatctaagagggcttgtctttttacatctttgtcagcactaagtattatctcccttacttttttttttttttggtaatctttgttactttgttaggattaaagtagcttctcattttaattttcactcctttaattgagaagcagaacgtattcttttttggtgacttgtttcagagtctctttagtttgaagatacaatagatgtagcatctgctatatccggtaacaggataacagtgcattgctgggatgatgaggctgcagtgggctgtgattgtgccactgcattttcagcctgggtgacagaggaagaccctattaca

SEQ ID NO: 190159 - DNA, 305 bp, Homo sapiens
gtccctctacataggctattctataacaaattattttgctgtcttgatttttcagagacctcatgctagtagtagagagccaggagaaagtgagatgtcctatataaaaggcctgctagaaaaagaaatcagcactgagttctaaggatactgaacaactttttaaaaaataaagcaagccatattaaacacattagttacaaccaaattagataaaacaatgaaaattatccaagaagaaaaagtacatcaactgtctaggtttaaaattgtttaaggctgccatccaaggaccatctatgata

SEQ ID NO: 190160 - DNA, 424 bp, Homo sapiens
cccagggtactgtaaaagggaagacagggttggaagacaccagaagggccagacagggagagattgctggccttatggagttaaccgaacagagttcatacgaagatgagtaagaagcagagcctctgctgcattttgtgactccacagggacaaagagtaaggagaccagagtggaaaaaaaaagtgagggaaaggaaaaaggacattacagagaacatgataaggctgagtataggaatctgggatgaaatgaaaataattctaagggataggagggaactacaaaaaagggcaaaagcacagaaaaggtaagtggtcacctgatgcagtcaagtgcatatatttcatatatgtatgttcagtctaaaactgggaaaccaaccaatgcccaaccaactagtcagccaaccacacacatttct

SEQ ID NO: 190161 - DNA, 737 bp, Homo sapiens
gtaaaaatgggccgggcacggtggtgcagtggctcatgcctgtaatcccagcactttgggaggccgagtcgggcagatcacctgaggtcaggcgttcgagaccagcctggccaacatggtgaaaccccatctctactaaaaatacaaaaattagctgggtgtggtggcaggtgcctgtagtcccagctattcgggaggctgaggcaggagaattgctcgaacccgggaggtggaggttgcagtgagccgagatggcgccactgcactccagcctgggcaacaagagcaaaactccgtctcaaaaaaacaaacaaacaaacaaacaaacagaaacatataaaaacgtttgcgtcagcacagaaagcaggcgtggcccaacctagagtgagtggcatacgctgggagagccagagactctattctagcaaaatgcttcggttttccttccattacttcccttctcctgcccagcagtgcctggaaactgaggctcagggagctttcctactggccaggagttgtctggcctgtcctatacttgtaatggggtgagttggggaatgagttttggacccaggaccagagggcctcctgggcagacaggcctaccctggagtttgattgatggttctctgtgcctccctgaccactgatttgattaggtctctgggtctcggccttgctgacctatgcctcttgggagctcagacgccatggtctgggtgtctaaccaaggc

SEQ ID NO: 190162 - DNA, 699 bp, Homo sapiens
ctgggagtcatactgaggtgcctgcacatcaaacaccagcgtctaagctatagacaaatgcagagccatgtgcaggcctgaatgtcattcaccaccgcaaacctcaaacggacacacagcactgcctgagcctcccactgcttttctctgctgtgtcactctcccttagagtagtaataatgtccaccttctctgtctttgaaacctacctaccttgtcagctggccttgtgcttcatagagaatacagaagtaatcttgcagaaacccgtctttcccctcagtacccacatctccaacacatcatccatctctctgtgcttgctggatcattccctccggctcagaacatgcaccatcatccgtaccatttttgtttttgttttttaaagagacaaggtctggctttgttgcccaggctggagtgcaatgacacaatcatggctcaatgcagccttgacctcctgggctcaagtaatcttcccacttcagcctccaaagtagttggaattacaggtgcataccaccatgcccagctaattttattttctactgtggtccatcaggttatacagaggtctcactatgttgcccaggctgatcttgaactcatggactcaagtgagtccacctgcctcagccttccaaggtgttgggattgcaggtgtgagccaccgtgcctgccaggaagagtgttttg

SEQ ID NO: 190163 - DNA, 489 bp, Homo sapiens
gtgtccatcccccttcgtgtgtccatcccccttcgtgtgtccatcccccttcgtgtgtccatcccccttcgtgtgtccatcccccttcgtgtgtccatcccccttcgggcttgctggatcattccctccggctcagaacatgcaccatcatccgtaccatttttgtttttgttttttaaagagacaaggtctggctttgttgcccaggctggagtgcaatgacacaatcatggctcaatgcagccttgacctcctgggctcaagtaatcttcccacttcagcctccaaagtagttggaattacaggtgcataccaccatgcccagctaattttattttctactgtggtccatcaggttatacagaggtctcactatgttgcccaggctgatcttgaactcatggactcaagtgagtccacctgcctcagccttccaaggtgttgggattgcaggtgtgagccaccgtgcctgccaggaagagtgttttg

SEQ ID NO: 190164 - DNA, 403 bp, Homo sapiens
acgggaatactgatcatgggtgattgctatacccggtttattgatagttgtgtgtgagtgtgaatgacttgtggtagtagcctaggatgtttgttgagccaatgaatataattagagatataagtattagtgatcaggtttggcctttttggttgtgaatagctattatttgtttggatgttagttggattaatcattgttggatcgagattggaaatactggtttttatgttttctaagaatcgatgtgggaaatgtgtatcagttttcttgtttcttttcctgtgtaaaaattgtgatttagtgtctcaagtatattttttatttatttggtttttgaggtggaacatagatgaaactgaaggaagcttatagctctatttatagagtcactctaagatta

SEQ ID NO: 190165 - DNA, 678 bp, Homo sapiens
ttatgagtgcctaggaacaccaaaaggaacatgtttatataataacactcagtacaaagtatgtaatccagaaagtgatcagcctgatgtgtgttatgacccctctgatcctcccatgatcacggtatttgaaataagactaaggactggcccttttctaggtgacacaagtaaagtaatagctagaacagaagaaagaggggtccccaaacatgtaaccctaaaattcgacacttgtgccactattaatagtaatcagcaaggaataagatgcggttctctagattgggaaaagagttacacagcagaaaataagtatatctgccatgaatcatattcatgtacaaatgtgtgtcaatactggtcttgtgtcatctgggctacttggaaaaaagatgaataagatcttgtttggctccaaaaaggaaaaagcagcccctcctgcacaagtggaagctgcaaccctttagaattaataattacaaatccttcagacccaaagtgggaaaaaggagagcacgtatctctaggcattgatggaaaaggacaagatcctagaataaatatcttaataaaaggagaggttcgaaaacgctctctagagccagtatttcagactttctatgatgaactaaatgtgccagtacctgagattccaggaaaaactagaaatttgtt

SEQ ID NO: 190166 - DNA, 573 bp, Homo sapiens
ctatagttaacatttatataccaaaaacttcaaattccttcagctatgagctgttactatcttgtgcttagcgtcaggcctgggatgctggagagttttctccttgttgctgctccactcagtcccagcaggccccaacaggaggtttctctccatgctcttccccaccacctgccgaccgttggtgctctttccacagcgtaaggcttggcagaagtagggaggcattcgctccatgatttttaaaaatacgcacacataaaatatctctgttctagacccacatttcattgttaacttgacctagacccacatttcattgttaacttgactggctaaaaagactccaggttagggataattttgactcagaattttcaaggcattattccttttttccccgagggttgctattgagaagtctgatgccgttaagattcttcagattttttatgagaccccttttctccgtggacacttgtagaatctttcctttatccccagcattatgacatttcaagataatgtggcttggtatggctttcttttgctatcctttttgctgaagactca

SEQ ID NO: 190167 - DNA, 645 bp, Homo sapiens
ctgtttattacatatatacacactattttgggagtttgattcctcccataagatcagggtgaaacattctgcccttggtttatatgcagagcagtttacaaaagtggggtgaatgcactgctggctgctcctgctgcgggccggagacagagtgaggctggctggggaggaagtgtcgtttagggtgaaagtgagaaaagctgggaagaagcaaaatttcttttttttttcaaaaccatatgactgtcaccagtgttgtaaaaaaaaggtcaaatacacagttttaaagattcagtaaacattgcacacagcaagtattcagtgtaaaaaaaaaaaaaaaagcacgcaccaacatttaagtttgtctgaaggtttaaattacatgtatcatacatataagcctgttgttgaaccaggagaccagaggctcaaaagcattgcattctttcttgtttgggacattggtacaagagaaatgaaaaatcccaactgcatagaaatctaggaaatgtatagacaaagaaacaaaatacctttcctttcctcccctccacaccccatgactccccacacttgagtgtattaagtaggcaagctttactcgtttcagtctgcagaatccaacgtatcattagaaggggggag

SEQ ID NO: 190168 - DNA, 317 bp, Homo sapiens
tattacctgaatgttctttttagcatttaaataatccatttttagtaggcatttgtattgcttttttccatttcaggtagcatctaaagtgaatgtcccttgcatgtatactattcatatgtgacttaataagtagagcttgctaaatgggtaggaacttacaggaaaaggggaaactctagtttgagaaaattgtctgggctaagtttaggatgtgttcaacaaacaggaaagtcaagtttggctaaagcatggttgagtaatagtgggaaatatggtcagaaagtaggtatgttaggactctttctactgaaatg

SEQ ID NO: 190169 - DNA, 333 bp, Homo sapiens
tacatagtgaagtgactgaaatgctaaatcagaaatacaagtaacattaacttcaaatggaaatgataatgattctaatccttctaagagtaatctcaaattctacctgttccttagactattaataagatgagatgggctaaattgtttttctgaaacactgaaagtaattatctccttgatttcttttgagttacaggaagattttaaaaacatttttcttgactgggtgcagtggcttatacctgtaatcccagcactttgagaggctgaggcaggagtattgcttgagcccaggagtttgagactggcctcggcaacatagactcagtc

SEQ ID NO: 190170 - DNA, 417 bp, Homo sapiens
acaagaatagctaaaattaaaagaagtcagtcaccactgaatgttggtgaaaataggaagcagctgaaactctcttacatggctggtggaagtgtaaaatggtaccattcctgtggaaaactaattgacagtttcttagaaaaaacactcaccctatgagcaagcactcctagttatttacccaggagaaatgtccacaaataggctggcacaagaatgcttatagcagctttattcagaatgaccaaaaactgaaaacaactccccaacattcatcaagagaagtgataaataaattgaggtatattcatacaatagaaagtacacagggacagaaaagaatggatttctgatacatgcgacaacacgaatatcaaaaacagtatgctgaattaaggaaaaagacaacaaaagtaa

SEQ ID NO: 190171 - DNA, 208 bp, Homo sapiens
ctcggtatgtcatctccagctctaaccattttgtcccgacactggctctccctctaccttctgtccttgtctgccactggtctcccgtgctctggggtctctgcactgctggctgcctcccgcttctctcccctctccctctgccgtcctgtctcctttgcccagtctctccttgtttctcttctcctccttccttctctccacctcc

SEQ ID NO: 190172 - DNA, 322 bp, Homo sapiens
ctttcaggacctaactaactaggaataaaccatcctaaccatgagagatcagatgaaacttgagaccagagattcattttcttctaaaatgctttctccaaatgattttaaaaaagaaaagtggggaaatgtgaaaggaaaatatcttgggctccttctagctgggaactgttcagggcaaacctgcctcccattctattcaaagtcatccctctgctcacagagatagatgcatattccgattgcctcctttggaagtctcatcagaaactcaaaagaatgcaaccatttgtctctcacctatctgtgacctggaagcccc

SEQ ID NO: 190173 - DNA, 382 bp, Homo sapiens
ggtcccaagtttacagaaactgacagtgaatgtgtgtccttagacaagggcagactctttgtgtttccctgtgtgcccctccggtcatgctgcctcccagcacttctgtgggggaaaagccagccctcatttctctgatgaaatggttttacctagaaccttcttcttagctggtgggtttcaggacggaaaccccagtgaatgttgatgaggatgccagagaatgacgactgtcacctgcggtgaatggttgttgctttatgggacactcgccgagaatgcatcacattcttaacacggagttcatgggaaaatggaaagtgcaagcaaaagttactggcatttctcctggggtagaggctgcattaggattcctggggag

SEQ ID NO: 190174 - DNA, 472 bp, Homo sapiens
catttttgcttggtcatggcatactggcagacttacatggaaggtccctaacttataaaggtttgactcaggatttttccactttctgatggtgagaaagcaatatgcattcagtagaaactgtactttgaattttcatctttcccccggctagcaatatgctatatcaatactctctcaagatggtggcactctctctcaatagtggcaatgagccataggtcccagacagccacatgatcatgaagttaaaacaaactggtactcaacagtatactgtgtggccagatgatttttgcccaactaatgtaaatgttctgaatacttaaatattaagtgctaagttcaatgtttggtaggttaggtattttgaatgtatttcaatgtacgatattttcagcttatgatggttttattgggatgtaactccatcacaagtcgaggagcatctgtactctactgaccaaagctt

SEQ ID NO: 190175 - DNA, 301 bp, Homo sapiens
agcatgtttcgtatgctcgctcatctgatcagcgtagtaactctgcagtacaagcaccgttatccccagtgtacagaagaggagactgaggtcaagagagcttgaccaacctgcccaaagtcacagagacggctgttctggatctggactcccagtttcgggatctttgatttcaacatcaaagactagagtaggattcctagttgaagatatccatgttgtacccaaacaccacgtttcttcccagaggagaggcctgcagggagactccgagattcagagagtggtgggtggccttgga

SEQ ID NO: 190176 - DNA, 689 bp, Homo sapiens
ccctctcaggggaagaagccttggaaaaggcagcaacaaataaacatcaggcctctgtacataaggctttctaaaagttgttccaaatggttttgtttgctaccccactgtttccagggcaaccacctaagccaggacagaagtagaaggagacatgaggctagaatgggaccacccactgcaattctcatttttatcctgatggcaagaacctttatatcgactcaaagtgtttgtcaggcctctggctgtgaatcactggaataacattttgccctgatggaagtgtgtcacaggctgctgctcccacatcccccccatactgaggtgtttttaaatggaaccaaatatcccaggggaattttctctgcactactagcattgctttgttgcacatttttagattacacactgtaaattatagctgaagaaaatacagtatgctaatttcctcctgcatgtctttgagttatttttaggaaaagtgtctttggaattcagcttctcaggtaaatgtttaaaatgaagagaataataagactaaggcagagggatgctccaggctcagaccacagctgtatcacagtctggcagtttgtaatgagcacaacttgcacgtccagcatggatttcagctgccaatagtggaagaagctctggactgggcatcagtagatttgggtgtgcat

SEQ ID NO: 190177 - DNA, 723 bp, Homo sapiens
ctgggagctgtagaccggagctgttcctattcggccatcttggctcctccctcagcttaccttcactaatcttggctacattcactaatgcgtcgttggtcacctgtggactggcttaggctaattcctttatgacatctgcctttgagaaagctgaagcatctgtggcctctctccatatgatcactcatacttcaacaagctagcccagacttgctcacgtaatgcttgctgagttccaagatcaagaatattagaatacaaagcttcttatggcccatgttcagtactcacaaatgtttgttgcagtctacttgtgaaagcgaatcacaagaccaacacagatacaacggaaggggaaacacaccattcttcttgatgagaagggctgcaaataaactcactcacttttacagttttgacactcagaacttagtgtgattacgacataatttaacacagggacaacaataatcagagatgactgtgtagttatacaaagtcattatgggttttgttgcctttaagaatgtttcactttatcaacaggatggcaccaagagattagtaatatgtatgctttcattaaataataattgtgttatctcgttaatttatcctatgatcagaagatcatcatttaaccttaaaattggtatgggtagtccaggagctgatgatagccttttcatgtttgatccaccaagctaaatgtcgggatta

SEQ ID NO: 190178 - DNA, 1152 bp, Homo sapiens
tgctgggattataggcgtaagccactgcacccggcctaaaaaccgttttctagggttcttttaatgtgttttttagatattcactgcctccttttctaatcagtgggcagaaataagtgggttgaggtatcaaaagaaaggtattccaggtgtagaggacagaggaaataaagccttgaggtggaaatggaatgaagaaatcagaacacttgtctgaataagaagaaaacaaacaggaagtgagttagctgttttggtgatgaattccgaagtcaaaggtaagaaacttgggctgtacctttctcaagtcacttggtaaatagggccttactctaaggacagtgcagataaagaataggggacggtaagacagcacatagcctcatgtggaaactcactgatattcaggatacagcagtccttgtttcactcagctctacttcagtgccttggtgtctgattctttctctctgctttttgttctgactctgctaccatctgactgccctctttgccatcctggccccctcctggcctctgcatattcccatgagcagtggtgtgggattctctactcttctgttctttcatcattcccttgctctcacttcaccagtggcttctcatgtcactgagaatgaaattcagagtccttactgaggcctagtagcttctgcaggacctggcccctgctccctttctttctggtctcagttcatacacctttccacctttgctcacagtgtcccagccacattgaccggcctgttcttcctcacacccacctaacactcagaacctttgtactcgctgtttactcgaccgcaccttctctccttttttagtccttgcttccctcctctgtttaggcctctatcaaatgtcacctcctcagagaaccttccctgaccaccctaaggtgggatttcccatcctgatactcttatctgcttctcttattttattatcaggctttcttgtacatgacattattataatatgaatttattttgcatttggttattgtctgtcttccactgcaatgtaaactacttgaagcccagcttgatttgttatatttactgtagtgtcctccatgcctggaatggtacctggtacatggtgggcacttaatactgttgaatgcacgta

SEQ ID NO: 190179 - DNA, 703 bp, Homo sapiens
ctgaattataattaggcaacatttccacttttatatcaaaaactacactaaagtgtgattctaaaacgtgactttttaaactctctttagtgaatctgctcataatgaaagtgtaaattattttttatttaaaaatttagttatcatttgagaattggttaatttgtttttatttttctaatagtaaatatatgaggaagacatatatatttttaccaggttgatatgggtagaattatctcactttttgcaaaatattacaaaatactgtgtatgtgctgtatttttataaatagaatcatgttggatgaaatattggtcataatatagtttattgttcgagtttgaaggcaaataaacaaaaagtaagtattgagtttatttaaaatgcccattaataatgtagttcttattttttaactttttaaaatgttcaaggattatttttaattgtatttttatttattttccaaactcctaatatgtacggttatacatttttttcttttttaaacaaatgcttggtttgatcagtaggaaaaacagatcttcattctttatatttggaaaagttatttttcatttattttagcttttaaatagtgagtgtagtagtcacaggtcaaacatgaaagagggggcaccctcaaattagaacaatttgagtaaggttgaattaagtgactatttaaaatgtaggtaa

SEQ ID NO: 190180 - DNA, 362 bp, Homo sapiens
tgaaaagatggaaaacttctagtagacaggtacacacaaacataactagtacttgtgaaggcatgaaaaaaaaatttatataccgccaatggggtatagatacgcagattttgtcagtggtaaaatttcacataatctactaaaattgaaaatgaatctacccattgaaccagcaattctactccaattttaaacctacctactagaatctagcaaaatatttagaggattgacatttaattttaaaagtttggtataaattttaaacacatttctatgtatgatacataatatttggtgacttgctgtttttttttgtttttgttttttgttttgaaacagtctcgctttgtcacccaggc

SEQ ID NO: 190181 - DNA, 166 bp, Homo sapiens
cttcgttcctggctgatcctacaagccaatatcccccaccaatgtatccctcccagccttctcctcaccccacgggagggaagaagcatggccccctctgagaagctgatgcaagttatgagcaatttctgcaggaaaatacaacgtcagaaagttcacagacccc

SEQ ID NO: 190182 - DNA, 242 bp, Homo sapiens
acacacgccctttttactcagggacttcacttaaatattcgttttatgggaagaaactttttaaagccacagacaattacttaagagtttgggacaacagcagtatccgtggctggggctgggagggggcaggattttagtctttctgaccttgtacatgatttatctaaataatccattcatttcatcctggttcctgcctccggcttgtatttactcagagcagtgtagaagaatctatt

SEQ ID NO: 190183 - DNA, 310 bp, Homo sapiens
agtatagactcaattcatgaattcattcaacaaatattgtttgagaatctgttctatgcctggcagtattctaggactggggatccagcaatgaagactaaagactatcattacagagcttatagtctaatgagagagagagacacagtaaaacaaaatagataatgtccatgtgttaagctttaaagagtaataaagctgggtaaatagataaggagcaacagagaatgactagggaaagaagtggaggcaggattttttttcttttgtgtgtgtgtgtgtgtgtgtgtgtgtgtgtgtgtgtgtgtgt

SEQ ID NO: 190184 - DNA, 415 bp, Homo sapiens
aggtaagtcactcaacagatctagaacaagactggatacagaacttttctccagtctgagaaaaaaatgaactggggtagccacctcacagtaggtttggtttcttagaagccaaatgtgatgaacctagtgaaccatttcaatgatgttttggtgatggcctgcaaaacaattaatcattgaagtatataagtaaactgctaaaatcataatctagtatgcatatattgtaaacttttagaaaaaaatgaaatttacagtttgaagattttcagctttcttgctcccatccaaaacttctttcccaatagcggttttatgaaatttttgtgtcaatacagagagctagcaccttattttttagagtggcattgacccaagtccacccaaatataaaataatactcccttctcaa

SEQ ID NO: 190185 - DNA, 341 bp, Homo sapiens
tgatgtaggatgaaaagtggataatcactagagccatgtccttgagtagatgagaagagaaagaatctacaagagaagagactggatttggtgaagaatggtactatctttaataacagatggaaaggcagagcatgtgggtttacatgctggtaattgtggtgatgggagtctgtgcacatttttggaaaatcaagaagccaggatatcagctgagagtattgttgggggagagaattttggatgtttaagaagtgaaggattcaattcaaggcttcagcatccttctctgtctatatcagtatattgtagaaataacatgattttctatctgtatcatg

SEQ ID NO: 190186 - DNA, 539 bp, Homo sapiens
tatgggcatttttgaaaacaataggccaatcagcttgctactggtggtgcctaacaactgaatgtgataccagtagagttagccagtgtaatggagaggtcaggaaaagagacaaagaaaggtctgctaaatctattgccatctcaggggaataatgcacatggccaaagttatgcctctgaagaatggcatcagagttgtataaagcaggggaaatgagtaaacaataatcacaagcttcaagacaagctgggggtcattattcaaagttgttacaatctattactttaaatgtccagttttcaaccaaaattatgagacatgctaaaaaataagaaagtgtcactcttatacaggaagaaaagtaggcaacaagaactgcctttggaaggctgagatagcaaacctaaaaaacaaagacttcaaggcaggtattgtaagtatgctcaaaaaactaaaagaaagcatgtttagagaagtgaagaaaggtatgatgacaatgtctcaccaaacagattataccaataaaaagttatttc

SEQ ID NO: 190187 - DNA, 359 bp, Homo sapiens
ctagtcttctggaattatcttactgcgcaattatatggcttcctacattaaggagtgtttgcagtccagcacactctgcaggggaaaaaaggtgtggtgtggcagaaagaacacaagttttgcagttaagatagttgttaaattcagatccaaggtttgtcacctttctcgctggtggccttgggagagtggcaatctgaacctcagtctcctcttctgaggaataaggctgccacacagggatgttgggagatcagtgatagcccacataaagcacctagcccagtaaaatggtctctacttttcacgccaagctgcctatacctcctctcacccaacatatccacatgctgaccaca

SEQ ID NO: 190188 - DNA, 201 bp, Homo sapiens
aatctgagtgcccaagagccactctaggtcatctaaggcctctctcctcatggagggtttgctgtcacagcccagggcaggcagggccattgcgctgtgcccggagcttcctgaggagcaggcaactactgtgtaaatggagaagcactgaggctctcgcaggggcccttgggccagacaggctcggccccagatcctccc

SEQ ID NO: 190189 - DNA, 317 bp, Homo sapiens
aaaaaaggagagagaggtggaaagtccgcaggtgaagcccagggagaaacttactgaagggggtgattggttgcaccagcctctgctgggaggtcagtcctaatgcctgagagtagacggaggtgctaagcaacaggttgcagtgggatggttcagagcaattttgggggaagtggtggggaccagagtggaatagtgggctcaagagacaatgagaaaggcaagtgattgaatctgccaaggaccaagcaccaaagtgccagctcactgccaccctcagtaaagactaacttgccctttcccccaactcccctccc

SEQ ID NO: 190190 - DNA, 422 bp, Homo sapiens
tctgtatctcagatccctcatttgtaaacatgcaaaataactatctctcatgagataaggcttaattaagtaaaaatagttcatgtaacgcatttagggcattatctggtttacgcttagtaaatgttgattcttaattatcatgattattaaaagaggtcctgataaaggaattaaggttatttctgaggaagacactacttcagtgaacaggagaacatgggcataatcggtaagatttcttcggaaaaggtaaggcttgacttatgccttgaaaagtaaacatgcagtcacataaagagaaaattataagcaaaggcaccaatatcagggaaatataaagaacttaaaaagaaagcaaaagaaaatagggttgaaaagtcagccaggatcataccatacaataggatcttgaatgaccc

SEQ ID NO: 190191 - DNA, 345 bp, Homo sapiens
aaagatacacaacagaacaacagattcctcccaactctgtacaaataccagacattcatctctggggcaaaaaaatgcaggttaattctagaaataaactggccacgaaataaagacttccactcttctattagtggtatctggagcctctccaggaaaataatcacatctctacctgattactctaagtggaatctaatgagcaatccccactgcagagaaagcatccactaagcattttatttaatgcttcactgtgaaagactaaacaaccaacaagattaagaaatatctacataatgaaagaccaaaccaaaaaataaaagaacttggagggaaaagaga

SEQ ID NO: 190192 - DNA, 625 bp, Homo sapiens
tagattatcccgttaatcccgtacactggaatattattcagccttacaacggagggggaatcctgacacatgctccaacaggatgaaccttgataacattacactgggtgaaataagccagataccaaatgacaaatactgtaagattccacttatacgaggttcctagagtagtcagatccagagacaaagcagaatgatggttgttaggggctggggacagcagggaaggatggagagttactgtttaatgggtatagagtttaagtttgagaagataaaaacattctggagatggatggtgctgatggttgcacaagaatgtgagtatcactgaactctacacttaagagtttttagtttttagttttagctgggtttggggtcccaggcctcaggcttcacctgctgcctcaggatctccagggccctcccagatcacagacctaacagatcttaggacaattggcccagggtcatcagcgcaattgatgcagctccctccctctcttgtaggacattttcatggatgttggcatttggtatcagagcagctgaagttattatgcatttacagggtatgtatcaatgtagataggggtagggattaacgcgggtcccgggc

SEQ ID NO: 190193 - DNA, 150 bp, Homo sapiens
ggtacccgtcctctgatccagtcatgatcataatgttaaataaataaagcaaataagtgaccccgtattgtgatttttctagggtgagcccatttcctctattcaaaaaaaaatggctgggtgcggtggctcatgcctgtaatcccagca

SEQ ID NO: 190194 - DNA, 170 bp, Homo sapiens
tcaaaattggacgtctgtctgtccccctcccaagatgaaggggtcagaaaccggctgggaaggggggattctccaaagggtgagccgggctggcccatccatctctcatttctatggaaagaggctgcacattagccccacaacgtgaccctcctttttaacactgagtg

SEQ ID NO: 190195 - DNA, 625 bp, Homo sapiens
tgctattatcctcacactggaggttaggctttcaacacatgaatctgaggctaagggaacacttttagtccacagcgcttggggatctcaaccagtctgtggtttaaataccatccatatgtctttcctttacttcccatgtaatcctttaatcctatttattccacctccaaaacatattctagctctatttgctttcatcttccctagtaaacactagtccaagccactgttaccaaggtctgtctcctgtctgtcctcatcaatttcacttttcttacagcactcaaagtgatctttcatgatgtaaatcagatcctgccactcccttgcttaaaatcctctcagggaggctgggtgcgctggctcatacctgtaatcccagcactttgggaggccgaggcaggcggatcacgaggtcaggagatcgagaccatcctggctaacatggtgaaaccccgtctctactaaaaaaatacaaaaaattagccgggcgtggtggccagcgcctgtagtcccagctacttgggaggctgaggcaggagaatgacatgaacccgggaggcggagcttgcagagagccgagatcataccactgcacttcagcctgggccacagagtgaga

SEQ ID NO: 190196 - DNA, 408 bp, Homo sapiens
gacttcaaagtcaggttcccattgagcaggaacactgcatggggtagggcaggagaaacctcaggtcccagctccacactgctcactgactgagcttgagcgagtcacactacccctttgggcttcctgtctattttaaagtgaggagcttggaatagatttttgtgggtctacctgatacaattatcatatcacacccacggtttggtggctcactgctggggatacagcctcaggaggctttaaaagtgaatggcaaccgcctgcagtggttcctacccttaatcccagcaatttgggagttcaaagcaggaggatcgcttaagcctaggagttggaggctacagtgagttatgattacaacactgcactccagcctgggagacagaccctgtctcttaaggttcc

SEQ ID NO: 190197 - DNA, 563 bp, Homo sapiens
agggggagatgtaatcggtatgaagggcaggaggaagatgatgagctcagtttggggcatgcatttgggatgccagggggccttcaggtacagatgtctaccacctgctgtgatggggacttgggaaaatgctaacaattggaatcaccactatgagaaatgagactgaaagtgattagaagcatgaagaaagaggctgtgaggcccatgggtggtgaaagccattacaactgatggcagcatagacagggaacctcctttatgacgagactgtcactggcactttattaaagaccatcattctatagtcagaagttcagaccatgttcacaaaacacatgaagccaggatgattatttttggaatgcaatgaaaagattaaatgaaaacataaaactattttatgagcataatatactactttgtttagaaaaatatatactgcttgtttgttactagtatgaaggttgctaaatagagactagacactatctagactctaggtgttaatttttttccattccaaaacaaagtaattcacaaaaacgtgcactattcattca

SEQ ID NO: 190198 - DNA, 312 bp, Homo sapiens
tccaccccagtcctacaaattagagttgctctgacttgtacaatgatggaaataaatctgtctgcaagcagggcactatttactcttcagattctttaatcacatctggctcctgcaagttcaattccacttgtcaatttctagatatgtagggaaatagggaagatgtagataatctgataatgacagcattgaactgtgttatattatcagttacttttcctagccttttgttgacatctggtagactccacacatatagcacttttcaaatgttgcaacatgtcaaattcctaacatcaaaatttatat

SEQ ID NO: 190199 - DNA, 168 bp, Homo sapiens
gcaaatcaaccatactgctacttcccagattaaatatctattatgatgttgcctttttagcttccatattcttaaaagatataaaacatcggttatagttgaagttctttttaaacactgtccttattcccattctcttcttctcccacaaccccaatcagaaacaag

SEQ ID NO: 190200 - DNA, 462 bp, Homo sapiens
catcattatcttttctacaaaaaagaaagacgaggcactgggtgcataattaacctgccccagacacgcagccagttagtggtgaagctggagccccccccggagccttcacatcactgccctgctctccagccaaccgtggaacgaaacaagaaggcagacaacgtccacggacggctcgccctgtgtttattatagtgtttgcaaatctgaataactgagcacattcctgacaaccctgactactgaaatgaaggcaaagagatgggatgaaaaatgggtactttggatcaaaacaacccccgatttatgtaaatgtaactctaacttttggacaggtggcaggtttgagactgggaagctggattccctctggactgggggtgcctctggcgacaacactcctgaggaaggctcaagcagaggaattttttaaaatgaatgaataaatgagctcttctc

SEQ ID NO: 190201 - DNA, 145 bp, Homo sapiens
ctagccctactagtctcaatctccaacacgtatggcctagactacgtacataacctaagcctactccaatgctaaaactaattgtcccaacaattatattactaccactgacatgactctccaaaaaacacataatttgaatcaa

SEQ ID NO: 190202 - DNA, 223 bp, Homo sapiens
  misc_feature (190)..(191): n is a, c, g, or t
  misc_feature (207)..(207): n is a, c, g, or t
gcttagggaggcagagaggagtttggagacaagggagatcatgattcctcttccctgtgttccgagttaaccaggataaccctgcctcgttttaatgcatctgtaggatttgattgataaaatatttcatttcttgcaaatgttgcatggtgaaatcaagagattgaaggcttttatttgagaaagggtnnccgagctcgaattcgntaaatccatgggtcat

SEQ ID NO: 190203 - DNA, 242 bp, Homo sapiens
tctagtaattcctttagttttattctatcttctttatgaagacacgggtttctatttttactggttttgtccttttaaaaacttgggcaacagagggagactctgtctcaaaaaaaaatttttttcataaagcttattttaaatctaataagcccgtttcaacttttaactactctttgaagtactataattgcaaatcagtatttgtttttatgtatttgctttatgtacctctttagata

SEQ ID NO: 190204 - DNA, 260 bp, Homo sapiens
attgcaggatgttgagcagcagcccggccacggccccactagctgccaggagcgtcccctacttctaagttgtggcaatcaaaaatgtctctaaatgttgctaaatgtccgctgggggcaaacttgcccccactgaaaaccgctgtttcattttttaatgtttttaagacttagatgcatttataaatcattttgatgaaaacaccttcttaagtttactaccaatgtaataccaagtcggtagagaaggcaaccgggtt

SEQ ID NO: 190205 - DNA, 374 bp, Homo sapiens
taaaaagtgaatgttaacatggaaaaagaccagaaggtgaatatacaaatgaaagcatttatttaattttgggataagatctaaggtaatatttgtttggttcagaaaattatttttaaagaagggtgttgtgagcatcagtgatagagtgaggaatcctcatttctttcagatcctggtaggggaccctgagaactttggggagtgaagatagtgaagtaaaggttgctaagcattctgctagaacactatggagacagcgatataaaataagagccaataataacaaagtagcacatagtgaatgtttaccatatgccagacattctattaatttataatgattgtaacattcctatgagccaacatcctta

SEQ ID NO: 190206 - DNA, 602 bp, Homo sapiens
tcactaagtgtagatcatactgtttccctaactcgttctgcctgccacactaaacagaaaagtctgaagttatcctgtaagaggactgtgtacatgaaagagttccccagaaataagaaacgtggtagaaaaatgagaggtctcatttattgagcaattatgtcctaaacacagtggtgagtgtattttgtctgtgtaatccttcatctcctaatgaccttgtgcagtgtaggtacttttttatgcccatttcatagatgagcaaatggaggctcagagggcttaagtaactcaaggacacttaaggtagtcaccatggaaataagtagtgaagtcaagagtaaagcaagatgcttctgggcatcagagcctaccttcttcatcatggtattaggccttcccaggtcagttgtttgtgatttgccttctctcaaacttagtttcaggatgagtacggtggctcacgcctgtgatcccagcactttgggaggccaaggcgggtggatcacttgaggttgggagttcaacaccagcctggccaacatagggaaaccttgtctctactaaaaatacaaaaattgggacgcgccatcgtgacgctt

SEQ ID NO: 190207 - DNA, 708 bp, Homo sapiens
acaagtggtgctgggagaactggatatttacatgccaaagaatgaatttggatccttttcacagaaagtatactagtataactcaaaatggatcacagacctaaatgttagagctaaaactataaaattcttagaatataggagtaaatctttgtgatatcgtatatggcaccaaaagctcaagcaataaaagaaaagatggataaactggacctcacccaaattaaatttttttgtacttcaaaggacatcatcaagatagtgaaaagatacccatggagtgggagactatatttgcaaagtacatatcagataaggaaagaactcttacaactcaaaaatgaaaagacataaccctacttaaaaaaaaataggcagaggacctaaatagatgtttctccagagaagatatgcaaatggccaattagtacatgaaaagatcctcattattactcattagataaatgtaacttaagactacaatgagataccacttcctacctactgggacagttataatcaaaaagaataacaaatgtgggtatggatgtgaagaaattggatccctcatatatggaaatgtgaaatgttacagccacttggaaaatggtcttgtaattccttaaatgattaaatggagaattatatcacccagttgtttcaccccttagtatataccccacaaatgaaaatacatgttcctcaaaa

SEQ ID NO: 190208 - DNA, 186 bp, Homo sapiens
ggatccacatctggtaggactggtatccaggattaagaaattccacgattcagtaataaaatgagaaccagttttttccccccaaggataaagatttgggcaggtacttcacaaataaggaaacatgaatggtggccagtggacacctgaaaatgtgctaacaccattaatgatcaggaaatgtat

SEQ ID NO: 190209 - DNA, 607 bp, Homo sapiens
acacactcacacatacacgcctatctgggttcaaacccacatagtcacttggatgctgcactggtttccccgccttcagtcttcattcctttcagtctattctccaaaattgtataagtgggatctttctctacaaaccatgcaatgttgcttcttggcctaaaacccttcactagctccccagagcagtcctgcaaaaacccgtaatgacctgaggctggccctcactcacctctccagttcacccatggtcactgtccttgccctctctgacctggcgttgtgaactctggcagctctctgaatggggcgacctcacaactctgcctttaaactcctttcctgccaatctctaggactcattcagacatcatcaccttctgcagaaagctcacctgaaacctgcatcggctgtgcttcctgcgtgatcctgtagggtcctctgtgcaccacaagttaggctgtgcgcttagccacctggatgctggtgaggccccgtggctgtttctacccctgacttgtcttttatcttctgcttcctacttttagaagaaaaaagataaatttaaacctgaaaagtaggacgcagaagacaacagacaagcta

SEQ ID NO: 190210 - DNA, 778 bp, Homo sapiens
acacactcacacatacacgcctatctgggttcaaacccacatagtcacttggatgctgcactggtttccccgccttcagtcttcattcctttcagtctattctccaaaattgtataagtgggatctttctctacaaaccatgcaatgttgcttcttggcctaaaacccttcactagctccccagagcagtcctgcaaaaacccgtaatgacctgaggctggccctcactcacctctccagttcacccatggtcactgtccttgccctctctgacctggcgttgtgaactctggcagctctctgaatggggcgacctcacaactctgcctttaaactcctttcctgccaatctctaggactcattcagacatcatcaccttctgcagaaagctcacctgaaacctgcatcggctgtgcttcctgcgtgatcctgtagggtcctctgtgcaccacaagttaggctgtgcgcttagccacctggatgctggtgaggccccgtggctgtttctacccctgacttgtctaatcctggaaggtagaaaatgacttggtgtcctccattttcaatttttccttctttcttttttttttttttttttttttttttttggaaaaaaaatttttttttgccccttggggtgaagggggagaaaaaaggccgggcttgttccccgccctttaaaaaaatttaaccttttgggggtaaccaaccgcggtgtcctgcccccaagggccccttggaaaaagtttttttagggggccccctttttaaaaaaaa

SEQ ID NO: 190211 - DNA, 395 bp, Homo sapiens
acactgtgtactgcaatgcaaagcgtggagtcgctctgttaggtgcccaggctctgaactccaagcttctcatcctggctagggactcatctcccctgccgccccccagggccctctcccgcaggaagcccactcagtgggagactcgcctacacctgcaacatgatgcggctgctgacttctgaaaccagaaagcactcagtggagacagtaaagcagctggtcccctcctgacccctctgcatctgatggacagtggcccgcccataccctggcccacaccccatggcctctgcagttctgactccacgtgagcagccaagtgcgaggtcgcaccctgggctcggtggtgggagctgtctcaccactggaaccctcacctctggccgcccatt

SEQ ID NO: 190212 - DNA, 446 bp, Homo sapiens
agagtcataaaagtatatgggaaactgtaataatgattattctttttttacctttggcttaactttagttcttcctcttattttataactaatgaaacttgtccacagatattaagtaccttgaccaaaatcacacaagtaaaagcaacaatgagaagaaccttcggctgggcgcagtggctcacacctgtaatcccagcactttggaaagccgaggtgggcggatcacctgaggtcgggagtttgagaccagcctggccaacatggtgaaaccccatctactaaaaatacaaaaatgagccaggcatggtgctaggcacctgtaatcccagctactcgggaggctgaggcaggagaatcgctcgaaactggaaggcggcagttgcagtgagccaggattgtgccactgcactccagcctgggcaacaagggcgaaactcatctca

SEQ ID NO: 190213 - DNA, 308 bp, Homo sapiens
aaaagaaagagaaagagaaagagaaaagagaggaaggaaggaaggaaaaagaatgaacctgatgacattacttggtacctaagaaatctacaggggaaaagagaaatgaaagtatagtcatccctcggtatccataggggactggttccagaaccacctggaggcaccaaatccaagactgctcaagtctcttatgttaaatcgtgcagttacttgcatgtaacctatgcacatcttcctacttaccttgtttagagaacagtgacaagaaaacaagtctgtacatgttcagtacagatgcaaccatg

SEQ ID NO: 190214 - DNA, 485 bp, Homo sapiens
tgttaacctggggactggtgtcattctggggcctaatgaccacctgggttgtattattcacctggggcctggtgtccacttggggcttgagtgtaaccttggacctggcacccacataggattgggtatcaaactggccccttggtgtccagttaagacatcatgtgaacctggcgcctgagtgtccacttggggccaaatgactactgggggcctgaatgtcaacctagaatctgaggtttactaggggcctaggtatccacctggggcctattgtccacctgagcctgggtgtcaacctggggcctgatgtaaacctctagttcagtgtccaccttgggcttgatgtcaacctggagcctgatgtccacctgagtactgatgttcacctttgacctgatgtccacctgtggactgtttatccacccatggcctgatgttcacctggggctgaatgtccaactgtgacttgttgtgcacctgga

SEQ ID NO: 190215 - DNA, 201 bp, Homo sapiens
tggttcttcatcagggaatcacatataaaagtgaataattaatataatgggggatgagaggctgggaaaagagataacaggtagtagatgagggaatatgagtaagggacaaacataatgcatcttctagaggaagaatcagtgggtttgggtgactcttctgtgttcattgccagacagtgagaagcacattgctgttga

SEQ ID NO: 190216 - DNA, 675 bp, Homo sapiens
gaatcgcttgaacccgggaggcagaggttgcagtgagctgagattgtgccactgcactctagcctgggcgaccgagcaagactccatctcgaaaaataaataaataaataaaatgtggaattggttgatggcataggaaacaagaagctgcttttaacattttagacccagctactatttttcgtggctgactagaaataatgccttacttaagtaccatccttaaccatcagcacagtacagattgggccatttgatacagcggcagaatcctggctgcccaaagggatgattttgaatttacaggattagtgctggatctcattactgcatatagaaagaatgtccaagttcagtggacaatactggttgaaaattactttttatctacattttgctgtgtttaaatggatgaatctctgacaagggtaagcgtgatgaaaaatggctctctgtgcaaagacgatgtttccttcctttttgttgtacggcattcttgcctttgtagccctaccagctgtttgatctttaagtcttcaaatctaactgtaggatgggcacagtggctcacgcctgtaatcccagcactttgggaggccaaggcaggtggatcacctgaggtcaggagtttgagaccagcctggccgacatggtgaaaccctgtctctgctaaaa

SEQ ID NO: 190217 - DNA, 533 bp, Homo sapiens
gtaggctggacccccccttctatatgcacaggcaacaaaagcaataatacaaatgggatgacatcaaactaaaaagcttctgaacagcaaaaaacaaacaaacaggccagacgctgtaatcccagcactttgggaggccgagggggggcggatcacctgcggtcaggagttcaagaccagcctgaccaacatggtgaaaccccatctctactaaacatacaaaaattagccgggcgaggtggtaggtgcctgtaatcccagctacttgggaggctgaggtaggagaatcgcttgaacccaggaggcggaggttgcagtgagctgagatcatgccattgcactccagcctgggcaacaagagcaaaactccgtctcaaaaataaaaaataaataaaataaaataaaatgtctgtggaatcctaagacattgaaattgatatgaggcaggttttcagtacactggattcatgtttatatatagcatgcaatctagatgaataggtttaggttttgtttggtttttaataacaaca

SEQ ID NO: 190218 - DNA, 554 bp, Homo sapiens
tattcttgaaactctcttttatcaggtagtctttttactgtcctgggtttcctcctgcaccaagtgttccttcactttttttttttttttcgagacagagtctcgctgtgtcgcccaggccatgcagtggcgcgatcttggctcactgcaggctccacctcctgggttcacgccattctcctgtctcagtttcctgagtagctgggactacaggtgcctgctaccaggcctggctaatattttgtatgtttagtggagtcggggtttcaccgtgttagccaggatgatctcaatctcctgaccttgtgatccacccgcctcagccttgcaggtatgagccaccgcacccagctgtgttccttcacttctaacttctgctgctcccatgtatagtgtaggcatcttcatagggtttttattgcagcccttttttctacttaatccaccagtcccatcccagggccttcccatttaagaccctggcttcaccaatgcactctctgcaagcaggcaattcgtaaatgtaaatatcttattctgaactctcctctctt

SEQ ID NO: 190219 - DNA, 497 bp, Homo sapiens
taaataagggcagaagctcaaatggaaactgaagtaagcaagaggctctgagctttgttttactgtgccagcagtagatctcagtttagaaagtaatttggtctagtctgtgtttacctattgaggcatcgtataaattcatcttaagcgtgtggcagtaagctctttttatttttaatgacatgtcattcatgctagttttgtccagtcaaacagtgtagatagacttaagaaaaagttaaatatctctactcctccccaccctctagaaactactaatactaatactttagtgttaatattagtagggcatttcccactattcctgtggggccctggggtctctactgtaggggtcatctcaacatattttacgtcaagcagcaggtaccatttaaacaggtcttggcaatatttttttcttctcagtgaatgaaaagatatgctgatgttctaacacccagtatctatgaatgtgatttctgtttctttctttc

SEQ ID NO: 190220 - DNA, 414 bp, Homo sapiens
aataaaagtcttacatgaatctgatgggggatattttgagagtgtcaaatttatgactctgtttatttacataaaatccaaaaacaggaaaaaattatgataatagaaatcaggcaaatgggctattgataggaaaagggctctagggaactttctagaacaaatggaaatgtttcatattttgatctcgtggtggttgcacacgtataaatatagagagatacattaagattggttgaattgtacatgtagtatatatgtgttttactgcatgcaaattataatctattgtttaagtgttgtaaatagtgacagagttcctaacatagcagcaacagacacagtgagaaaaggatttctaagggtgtaaaactaaggtaactcagaagcattggttcattctacattcactca

SEQ ID NO: 190221 - DNA, 101 bp, Homo sapiens
gaatggacatacttggtggaggaggatcaattgttcatgccacacagctggccagggtgatgtgctattcttttctatatgaaaggcctgggtatcacgtt

SEQ ID NO: 190222 - DNA, 473 bp, Homo sapiens
gtagtggcaatgacaacaaaaaggttaaccttccctaaaggggggctccaaaagtctctaagaaaagcaaatgcatagcatgtagaccattttcaaagcattatcatttctgcagatgactaaaacctccctgaattttctgaacatataagcaatgtttcagcactaagaaacaattttttctgttgaaatataaccggacccagtggttcacgcctgtaatcccagaactttgggagggcaaggtaggcaaatcacttgaggtcgggagtttgagaccagcctgaccaacatggtgaaaccccgtctctactggaaatacaaaaattagctgggtgtgatggtacacacctgtggtcccagctactcgggaggctgaggcgggagaatcgcttgaacctggaaggcggaggttgcagtgagctgagatcaccattgtactccagcctggcgacagagcgagactccgtctc

SEQ ID NO: 190223 - DNA, 159 bp, Homo sapiens
taagatgaggggaagtaatggtttgaaaacaagtgtgggtagcaaagaggatctcaaactcctcttgattctgagagggtcaaattttagtcaagagcgaatgagggttggatgaagaaatgagcaaaatgtaggaatggaaccctggaaaacattgac

SEQ ID NO: 190224 - DNA, 171 bp, Homo sapiens
tattacaatagtattacatgattattatacttctgatatgtgaaaggtagaggaagagaatatgttgctgaaatgcagtaactaagcataggtctgcagagagggcactgctacagaaaaggaatagttataccttccttgattgtgagctattcctttaatttctaaaaa

SEQ ID NO: 190225 - DNA, 249 bp, Homo sapiens
aataggtatgcgtaggtaaaatgtttcattaaccccaggtgttggtattacagatgtgagccaccacttttatcatgaaagggcgttacattttatcaaagccttttcctgcatgtattgatatgattatgtgattttaattctttattttgttaatgtatattaattgattttgtatgtcaaaccatctttccatcccaaggataattcctgcttggttatgttgtatgatccttttaatgtgcagtt

SEQ ID NO: 190226 - DNA, 225 bp, Homo sapiens
tcttagttacaacagcaaaggttaattacctagttacctagttcctctgtaaattatttaaagctcagaatattctccaacattacaaagacttaaaaagcaaaggagaattttgagaatgtactccatgcacagatgctattgttgcgccccctgagattttgcttcagtacttgagatgtgtatcagaatgttgaagggcagcaatgatgtgtaacagtttta

SEQ ID NO: 190227 - DNA, 612 bp, Homo sapiens
cttggccatttagatgctgctgctgatgccacctcctccatgcatttcatttgcagtgccagcagggagggagatttgtggggtgagactgagaggctaagggaggagagatgggaggagagagcaggccaaggccacactgtagcacagttcacaccaagaacagcccatccagccctgccccacgttggtctcatgcccccactggagactcatcctgtgcccccacacacccacacagaagtctcatcctgccttccccacaccctccgcccctgcctgcaggcagcaagatcaaagccaccagggatgcagccactgttcttctatgtcttggaacaatagaacccctaagtgtggaaagcagcagaaccagagagctactgggctggcccaccctgggcccagttggagcctaggtttgggctccagtccaggctcagcatcacctctgtccagtcacagagagcgtccataccagtgtccctgcaagctctcttagcaaggcctgctccattttcattggcataccttctgctctgggacttctcaagtcatactgaagacagagaagccaaccctagcatgttcaggatcagtttaacccatttt

SEQ ID NO: 190228 - DNA, 701 bp, Homo sapiens
agcggcgtagcggccgccttttgcatacgggaccctctgccgcctctcctctgctgccctctcctctgccacgtgggatcctctgccatctgctccgcgctttgctttcggggctgcctctgtggctgtctccctcacaccggggctcccgccaaccccatgaggcagcccctgtgtaaggctcctggtcagccaagaggaccccagcgccctggaggctgcacccccatccctcctgctgtggggcccttggtgctccatgcccgagtctctcacaccgcggctcacccgctgccccaaggggctccggcagcatgtccagctcctcccggggcctgtgacagaacagttccagcagggggctctcacgtccccacctgctcccagagaggtgcttctgtgcccagacatggaacagctccacagaaaatgagggcactggccgagcaggcccagactccagaagggaaaccactgagggtggaggcctgacccacgtcacctcggagtctgtcctcgcggagacggtgatgggcctttccctctctgtacagatgaggacacacaaggagctgacttcatgcctggacattaagcccaggaattcccagcctagagctggctctttaggttgcggggtctggtcccagtccagaaacatctcccaagccacagctcaggacacagcagggtgggggtcg

SEQ ID NO: 190229 - DNA, 181 bp, Homo sapiens
tataaactgcttctcactactcaacacaaattctatcctgactactaaggattaactaacttcatcgccattaaccatttccttcaagctccctttatcccattgttcaaacatttattgagcaccttcttgaagtcaaactctacaaggcattgacttcatggcatcctcaaaggactct

SEQ ID NO: 190230 - DNA, 346 bp, Homo sapiens
tccagctgccttggggaaattactcctttgaatgtggcacagcagggcctacacaccacgagagggacatggtgaagtctggtggatgataagatgctgctgatgaagaatacttcactctttatctctcaaagcactagtgagaacttctgagaccaaaaaacctcctactctttgaaagccaccccaattgttttctgaatcagacagagacgagagtggaaaatgggatcccaaagggaaagatcctaacccccagtatattttcaaaaggcaacgcatttttactaaagtctttccattctcaggaaaacagtttctcaattcaaaaaaaccgtttaagtct

SEQ ID NO: 190231 - DNA, 154 bp, Homo sapiens
ttatgtcttgcccttgagaaatgatgggtgggaagaatatcagtaatgcccttagtgaactgggaagacagcaggagtccctagcaggaaacagaaggaaacccagcaaaatactcaaacccatggggaggtgttgccctttggggcagacttt

SEQ ID NO: 190232 - DNA, 265 bp, Homo sapiens
atgctctgctttttccatgaaaactttttgcattaaaacaaaattttaaagcaattttacagttaaaagaatccctgcaggctgggcgtggtggctcaaacctgtaatcctaggactttgggaggccgaggtgggcggatcacaaggtcaagagatggagaccatcttggccaacatggtgaaaccccatctctactaaaaatacaaaaattagccaggcgtggtggcacatgcctgtagtcccagctactggggaggctgaggc

SEQ ID NO: 190233 - DNA, 625 bp, Homo sapiens
gccatgatcacgtcactgcactccagcatgggcaacggagcaggactctatcccccaccaccctcaaaaaagaaggatgtcaaattagtttaaaattcctacatcaagacaaattgcaagtctggtgtacacatgtgcacgaaggtaaggggaggatgcacacatcagcttactgcaagtatgaagagtttgttaatgacagcaatgacacctagaaaaagatattaaaatgagaaaagaataagaagagactgtccaaaaagacagaactcaaagtataaatcagagtataagtagagagcccactaaggtactgatgttaccaaggtgcatttccagagtttaacaaagcatgaaggttccaacaccttacctggtggactggggaggaggcgaagtatcttacagaaaatgaggaaaggcttgtgagagcagacctgaactccattctacgtctgaccactcagcccaacatgatggcagcagcaacaataattactgagaaactgccaaagtttgagcagagaaaggcagtaggcaaaggagctgtagactgaaaaacaagtgatggagcaatgatcttcaggaagtagaccgagcaaaatctaaaacatgaatagagaac

SEQ ID NO: 190234 - DNA, 144 bp, Homo sapiens
aacagacacaggaatagaaaagaaaactaaattgtattttcagtctgcacctaagctcttgtggtcacctcttcacctggattcctccagcttcctcattttgtctgaacacacagcaaacctaaattttagcccttacagcct

SEQ ID NO: 190235 - DNA, 510 bp, Homo sapiens
gatggaggcccttcacatttctgggcctcagccacagctgcagcaggtgcccagaggtcagaaccagagatcccagacctcccggaccagctcgtgccccaaacgaaatgccatctcgagctcctgcagctctacgggagacctcccgggacgaaagcggaagaggcgccagcctcatcccactgccagctgaccctcagttcctcaaacacagtgagtgaggacggacctgaggctgtctcttcgggtcacacccagtgtgaaaagacggcagatacagcaccagggcagacactcggccccaggggtggctcccccagatcccagtcctctaggccccgtagacacaagtttcccctgctgccacgcaggcgaggggagcctttgatgctgccacctcccttagagctggggtactgggtcactgctgaagacctggaccgggagaaggaggcggcattccagcgcatcaacagtgcactgcaggttgaggacaaggccatctcggac

SEQ ID NO: 190236 - DNA, 981 bp, Homo sapiens
caaataggaacagctccggtctacagctcccagcatgagcgacgcagaagacgggtgatttctgcatttccatctgagcttcccactgggcggttaatagaaacattccaaagcaatgagcaccagtcagaagtaaagctcttaaaacaggacaagaagaaatgggtgggaagctggaatgagaacattcatcagcagctcaaagcacagacttctaagggaatctttcctcaccctctgcctctttggaatattactgcttttggggaaactacatgcaacagacatcattccaggcacaggagctaaaactattaagaacatacacctcttgctctcaagttgtgtgcaagctagcaggaagggctgagagaaaaacaggcaatttcagtttatatgctcagcgtcgttgaccatctaactcaccttggcagtcgagacagaacacgagctgagacttgacgttcacgcatcatccaggcgacctggtggctattcctttgagaatccagcatgaccaacacagttcaagcacagaatcaaacagaaatgaaacacattggagcttcgcctggcaacggacacgtgcgacaaagacgatgctatacatgtaacattatgaactaatattacgattcatggatcagccatttccgcattgcaaggccagactcggcacgccatgaatgagacgcgagaccacacaataaagagggacacagtgctcacaggggtacagaagctcacaacaaagacactgactaacacggggacaaaaaaaacaaccaatggccacagaaagcgaccgaagaataaccagacgaaaaataaaacaaagaaccaagaggcacacaaaacaacagaagacgccgagacaccgggacaccacggagagagaacaaccgaagaagaaccgccacgagcacaaccaaccacaagagaacaagacacataagagaacagcaaccaacacaagaaaaa

SEQ ID NO: 190237 - DNA, 489 bp, Homo sapiens
gcgaattcactagtgattcctgagacacagaggtgcacatatgtagcagtaatggatactaaatgatacactcggaggaaacagaaaagacttctgaatagagactggagatacttccttggaccattgatgaatgggcaatgatgcatttttgtcttccattcagaaggctaatatattgctctctatgttctatggataaaggcagtatatgctcaaggatgaatcacataatatgcataataaatccagcaagcattacccttttacttatgtgactgcaagtaggaatacatttcccccactctaaccatgtaagatttctttcccttctcccattttgtaagcaaaagtaagttcctgaaaggttaaatggacctcaggatgggaaaaatccccagagctatctttctgcacagacttcattttttctcccaagtctgactgtcaactgcgatatctgatatgaggctctggtgctgatgtttc

SEQ ID NO: 190238 - DNA, 432 bp, Homo sapiens
tgacaggtggtttctgatcataggaattacccatgctgtgttcaaaaggcttgtgacattactcatcctccctgcctttagtcttatctagagccattcactgaaggcattccttcagcaaaatctaacaagaacatacaccatatcagtatcatattagctatagcttagccccatttctgccccactgtgtgtagctcagagtcaccttgttactctagagccaaattcatcactgtttaggtaccacattagaaaagagtcaagtgttggcaagggaattccaatcaagccacaagcctggaaaaggagctctctattctgagctctctgagttctctattctgtttaattggtctatgcgtctgtcgttgtaccagtaccatgctgttttggttactgtagctttgtagtatagtttgaagtcaggta

SEQ ID NO: 190239 - DNA, 484 bp, Homo sapiens
gttattttttgaattttctataatgaacatgctgagcagttcctcattcaccaagagtaatacatagtttatttccacattccacatatggaattttccaacaaggcatctttgtaaaatgttagaatcaatattaaatgaagcaatgaatactcagtgaaatgtgttaaataaaagctgagttttaaaaatcaaaacaatcttgtcttctgcttataatgaacacattttaacagagaaagggtataaagaaaagtaacattctgtaacataagagaaactacccaattaatgcagtttgtagtttcttagaacacagtctcctaatattctgatttttctggagcagaaaataaacattaggaaggacttactttgaagaaaatattatctgccattgacagctagcaatttatttagagaaataatattttagaagactgtaacaggctaggcacagtggctgtcacatataatcccagtg

SEQ ID NO: 190240 - DNA, 207 bp, Homo sapiens
cttccttcccttgcttgatcaaactccccaagacctgttcctcccctagtcttcctactacagtagaagataccctaattcacgcaagtccctaagctgtaaacctagacaccaccctgcctcctcttttcatttcatttcattcctttttttttttaattcttgccttcctggaatatgagacctgcctcctcttttcatccacct

SEQ ID NO: 190241 - DNA, 408 bp, Homo sapiens
ggaagttactgttagaaagttgccgtcagcgggcgttgttccagctttccatggaaattctgggagctgctcctagtttgcggcggagccttccttccttccctgcattgggcgctggaccttcacggccaggaggctccaaggcccaggcttttcgccaacagcaacaggctactggctgggcccaggcaagggggccttggcaggaaaagttccttgctgtacctccactgcactcagaggccagtgaggggggtaccatacaggactccttcctccctggtgaagtgcccttgcagctccctagtgtccacgccatggatatttcctccacagaagtacaatgctgattatgatctgtcagctcggcaaggggcagacaccctggccttcatgtctctcctggag

SEQ ID NO: 190242 - DNA, 208 bp, Homo sapiens
aaactaggctttgaaaactgaagagactactgagagtcagagatgaatcaagttctggggagaagaaagacatctaaggtgagggaaggccctaggaggttaagacatggaaaaatacaataaatataattacatgagataatttctatatgagtaaaacattgacaacccaatttatccatatccaaggtggcaggcagtttgattt

SEQ ID NO: 190243 - DNA, 120 bp, Homo sapiens
tagggagaggtgcatcaccaagaatatcggagacttctccttagcaggctcatcgtttccaaagagatggagatgcagtcccgagatagcgctccggcttgctggggacactggctccag

SEQ ID NO: 190244 - DNA, 417 bp, Homo sapiens
tccactagtgtaggctcagctctcagagcagcctcagtcactgggaactttttttttttcacggatgctgctttctcagcttctagaattgcctccttagtcctgagttagaatgtcagagacaggttttatgctactttgctggcaaggatcaccatcgcacacgtcatgtagtttatcttgaaattttatgatttgggaatcagattccttcaaataagtttgtgccatctgttttgttgagagagctcgtggctaggatcgcagacgcgaacattgtttcttcctgaattgtgcccttgagttggttggtgtgtatctccagagtccattgtttcttttgcagaatgaaggaattgctctgcagagatctcaaagataattccaacccagcacaccaggactcaaacttaagaa

SEQ ID NO: 190245 - DNA, 411 bp, Homo sapiens
attcaggaactacctcacaaacccttacaagttccacgtttcctctgagctactaagatggaaaggcagcgaagtaccattcactctccaagaaggctctggaattctgatgccaccactgcatttgctgccccagtatatacattgtgagcgactgccatgggtcagggccctgggacctgtggggagtggaacatgagagacagttctgctgagcacttacatctggcttgcagcaaatgagcagataagtaaggagaatttccgggagtaacaatttctatgcaaaacatacactggagagggtgcctcaggagagctcctgcagacatggaggctgggcctctgtggggagacctcaaccacacagagaactgactgactcgaagctccatcatggggctatcacgg

SEQ ID NO: 190246 - DNA, 245 bp, Homo sapiens
agttgcatatgcatagggttatatttcacataatacctaaaacaaagacccaaaaagtggggacggttgcactagagaatgcatctgcagaaaacctaagtaattttatgagcagcactcaagtttactgcttcttttatgattcttaatcccgcctactaaattcacatgtctttacaaatcccaaatctgtaacaaggccaccaaatgctcccaaattagcaaaatacagaatagccttttaa

SEQ ID NO: 190247 - DNA, 592 bp, Homo sapiens
aatgccagcactcagctagcctcaagggaaaatgaattcttcttttccctctacccacactcccgagtcagctattcttctgcctttagacaacactatccacaccaacatccactctcctgtgggtgtaagaaaagccacctgactggcctgcctgcctttttttcctatgataatccaccctccacaggcagccaatgagcttccaccactctggaccttatgcctgatctgggaatgaccaaagttctcttcagcctaaagccttttggatgtgtagaaattgaactggaggggcagagctatgcctgaaaccacagatagtaccgaaccctatagagactgtgatacacagtaagagattaacagtaactcatacgaacatagagcaattataataatatactgtaataaaagatatgtgaatatggtctctcaaactctctactggtgttgtatacacccttattggcgacaatgtgagatggtacactgcgtgtgtagaaactgaacgttcaatttctacacgaaacagaattcaccagcgtaggatagtacacccactaatagggacgtagctggcttacacgtc

SEQ ID NO: 190248 - DNA, 355 bp, Homo sapiens
gaactggagaaatgttttatattttaaaagatttaagacataattcaaccaaaggcaatgtttgaatcctgattggatccttctgttaacaaactgcaagaccatttctgagacaatcagggaaattttaatcttacctggatatttgataatatttattgttaagtttttaggcatagcatctgtgttgtaaagtgacaattgtggccccaggaagagtacctaaaagcagcctctagttgctgagagaaattcctagctgatagccaggaaggaaatgggacctcagttccacaaccacaagggactgaattgtgctaactgtaccactgaacttggaagcagatttttttct

SEQ ID NO: 190249 - DNA, 373 bp, Homo sapiens
accaccacctgccccgccacttcccaacagccaatggctgactcatgaacacggaagtccagtctgcttcaaatcatgataagtctgctgtactacttatgctccagagtcccctattgatcaggccaaggctagacttcattagaggatatcctcgtttggtaatttgcactttcctatgtcacttccctttttctgatataggtttggcctgaagaacacttcctcaataagtcccttgtcctcagtttctgacttaggctctgcttctggataacccaacataaaatgaagaaaatttgagttcctggccatacttctggttatcacacctaatgatttctgatcttcacaatgactcttcgaggtaggg

SEQ ID NO: 190250 - DNA, 395 bp, Homo sapiens
agttctttcatctccggctgaggagaaatcagaagcaggcaagcgtgatcactgtccattagcagcagcatttgctggcagcaagagggggaaggggtcctctgttctcctgagctgctgcagccgtgggcttaaaggacgtgcccacataacttgattgatcatctcagtcacaattttaagattttagcctggaagttcaatgtaggtgccatcatatgaaagatttaacagatgttaatatccataacgttcatgttcattatatgtatttgactcttaactaggttttctaattttcctttttaacgtattctagatattaatctcttggttttttttaacttttaagtttaggggtagaagtgcaagtttgttacataggtaaacttgtg

SEQ ID NO: 190251 - DNA, 476 bp, Homo sapiens
ctgaaaaataatcacccttaatcccacccagacacaactactacttgcatattcgtgtgtttcctttcaggctcatgcccaggtttgttttatgatgtcatcacatacttacaggtttcatttcatgctcaggcctctacacttaacattattccatgaatctttctcgtataattacatagacttcataattagccattaatacccgagaagaacccacagtggggatatactttaatttactcaagcagttctccctttgttgggtatcttactctggtaaataacactgcgttgaacatctccatgctcacagcttggttgggttccttgggagagattcccaaaagtagaattctaggtaaaaagacacgccctcattcatacacgctgctagattgctttgtggatttgatgcaagtgtcgtcaccaagttgtcattctccgaagtcccagcagttgttcatgggcccaca

SEQ ID NO: 190252 - DNA, 217 bp, Homo sapiens
aggcaatctttttaaatgtttagatcctgttatccttgcaggaattccattacatgtgccagatgttgcttgctgtgtctaaacatgtgtatttgagtagctggtattttcaaattgaaggtccttaaaaatgtttatgctttataatcccataatgccactcttgggaattttatcctaacaaaactatttaatagaagaaaataactatatgcac

SEQ ID NO: 190253 - DNA, 391 bp, Homo sapiens
gtcagtgtcttctccccttgatcatgggtgggcttgtgaccactccagtccacagaagcaatgctgtgatttccaagacttaggtcataaaaaagatacagcttccacctgctttctcaggtagctcccccttgggacctggccgccatgttgtgaggaagcccaggtctcatgaggaggccttggtgggtgtcccagcagagcctgggtggaggtcccagcagatagatggctagcaccagccatgccaaagagcgagtgagggagagagagagagagagaaaaagcaagagaatgagcttcaagggctgcagccctagcctttgagcctccccagatgctcctgaggacagcagagaccagctattcttgccaagctctgcccaaaatg

SEQ ID NO: 190254 - DNA, 191 bp, Homo sapiens
aatacatttagagctggactaggtggtgttgctcgcttcatttgtgttctctgagaacagagctggagatgagaatttgaaggcaagtagcttcgggatgttgtcaagaagcaggaatgagggaggagagataaggaagcaatgccagtgtaagggtgctgtgatgggcaacgggaacgtcatttgactga

SEQ ID NO: 190255 - DNA, 378 bp, Homo sapiens
taaaattttgatccctccatattacacatatgaagtagtataaggctagattatgctttggtagcaaataatcccatctaactagcttatgcctaaaacggtgtatgtattgctcacatcacagtctgacataggtcaggtggctccttaaagaattaagtggaaactcaggggttcagagtcctcccagtctgtggcatacccacattaaaaatgtggcctttgttacagcagttgaaagagaagagtgtgagtgattatgcaaggagttttctggtcaggcctgaaaatgttatatatcataccaataggatctgcccataccccattggccagatcatagtcatatgaccctaacctaactgcaaaggaggtaag

SEQ ID NO: 190256 - DNA, 507 bp, Homo sapiens
tctgcatgcctggggaggcctcaggaaacttacaatcatggtggaaggcacctcttcacagggcagcaggagagacaatgagagccagcaggggaaatgccagacacttataaaaccatcagatctcgtgagaactcactatcatgagaacagcatggggaaaccaccccatgattcaattacttcccactgggtccctcccacaacacatggggattatggggattataatccaagatgagatttgggtggggacacagccaaaccatagtacactcaatggaatgtcatgctgccattctatgatggttgtaaaaaacatgttgcaaactcaaaaatgcctatgtattttctcaaaaaacgtacctgtcacgcaccatttcttaagaagctgctggacggtatgtttctggcagaaagaatgacaatagaaaaggccgtcaggactccagacattggagttatgagttacaactttaaaataatgaaagctccctatgttcaaag

SEQ ID NO: 190257 - DNA, 388 bp, Homo sapiens
ggtgaggtgggcgcatcctgtgcatatgattttctcaggtgatgggaatatggttggcttttgactaatgggatatattttctctttgaatgatttggcaagatatcagatgagagaagttgaatgaatgttagaagaacatagaaaaaataggtatacacgttgggtttctgaagaaatgatgtctttggagaaacaaaacttttattgatttctggaaacatttagggccaattttttatgtaagtaatttgaatttatgatgatatctctgaccactttttgatattttttctggttcaggtgagtggtgtcattgagcaaacacaaagtcgggctcatccaaggatgagattttgccagagaaaggacgcgccatcgtgcgctt

SEQ ID NO: 190258 - DNA, 507 bp, Homo sapiens
aagcctcgacatttttctcaatacgtactttataatcatcagaataaagatctgccagcacacacattggctgaatttccctccccacctaaagaatcatcaccaaggttcttcagttataaaatttaacaggtcaaagagcttaaaatttttactctttctgagacaacagttaaatatagttctagtcacagagtgtcctgagcagtgccagcctggctctcttggcacacaatcttctaaaataactgcatactgctgatgcaggaatgaatcacagaagcaatttctctgcacacacaagaggagtcaaattcacaattagcttcaaaagctggattgctaatttaagctagtgttaagagctagtcttctcagaagacatgccttgctattttatgcaaaccatttttcactaggcagaaattaaccttggaagccagacacaccataccattcatactctttattttttgtagtcattcacccactggcactaggatagat

SEQ ID NO: 190259 - DNA, 275 bp, Homo sapiens
caggaagcgttgttaatctcctgggtcgcctgcgtcacccgcccctccaaaagccctttctacagaagctgaagagcagggctcaggctaaatcctcaggtgctcagattgggtcagatccagatcgttcttcatgtctctcccagctcggagactggagagtaagcaggcagaatggggaaggggttggcttggcaatgcccaaagggcaaaagttccagggtctgagtgggtgtgacctccagcataaataagccaatggcaaggctcaatgg

SEQ ID NO: 190260 - DNA, 415 bp, Homo sapiens
cttttgtctgtaaagcaggaataacaactgtaagctcatttgttcaacaatatttacttagtacctaccacactccacaaattgcactatgtggggatacaggctaatagataaggtcccttctctcatagggtatatatttcagaggacagagactataaacaagtgaacaaataaacaagatgatcacagactatagtaactgttataaaggaaataaaggatgacataagagaaaaactaacctggggcaaagcagtagggtggctgcaattttaggtaaggggtcagggaaggtttctgaaaaaagaacctttaagcagagacctaacgaatgagaagccaggagctcaagcacttgagcgcagaattttcaaggcacaaagaaaagtaaagagtcttctaacttcatagg

SEQ ID NO: 190261 - DNA, 561 bp, Homo sapiens
  misc_feature (550)..(550): n is a, c, g, or t
cacagtgaagcccctcagaaccctccccctcggtatttttaaactccattacctcactttccaaccataactgttttatctctctcaagctggcacatagactcatttttccttttgctcttaaatagatctgtagttcgttcttgaactttctgctttcaatacctgctgaccaacttttcttatagtctttttttgctcggcccttatcctccacccatcatttaaatgctaaggttctgagaccttttctttttctttttctttttttttttttaaatagggcacaaggtattttacaggtcctcatcattctgctgggaatcctgtgggtgtaactttggtgtgtgataaattctgctccagagacttatcctctaagctctccaatgtgtcttttaagctggagctaatgtgtaggagggccatttttaaagcaaatcaaaaacattaaagggtttaacttctgtaaaccgggtgtaaatctagaggacttaaaagatttttacaatcctctagcttaccgactaaacgcttccctttatacggnatattcatatg

SEQ ID NO: 190262 - DNA, 215 bp, Homo sapiens
caacattcagtctgtcagccctcccaggtaaagccattcaaatattttaaatacccaggtactttggccgcttgcacagcttccaggactctccagcatgatctggctcttaccaagcactctagcctccccttgtgccactgtctccctctggctctgatctccaaccacagtggccatccctcagctccttcaagcccccaggctccctcccc

SEQ ID NO: 190263 - DNA, 233 bp, Homo sapiens
agacaatcgtgtcatctgcagacaggagtaattttatttctccctttgtagtgcgtgtaactttgatctccttttcttgccaaatggcagcagctgggacttccgacaagtacaagtggagaaaagacactcctgccctgttcctgattttaggaggatggttaaaaatgatattggcttggccaggcagggtggctcatacctgtaatcccagcactttgggaggtcacttg

SEQ ID NO: 190264 - DNA, 180 bp, Homo sapiens
ttgcaaagtatctacacaacgcctcacacatgggtctaatgtgtcactcagaggtgactgtgcttctctggaaatgcggttttctaccatggcatcatgtcttctccatgtcagtcccctggcatggcagcagtgggactggagttgctccccagtgactggggcagctgagaagtcaca

SEQ ID NO: 190265 - DNA, 180 bp, Homo sapiens
tgacacaggagactttaaaaatgtgacaaaggggatgacatcgatcaggataatacaatgaccccgtggcccaaatttgggatgagccttctcttttgatgtatctcacagcccctcctctctcctggacacattctacccatgcttcagctgccgccccacctactccaggaggccctc

SEQ ID NO: 190266 - DNA, 181 bp, Homo sapiens
gaacaacagcaaagacaaaccaaactttgtagctgtatttttggggccacctatatcctcttcttgggactgatcttcacttccactgaggacttggaaatgttcgcttgggtctaggtgtgtctctgtgtgcttctttcctcatgctgcaagacctaccaggttttggaaatctacctca

SEQ ID NO: 190267 - DNA, 125 bp, Homo sapiens
gaacattctccaagatagactataagataggccacaaaacaagtctcgataaatttaagaaaattgagctgggggcggttgtgtaatcccagccactttgggattacattcctgtaatcccagca

SEQ ID NO: 190268 - DNA, 201 bp, Homo sapiens
tgctagcagaatatatctttctccacccctttacttttaatgtatctgtgtatttatatttaaagcatatttattataggcaacatatagttggatttaatttttagatccactctgacaatttctattttgtaatgcatgtgtttagacctccacatttacagttattatttttatagagttggtttatctaccatgtct

SEQ ID NO: 190269 - DNA, 537 bp, Homo sapiens
agaaaacactgatgcttatcataacactttcttttaccacttttgcatcactgttgctgactgattattgtctactatcctttctgcaaggaacaggagtatagaagaaaaaaaatcaacactattgtctccacatttcttactagagtccaaaagactgaacaataaacaaagggatctaaagaaacacctaaagccaacatactgacaatcagagtatcgcctgcttgacatcagtagcagttgcgcaaaagaatagtgcaaaaccttaggcttaatggagcttacagactagggggactggcagtgtccaaacaatattcccagctttaagtggcaattgttaaacttacacttgataagtgtactgtattctggaagcctctgtcacagtattagccattgttcgctaatctcactgtgtgtttactctgctgtcccatccttcaaggcattagagactctacctcagttgggtttagagtagtggttctcaattgagggaaattttgcacccaggtgacatttggtaatatc

SEQ ID NO: 190270 - DNA, 512 bp, Homo sapiens
ataaatctgaccagacaaccgagagtatgtcaactccagaagcctgtccaactacagaggcccgagtttgagctctagtttgccatttactggttatgcaatctcagtaaattattcaaattcatggagcctcaatttccttgtgtaaaagggaaatctcccaggatcatcatgaaaattataataattaacattcatgaaactgccacacatggtgccagatgcctaataatcaatcaatcaatatttaccaaaatatgcaatacagacagctaacagcagtgtaagaggtaacgtagagacagatccttctaagaaattaagacccctacctgactgcattaggagtcatcaattgaatctaccgacaagaattgaacacaatttaatacaaagtaatgcataaaacaaaagtacaggcattcaccttcattaggcctgggctgagtctgagaggaggtaagggggtttgttagaagggggtgtggtgagactggtctgtggggcatctc

SEQ ID NO: 190271 - DNA, 200 bp, Homo sapiens
tagctcttcctctgttccctacctcagtttcatcaccttcatggtgacacaatctttgttcctacattcaagcatttaaatccagccaattagatctctgcagcatttcacctctcattttcttctctgccactgttctctttaagaactcatctttctcttttattattttagtgcccttctatctgaagtgtcaacgt

SEQ ID NO: 190272 - DNA, 425 bp, Homo sapiens
gctgacgctgcagatgcatgagggacctgtgtgaagcttcgtaagatccttggacagagacaaccaaagaatgtcttcagatatgagcccagaatagagaggcggacactgcagattgcaggatctgatttgcagtcttgctgcctctcacatggtgcctctgtttggcttgcttcagcatgagcagcagtaggcgcttatttgtttaatgatgcttagtgccttttttttccaggcacaccactgagaatggcaggctcagtgatgagatgtaattccattttgtgccatgtgctgtcctgggcgctttctgtgaactgtttgattttgtcttcacagccaccctgcaaggtggataccgttgcccccactttaaagatgggagaaggaaagcccgggcagggatgctcattactcaaagtcat

SEQ ID NO: 190273 - DNA, 535 bp, Homo sapiens
agagctatctaatatgactcaacttaaagaacttgatatctcaaataatgcaatcagagagattccaagaaatataggagaattgagaaatttggttagtttacatgcatacaataatcaaataagttatcttccaccatctttgctatctttaaatgatctgcagcaactaaacctgagtggaaataatctgacagctctacctagtgctatctacaatattttttcactgaaggagataaattttgatgacaaccctttgctgagacctccagtggaaatctgtaaaggaaaacagttgtatactattgcacgctatctacagagggcagatgaaagagatgcactgtttcattaagtgagagagcccaccaagcacttgttatatggaaaacacaaagtaacaagttatcactaactgctgctgctttaagagatcaactaattcgagcactaactatgataggagcatatgaaattatggacaaaataacagctttaaatctttttacgcgtgcaattaaattctaaccag

SEQ ID NO: 190274 - DNA, 252 bp, Homo sapiens
aatcgctagtgcaatgttacctatcagcaaaggaatacctggagactctgtgggtttgcctgattgtctttctgatgctccttggctcagctttctcagtggccatccaaatgccttccattcctcaccagacacacccgtcctggacaagcaatctcccagcctcaggagatggactttgccatttccaaacagcttgccagaggagtcgatgttgaagattacattgcaaaagatggagtcatttggttg

SEQ ID NO: 190275 - DNA, 255 bp, Homo sapiens
agtgtaaactgaagcttgggctgtcaacaagttgtcttaaaactgttaccttggtatgcaacaagacctaaacaaaaaagaaaaaaaattgttgtcacacaaggttaaacgtgaagaaatatatactttgttcttccatttcctggtacccaaattcctaaaactctaggaataccagtgtcttttttatgctaatgagatgaatgatgtctgatggcttctggatagcctcaggaagtggtttgatttccaggg

SEQ ID NO: 190276 - DNA, 277 bp, Homo sapiens
cactcaataggtattttttacttccattgtacagaattggagatagacaaaaaagctaagcaacttaaggtcatataactggtaagcagtaaaattgagatttaaatccaaagtacttgttcaggcccactatagcttaagaggtggaaagaaaaggtgaatataattttttcttctttttttttttttttttgagatggagtctctgtcgcccaggctggagggcagtggtgccacttcagctcactgtaacctccgcctcccaggttcaagcgat

SEQ ID NO: 190277 - DNA, 674 bp, Homo sapiens
gtggcagtgtagccctcaagtgaaatgttactcctaaaggcacctgtgagccagagccctgctctggtggctgtgggagacaggggatgatttttctaacctgcctccacccttcccggtgccatgggaggcagtcaccaagttctggggtctccagctgcagtgggtggctgctgattgcttctctctgtccagaacaatgagaacaagagcgtactacagttggagcagcaagtaaaggagctgcaggagaagctaggcaaggtgaaggagacggtaacctccaccccatccaagaaggtctgggaggtgggcaccagcctctggggaggggaggtgccaggccagaggcagctccagcccgggggcaggtgaccccagcaccctccagggcagtcctgtggctgtttcttgcttcctgccctctgattttagaggtgggtagccctgggctcctcccaggtctggacatcatcattccagctagagacatggagcacccccaatcacaggggaagagacagagtggtataacagtcttcttatgccagacgcggtggcttacgcctatagtgccaacactttgggaggctgaggcaggagaatcacttgaggtttggagtttgagatcagcctggccaacatggtaaaacctcatctctactaaaattaca

SEQ ID NO: 190278 - DNA, 236 bp, Homo sapiens
tgtgtgtgtgtgtagatactatataaaaacaggtactatcagtagtctcacttaacataggacagaaaatatctctgtcacgataatacttagcaattgcgaagaggaactagaattcagatccaggcagtctagctctgtaagtcccatttttaacacctccagcatctactgcctgaactcaacttgctttggtgtggatgatgcaggttcgtggcctgcacaagctgatcact

SEQ ID NO: 190279 - DNA, 206 bp, Homo sapiens
tttctaaatgaatgagtgaaggcagcctgggcacatagcgtgagacctcagctctacaaaataaaagtaggccagagggccaggcactttgcctcatgcctgtaatcccagcacattgggaggccaaggagggagggtcacttcaggtcaggtgtttgagagcagcctggctatcatggtgaaacccatctctaccaaaaaataac

SEQ ID NO: 190280 - DNA, 420 bp, Homo sapiens
accagtattgggaatggaagcatagtaaaaaatcttagaatatttttagaaatactgatacagtaacctgtagacagcagtgaataaaataagtaaaactggttccaataaataccacttctatgaaacgggattacgtaagaatttaatatgtgaaatctccaagtagaaattaatcattatcaaaaaatattgctaatttacaatctgataaatttattagccttcccacagtaaactaagaccctcaatattaaaataggaatcattattattagtagtagtattttttgagacaaggtctcaaactctgccacccatcctggagtgcactggtatgatcatagctcactgcagccttggactcctgaattcaagtgatcctcccatgtcagcctcctgagtaactgggactacaga

SEQ ID NO: 190281 - DNA, 596 bp, Homo sapiens
cttcctcctggattagagataatcaaacttattatcaacctaatacatacaatttttcttttgaaaacttcaagtataattctaggtcaaacatctttttttgctttctttttttatgagctggaggaagaagctgctttctttcttgacttgcaatcagtctcagaaatgttgaatcattgcctaggtacatgaactcaattctgagcagctttaatttacagcagccaacatttctataacataagctctctaaaaggggcccacagaagaaccagaaatctgtggttgtgtagaaagtttaatgggaatggaaaatctccacgtttacacgtctattcttgcatattaatatcattacatttaaactgtggtttgatttcaaacattgaattaattaagggaacttccaggtcgagttataatgccaaatcaaatgccaacagctccctctactggctactaggggaaaacatttgatctctatcaatcagaaatttgtttacttatttaaaaaacatcttcaccaaattaaattttgattaaaaaatggctaagctttttggtaaacctgaaagatgttcacttataatgat

SEQ ID NO: 190282 - DNA, 203 bp, Homo sapiens
attttattacttgtgcttcctttttcccttgggaggtggatttgggggagtgcagggaatatgtcttattttgtattttccatagttcctaactaagcacatcataaatattcattgaatggaatgtcagttttctataatggtaaaacagtttgctcctatttccaatcctatggtgatttaattaaaacataatagctttg

SEQ ID NO: 190283 - DNA, 624 bp, Homo sapiens
gtatatattcatagttaagtgtcagtgtgagattaatttcctgagcttaattacttggtgtttgatgtactgcagggaaggagttggagcacgaagttctcaggaaagaaatcgtacacatcaagttttacacccctttcactttgttactttccttttgtgtttgctatcaccttgatactatccataacatttttaagcatatgttttaagtcctgaaaaggtttggtcgtacatacaagatttctcttaaaacatttgtgtgaggttatcttgtttatttatttatttattttattccttctagaatatccgtcatttagtaattcatcttaatttcctagcaagtccttgttagatatttgcttggtgaatgaatgacaccaactgtagaacagacacagtgtttacaaatgaggataccaaaatgaacaaaatatggtccttttgtagtttaatgggtatatgtagagttgtaaggaaactgaccaagttgttgtaataaagggcatagaaagttctttgaaaacccagacgcaaatagttcatttactttgcggagactgggaagatttcactaagatgatagcgtttgagcaggacctgaaggtgagtagatacttg

SEQ ID NO: 190284 - DNA, 481 bp, Homo sapiens
aagtgatccacccaccttggcctcccaaagtggtgggattagaggtgtgagccactgtgcccagctgcagattttttatagtattttggagtcaaaggccaaccatgattctggaggggcaccaggtgggcagtattctgagtatccattcctttggtagcactttctggacacatgcgtgagccaggtactgtgctgatgatcacaagacaaatgttccaagtcacagtttcaggtggaagacaggcccacatttactatatactatgcagtgtaagtactttagtcagtagtcaataaagagctttagtcagtaaggagactgagaaagcagagaagggatcaagaaattctaccttgagaagctgaggtttgacatcacaatgggccccaggacagcaaaggcagtgggaaatactgtcaaagatgaagttttgtctgcattgttggtgcttttgaggaaattgtcactactctgtag

SEQ ID NO: 190285 - DNA, 790 bp, Homo sapiens
ttttttttatttttgagacggagtcttgctctgttgcccaggctggagtgcagtggtgtagtctcagctcactgcaacctccacttcccgggttcaagcaattgtcctgcctcagcttcccaagtaactgggactacaggtgtgcaccaccacacctggctaatttttgtatttttagtagagacagggtttcaccatgctggccaggattcctaacatgtaacctttatcccatagcatggacccatcaaaaggcaactcttcaaatgcctttaatgatgacacaactactcaccatagatgtgtaatatactggcccctttcctcacttccacacattctcagtactagacaatggccaaacttttctgccaaacttcactttatgacccttctccggcaacagtgtagaaagcagacaagtgtgcctttaaagtattgataacattgacaacataactgggtgtgatggcgtgtgcctgtaatcccagcaacctgggagtcttaggccagggttcacttaaacccaggagttcaaggctgcagtgagctgtgatcacgtgactacactccagcctgggcagcatagcaagaccctctctctacaaaaaaaataacaattagctgggcatggtgctatatgcctgtagtaccagctactcaggaggttgacgggagaggaccacttgtgcccaagagttcgaggctgcagtgacctatgatcgtgccactgtactccagcctgggcaatcttgtctcaaaaataataatgatgataataagagtgata

SEQ ID NO: 190286 - DNA, 432 bp, Homo sapiens
agattaagtgtaattaacatcaactggtaaatgtgatgtgaggactaagcttggttagtggaagatagatggtgaaaccagtggcctgggagaaggggagagtagaggcagaatggcaggtagggcctgtagaagtcacacaaaatgtacctgctggcagggtaggggagaatcacggaggacctaacactatgaccagcagaccaaaagcccagagaagggtaatctggcaggtgatgatgggataccatgcttctagacagataggcaactttgagaaagagactcagaaaaagaagaaaggctttgatgataattgttacgaaaacctggcctttcatctgggctactttacaccccatcaagagtatatacaatcccagttaagaatcatagaacactgaccaggggcgggggctcacgcctatatag

SEQ ID NO: 190287 - DNA, 413 bp, Homo sapiens
aaggaagctggctgggcttgaagcccagcctgaataattcaccaagtggagaaaggagaaggaaggatagattatgttaagctgcggcaagagcagaggggccccatagagaggaggatggttgcaaacctatgattgcttttcatttctgattaacatgggacatgctgaaattgaataagtggccagtaaggaggcacatttagcatcatctctaataacagccttggcagatgaactcattaggtgtatgcatgcttgtgtccccccccaggaattccctttaatagagtattaattaaagtttgattgctgctcaggaaaaaaaaaatagccctacttaattaagttgaattttaatattgggaatgcattaagaatcttggttgttactgcttcacagccttttctga

SEQ ID NO: 190288 - DNA, 623 bp, Homo sapiens
agtgtgagaccagtgttgcaggggaaatcttggccgccctggcatatggcctggctccgcagatgatggtcgtgctgcgttaatctctctgaagcctctcctcgacatattttagagtgctttgctagcacctggaatcagtgtcagacgggccctccctcccctgaagatcacagttggctgtggtgcattttgcccgttaaccaagcaagggttacttgaggagcttggccagggagcgctgccgggacccagagggcagagggcagagggcagggccggagctgtcaggaaggcccttgaggaggctggacccggttcccatggaagcagaggacggggagaagctggcccgctttgtcccgctgtctggtgattcagctcagctcctctgtccttgacttggctgctgtcttttcattgtcacttggcaaacttttctgtgaaaggccagataataaatatgttagactttgcgggccagatggtctctgctgcagccacaccactatgctgttgtagcgtgaacaccaccagagacgttgtataaatggatgagcgtggcttgttccaataaaactttatttacagaaacaagccactggcccgcttcagcctacaca

SEQ ID NO: 190289 - DNA, 764 bp, Homo sapiens
attcctgcttcctcctcacgctgcccccacatcctccccaactcaccttcatgctacatctcggcaaatacagctcatatccaggcacggtgcagcccttgacagctgggtccgcaaaggcagatcgggtatatctttaaagaaaagttatcttaaccattgagaagccttccttcctcagaggagagcacctccccagcagacctccgaggagaccaagggcaggacaggaagggtgaaaggaagtttcaggactgcaggaaataagagcttggaggtcaagggagagatcagataaaacatgaatctgatcagcatcctagtggtctagagtggagacaatctgcggagtcaacctcagtaaggacacacatagagaagaaccaaagcctctaaagacgaagctgagaagtgtacggtcgtagaagactcgtgtctgttattcttaaaagctcaaggagatgttctgccaattgaatggaaactgtccatagtggggagcagagagcctcatcttttctggaactgaacatccatccttaaggccagatttctcccatcaccaactttaactcctgccctagccctctctcttccttttcaaaaccctctccacccaggaagggagattctggagccaagactgtaccagccacacctccccagagttgttaaggaaggaactcgaagccaggggtgtctctacgtctattaaacgtcatgactgggatcacggattagcaggatactcaagaacagctatg

SEQ ID NO: 190290 - DNA, 733 bp, Homo sapiens
attcctgcttcctcctcacgctgcccccacatcctccccaactcaccttcatgctacatctcggcaaatacagctcatatccaggcacggtgcagcccttgacagctgggtccgcaaaggcagatcgggtatatctttaaagaaaagttatcttaaccattgagaagccttccttcctcagaggagagcacctccccagcagacctccgaggagaccaagggcaggacaggaagggtgaaaggaagtttcaggactgcaggaaataagagcttggaggtcaagggagagatcagataaaacatgaatctgatcagcatcctagtggtctagagtggagacaatctgcggagtcaacctcagtaaggacacacatagagaagaaccaaagcctctaaagacgaagctgagaagtgtacggtcgtagaagactcgtgtctgttattcttaaaagctcaaggagatgttctgccaattgaatggaaactgtccatagtggggagcagagagcctcatcttttctggaactgaacatccatccttaaggccagatttctcccatcaccaactttaactcctgccctagccctctctcttccttttcaaaaccctctccacccaggaagggagattctggagccaagactgtaccagccacacctccccagagttgttaaggaaggaactcgaagccaggggtggtcttctggcaagcacccccactaccagtagcag

SEQ ID NO: 190291 - DNA, 400 bp, Homo sapiens
attcctgcttcctcctcacgctgcccccacatcctccccaactcaccttcatgctacatctcggcaaatacagctcatatccaggcacggtgcagcccttgacagctgggtccgcaaaggcagatcggatgttctgccaattgaatggaaactgtccatagtggggagcagagagcctcatcttttctggaactgaacatccatccttaaggccagatttctcccatcaccaactttaactcctgccctagccctctctcttccttttcaaaaccctctccacccaggaagggagattctggagccaagactgtaccagccacacctccccagagttgttaaggaaggaactcgaagccaggggtggtcttctggcaagcacccccactaccagtagcag

SEQ ID NO: 190292 - DNA, 435 bp, Homo sapiens
cttctcagattccaaactataaaacattagcttgtattttaacttttaggctttttcccctctgggaaaaaatagagtagactggccattggagagctcaaaataaggtatctgctttgtaacgcggtgccttaggatgtggattgtcatagcctaggtgtccaccttccagccgagggcaggggaagcagccaagctctgctgccaccaggaggcccgaggaggcctgcctctgtgatcctcacccccgtgcacactgtggtgtcctctctctctccttcttccctcctgtgctgctatcgtcttcctttctttcctgattcttggccctgctggtggcacttaggactaaagagactgctcagccctgggttagacaacaccgtggtagagaacaatttgtatattgccttgaggcgccctccccgcaccccg

SEQ ID NO: 190293 - DNA, 697 bp, Homo sapiens
tgggcagcgtaaggacggaactgctataacaaagttggagaagacttcaaaaggaggttagggtaaaatcaaggcaggaaaggagaggcgcataatttgaatggtcttcagtttcttcaacttataaaatgaaagtaatacctactttgttaaggttgttttaggatgacaaattagcatagtgaagtgtataacacaatgcctaatacatgatagacacttaagaatgttagttccctctctacaaatatgaatttcattcatatccattatgccctctgggagtgaaacagactcattcttttgaggaaataagtcttgctaaaggtaaaggggctgtctccttctcccattcttgccatatgacactgtctgctctctctttgtcttccaccatgaagacaggcatggtagctcatgtggaagcttcccgaggccctcacccagaagcagatgctggagccatgcttgtacagcttgcagaactgtaagccaattaaaactcttttctttataaattaaaatagataaataaaaataaaggataagcagatgtggtggtacgggcctatagtcccaactgcttaggaggctgaggcagaaggatcaattgagcccaggaggtcgaggttgcagtgagctttgagtgccactgcacgcccacctgggcaacagagtgagaccctgtctcttctta

SEQ ID NO: 190294 - DNA, 339 bp, Homo sapiens
atataaggagctcacaggttatgaagggagacaagaggaaattctgtaaccaggtaattagacagcaaaatgatagcaaatagtaataatttaaaatgtgaagaacttcagacaagtaagtttgagaataattcctgactcaaggtaagaaaccatgggaccatctctatttttatttttcagcttgaaacatgaagagaatgttcaattgtgttatcttttaaaatgaatggaggcgtgtgtgtgtgtttaaaaaacctgtggttacaaaaccattattttgctgcttaaagtgaaaaacttaagctacttggaaaatgttccctatgtgtaaataca

SEQ ID NO: 190295 - DNA, 601 bp, Homo sapiens
tggggcatatactttgtaaatatcttcactcactttgcggtttattttttatcctacagttcttttgaggaactgaagttcttttcatcaaatttatcagtttttcttcatgactggatttttgtatcttgtttatgaaatcatttcttattccaagtgactttttctatattatacgctgaacactttataaatttgtctttcatatttgagtgtttaatccaacttggatttattacttatatagttccaatttctccttgttccatatgatctcccaattattcaagcactatttattaaaatgcctgtccttactcaccaatctgcgatacccactcttccatatatcaaatgcctttaaatgtacatttctgctctgggctctactctattgcagttatctatttgtctattgctatgctaatatcatagtgtctttttacattagctttataatacagcaacaattgatagtgcaaatcctcctttttcaagaataccttgactgtatttggccctttgcatttctgaataacttttaaatcagctcatcaaagtcaacaaaaaatacgttggaattttgactggtagagcattg

SEQ ID NO: 190296 - DNA, 283 bp, Homo sapiens
tgggggcgggggagcaggggttgactgaggagaattgcttgaacgaggaggtggaggttgcagtaagccgagatgacgccgctgtactccagcctgggcaacagaaagagactccatctcaaaaaataaataaaataacaaacctacatttagctaataggagcacttaaagctcttttgatctagattatcagtcccggaggtggggatatatggccttccggttactgggagtgtcttaagtcctggctaaacttacttgaaatgtgtgtgagaaactgtc

SEQ ID NO: 190297 - DNA, 264 bp, Homo sapiens
gctggaggcggcaggaagggccccgtagggagaccccgagggaggtggagaaggaacaagaccccggctgggggctgcaggtcggatggagcgtggggcctgaagacccggtgggagggtcaccccagccccactcgtgggacttggggtctggaagccattgatcttcctgactgctgtgagtgggaccgaagggccgcatggaggtgagagtggtggtctgggggctgctgtggggatggggagggtcgtagaggctggtgg

SEQ ID NO: 190298 - DNA, 1237 bp, Homo sapiens
cataggactaccgcaaatatgcagagtactgagtcggggaacaaagacaccaaaaatgcagatgaggtcctctggggacatcccctgccccacagcggcccccggctcaccgccgctctctgtccctaagttactcaccgtgttttgacaactgcttattttctgaaattgcccggacacgtagtctagggcatgcttgtataattcagttattccaagaaactaaagtgcctttcctaggaaaaggttccaggaatagtcatgagtgccctcgatacaattttttaggtctgctgccccttctctccaaagctctacttttcccaaagctcttcagactgccttgctgaggtaggagagagagcctcaatcacttaggtgtcctcatcagccctctccccagactccactggctggctggaaaagaaatcgggcatgaattgtagaggattcttccaccttaaggcagctgttagtctgatgtagacctgcatagaggaactgatggaactgagcaggatgtttggacccgatgttttttcttcatactcttctgtcgcctcctcccatttctgcacagttctcacccactactctaccccgtcatgcttccccttgctacgttgctgacgagctgtgacttaactaagaaataaatacaaggtatcagtctttttttttttttttcaaaattcctaatgtcgtggatacaaataacaccaagcaaacaagcaaaactgcacatggtgcaatccattcctgatttaagaactaggaagaaccaagagctagagaaaaccagtattctagacaaaatttaaatctgcaaaataacgacgtgggaaagctggactcttgagaaataatgaccacaaaagaaaactcatcgtagcaaagtgagtaaaatttgatacgtacataaagtacgttgatgaatcgaatctttacgtatgagttaaaacaggaaaaaaggtatgaaacatacacaagagaataatatcacggtaaaatgaatggaaaacatttgggaaaatgttactgcattgtttagaaagttgatcaaggaattaacttggcgtaaagaaacttattccagaaacactttttaaataaagatccattaacgtcttaacatatttgattaagatattggcttcaagtatatgggaatcagaatgacagtcacaacttgtcagaaatgtagcagggtcgtaatgatccttcaccaagatgagca

SEQ ID NO: 190299 - DNA, 238 bp, Homo sapiens
cctctgtggcctcccaaagtactgagattgcaggtgtgagccactgtgcccagtcctatttttttgaagtgcaattacttgtctaatacacacacacacacacacacacacacccacacaccctacctgagtttttaatatattcttgatcttaatggtgtctttgaagacagttgcacatattgataggtaaacttttaagtaaaccagccttaattgttaaaattataaatccaag

SEQ ID NO: 190300 - DNA, 144 bp, Homo sapiens
tcgcctgttcaggacatttcatatgaatggaattatgcaacgtgtgctatttagtgattagttatgtcactctgcataattttatatttagagttacctgtgttgtagcatgtatcagtattccattcctttttatatctaata

SEQ ID NO: 190301 - DNA, 622 bp, Homo sapiens
ctcgcctgttgcccaggctggagtgcagtggtgtgatcttggctcactacaatctctgcttcccgggttcaagtgattctcatgcctcagcctcccaagaagttaggattactggtgcatgccaccaggctcagctaagttttgtatttttagaggagacgggtttcaccatgctggccaggctggtctcaaacttctgatctcaggtgacccaccgccttgacctcccaaagtgctggcattataggggcattataggtgtgagccaccgctcccagcctatatataaaagtgtgtgcttctaatggctatatttctattaactactatcagtgtaacattgtaaaaggcactgaattaaaacctcttggaattctaatcctggttatgatcttgcatgaatatgtaatctcaggatgataacttttcttgtacaaattattgtccataaagtgaagtgtttgtgcaatgtccatctctcaggtatctatgatcaaattgtgacattcacagtggcttgttgaaagcttacaagtttacgtgatcttattccctgctttactattttcaaaatctctgtgactactaatgtctaatcactttaattaactagtccttatga

SEQ ID NO: 190302 - DNA, 346 bp, Homo sapiens
tccacatatttccttgtaggtatcttgtttccatcctcttcctgaggtggtatcacagaaaactctaaaagtgatattgtcagaaataaacgccaacaggtggcccatgtgtagttctgtgcctgcccctgggcaagtcatttatttatcatccctttcgcttttcacatttccagctctgagtggtaatttggagccattgggatctaatgagaaaatgaaaggcattgttaccattattgctctggtgccatgaggtctctggtgggaacatttgagagaggaagacaataataaagaaaaaagaaacctccctagaattcagctgtactgtctggggcctcct

SEQ ID NO: 190303 - DNA, 355 bp, Homo sapiens
aacccatcctatctatcacaaactggatgattcttttaaaaataattctgcttttgactttcaacttcttaaaatatattaagtggtcacacagtatcaaacccaagtcaacatgatttattaccctctctaaatatggctcctatctatttttcctagccttatgtgcagcttctccttcaaggaacatatatgcctgagccaaaactactcaatattacccaaacatgctatccatttctacttcaatggatgacggcttttcccctcatatcttcattcctgcctcactgaaacaagtgtcacttctttgtgaacttcaaactccctgaaaaaggtattgcagttcatctgt

SEQ ID NO: 190304 - DNA, 311 bp, Homo sapiens
agaatatatcaagggtagcttcttttttatgggagaaacttgaaaatgaaggaagctgaggggaggatccagttgagagaaaattgatgatgtaagcaagagaagagataatgacaatggagagaccttgagtaattgggagaagaatagatggagggaccagtcttaggtaatagtttctttctgcaggacatgaggaaaaaatggagcagttatagacacatctgtctgtgtggggaaaggagtgtgagaaagtcctctcctaaaagacaccatttttttccctatgaaatatgagaaatatcatctgc

SEQ ID NO: 190305 - DNA, 498 bp, Homo sapiens
ttgctgagtcgatctaaggatccccctggtacgggcagtggcaactacgataaaagagtaactgcaagatgtaaggaaacatgtggtgtccttgggctgaggggagtgcatgaggaaggatggacctggaaggggaccctccgaagctggggttcagacctcttgagagcaggtgtggttttgcccacaggaatgcagagacgttcactggcttccccgggctgcggttggtttgtggtcactgggtaagcaggaggcgaccctcctgggtgcagcaggcccaggctgtgagcaggcagtggcgtggtcctgccgagggaattcggtgccagtgtgggcaggtggcctttgggcactggtttccacattgaggactgtgggaagctgggaaattttcaggaggtcaggctgtggctgtaggtcgcctggggactatgtgtctcggacagagcgtgtccagatgtgcttaacaccacactccgatccaccccgtagcat

SEQ ID NO: 190306 - DNA, 331 bp, Homo sapiens
ttatatacgagtaagctgagattaactctatctttcccattatttggcaactgaagatatgttatagtgtggcataaaacagcctaattttgctaagggaaattgataacctgcagtgggtgttgagaggagcctgagggtgctggtaatgtgctgtttcttattctgggtgctgtttatatgagtgtgttcagtttttaaaaattcattgagatatatccttatcacagtcatgtgtcacatgacattttttggtcaatgacagatggcatataggacgatggtcccataagattatgctggagctgaaaaattcctatcacctcatgat

SEQ ID NO: 190307 - DNA, 436 bp, Homo sapiens
aacatgctgttgctggtttggaaagaaaaagttttcaaattgagtactatctaccagattaaagggaaatttctcagtctttctgactttccaaactgtaggtctactatccatcactcttgacaaaaccaattatccactgcggtaaaatactcccatcccattcacccaccagcctcccctctctcttctatcaaaataataatcaccatattatttaatgtttcacttcccatggtgaacctctcatccctctttctgtgaggcttagcaattattacacatctttcaagatgtaaaccgtacttcatctcattgatgaaagttttactaactactctgcttcctctagattccctttttctgatgtcctataagctgtaaagtgctacatcaaagcttttaccaaaaatactatttttactattctttcact

SEQ ID NO: 190308 - DNA, 378 bp, Homo sapiens
agtcgggctgatttactgatggagatcaccttgggaagcctgtgaggagagttcagacccctggaattcctacactcccacccaggagaacctgttataagcattcaaccacagccccggctaatgaccatagtggtgataccaccagctcttgatcgtaggaggtatagggtgactatgaataaagtaaatcactcaaacaccccctctgactcagttaagaagtccagtgccacatctccagtcctctcttgtacctgcatcagaatcattaagagcagattggagctagactgtctgctttcaaatcttggctccgctacttcctgtatactgtttttgtgagttaaagaatttaataagtgtaaagcagttcct

SEQ ID NO: 190309 - DNA, 252 bp, Homo sapiens
aggctaaggttgtttggatgttattttaagaacaatgggaagacactggaggttgccttaaagacatgtgtctctaggcaagcccttcagattaaaggctgcattattattttgcttatacaagatttcatgctatacccagatgcttacatttagggtgctgaattaggggatcacaataaataatactaataccagaatttattctggaatattccctgtagcatctgtacagaatctggcacaaggtgg

SEQ ID NO: 190310 - DNA, 459 bp, Homo sapiens
gtgttcttcagtatatggagatattctaaaatgggataatactggtacccacttcagaggtctgttgagaagattaagcacattaatacagcgaagcatttggaacagtgcctattttagcatggggggttttatttgtgaataagtctgttgaatgaacaacatagttgaaatggggtgttttatttatgaattagtctgttgaatgaacaacatagttgaaagaacacaaccacaaaccaaacctcagttaacaagtcaaggggaaaaacttgtgactctactggcagcagcagatgatgggtgtcccagacacaagctggttccatgtggtggatctgtgtctaggctattaccatacaatgaagggaaacttacttggaactaaagagacttaactatgtttaattaacttgtgaggagtatgtttttcagagtggcgattttaatcacccaccc

SEQ ID NO: 190311 - DNA, 644 bp, Homo sapiens
acagcaatcgcaggctgatgctcagcttttcggatgctaaaatgaaacctatgctgccagctgggagacacccttccttcctgtcagtgtcttagaaatgggggtgagcaatcagcagcaacaggtggcaaggagagtccagtaggtagtgtgggagccaaaggatgaacagggctgaagtctcatttccagaacaagaaggtcaaggaacagatcctggattctcctgccaccatgaatgctgactgagaaggccattcctgcttcttcctctcagtgatcaattagagacatcagttactgaattacaacctggtcagatcctgccccctcctctctcctcccaaccttgttccctaattgggatttggcagttgtttcaggccaggttttcttttcactttatttctaagggctccttcaaggctgaaaacgagatggcaataagatagctgaaagtcctcatctccccaaaataaagcacagggaaggacatgggttcaggggccagttgtagcaccatgtttgagcccaatctttgaagctgctggctgtgttggaatcctggatcccgtttatgagcctggtgattgtgggaaatcaggtcccctctttgtgcctcattttcttcatctgccaatggg

SEQ ID NO: 190312 - DNA, 337 bp, Homo sapiens
atgtgcaaggtaaggatacaagaaaaccctgaaaatgacagacacggagacagatggagacagacacttctggaatggaagccgcgaaggagaggctcattaattcagacttatttatctcaggctcaaaccagaatggaagcggcatgagataaacatctgcccagtgaatgaaccagtcacatggcaagacagagacagagagatggggacagtatctctaggtcaaaggtgagggagggagagaatattggaagcccaggggctgggaggaactgggacagaaagtgaagatgttgacagatgcaccgaggcaaagacatggtgaaattgaaag

SEQ ID NO: 190313 - DNA, 292 bp, Homo sapiens
tgtagaaacatttggtacacagaaggcagtgttcatcttcgacaggctaaagaacaagggtggcccgagcatttccctaggcagaggaaaaagccaataggaaaaaggaaatcactgagtcattcaacaaatagttattgtatgcctaactgctgggcagtcattcaccagggaacaaagtcctgacactaatggaatgaaacagacaataaaaagtacatgctatgaagaagaaccaagggtaaggggatagactgcaaaggggaggggtggctattttatacagggtagg

SEQ ID NO: 190314 - DNA, 674 bp, Homo sapiens
tacaaaattagctgggcatggtggcgcatgccagtaatcccagcaacttgggaggctgaggcacgagaattgcttgaatttgggaggcagaggttgcaatgaaccgagattgcaccactgcactccagcctgggcaacagggtgagactctgtctccaaaataaacctaacagaaaaaacttacactcaaacattaaaacagagtgctggaactttgtcctagcatataattagttacttgtgatttgttttcttcttttaagtcttgctattaagttttgttaggaaaagcccaggttggcctctactccagagatattaataatttagccccactaagtctctatccttctgaagactctacccaatacctgtgtgttatgaggtctctttactctggttgatggaaacacaaactatgcctagccctgtgtaaactccaacacttgttcggcctcctgctttctggttttactttttccaaccttctggaatttcaccccacacctgtgtagatcagtccccaaagacttgagggaatctctaatggtctatgaggctttgtcgctttctctctctctctccccatgcagctcttgcttctccagcactctctcccacaaattctagctgatattcatggccttgaactcgaacccagtgtgaagatcctt

SEQ ID NO: 190315 - DNA, 326 bp, Homo sapiens
tacaaaattagctgggcatggtggcgcatgccagtaatcccagcaacttgggaggctgaggcacgagaattgcttgaatttgggaggcagaggttgcaatgaaccgagattgcaccactgcactccagcctgggcaacagggtgagactctgtctccaaaataataataatgataagaataataatgccagggtactctcctcccttaatgccagggtactctcctcccttgcaccagtagggaaattcaaaccacaaaaccctggcctgtgcatcagaactctcaccccagctttactccctaacagtaaaacccagggccactt

SEQ ID NO: 190316 - DNA, 453 bp, Homo sapiens
ttggccctttttgttcagagacagagtcttgccctgtcacccagactggagtactctttaaaataccacagtaacagaaacccttcatatttttcacaccaagataatacattttttctcaagtctccaacttcaagaattgtacaaatatgactgtgacatcgcttaaaaatacaggaaaattaaaaaaattgtacaaataaaatgaatcatgtctatgacttattaatggaacttcagtggcaactcagaggtatgtgacccttcgggaggtgacaacactccagatctgtgagtggcccatgggcctgggaagagcgggagcctagcctggaaagcagcaagtcctgcttctctttacttacagccccctgctgtcccaaagccttggaaatcacacacagagaacacaggtgttcccaaggattaaaaggaaataaatgctaagtggca

SEQ ID NO: 190317 - DNA, 184 bp, Homo sapiens
tttttgtctttacgtaaatttgaggaggcttggcattggtggttattgatagccacataggagtttttcagtagaaaatagattgtctcttgctcttttaagagaaggtatgggagagaaatttaagtttttacatatgtgaggtattttttacttaagtttaatatagttgtgaagaaaggga

SEQ ID NO: 190318 - DNA, 315 bp, Homo sapiens
cacctcccctgccactgccctcagtgccttacacagaagagttgctcaataaactattctaattcatttctatcattcctgtgggcatttggaatggtacagaaacctacttactagccacatgttgatggtaatatttgtgtacccagaattttttggtgagtgccaacataggtactagctggatttttgagacttgaaaacgctgaagtgaaaataaactaactacttgctcacattttgtgctaagttgctgaagcatagcatactacttaatgttgcttaattctccaataaaataattctcattttctg

SEQ ID NO: 190319 - DNA, 623 bp, Homo sapiens
cgcaatggccgggaagaacttcctcttccttggctctccccacttacttcctgataacctgagttgaagtcggtgaagacattcatgatttaaacaccagatcctgaaaggcattaaatctactttgaaatgaatctgcaatcagtatttcaaagcttttctgacgttgctgaatttgaattgggatcacatgtgtttcctcatctaggacctggtgaacttccaacactatgttgaataggagtggtgagagagggcatccctgacatgggtgcaggctatgaagatgggaaaaggccgttgatcactctggcttcttcctgctgacagcggacatagtgggaatgggagtgaaccccaaggtgagagagtggaaccactttgcaactgtctgagcgtactcatgcagccctggcttttcagtaggcctacacagaaaatgtgagactgaaaacccctgcatccttgagctcatggacgatgtgctctatgaggcagtagaggagctccgcctggtactcgacactccacaaagcaactctccctttggggctgcagttggtgaacaaaaagaaactctcaaggatccaagatgatgctgatagtaagaagtcattttttgt

SEQ ID NO: 190320 - DNA, 447 bp, Homo sapiens
gtgcagtggcacaatctcggctcactgcaacctctgcttcctgggttcaagctattctcatgcctcagcctcccaagtagttgggactataggcgtgtgccaccatgcctggctaatttttgtatttttagtagagacggggttttgccatcttggccaggctgctctcgaactcctggcctcaagtgatccgctgacctcagcctcccaaagtgctgggattacaggtatgagacaccgcacccagcctacttatttttgatgcttagtgattttagagagtaagtaggttttgcaagtccattggtcctttaaaataatttctagattgttggcattattaaaaccctaaatccttttaggaactattgcgaagaaagaatatgatattcgtaagagctcagtgctaatattagcattggttatggtagtgaaagaccagataaa

SEQ ID NO: 190321 - DNA, 687 bp, Homo sapiens
aaaaattcccatttggctgccagcctcgattcatagttccctcttccagctcccaagcaaatatttttcaaatagccgtgctaagccttttccaggcatgatttgcgggcttacttgctgtcattctatttttcagcaaaactctgggtaggaatgtcggaaattataccttttgaaatccctccttgaaaacatggagatttgtaggtatgcagaggcaattgtaacaatataaagtattgtatctcttccactagagtaggagggcctgactgtcggcccctggggtctgtctttcattacttgtcttgacttccgctgtaaaagcattaagtgggaaggtagcagttctgctgaacaagcagacattgccttctgtaagagaagttatttaaaacatcgaaaatatgtttgaaagatattggtgtagtttcctctgacctcaatttcatacactagtaactctccggtgtctagagttagtactgatggactccctgccgggtggccagaaccatgtgtccatgccagatagaagattctacttcacttgattgaggacgctaagaagttgtgctttgccatacatgttgcccctaaggagaagctgggcattttaaagaatagacttaaaactaacacacatactctgtttttctcacacacacattccgtactctccccttc

SEQ ID NO: 190322 - DNA, 214 bp, Homo sapiens
atctctagaacttcttcatcctgcataattgaaactttatacccatgtttcataccttcttgccggaacctgattttccctctccctggtacatatttgctcattctacaacatgccctcaaggcatccctctctgtcaagccatccctcctctctctgtctcaatctctgtctctctttcactctcccctttccctactcttagcttactttg

SEQ ID NO: 190323 - DNA, 522 bp, Homo sapiens
aaacaagcaaactcactttagtagcatttctaccaaagaaataatagaaatgaaacactttcacctagaaggtaccacatgacaatgacaattaacctctctcttagcaggctccaagaatttataaaatatcagtgaatatatggtttttaaatagcttgctttatgcagatgttaatttaaggtttaggtttcctgaccttgcaacccattctcagtgctatgcatgatggatatcattttctaagtcttcaccatggattattttactaaaatctattcattcctgaacacatgaaagtacttatttgtgttgcatagaaattgatttgaaaacaaaacagaaacaaaacaggtgctcaacttgaaaagaaaggttaatgttattctgacatccttcctgagcattgacaagggtcagtgcacgttttcacatttctttttccagcagttcaaaaccgccactcagcaccacaaaaaataagaaggcatatgcaatcgggagacaagatcgtctccaag

SEQ ID NO: 190324 - DNA, 346 bp, Homo sapiens
gatcagacttttcacaagaggatggcactaattaaggtccaggcagtgggacaggatgggatagggagtaggaagagacaagcaagtctttttaacatgactcagatctcacaagtggttttatctgcccaagatcatcaagaataaatgaaggaaggggaaatggggaaaaattgtgtgtatggggaattggggtgggaagggacaatattggaaagggataatgctggaaggaaattttaggctgtggttggagtttcttgcttcctttgagagaaaattgttcaaccatttcctttaaaagtgtaaagcatacaattaatctacaaatctagatctggtgtgg

SEQ ID NO: 190325 - DNA, 326 bp, Homo sapiens
agctattgtgaaaggaaaagtagaaaagcagaattggcagaccataattggaatatcatttggactcttttaggaaagactgtacaggaaacctcaaaatttggaagttgtttccttgaaaacttaatttgtatatcatctccagcaccaagttataaagctatataaaactataacttggtggtagagatgatatatagctgagaagcaagtgctcagaagtgaggagagtaagtgatgggggtgccaggtgggtgtaccaatatgtaaatggcattcaattatagaaatcaccaaaaaccaaataactgaatccagaatggctg

SEQ ID NO: 190326 - DNA, 482 bp, Homo sapiens
agaattagacaccaaagctccaggatttgaccctatccgctgcctggttgtaaagggaagtgacagctgtcccggaagctccttggcactggacgttcctcacctggcctcccacggagccaagggcgcacctgccctgaaacccccatgcgtgagtgtatgcagcatgtgcacacctgctggggacctggggccaggaatgcctagtgcagggagaacacccagcatcacctttaaatgtaacctttgccacgtggagggcaaaaacaccttcctagactctttcccacgcctccacctccttcaacctgtttctgactttaagcagccgtaagtcactcttgtctccacagatgtccagcaggaacaaggcactggctgctcagttacgttccatggggtggccacgggtcaggacccggagcactttgcaggggtgggtcccctggtctcctgcccctccctcgggacccaccctggag

SEQ ID NO: 190327 - DNA, 420 bp, Homo sapiens
gtcaggagttcgagaccagcctggccaacatggtgaaaccctgtctctactaaaaatacaaaaattagccgtgcatggtggcgtatgcctgtattcccagctactcgggaggctgaggcaggagaatcgcttgaacctgggaggtggaggttgtggtgagccaagatcatgccactgcactccagcctgggcaacagcgtgagactgtctaaaaaaaaagaaagaaagaaaaagaacatgtttctgatatatttttctatctaaagccatagcatctttaatgagttggtgttctttctgcttttttatatcttaggggaatagaccctttggctcagtattcacttgtgaattcttatgaagagtagagataattatatatgcaacctcaatcctctctctctttccgccatatctaat

SEQ ID NO: 190328 - DNA, 261 bp, Homo sapiens
gaggatttcaaataattcaccttaagtcaagaaacatgaacttgggttaaaaggaagttttttacacagatttacacacattccctaaaagcacataggttaaacaatgtgggcaatttacttatggaacctaatatgtatgacaaaattaaaagcaagctcatctacttttaggcaaagagacagtacctgggggtggggaaattctgacaattcactaaaattcactaatctttctgttaagatttcactctaagcttc

SEQ ID NO: 190329 - DNA, 346 bp, Homo sapiens
agcccccactcctccatgcagtctctcaaacaggaatgtttcaattaactcttgccatgctgtttgtcttttcacctcatatttaagaaaaatttaaatgcttagattgcttctaatatattttgctagattctgacctataactgcatcctatgagttgaatttaactacagtggtagacattctacaaaaagagttatatttttgaagaacaaaggaggaaaatagtagcctcagagtgaatacagttatgtcctttattcagttctcctaatctaataaagatagtgattctaactcatattttatagtattctaatatgtcttaccagctatcataggggtt

SEQ ID NO: 190330 - DNA, 251 bp, Homo sapiens
aggaggaagagaaagaggatgaggagaaggaggaagaggaggaggatgagtaggaagaggaggagaaggaggaggaggatgaagaggaggaggagaaggaggatgacgaggaggaggagaaggaggatgacaaggaggaggacaaggaggagaaggaggaggagaaggaggagaatagtgaaagctacagaaactaagaactcctagagaaagagggtcagatgcagagaggacagcaagctccctactga

SEQ ID NO: 190331 - DNA, 327 bp, Homo sapiens
aacactaaaaaatcttttgaaaagtggcattattttcttctctactgaactactgtgaagtttggacaatgtcaaaatttcacatcctaatcttaccttattaatttctaaattcagatttcataatcttgggccgggcatggtggctcatacctgtaatcccagcactttgggaggccgaggcgggtgaatcacttgaggccaggagttcaacaccagcctggccaacatggcaaaaccccatctctactaaaaatacaaaaattagcagggcttggtggtagagtcggggtttcaccgtgttaaccaggatgggcaatcaagctt

SEQ ID NO: 190332 - DNA, 496 bp, Homo sapiens
taaatcagctcggtccctggtagctggttttctcggggagcgagccagggtgtgcgtggaggttatgcttcgtggctgtggcgactatgcagctccttctgtagacagctaacggagctgatcgggatacagcgctgtcagaacaggacattccctcctcttttctttttgcagcataatgggtggagtggttttgagccatgaagtttttttcctccaacatttctcaacttaacaagtttagcaatttttaacaacttaacaagcctgtggccccaacatatcacaattgtgaggtgatgtggcgacagacgatgaagaggcaaagtggttgttaggtggattccaggtgagacagttgaggcctgcctgggtccatgacctcatgctttctgacattgctctgttattgccagtgctgggggtccctctgcaatgcagaaggtgttcacacctcatgcaggtctcctctgcagtggcactgggagaactggaa

SEQ ID NO: 190333 - DNA, 137 bp, Homo sapiens
gtatacccaaaatatcattttactctcaatatcaaaaatactaagatattctacttcctctttttcatagtaagactttgaaatctggtgtgctttttacactaacagcacatctccgttcaattcagccacatttc

SEQ ID NO: 190334 - DNA, 220 bp, Homo sapiens
gtccttggtgagatgcccttcctgggaaactccgtggcgtggttgcttcacatcaaccggaattgcagatctggttctaaattaagactccttgtggggtggagggtggaggatcttacactcctagctttccccatgtcctgtgcatattccttctctctactgcagccaagagtggctgttgcagcctcatgactcagtgcgacccattgcacaactc

SEQ ID NO: 190335 - DNA, 398 bp, Homo sapiens
gatgggtgtggctataaagggtaagcactgtatcttgatcatggttggttacataaatctactcacatgataaaacggtatagagctatacataaacacataaatgaatgcacggataaataactgtgttagtccattttgcatggctataaaggaataccggagcctgagtaatttataaagaaaagaggtttaatttgttcatggttcttcaagctgtataagaagcatggtgttagcaactgctcagcttctggtaaggcctcaggaagcttacaatcattgcagaaggtgaaggaggagccagcatgttacaaggcaagagaagaagcaagagagagaaaggaaagagatgccacactcttttaaacaactagatcttgtgtgaacaaactgag

SEQ ID NO: 190336 - DNA, 350 bp, Homo sapiens
tttctctccctttagatctcataatatttgctttatatatttactttatatattgggtgttctggtgttgtgtgctcatatactgacaactgtcctaaccttctgctgaactgatttccttatctttctttatataatgaccttcttttctcttttgacagttttttacttaaagcctattttgtctgatgtaagtattactacccctgctttgttttggtttccattttcacagaatttcattttctcttctttcacttcagtctatgtgtggccttataggtgaagtgcctatctggtaggcagcatgttgctgaatcttgtttttttttttttttaatttaatccat

SEQ ID NO: 190337 - DNA, 291 bp, Homo sapiens
aaacagagcccaagctcttccagccaattcatccttatctcaggttgttgcattccctgcacattctacaattattcttgagaacaagtgagaaaggggaaggtttgaggccacccagagagctgtcctgcaagtgtttagtgtgcctgtggatatgtgactactttgaaaattccatgtgttagtggcccattgaatgctgtgttttctgcatttaatcttgctttttttttttttttttttttttttgagaagaagtctcgccctgttgccaggttggagtgcagtggc

SEQ ID NO: 190338 - DNA, 763 bp, Homo sapiens
gaaagaatttattgttggaaaacggggcggcaagatggacaacattctctgggaccaacgggatgtgcagcctcctgggctcaggcctcaccagctcctgcacagtggtgggggtgaggactgagggacacatcacatctcctgggagcagaagacgatgtctgcgaacccagctcaatatgcatggccttgtccccaggcaggggcggcctcagctggccaggtgtccccgtcactgcagagttctggtcttagactggctgcacacggagactccagggcagcaaaacatcttctttcctcaccctcaggctctctgagccagcacctcctgatccagatccatttctgaactcctggatccaagaccaaggtcattctcatcaacccttaagccagtgaaagactcttcctggggcctcgtgtgctggtgcggcttccagataatgatagccaaggtcacacttgccgagagccctggtgattcaggcactcttcttagtactttatgcaaattatctcattgaatccttacaacaaacctctgagggagctggaattaccatattctttccatggaggaggaagcgaagggcagagaggtggagccacttgccctgctcacagagctaggaggaggcaattcgcaatgtgaactgggtggctgcgtctccctccacgctcttcactgctctgcccacctgttctcagtccactggccaaccagaatactgtcccagatagcaagtgtgacactgttgcc

SEQ ID NO: 190339 - DNA, 391 bp, Homo sapiens
aggggcaaacaggctcccttggacctcatttataaaggcacttatcccactcatgagcactccacccttgtcatctaatcacctcccaacgatctcttaatatcatcaccttgggagtgaggatttcagcatataagcttgaggagagaaacacattcaaaccatagcaactacacttttctgaagctaggataatcccaatactaaaacctaacaaagattgtgggggtgggaggagctcaatcatttgtaaatgtagttgtaaataatacagcaaaccaaattctatacagttttaaaagttgtccagcattgtcatgttagttacattttagaaagtaaatttgattaaatatatcattccagtaaaaccaataaaagatattttttc

SEQ ID NO: 190340 - DNA, 375 bp, Homo sapiens
gtggttactcacttggtggggggatttctgctccctcccacccaactattggttatgagagtcttttgtgtttatgattgttgtggtgtgagaggagaggaaatgtggttagtgtttttcccaaaccatgggagagtgagatgacttttttagattcagctgagagagaaaggaaaagatgagaagaagctgctaaaagaaatggagaaatataaaaagaaatgttaagaagtgctgctgtgtgatctacttgttgacactaattcagaaaaacttcagtaaataactacattatttttcaatactattgagagtaagatttctacttcttttggatgcatctccaaaagctgagaaggcccttaaaataggagc

SEQ ID NO: 190341 - DNA, 674 bp, Homo sapiens
cagggcaattaagaacaaaggaaaaagggcaggcagcttactgtggtgagcatagctctacaagattgagagaaggcacagagcctgatgcttcttccactgtgataggagagaaatggaacatgttcccaacaatctggcctcagtgaaccaccagggtcgggctggattctgtcctgcctcagaagacattagcatggctctatgaattgtgctaggggtaaatccatctaattaggaatcctcccacacaaatccagagaagacacattcatagaaaaggtttgagaggctcctagaatctctagcctagtgaattggttaagctctttccatgtctaaacaagtccagaaagaatgggaagggtggctgcttcctcaaatgtgcagacaccagtgcaaaagtataagaaacaagaaaaatcagtgaaacattacactaaaggaacaaattaaatcgtaatacacaactctaaagaaatggagatctatgaataggctaacaaagatttcaaaataatcatcttaaggaagctcagtgagttacaagagaatatagacaactgaacaacattaagaaaataattcagcaacaaaatgagaatgtcaacagaggtagaaattatgtatgtatttatttatttattgagacagagtctcgctctgttgcccag

SEQ ID NO: 190342 - DNA, 170 bp, Homo sapiens
gggtcagatggggcatgggggaggacgggctggaaaagctgtcattggtgttggaaccttgccttgcaagggaagtcgcagagaggctttgaatcttgacctctcctaatcaaaaggaaagtgcactgcctgccattcctgtgtgaagaccactcctctcctggctgtta

SEQ ID NO: 190343 - DNA, 332 bp, Homo sapiens
ccgtctcaaaaaaacaaacaacaacaacaacaaaaacaagtaaagaagtgctaacacttgggctaggctacactgtgggaatgaattcatgaactgaatggaatctgcacatacttaatcaaactgtgtattctgaattatgctcacgagatgctaagatggaaaagaacatgagtggtagtgcagctggttcctcccgctgtgtcaactctctgcaggtcctctgatgtctgctaagctcctcccaaatgtacccatcatgagaaagactctgagcaggacttccacagcactaatctccccccaatgccaccagactcttaattctgctt

SEQ ID NO: 190344 - DNA, 431 bp, Homo sapiens
catatcctgtctaaaacacacacccatactttaatacacagacacccacaccctaacacacataccacaccctaaaacacaaacacaccctaacacacacgcatacagaccatacacacccgtctaaaacacacatacacacatcttaacacacatcctgtctagaacacacacccatacttttaacacatagtctaggacacacacaccctgtttaaaacacacatacataccttaacacacatcctgtccaaaacacacacacacacctgtctaaaacacacatacacaccttaacacacacacactctgtctaaaacacacacccatatcttaatacagtctaaaacacacacactgtctaaaacacacaccctaacacacacataccctaacacacacgctctaaaacacaccctgacacacacacc

SEQ ID NO: 190345 - DNA, 370 bp, Homo sapiens
gcagctagcttcctttttttataatcacagggaaagctctctccattgtccatcaaatcagctctagaaggtttttcttttttttctacaagtgcacaaaggggaaacactgattttaagaacctccttttcccaaagttttggccacaatttcccttttcatcttcctagtttgttaaattggctcttctccacatctcctcgaggagatgtggagaaagaagagggtggcagctctggtgcagggcccagagcagggagccaggtgaagagtggctggacttggctgccaccctctctgtctgaatcatccaaatcaaaattggccagggatgagggtatagtgctgggaccagacagagccaccacc

SEQ ID NO: 190346 - DNA, 106 bp, Homo sapiens
actatttgttgaatgaaatgatgctaacttgtactgagtgctggctatgccagatacttttatagtacattacacattattaggtcattttctcagcagcctctga

SEQ ID NO: 190347 - DNA, 328 bp, Homo sapiens
ttactgcaagatttcttcaagaatagctagttacttccttttccttgccatctttaatcctctacaatcttgtttcaaacagttacaacccatgacttcttttattgccacatctacatcttggttgttacctttcctctcttgcttggcccctttactgtttttagctgtaggtgaggaccactcttcaggttggctcctgctgtttctctgactgcttcctttttctttttaggttcttgattttcccttccatttctaattgagcagtccccaagattttgtccttatgtctccttccatgttctttttccatcttgagaagact

SEQ ID NO: 190348 - DNA, 101 bp, Homo sapiens
ggatcatgtctaaagggggcaataatagagttctttgatggggaagggccagtaagtcatgttgtgtcacttatagagaacagtagaagaaaaaatggaaa

SEQ ID NO: 190349 - DNA, 240 bp, Homo sapiens
tgattagggtgtctctatgcttaggaaagactcaggaattatcagcccctatggctgctcaacaggttttacttccctgctctttgtttgtaagaacaaagcccagaggagaggcctgcctgaatgctgaattcttctaggtgccaaggggcagagcccaggaggtaaagtccaggaacactttgttatcaaggagtggttttagtgctggtgtgatggcttctggaagccttctcactg

SEQ ID NO: 190350 - DNA, 363 bp, Homo sapiens
cttaaattgcaaaatgacaaaatatattaaaatactagagtacaaaagaaaagatacagaaaaattctacaaaggtatatatgaatggccaaactgtccaacatacataatccttgcataagcacccagtatgtcctaacagagaaagaaaccagttccagaaaaattaagtcaaaataatcacatataagagcttctctcttttagcccttcagtgacagctgaacgttggtcattaaatgggcatggaagaaacagagagaacaccatcttctgtttgaacaaaatcctgatctccaccaagaactgaaattgggtcttctccacttggaagactcctctctctatagagaaagagagaga

SEQ ID NO: 190351 - DNA, 769 bp, Homo sapiens
ccccacagcctcaccacctgtttctttgtttgagcacaaataaatagcctgggctccctgtgtacccattgttctcacttaatacatgagaacatgcaatatttggctgtttctgtcgttaattcacgtaggataatgaccttcagctgcatctgtgttgctgcaaaggacatgattttgttcttttttatgactgcctagtactttgtggtgtatatgcaccacattttctttatttaatgaaccgttggtggatacttaccttggttccatgaccttgctgttgtaagttatgctgcgataaacatgggagtgcagtgcctttttatgtaatgatttctttccctttgggtagatacccagtagtgggattgctgggtcgaaaggtagttgtacttttagttctttgagatacctccctactttttccatagaagttgaactaattgacacctaccaccgcttgctggaggttgaggacgcccagtgagtgtgcacccgggctggagaaggcaggaggtatggcccggaaaagagacacagaaaggtaatccaagagggctttctggaggaggtggcagctgagcctagaggtgaatttcgttggggaagagggagtgaggcctaggcagcttaggccatgacccccatggtgggagacggctgcataagggtctctctcctggcatccgtctttacccatgcctgggcatcctacccccatcaccctttaacccccgagggccttggctgggtcccagaaattccc

SEQ ID NO: 190352 - DNA, 620 bp, Homo sapiens
ccccacagcctcaccacctgtttctttgtttgagcacaaataaatagcctgggctccctgtgtacccattgttctcacttaatacatgagaacatgcaatatttggctgtttctgtcgttaattcacgtaggataatgaccttcagctgcatctgtgttgctgcaaaggacatgattttgttcttttttatgactgcctagtactttgtggtgtatatgcaccacattttctttatttaatgaaccgttggtggatacttaccttggttccatgaccttgctgttaagttgaactaattgacacctaccaccgcttgctggaggttgaggacgcccagtgagtgtgcacccgggctggagaaggcaggaggtatggcccggaaaagagacacagaaaggtaatccaagagggctttctggaggaggtggcagctgagcctagaggtgaatttcgttggggaagagggagtgaggcctaggcagcttaggccatgacccccatggtgggagacggctgcataagggtctctctcctggcatccgtctttacccatgcctgggcatcctacccccatcaccctttaacccccgagggccttggctgggtcccagaaattccc

SEQ ID NO: 190353 - DNA, 381 bp, Homo sapiens
ggctaacaacagaactttcagcagaaacactacaagccagaagagatttggggcttatattcagcatccttaaagaaaagaaattccaaccaagaatttcatatgcagccaaactaagcttcataagtgaaggaaaaattaaatccttttcagacaagcaaatgctaagggcatttgttaccaccaggtctgccttacaagaggtccataagacagtactaaatatgaaaatgaaagaccattactgatcaccacaaaaacacactcaagtacacactctattaacactataaagcaaatataataatacaatcaagtctacataacaatcagctaataacatgatgacaggataaattccacacataacaatattaatct

SEQ ID NO: 190354 - DNA, 358 bp, Homo sapiens
gcaggacacagcagaaggcaggggctgggggctcctgcagaaggaacctttcatcaaggacttgaaggggtgagtagaagcccatcctggttttctcaccaggcagtgatctcctccggggcaggggtgcttctctgtatctctaacccttatcccaacaccaacagggttggcaaatctgaaatactaactaaatgaatgccttgttaaggcttcacatgactgatattgcacatggagacagaccacccgaaacacccagcacgcagggggcttgtcccagagtgcaccaaggactccctctgccacccttggcactggccttttgttctgtccttctatgctgtcttcagtcttc

SEQ ID NO: 190355 - DNA, 350 bp, Homo sapiens
agctgttctagagtaccccggtatccgctacaccagacacagatcagctctttgaagatgaatttctcagcactgctgtcacaattaaagaaagacatgcaggggtgaaagggaatttgtgtgtttcttagattggaaggatgtgttgagtcaaatgaacattctctcaaggttaaattatctatttaaaacccacccaattacagtgccaggtacaatctttgatgagattcagggaaaacaaattaatctgtgtgggagagattctctttgtatgaaggcaagctatgaaatcagaatgaactgggcattgtttgttaagggggaaatggttatataaattgaagatg

SEQ ID NO: 190356 - DNA, 335 bp, Homo sapiens
tctagaggatcccgttcattttctacactcagctctttgaagatgaatttctcagcactgctgtcacaattaaagaaagacatgcaggggtgaaagggaatttgtgtgtttcttagattggaaggatgtgttgagtcaaatgaacattctctcaaggttaaattatctatttaaaacccacccaattacagtgccaggtacaatctttgatgagattcagggaaaacaaattaatctgtgtgggagagattctctttgtatgaaggcaagctatgaaatcagaatgaactgggcattgtttgttaagggggaaatggttatataaattgaagatg

SEQ ID NO: 190357 - DNA, 517 bp, Homo sapiens
gagtgatggcgctcctagaggatcccgtgacacttcaggttacctgttactcctgcttatggatctgatgttcagagcagcaagtttattactttcacggagggtcagttttcgtgcttgctatattagtcactgaaatgcttcttttgataggtcagatgatattgaaacaaactagaattctgtttcctgtctgacttgtggaattgcagtatcagtgttcagaaaacttaccagacttttgaacgtaagatcgactagcattcaagtagaattacaaagtccaaacgatatgactcagctgggataaaaagtgctgttttatcttttttctgttccagtgactcagcaaaaacagtgctttggacatacggaaatgtaggcaaacgaatatttctgcataaagggaaaatgtagacctttacttttaggacgactgtttgttagtggaccagcccaaaattcttttcagagttttgcaaatccacctgagtctccacaagtgcaatttcatctg

SEQ ID NO: 190358 - DNA, 368 bp, Homo sapiens
aaaaactgcgtattttacctagacctacattttataaatgaagaaccatttgtttgagaaaagtttcattaagtaattgggacataaatggagtttcagagaaaggatgccgttcaatgatagtctaattatcatgaagatgattgctgcctggatattcctttgaatgctacagatatttgctctttcaaatttaattaaattgggttagaaccccatctcatgtacctagcaaatccaagtttctctccaaaatctctgaggattagtcaccatttcaaccaatattccctgtttctcaggcacttgttgcctctattacttttacatgcctgctacatatccttcccaaagaattcttcccaaag

SEQ ID NO: 190359 - DNA, 287 bp, Homo sapiens
ccttgaatccctccccttctctttcccatccaaatgatcaccaagtcttggtaacactgcaccatcatgcactgagcacacaggcccttgctaaacacccaatattcagcattttagaaacctgacatccttcccatcctgatggagcttagagtctggtgatgagctgtggttggtgctctgtaagaagaagttatagtgcaatcttgaggtggggagtggaaggaagtgagttggacaggaagcaaggccagctctatgtgtttgcccaggaagaaaaagacatg

SEQ ID NO: 190360 - DNA, 294 bp, Homo sapiens
accagctgagcaaataaacaaaaattggccaggcatggtgttgtgtgcccgtagtcctaggtactcaggaggctgaggcgggatgatcccctgagcccaggagttagaggttacagtgaactgtgatcgtgcaactgcattccagcctgggtgacagagtgagaccttgtctcaaaaacaaacaaacatacaaacaacgaaaagttagcaaagcaaaaaaggcacagcagactagtatgaatatggctgagaagcatgacatagcatgatgttttccaaacaatacagatagct

SEQ ID NO: 190361 - DNA, 797 bp, Homo sapiens
tgaaaggtcccaaattcaaaatgcctgagatgaacatcaaagcccccaagatctccatgcctgacattgatcttaacctgaaaggtcccaaagtgaagggtgacatggatgtgtctctgccaaaagtggaaggtgacatgaaagttcctgacgtggatattaaaggccccaaagtggatattaatgccccagatgtggatgttcaaggcccagactggcacctgaagatgcctaaaataaaaatgcccaagatcagcatgcctggcttcaaaggagaaggtccagaagtggacgtgaacctgcccaaggctgaccttgacgtctcaggacccaaggtggacgttgatgttccagatgtgaatattgaaggtccagatgcgaaactgaagggccctaaattcaagatgccagagatgaacatcaaagctcctaaaatatcaatgcctgatttggacctcaatcttaaaggccctaaaatgaaaggagaggtggatgtttcacttgcaaatgtagaaggtgatttgaaaggacctgctcttgacataaaaggcccaaagatagatgtagatgctccagatattgacattcatggcccagatgccaaattaaaaggtccaaaactgaagatgcctgacatgcatgtaaacatgcccaagatctccatgccagaaattgacttgaatttgaaaggctcaaagcttaagggagatgttgatgtctctgggcccaagttggaaggtgacattaaagctcccagtttggatataaagggcccagaagtggacgtttccggtcct

SEQ ID NO: 190362 - DNA, 1366 bp, Homo sapiens
ggaaaagttgaggcttgctaagggttgagatctgttggtagccctggatcacatggggtcagcaccaggcagtgcctctgaaagcggagagaggtcctggacttcccttgtgtataacagttcctagtgtccaacaatgaggaaatggtgaagcatggttacaaaactgtgacaaaaatatttacatctagcactgttaccactcacatgccaaacattggctgcacacgtgcagccttatttgtaattaacatcaaaagactagatctgaagccttccataaatgagaggccattcatatggcattcctggaacaaaacactgcacaggtaccagcctctccactcctgaccgggttggtgctgaacagtcagggattgttcttgaactagacttctgatgcttcttgcaatcttctttcatctttccctgaaatacacaaaataaacaaatacaataacaaatagtaattaaatgactttcaggataacatctagttgttcagacttcacccttcacaggtgtgtgtgtatgtgtgtttatgtctgtatattgaagcaatttgaatttatttactgtatattttctgagtaaaagactgaaatgaactacttggttcagatcatggtgtccattggtgacattgtttggaggcataatattctttatatggaaaatcctttaattccacagttagttacctcagattcagaatatgaatactgtttataatacgcttttgtaggaatgaatttgaaaggtagtttgtcagtaaacaaaagcacaacaactaatctcaaatctgttttgatggtgtgataggaaagaaagtaaaacctatgtgatggaccctgtaattggggcaggaatctcccaaagaaaaaggggagaattaatgacaaatgtcatagatcttgaaatttaatttagggtgcattttgtttatgaaacaatttaataaggcaacaaagtgaaatgatttttcatgtagcttatacacatgtaagtgcctctgattcatggtaactaacgtacctgatggtgtgtaaagtaatactgttgtcagaaggtttgccaattaagataatttgagtttactctttttttgttggttagtttagctgaaggcttgtcaattttattgatttttttcaaggagccaaagtggattttggggttttctctattgtgtttgtattctctatgtcatcaaactctgctcaaatcttacaaaatagtaagattagtaagaaagcagactaacttctgcttgctttgtatttagtttgtgtcttttccagtattttaaggtggaaggttaggttattgatttgaattcttttttgaataaaggcattaacagtta

SEQ ID NO: 190363 - DNA, 182 bp, Homo sapiens
ttgtgcttctacgaacataggtatacaaatacctctttgagaccctgctttcggttcttctgaatacatatgcagaagtgtgattgtcttttttttttttgtgaaattgacatttttaaagaaaacaaccccctctctgctggttttgtttttttttttttttttaaagaaaaatagaacac

SEQ ID NO: 190364 - DNA, 526 bp, Homo sapiens
agaagtttttaattttgatgaagtccaatttaataaatgttgttggtcatgagttgtgcttttggtgtcgtgtccaagtgtaatggaactttcaagtggctcatggccacacctcgcctttctcgtaacgaagggtggtatgtgaccaagttttctggtcaatagactgaacagggtgttgtgttccagaaatcctcctgaaattttggttggtagactttccctggctgcttcttctagtctcttccattttgtttttgggggtggggtggtgacagctggagcaccaccttgaggcacagagatgcaggccacaccgcaggcatggtctggtggggagacggaagtcatcgtgtgcttgagggcttgtggagccgagcctcatgccaatcctgcatggcctgctactggcttttaggggaagaataagaaacttccattttacttagactactgttattttttattttccatcatcctgggccaaatctagaccaactggatgcagggatatctcatgaaactc

SEQ ID NO: 190365 - DNA, 227 bp, Homo sapiens
cttttactcccctacttggcgtactatctgagacactcctcaattgctcaattaattctccaggaaaggcaaacgagcgagactccgtctcaaaaaaaaaaaagaagatacaacatttgagcaggtagtcaaagaaggtgcccacgagaaaaaaagataattacctcagtgaagtcttagaggaaggcaaatgggcttgagacctaggccacaggtggtgagactgg

SEQ ID NO: 190366 - DNA, 243 bp, Homo sapiens
tccgtgacagtccttgactgtgaatgctgctaaatctgtttaaaagaaaaaaaaaagaaactaaaaatgcaaaacaaaaaaaccaatcctttttgcttcacatgaaaaatcatttagcaatgacaagtaaagaaatttatagctgtacaagtaaacaatatatttctataactctgtgaaattttatatccagagatatacacttacacagagatacacacttatacacattcactacttgtg

SEQ ID NO: 190367 - DNA, 219 bp, Homo sapiens
attgtcatgttgctctgtcttgccttctcttttgtggccttgacacttatgaagagtagaggtcagatagtttgtaggatatctttcaatttgagtttatctgttgtttccttgtaattagactgaaattatggggttttgagaataccaccactgaggtgattttgctttcccaatgtatcacatcaaggtgtacgtagtatcaatctgttactgtta

SEQ ID NO: 190368 - DNA, 183 bp, Homo sapiens
gcactgtaagcatcaatgcggggtagagatcctcacccagacctctaacacctatagcctaaggctgcatgatcctccttagcagctgtgccagtgagaccaactcttgagatcctaactccaaggtcaggtccatcatcatatgaacttctatcagttaagaacatcctccgtcctggaacc

SEQ ID NO: 190369 - DNA, 525 bp, Homo sapiens
tccaggatcgtcttaatagactgtgtccgctgtggtacataaattgagaaagcatgatatttgagcaagaaaaattactgaggtttgttaagatttgagaagagagatggaaaatcttcctgttcagttggagaagaagctgaggaataagtctttgtgcatatgaagagtgttttgtaggctgtgtataggtattttctgtttcttcagaatgtagtaaaaaaacagtgtgaacttaagactggtcctgcaggaccagtcttaagagcatgatggggcagactgcacataggtctggtccgaaaccaagcccctgcagagacaaccagggaagtaatctgagagagttaatggccctcgtacctcttattatttcgtttcatttttgtaacagaggcacattatgttacgcttttatcttatttgagggaccaaggaacaagcaaatacttctgtagtgcctgttctgtggtaggctctgtcttaaatgcttcacaaacattaagactgtacctggattctact

SEQ ID NO: 190370 - DNA, 521 bp, Homo sapiens
ctttttgtggtgagcattcaaaatcctctcttctagcttttttgaaaatatacagtaagttattgttaaacatattcacctgacactgctacagtactttacaatttattcttcccatctagctgtagctttgtctgttaaccaacctcttcctatcatccccttcctcaatcttcacagtacctcataaccactattctacactcctacaaactcaagtttttttttagttctcacatatgagtgagaacacgcagtctttatctttctgtgcttgacttacttcacttaacataaagtcctctaggctcatccatgttgccaggactggcaggatttcattctttttcatggcttcttttttatcccattgtgcatatataacacattttctttatccattcatctgttgatggacatttaggttgattccatgtcttagctattatgaatagagctgaaataaacattggggtgcaggtacctcttcgatatactaattttttctcctctggataaat

SEQ ID NO: 190371 - DNA, 694 bp, Homo sapiens
tgggccctgaggtcaaacctggctctgccatgttcaagccgtgtgacattgcagaagacactgaagcagagcctcatttttctcatctcaggaaatgtgcacatgatgatagtagcatatgcctcttagggttgtgagaattaagagcatttactggccaagtgatggaaatggtctcaagaaggcaacctcaaatgggacttttactcaccagcaagtttgcctttcagtgactaagcctgccttctacaaaagagttgccatcaaatcacagttttttcattgtttttagtaccagcactactgacatttgagcctgtcctgttctagtatcatcgaggattaaacaattattaaagcactgtatatagtgagggaaagattccacttttctccaaagtaactttatcctcttgattattccatttcttctctcaattggatctttgcttttggctttatatattcacaagccttccatgagaaagtaaaagaacaaaacatactcattttcctccagctatcttccagatttcctccacttcaaaatcaaattcagagagctttcaaatagtctgtttgcttccatttcttcagttcttaattcctgacatgcctcaagcagctcctgtcaggtcatcagtgacttccatgacactcaatcagtcctcctcttatttgacctttctttcag

SEQ ID NO: 190372 - DNA, 318 bp, Homo sapiens
attaattcccaccaccccaaaaatatgtccccatcccatgtcttcaccatctcagacaacagcactataatccacccagttgctcaggccaaaaatgcaggagccattcttgatcattctccttcctccataccgtcatgcaaatccattagtaaattccactgaccctacctccaaatatctcccaaatctattgttcaccatctcacgccaacaacccaggcccaagccactagtctctcacttagcctaccccaacaggtatctaaagggcctccaacttcttctactgcccccacagtccatcctccagctagc

SEQ ID NO: 190373 - DNA, 316 bp, Homo sapiens
ggcattttactgtgggtctgtcaggtcttcagactgctaccctggtgaaaacgtgatttaagaaggtatttcggtgtggggctatcataggaaacttctgattttagatgcagtctatctgcaataagtaggatttgttgttgctgttgttttaactgtaggtgaaaaagaaaatctgcttcagagagaaaccaagttcatcttggagataagtgtggatgttggactccctccagctcagtaactgaggatcactttacttgaaatcgttgtgcttttgattggccgtccgtggttgcgctgaagagggaggagg

SEQ ID NO: 190374 - DNA, 250 bp, Homo sapiens
ggcattttactgtgggtctgtcaggtcttcagactgctaccctggtgaaaacgtgatttaagaaggtatttcggtgtggggctatcataggaaacttctgattttagatgcagtctatctgcaataagtaggatttgttgttgctgttgttttaactgtaggtgaagagatctttgtgccacacaggattttttttttttttaagaaaaacctatagatgaaaaatactaactgacactggtgtacgtgt

SEQ ID NO: 190375 - DNA, 321 bp, Homo sapiens
cagtatgctacacttttagaaaaattactttcccagtctcttgtagaaaacagtatcgtaagtttgatatatttttttaacttcctttttttggtcctactttcctagccattttattcagaggaagacccctgtaagcatactactaaaaagataaagaagcataatctaaaaatctctgggctgtcagtcaggacttcagaatgggaattccatctgttgtcaactattctccatgactgaagctagaaactttatagtatagctcttaataaaatcacgaaattgctagaaaccttttcttggttttgttttgaagca

SEQ ID NO: 190376 - DNA, 637 bp, Homo sapiens
tgatgggcacagcatttatggagtggagggaagaaagcctgatgggagtatgtttgagagaaaatgagaggctgggaattagagacacaagtgtagacagcttacttgggaggctgaggcacgagaattacttgggcccgggaggtggaggttgcagtcagccgagatcatgccactgcactccagcctgggcgacagagcgagactctgtctttatttatatatgtatatatggcagaaggaaaaggtgtgagacagttttcacattttggctaaataggtaaataaaatgtgggcataattctgatttgacaatatgtatgaaccaggagtaggaaggagaatttgctagtgaattgaatgccagaaacacatttcctgagcgggtcttttggaagtataacattttggaagaactgagttcatgtaccagttccctaggttatttcatggtgatgtaagttcatttttctaagacatgcctcagtgagcacttttttaagctgctgttgatgctatttttttctcacttgcattctcttgtatagcgaatacagtttcagtgtcactttcccacatgtaatcctaattatcccaagcctaacaagcaccctgtggaataggcaaagctggtaat

SEQ ID NO: 190377 - DNA, 782 bp, Homo sapiens
gctgctttcctttggccctacctatcgctttatttcttattcctatttgcagcaaaaacttccataaagagctgtgggctgggcgcagtggctcacacctataatcccagcactttgggaggccgaggcaggcagatcacttgaggccaggaattccagaccagcctggccaacatggcgaaaccccatctctactaaaaataacaaaaattagccgaccgttatggcaggtgcctgtagtcccagctacttgggaggctgaggcacgagaattacttgggcccgggaggtggaggttgcagtcagccgagatcatgccactgcactccagcctgggcgacagagcgagactctgtctttatttatatatgtatatatggcagaaggaaaaggtgtgagacagttttcacattttggctaaataggtaaataaaatgtgggcataattctgatttgacaatatgtatgaaccaggagtaggaaggagaatttgctagtgaattgaatgccagaaacacatttcctgagcgggtcttttggaagtataacattttggaagaactgagttcatgtaccagttccctaggttatttcatggtgatgtaagttcatttttctaagacatgcctcagtgagcacttttttaagctgctgttgatgctatttttttctcacttgcattctcttgtatagcgaatacagtttcagtgtcactttcccacatgtaatcctaattatcccaagcctaacaagcaccctgtggaataggcaaagctggtaat

SEQ ID NO: 190378 - DNA, 703 bp, Homo sapiens
ccttcccgaaggggtcctgcagtaatgctcacccctagacccacactctggccagtagcttgggtgcggggggacacattgattgactctcccctggtcatgtgcttcacatctgactctgttgtgaggttccccagagccaccaagattctgcaaatggaaattagcgcccttaggaagcacaggtacatgcagggcaataccaccaattgttcacgatgaatgaattggactcccgggataataaaccagaatgtgtgcttgcgggggcggggaattagttttgcttacctctgtatacctggtatcctaggagggtgcgaggggcatattaatgcttagcaaaagttgacaaatgaagggacctcaaaagttctttcctcctttgaatctctaaacccgagagtctgtttttgcatgggacatcatcttgttccatcagggagctggcgatttggctcctgggtcactaaatccaaacttgtagttgatcacccatgactgggttctcattgacctgcacgaagagttgttactggaataaacactggatgctagaatgccacctgctgcctgagatttcatcaaagaaagggcaacacgttccctagctctgagcatctctaggccaatggtgttgctcccagtctaccttgggaggcaagttctgttcttctcctggtatgaaaagcctgacgatgtg

SEQ ID NO: 190379 - DNA, 296 bp, Homo sapiens
ccattgaacgtggatttgggaagagaagcacaaattggagagtcggcaggagccagccccagcacatcaccatatcgaggtcacactgacttattctgtgaactgggataagttaacatttcaaatccccagtttcattgcctgtaaagtggagactaggaaagtttcctcaaatattgatggtaagactaaataaggtattatatgaaaactctcaccatagtatttgacctataataaagattcaaaagtatcatttcggcagggcatggtggctcatgcctgtaatcccagca

SEQ ID NO: 190380 - DNA, 475 bp, Homo sapiens
cagatcatactgtagatattactgtagatgttatattcatttgttcacttaaactaataatttgaatatactttactattattaagaactctttgttaaagatcaaattgttttaaaacttaagttagagaggcatttatagcattagataatgccagccaggacatatacactatctttaaaaatgaatctaacccttaaatgaaatccagcagccaatctaatgtttctttgtaataagcaaaatatttttctgtgttattgcatctcacaggaatctattcctaaaggattcaatagtaaagatgctcagtaatcatgctctagagtttctcatccctctaaagaacacacagcagttctgtgaatgactaaggatcagcaggaatggatgtcaggtgaatgttggcactactggatacaattgatatgctttatggattttttgtttcaatgtgattctgcatagatggca

SEQ ID NO: 190381 - DNA, 433 bp, Homo sapiens
ccaaactaaaagcagtatcacaccaaccatcgaagcagtctttgtggtctgacccagagaagagcttgtaagacgaacgacatatgtgaagaaggtcatgaaagggcatagtattccggtctaagtgcagaataacatcagatgaggctagagaatgaagtgagccccactgtgtgctacacaatatagatctttgtcccttaacagtgaggcatacaccaggttccaaggaggaaattttgtgagaaataaaactctaacataatgtagaaaatgaagagatggcagattaagccagtggcaggacgactagttaggacattaacacaagggcccaagtaaagaagatgaatgcctagaatcgggtagcaaagaggaaatgggggagaaatggaggttcagtaaggtaaaaagcaacatgctcaagtgtgaa

SEQ ID NO: 190382 - DNA, 466 bp, Homo sapiens
tacctcagaaattgaaaccattgatttaatggaacctttcatcaagtgcattagtccactaggcactcctatttattgagttttacattgatttttctcagttcaaaagagggcatatgttacatttaggaatgaaagtttgattttataagccaattaaaaaacagaattcccattagaaaaattaccttgtagcaagttttgctagattctaactgatctttaaagagggacattcagtaccctaatctaaatagcattgaaaactttccgtttcttttgggagaaattgagaattattttcccgagtttatgtgatgagagagaaaattatttaatcacaatcacgagcaacttagaaagacaaaaacacaacttttatgcatatatgcatgtatgtgggggtagatggaggggtgtaaatccagagagggacttgattgtgagtttcttattttgcattttt

SEQ ID NO: 190383 - DNA, 429 bp, Homo sapiens
tccatggtgtttttgtatacagttgatctcatagtcaggaagtggagatggatgtaagggaatgagaggaatcaagggttctgaatgagcaactgggaaaatgggattgtcatgaactgatggggaaggctaagggagaagtaggtctggtgggggatgatagagaactcagtttggaacatgctaattatgagatatgtattaaatatccaagcgaaggtactcatcaggaggtggatatacgaggtaagggctcagggaaaagctgtggccagaaaaatacatttagaagtcaccaatattatcagtgttataaaaagtatgagtctggctacagctgcctactaccagtgagtgaagacagaaaagagaagtggtccctgtcacacactaccattcggatttcaaaggagtgtggaaaaacttgca

SEQ ID NO: 190384 - DNA, 631 bp, Homo sapiens
caatcttgtgtgttttaaggaaacagaaaaaaagggaaaagaaaaagtcttttcctgccttgtacctctgtctaactaaaaagagaggcagcttcctcacagaaaaatatcactgatcttaaaactgaattcaaagaactgaagaaggaagtttctagtgtttcacttctgtggatttggcccagaaaaatccacagagaaggtgttaaagtcaggtaatttatcctgcatcccttagaaagccctagagccaatcaaaactctccccaaagggctgaaatcaggctctgagggttgtgggagtgacagagccatgtaagctctctggattcacaggtttaggtcactgctgatggattcaattactatgggaggacatttcatgctgtctaattttcattcaattggatgattctcccaaatccttcgttctttaccataagtttactcattattttagctttacctcaaggcactttcccctgggaatttttctgagaccagtgtgagttaggtgtacttcctgtgttttgatttgtcatactaaaaatcttacaagtatgaatttctacatgaaataaaggtaagatcttaatcttaacaatctaggtcttagatttcacggtatggg

SEQ ID NO: 190385 - DNA, 330 bp, Homo sapiens
cttagaagagcacctcacacctgatgggtgttcactaagtattgtgagcaatacttatgaaggaagcaaacaaataactaaatagacaatataatttcaggtggtaatgagtggtatgaaaacagtaaaacaaggtgaagggctggcggggctctttttgaaagaatggtctaaaaaggcttctatgtatgtgagagagaaaaagaaggagattggttttgtgcagagacctgagtggagtaaaggaaccaggggaggagaagtgttcaggcagagggaatagcaagtgaaaagaaaggcctttgacgtaggataagcttggcttagtag

SEQ ID NO: 190386 - DNA, 363 bp, Homo sapiens
tttaattgaccattgatttggaagatgcctagagccggcttggtaggcattctcagaagcgcgtttcaatgaaatatttccttgatatataaaatgtttgcaaaatgtcacattggtggggaggagaagagctctatctgggatcattaaagctaggatttgaattgttctccatagtgactgtaagaggtaatctgtccctgctgtgggcgatttcccaagctctgagtgttatctgatgcacggatttaccttgctgtgggaagtgtggtgattccaagcctcctctcttcttgggctgcaaggcgaaacccagagaacatgtgtgttcaaagaggaaccagaactctggtacttttctgt

SEQ ID NO: 190387 - DNA, 578 bp, Homo sapiens
tccttcagagctgagttctcaagtccctctgtgagttccttgattccatcagatgtttcctccatcgaagaccatggtttccctcagatcccttattacaatggtagctaaatgtctgtgtggcctgcaacagtataatctccagggataagtgtgtgctttgttcgcttctctactgttggtgctctttggagtgctgagtgcccaatacctgttggttagatgaattatgtgccagttcttggtgctagggttatagcattaatcaaatcagacatgatccctactctttggagcttacactgagatacagacaataaagaaataaacaagaaaccatcatgtagtaagggtgatgttttagagagttactggagaccttctttagttgaataattggggaagggctttctgaaaaagtgaaatttcagctaagatgtgaatgaaaagaagcagacagccacctaaaagtatctcaaggaagaacattccaggtggaggtcacagagaaatattacacagagagatattcctgtcttaagacagaaataagtctgctggagctgtttaagcaagtg

SEQ ID NO: 190388 - DNA, 168 bp, Homo sapiens
taagtgaactattgctaacattatttttgggaaaataagtttaatggagcaatatctattcctcagtgattattttactgtgcaggtatgctgggaatgtggggacctttaataaccttcattgcttgctaattcagatgcttatcatttgataccagcaaaatcact

SEQ ID NO: 190389 - DNA, 229 bp, Homo sapiens
ggtaaatgttctcaactaggagttgcaccagaattacttagaaagttttttcaaagtacctacatgaacaatcttatattatatatataaggtatatataccaactatcccccaatacaaacagacattcacttattactctcttatggactatcaaaatctctgggcagaaaaaaagatgttcatctgagcagatgatcctagtatgctacacataactcctttgcct

SEQ ID NO: 190390 - DNA, 271 bp, Homo sapiens
gtaaggagacagattcctctcaggtatcagtctaagtaattcaaaggaattgggctttgctgcctactatgcaaaggattagttttcaatgagagagcagacttgtcattttgagtaagtgtgcacatcacatcatgtctcatagtcagagagagaaaaaagcagaaacaaaaaccaagacaaaaacaaggccactatgtctacctctagtccccataatagaggaaaccttgagccctttccaataagttactgtctccctaaaaaaaca

SEQ ID NO: 190391 - DNA, 547 bp, Homo sapiens
ttgctgctcttaggattctctctttgttgacctttaagagtctgattattatatgccttggggtcttatttgggtcaaatctgatgttctctgattttcctgttcccaaatatttatatctttcttaagttgtgtaaagttttctgttgttatttcttagactaagctttctaccctttgctcttgctcaactctctcttgaacaccagtaattcttagtttgggccttttcaggtagttttctacatcttatgggcaatcttcatggcttttcatcattttttttttacctctgtgtattttctggttttgtttgtttgttttttacaatctcgctctgtcgcctaggctggagtgcagtggcacgatcttggctcactgcaacctccgcctcctaggttcaagcgattctcctgcctcagcctcccaagtagctgggattccaggtgcacaccaccacactcggctaattttttatactttttggtagaaatggggtttcaccacattggccaggctggtctcgaactcctgacttaaagtgatc

SEQ ID NO: 190392 - DNA, 456 bp, Homo sapiens
gggggcgtgagatatccctgagtggtggtagagtagcagatggaacactgagaagtaatttccttgaggatggatttccatgatggaaaagaaatgagaggttctaagagatgggccattggcttgtaacccacatgaaagaggttctgaaaggatgataagatagaatgagcctgtgagacaggaaggaggaattttccttgatccaagaaccatttgccttgagtaggaatggattaataggtaatagtttcatgagtaggaatggattaataggtaatagtttcagtgggagaataggtgggagtgatagatgagaaggaagaaaactggctgtgagggacagatgtgggaatactagctgcttcttttgctgcatatcagcataagtgttgcctcaagcaatgggatctggtgacctctgatgccccttgcagtgaatgacttcagcttctt

SEQ ID NO: 190393 - DNA, 238 bp, Homo sapiens
tttagaaaggtataagtgactgtgggaatgagaatgtagcacgggagagcagttgggccatgccgtttcagtgggagaataggtgggagtgatagatgagaaggaagaaaactggctgtgagggacagatgtgggaatactagctgcttcttttgctgcatatcagcataagtgttgcctcaagcaatgggatctggtgacctctgatgccccttgcagtgaatgacttcagcttctt

SEQ ID NO: 190394 - DNA, 469 bp, Homo sapiens
tttggcccggctgtcgtgcccagctggttggtgaaacaccagtctagatgccatggtgaaggtctttgtagatgcaattaacatctacaatcagttgaccttaagtcaagtagatcatgctccatagtgtggctgggggtggggtgggggcagagccaatcagttcaaggccttgagagctaaagctaaggtttcctggagaggaaggaattctgcctccagactgtcactgaaatcctgagttgccagcctgccgtacaaattttggacttgctatcccctacaatcccgtgagccaattccttaaaataaatctctttacacacacgcacacacacaccccccccacacacatacacacacacacacatcccacacacacgtgcacacacacacacatcctgttggttttgtttctctggagacctcccagctgataaagcctccatcagtaaatataatttaaacc

SEQ ID NO: 190395 - DNA, 403 bp, Homo sapiens
cacagcagagagtagagggagggtggggagtgagggtatttatttccttggctccctttttgtgagatcagtttgggctgcctgtattcctgcactgaaagtcattgctcttcccaaggtattcttctctatataactctttctttccagattctggtaatctcgaataacttccctgcttttgctaacctggatttactgcaatacccttggggttcttttccactactgcccacaccctgttacattgtctgtttataaataaattccctcagcttatcaggagctgtgtcaattaaagtcctattttctgttgattcagcttctgaaagcctgctctttggagtcttcttggattgataagaacagtcgtactcccttacctgttttggacatctgcttt

SEQ ID NO: 190396 - DNA, 407 bp, Homo sapiens
gttgttaaaaaaaaaaaaaagtaggtgaaggaagggacaggaagaggtggggcattctgtgtagagagaacaacataaatgaaggcactgtagcagcggctgacagcattttgaatgactaaaataggagttcaggactggaacagagagaagcagggcagaatggtggaagacaaaactggtgaaggaagcagaagccagatcatgcaggtccttgtagaccatgttaagaacctgtactccattaccagaacagctgtggaaagcttttaagcttgggattaacgtgatgagatattcaatttaaaggatcactctggattggggaaggtgaagggcatgagaggatgtggggaaatcagatgatggtaagttgggctaaggtggtgatcatggagatggaaaga

SEQ ID NO: 190397 - DNA, 765 bp, Homo sapiens
gttgagtctaagtaatggggcaagttgtggggagggcactcatggttttggtggggagggcagggaccattccagctctaatcagaaggataaaggaagtaagcagaccagcagacctggcctctggcatgtgaaacagcatccacatgcccccctcccgatgtcctatcagatctcattaaccctctcccattccattatccaggcactgcctccttacctgccttgattatctcggctagctgccagggttgataagaaatctgtcccaaaatggcagagggctaacagattaaggggttccctctcagggacttagcccttcgggtgggctgtctcacagttcccaattcttccagagccaaaggaaagccacagaagcatgaagtgtcaggaagattagacagacatttctgggccacaagcctgtgtgatgcttttcagatcaaaacccaggtcgtgcctgctatgtttgtaggaaggagggagtctgggtgggaaattagagaaagtacagcaccctctgtcctgaagaacctttcatccctgaactcagaggtgtaagctgcccttctgaaacacaaatccttatctactctcattttccaaatgttttgtgtttctatatgaaaatctttagatttgctgaaccattgggccccaaaaatatggcccaggtcactcaaacctatatattttcttcctatgattttcctcagggcaattcatgtcgtcacaggtggccccaccccccaaagccttcac

SEQ ID NO: 190398 - DNA, 177 bp, Homo sapiens
accatcgtcagaggctacttcatcacagcctctctgatttgaggattcaagtgggaaagactcatgacaagcagcagaaagtcgaattgggaaaacagtgccctcagggatggggccgcgctcaggtacttagattataacctccgttgggatgtttctgaagctttcgtcttagca

SEQ ID NO: 190399 - DNA, 273 bp, Homo sapiens
gttacaaaggtgcccctctttgctgctggggggaagaatagaataagcctttctttgattttctcattattagggattcaggaagttcttgaaggggtgaatgaatggaagagaaatgtcttagtattacatttgtttcttcttcttcttagtattacatttgtatctcttgttcagaataaaatctttttctttggcatatcatcaaacggaagatgtttttagggaaagggatgacatactaaggcatttgctactactgggacctagaat

SEQ ID NO: 190400 - DNA, 711 bp, Homo sapiens
aagctggcatttaagaacagactggaatgaggctttgagaacaagatacagagatacatggcagagaaaagtgtgcaaagcagcaggtaaccacatgcacaattagatgctagagatgaatgtgattcaaaattataaaagacttgattccatttcaattataactaggtgataaattatcttaagaagtttgaacaggaggtacctgagcagaaatcttccaaagcagcccatggaatttaatgttaaatgaataaataaatggcaatagatataacaccccatgtgtgcaaacacacaatctttaagtaaattcccattttgttaaatataccaattacggaaaagactaatttataagtggatggttcaaatgaatcagccattaaataacgagctcatcatatattcaatactacttttcagggacagttgttatgaaaaatctttgtggagctgtagagtaatctttgcttctcactgtcattcctggggagagggtggcatttaatggcctcagcaagtagttctagagaacacaggactgaatgttctctttccaacatctctatcaactaggcccacataagaaaggtggcattgcccactggagctttatgtactgggctctgccagccttttaggaaagctgccatcactctcaacatgtatggttctgcatggctcaccgactacaacgtatagcaactc

SEQ ID NO: 190401 - DNA, 597 bp, Homo sapiens
gagatctgtcagtacatagctttctttctcattaaaaaaagtatataatattccatactaaggatgcaccagtttatgcagccattgatggaacttagtgatgaacatttatgttgtttacagtttccaatactgtattaaacaatgcttcaataagctaacttgtgcatatgtgagagaactgttttgtagaatagttatattactatgcttttctaacaaaacaatttcacataataaaactcccagttcattctataaatgcctcctttccataaatattttcagcaaacatacaagatggttttctcctatcttccaaattattcttacaactggctaaactggaatactaaatgatatgttttagttttagaagcaacctctttgtcttcctttgcttctcttctctttatggggacaactagaaataacccctgattaatctcaaatcacaaggctaacacatgcaaggaagacacaataagaggaagtcaaaataggaataagctatttcccttttttatttgttttagttacaggctgataaatgcaatgaaattcctcactgctgtaatcttttctgaagcccctccg

SEQ ID NO: 190402 - DNA, 285 bp, Homo sapiens
tggggcctgaggtctgggggtggagtctcctgggattgtaagggtggggaggtacagctgtgggaggatgcgaggctgtgtgtatccgaatgtaaatgtacagggcactcaagcttgtgtgcaagcaggtgtgtgtggaaggctctgtccttccgtgcacatggggtaatatacaagagttgtgtaagtggacatagctggagctgcttcacaggattcctgacagtgcttggctgggctgctccacactgggtggtggacacgaatgttcagggtaccgagctc

SEQ ID NO: 190403 - DNA, 131 bp, Homo sapiens
tgggaattatcttgggtttctgataaaaagatgaggttagcctccttctcttgctctctcttgttcatgtgatgccctccaccatgttatgacccagcaagaagaccctcaccagatgttggcttcttgat

SEQ ID NO: 190404 - DNA, 384 bp, Homo sapiens
aggtgaccaaaatggctggcttcttagctttctggcttcattgatgtcagggaggttgcgtggttaaataatgaaggaggagtgacaagcaagagccaagagagggacgtccaaggactgtttccaagtgatccatggtagaggcttcatggcattcctgttgtttgtgctttgagcaagaattccttggtacgttggttctagtaaagagatcagctatggtctgaatattggtgtcccccagaaaatttctctgtggaagctttaacccccagtgtgatggtattcacaggtgaggccttcgagaggtgaatgggattagtgtgctataagaagaggcaaagaaagatgatctctctttccaccgtgtgaggctacagcaag

SEQ ID NO: 190405 - DNA, 262 bp, Homo sapiens
ccgaagggcaagttcccagactctgctgcactcagcttcaaggaatgcaaccctggataagtaaatagcacttttaatttgagcaagaagtctggaggtggcagttctaaatttggtacagcagtctgacagcctcatcaaaacaccaagtacatgagccaattgtgtcactcctgctcacaagatggctgtcacagaaccaaacatcacatctctacatcatgggatccaaaagcaggagaggaaaggccaaactttgcca

SEQ ID NO: 190406 - DNA, 496 bp, Homo sapiens
tgtatttacagaaaaattagcacattatgagtgctaaacttcccgacttccagagcttattgcccatgagttgctccatttcttcctaacacaggaaagaatacacataaaagggaggaatattgccatatcatgggttgaaggaaaataaaatctagtgcagtctgacttagtggcccatacttcaaatttgtgccaataattcctggcaggagattgcctaaaacgtttatacaggagagcatccacaataacatcttattctatgaaatctcattcagagtcatgctttaaaaggtgtctaacttcaatgaactgactggcaatctagttatgtaattgtcaaatttgttttctagaataaacacataatttaaaataaatagaattatcacataaaggcaaagttgggacagtaagatatggaagaacttggaacgtgactctggcacagctaactgtccagctactcttgaagtctggtcaaagatgcttc

SEQ ID NO: 190407 - DNA, 603 bp, Homo sapiens
aattttctggtcagtcaaaaatcttgcatgataaattactaaattaaaacattatgttcatagtgaaatataaatcaaaaggaaatttaaggaaaaacaataacaaaatcaatagtttatatatctgtgtttatgttgtatatccttatatagaagttaccctaagtaaaaagaagtcagaactttgtcctcagcatctgagaggtaatctctaggatcctgacatatcatgcgggaggacagtgtctttgtttgttagggtgccaactctggatcactctggatagtgaaacaatatgatttagggttgtggctggccactcctttcgagggtgaggggtgggagaccgtcctccccatgtcagaaagaacaaaagtgttgtttaatctgtgaagtctgttatttgttaccagcaacagggaatacagtgtccatgacaggacagagtaacagcagggaggacaacgtggctggaaaagatgatgcaagggcgagaggacagatgtagtcaagaggcagcaggggatgaagaacaaacctcagggtctctaaaagccaataaagaggttgtaactttaataacattaataaaccataaaggc

SEQ ID NO: 190408 - DNA, 205 bp, Homo sapiens
gccacattttgcctctcagggagccgtggcaggttgcacggtggaaccggagtagtatagaaacttgctgatatcagccggcacagagcaggaacacgctaaaaaattaatgtccgtgtgcacccacagtattcaagagttttcacatcattgtcagaatactgtgtaatgaagaagttataatatgtttctcctttagtccgta

SEQ ID NO: 190409 - DNA, 448 bp, Homo sapiens
cttatttgtgtgcctcttgatttttctcttatggatcaccaccttaaaaaagttaaaaaaaaaaatagaaaagtcttcattagatttttcacacagaccagactagaagtaaatacagcttttgcttactcaaaggctgactaaaccagcaatatgcaaacaaagatgatagcaaatggctcagctgaattggtaaaatgtccgctgtgtctttcttgtaagaccgcaaaattgagatctgttaatatcaacaatccttacaaaagagtaagaaataataactgattgcctttgtctcttccctttaatctgacaggccttcaagcacttagtaagtgcatagcaaattctcaaagaactagctaaatatcattttggtcaacaagaaatgatttgggcaagttttatatccaaaaactttattttttggaatcactgcatattccaa

SEQ ID NO: 190410 - DNA, 358 bp, Homo sapiens
ctatacctaataagaaagttaaactaccaaaatagacatttcattaattttaaggtgttttactcacagattgaaaggaaattactgaattctcagaactaatgagcattatcactgtctctaaaagatgctgattaagactagccaccacagaagatactttttctgaagttatattcatgagagctctttcaagtgtactgagaaaattaaaaatgttctgaaatattactttaactttcataaagtgtatgctttttttcacttaagaatcaacaagcggctgggcatggtggctcatgcctgtaatcccagcactttaggaggtgggcagatcacgaggtcaggagatcaagac

SEQ ID NO: 190411 - DNA, 211 bp, Homo sapiens
ttcaaggctaaattactcctccaaatggtctcttctcccaagagtgtctctcttcacattgatcctcaccgtttctgagcttctacatacataattagtttcatcttgtaattctcacacatttgagtactgccttacattgttatataactattccaggtgtgcaaggacatctatgacctctagaggtcagagatctttgccttacact

SEQ ID NO: 190412 - DNA, 265 bp, Homo sapiens
agtgaatgtacaatcagacagaaggaagggagggagggagggataaagaggtagttttaggagaccatggggttaagtttgagatgatggtagagaactacaagtgaaactagtcagcaggtatgactacctattcccaaacctcatgaatagttaaatccatgctgaactaaacttgtcattaggattttagaaaggaagagataaagaggggtttaaaagagtgtgagaccttctgaaacaatacctgctatacttgtaccag

SEQ ID NO: 190413 - DNA, 659 bp, Homo sapiens
aacaaaggcccagacgttggcaagaagcttcgagtgcacccagacaggactgaacccaggtcaatctaatcaaggtggatacactggaactagggccgcccttcaagctcacaaccttcactgaggcttaccacatcatgcaaattaaattattaaggccagcttttaaagtgtgtacatggggtggggggaaggcattttctaggtttcattatttctgttaaaatgtacacaattcttgaaataaaaatctggacaatccagtggaaacagcaaataaaatctctaaactataaaaaagtctcaaacactttaattgtgaccttgtgaaatacgactcatataatctggcaccaaggatacccatatgtaaaatggaaagaaattactcttaaaatgtccttagggtcaacttacccggggctggcgggccaatcatgttgatcgaataaactacgtaagtttatggatcactttcactctgtttcggtatacagcacgctagagggagggggagttaaattcatccctgctcttggatctccaacctcggcagcagtggaacgctcctctccagcatcctgaacatgttcaagttttccccaaactaagttcctgtccactctgcccctgtcctcctaaaagctggagcaagctat

SEQ ID NO: 190414 - DNA, 230 bp, Homo sapiens
atagagatttgctacacatctatagattgttttgggcagtattgttaacagtattaattctgatccatgagaatgtgatgtctccatttgtgtcctcttcgatgtctgtcttcagtgttttgtagttttctttgtagagattttttgcctccttggttatttctaggtattttttttgatagctattgtaagtgggattaccttcttctttctcagctaactcattattg

SEQ ID NO: 190415 - DNA, 337 bp, Homo sapiens
tttgtggatcgggctcacttttatttgcaatatcaattctaatgtttaatattatgtggcatcatattacttgtattaacttagattatgtggcatcatattgcttgtgtcactgtaaccctgagccctgtgcctaatgttaaatattgtctttgttttttcctcagatagtccctaagaagagtcctagaagcacctaccctctcattttacagatgagcagatgagcaacttgtacaaaagtcacctaatttgccacctaatgccaattccaggactaggactatagctttttttcttttgagacaggtctcactaagatagacagcctcactat

SEQ ID NO: 190416 - DNA, 373 bp, Homo sapiens
acgttgacacttcagaggagagaggacacgaattcattcttgaagtataatttccaacacaaaattttacaagactctaaaagatctttgtaagactataactgctattaggtaatacctgacgaaaatcaacaggactgctgaccatgacattaacaacatgcagaatccaaaattccttagcatactactcaaagccctcggtaatctggtctcatttcaccttattgatctatttcctgatacggcacatttaatttcttagaaaaatatcaatttttttcatcacatgcttttcttttcttttcttttcttttcttttcttttcttttcttttcttttcttttcttttcgagataagagtctcgctctg

SEQ ID NO: 190417 - DNA, 195 bp, Homo sapiens
ataagattcagctgtgagaaaactggggacaggatattccaggcaaagaaaacagcttctgcaaagcctagagggaatgaagttggccaatccaagcagcagaataaagccaatgtggcagatcaaagtaagaagcaaagaggaggataaaatgagataaacaggcagagaataacacatcaaggccaactagct

SEQ ID NO: 190418 - DNA, 439 bp, Homo sapiens
agtctcgtttaaactatgtgcaggaatagcaaaggaaatccagcaaatctggcacagtcattatcaaccctggccatgcagcaaaatcaccagcgaaaattttcaaaaatacacgtggccaggccccagcccaaactactgaataacaatctccaggctttcacctgctagactggcaaaaatccaaaagtaaccactctggagaaacaggcattcctagacagtactggtgggatacagaatggtacaattctcatgaaatttcacagtagttaacaaattaaacatatttatactttttaacccaggaatcccatatttaggagtccagtgagaagatacagcccacaaataccaaacagcatgtgcccccggacctttccctgtaatcatgcgcctgcctatccagagggtactggttggataagcttcctacatc

SEQ ID NO: 190419 - DNA, 707 bp, Homo sapiens
  misc_feature (15)..(15): n is a, c, g, or t
  misc_feature (18)..(18): n is a, c, g, or t
  misc_feature (63)..(63): n is a, c, g, or t
  misc_feature (76)..(76): n is a, c, g, or t
ggccattttattttncanttaattagggccaaaaaaaaccctggggaaattggggaaggtaancccattttcaagnattaacaacatgtggcatatgcatacaacgaaatacagcaacgcatcactaagacagaatgtgttctgagaaacgtgttattaggtcatcgcttcattgtgtgaacttcagagtgtacttacacaaacccagatggtacagcctactactcaactaggctatatgatatagcctactgctcctaggctacaaacctgtacagcctgctactgtactgaatactgcaggcagctgatacacaatggtaagaatctaaacatataaaaggtacagtaaaaatactgtattataatctaaagagaccactgacttatatacatcattgattaaagtttgttacgtggtgcctgatcatattactaatccataaaagggaatgaagtatggttacatgctataaatgcaaagtgaaagaagctagacaaaaaggtcacaataggaaatgtccaaaataagaaaatctacagagacaatgtcagttagtgattgtctttggatgggcagagggagaatgaaaggcagttgctaagaagtacctgcgttttttttgaaatgatgaaaatgttctaaaattaattgtggtaatggtcatacaattctatgaataaactaaaatgcaatgaattgtaca

SEQ ID NO: 190420 - DNA, 470 bp, Homo sapiens
catttctgcaatatatgcttttggaattttgaaacagattgtgttgaatccatagattattttgggtagtattgtcatcttaataatgttaaatttctcaatgcatgaaaatgggatgtctttttatttattttgttcatggtccaaaattaaaatctgcaaaagaatttatattcaacaaattccaggccaggcatggtagctcatgcctgtaatcccagcactttgggaggccgaggtgggtggatcacctgaggctaggagctcaagaccagcctggccaacatggtgaaaccccatctctactaaaaatataaaaatcagccaggtgtcgtggcaggtgcctgtagtcccagctactcaggaggctgaggcaggagaatggcttgaacccggtaggcagaggttgcagtgagctgagactgcaccattgcactccagcctgggtgacaagagtgaaactccgtctc

SEQ ID NO: 190421 - DNA, 324 bp, Homo sapiens
ccctgaatagcttcaggatggggcaggtcaccagaaagactgaggcatgattagagggttggaactttcagccccactctccaaccccaccccatgacatctgggaaggtaaaggactaaaggttgagttgatcaccaatggccaatgatgtaatcaatcatgcctatgtaatgaagcctccataaaaacccaaaagcatggggtcagagagcttctgggttgctgaacatgtgcaggtgtctgcagggaggcatgcccagagagggcatggaaactccacacccccttcctcataacttttcctatgtatctctttcatctga

SEQ ID NO: 190422 - DNA, 517 bp, Homo sapiens
ctgagacaggagaatcgcttgaacctgggaggtggagagtgtggtgagctgagatgtcaccattgcactccagcctgggcaagaagagcaaaacttcgtctcaaaaaaaaataaaaaaataaggctccaagcgctgttgtgagggttaaatgaactagataattaatgtaataaacagaatagttttggcattcaacaaacattggctgttattatattagctattaaaaatttaagtcatttaggtcaatgaaacaggagggtttccagaattatacccaattaattatacatgggaaggtgatgaaggtagcatgtcaaattggtataaaaagatggaatattaaataagtggggatactgtatcagataggaacatatttggttgcaagaaacaaaaattcctgtgattactagcttcactgtgagtttattttttcacgtaataaatccaaggttacataatccataactgatatggcagtttaacagtgttattaagaactcaaggtccatt

SEQ ID NO: 190423 - DNA, 575 bp, Homo sapiens
atgttggccaggctggttcgaactcctgacttaaagtgatccacccgcctcggcctcccagagtgctgggattacaggtgtgagccaccgtgcctggcctgtttaatttcttaatctacaacgtatgtataccagagaaacttaacaagatcttccgttgtgatcatacttggccatggtttttcagtgtaatactctaaattacttcttttatacactatttgtaaatgactttttctcctgagataatttcaaagcttccactgcattttcacatttctcacttccttgagtgacttaagtcagttaataattagaattttattttgggtgtagatcactttaagcgaacctgatttaaagtctagcttccaaatctttgataaatcagatgagcattatttagttttagtttggtacagtatgaaataaaagtttgtggtctaaagattatagcaagagcatattttaatgttatcagaggaaaaaattacatgtaaatacatatttcctcatatttacaagtaccccattttctggaaaaatgaaatgcttttggctccagatattgctta

SEQ ID NO: 190424 - DNA, 319 bp, Homo sapiens
gtccgcatccttctccagcagccttaactcgatcagggctgcagcggctcgctggcttgaccagtgcagaaggggcgtgaaggtgaggggggtggggtaggactctgaacttcaagcactggagtttgccgggatcgtgaacttgcagggagaggcggtcctcatccagtgaggtctgtatcgccacctacacccacacatccacacactgctttgctagctagaggaatgctctggagtaggaccagtgctgtcaaagaaggaaagtgggccaaggcgccaaagtccattaaaaaggaatagagccatcacggagtgg

SEQ ID NO: 190425 - DNA, 206 bp, Homo sapiens
ggttccaggcgtgagccaccacaccctgcccaagtctgtgatttgacctgccttgtatggataaataaaattgcaggttgcgacgaagacccacctctctcagcagggcaggagataggcatgaatccttgccttggtaatcttcctgaggtaaatattagtacagattttaaaataaccttcccttttaaaacctgagatttgat

SEQ ID NO: 190426 - DNA, 406 bp, Homo sapiens
agcaaatagctttaaaatagcattaacagtataatctgtttaatgcaaactgctaggatgtattttgcccagatcctgtttaagcaaggcttgatattttacatgctccttagagtctgtcttgttgggcctttcatcttactcttatataaggtaagtgctgatcttgttaatcatcttactcatatataaggtaagtgttaatcttgtaatccttccttgtttctcaaggaaggaaagcatacctctagaagcacattaaaggacttgctattggtttactctgtaaaccaggaacctgacatagttgctggtttctgagtaaccacagcagtacaacaaatgaaaggaaataaatctagttttgattttcaaaatgcaggcctattccagccaccccatcact

SEQ ID NO: 190427 - DNA, 357 bp, Homo sapiens
gttttgtggggaagacattaatcaaataataactcaaattattacaggttatgacacatggaggaaacagggtgagagagagaagagactttagaaccattgttagggaaggcctttctcaggaagttgcatttaaactgagcactcagcatgaagtggagctacccatgtaaaagggtgagggggagttctattccgtaagaggagaaataatatgcaaaggccgtgaggcagataaaagtttacagtgttaactgaaagagtggttggagcctgattggattgtaattggagcctggtgaatgaggagagtggcatgagctgggcaggtccacagcattcaagatttggtaggcc

SEQ ID NO: 190428 - DNA, 395 bp, Homo sapiens
tgactctagaggctcccccaatttgacgcggagtctaggcccacttcaaaatccaactaagatgtttctttagggtctactatgtttgtgtgattcccctcacaaattaagcatctgcagtgtcccctccagagaccatgaaggagaagacaggattcaagagaaaacactaaggatgcagaagtacagaggaaaggaaggggcagcacagctcagaggaacatgaagtgtttggcgaaaggggactcgtggtggacactcatgttgggaggagtaggaaaaattgcaagtatttattttcaaagatgttttcttaaaaactaggcaactgaaaggacattactacaattcttgaaaatataaacacacagctgaatctgtttgacaaagtagga

SEQ ID NO: 190429 - DNA, 340 bp, Homo sapiens
taagccagttttacttaaagaatgcttgatgaaacagtaacaattattttattaatttacttcatttgcacatctttttgttattctatatgaggaaatgggaaatatgcataaagcacttttgctgtggtaatactaagcatgacacctgtttgaagaaaacttgtatccaccacaagttttgcaacttcccaatacttataaagactttctgctagtatctatggtgatagtaacaaaaatagtttttagaaagatattagtgaaatgtatcaacacttggaagccctgcataactcagcaaaccagtattttttttttttttttttttttgagacag

SEQ ID NO: 190430 - DNA, 356 bp, Homo sapiens
tggagtagaatttagcctgctgaagtgttcatagatgacctggcatatgtccctagaagttggggaaaatatattggcctagaaacttgtctacttcttatctagagatttctgaagatgggaggcttgggtagagcagcctgcagcagcagacctaatagggccacagaaatagtatacctgggtggggcgggggagaagtggagagtacctctcacatttcccctatctacccactaattctctgagaccctagaaaaagaacaccactgactcccatggctcatatgagagaaccaggactggggaagaagcaagggctgctggtcaaacacatcaatgccccatctagagag

SEQ ID NO: 190431 - DNA, 616 bp, Homo sapiens
agtgtgagctggaccagcctctctcttgcttaaatccctcataggtttcccccgtcggagcacagaccaaagccgtgctcatctcccttatgcttcaggctcctcccagatgcctcatccatccctgtcctccgtggacttttcacagccttaactgtctaatgaattgtgctgactgctgtgtggagactgtctctcctggtggattgtatgctctgcaagccccgggacttcctctccccctgtcacctgcagagagtctgactactcaatggaatgtagtgcaaatctgtggaataaacgtatgcataactagtgtgcatttgtggaatggagcagtcagcccctcattctgggcgagggctgccaaaccccaaaaccaccatgccctcagcgggttttccacagagcccagaatgtttctctgccaggtgctgggctgggatggttcttgcaggatcctattggagcttcctaacaaccccaccagggcagcttctgttgtccccattttccaggagggaagtaaggcccagagaagtggagtggcttattctcggccacgcagctgagtcagagctcaggcccagctgactcaagtcttgttcagtcttta

SEQ ID NO: 190432 - DNA, 265 bp, Homo sapiens
aatactaattcaggctgagtcttagcaaatagtctgtttataaagagaaatcatatactttatcatcttacatcttttataaagagaaatcatgtacttatcatctttatatgtctttttcatatattggcttttcccaaaaatgtgatgccattggtacttaagcttagagatttttgcttccactatttgagtaacgatgtgaggtaatttaaaaaataataaaatagtccgggtgcagtggcttgcgcccgtaatcccagca

SEQ ID NO: 190433 - DNA, 302 bp, Homo sapiens
attaagtgaaattaaacattgccagaacagattcgtatggtaactaacaaatcatctctctctcaatcattttaaactgtacacatcaaggacactcttgttaagtaaacgagcccactttgtgaactagatacccatttatttttatttgaatgcccccaatttgtctcttaaacaccttttatgtttaggaagaaattcaactgcgaacacccctaccattgctccgacctccaaaaatggtacttacaaatgttccttgtttggatctgtcgacttcttctcccctcccccgacatttg

SEQ ID NO: 190434 - DNA, 384 bp, Homo sapiens
tcaaaaatagaatgtgaagtgtaaatcagtcattggcactggtacagaaaatgggaacattttagggaaaccattaaaagaaaatcagaaaactgctgctgagggggaaaaacagcctcatggaattcatgaaacagtaccacattgtattgcctacaaagggaaaaatcttacatttctgggtgttttctgaaagaatatttgatactttgatgtttgaaaagaagggctaaaaatggaaatgtttataacagggggtcaatttgacatttcttagatgatgcattataataaatcatttttagagaggctaatatccccaaaacaaaatttccatttttgtattccttggcccagtataagattacgagtcatcgttttttt

SEQ ID NO: 190435 - DNA, 265 bp, Homo sapiens
caggcatggtgagtttaggttaaggtgaaaatggaatccctagaaaagaagttccagcagacaactagacatacaggaattgagctcaggaaaagagatgaagcgggctagacatagattcaggaactggccatagagtttacagtttacagtgaatctagggaagtgggtgtaggtgaggttcctagaggaaagtgtgaagaaaaaaatgccaaagcagaagaaagacaaaaaaaaagaggcatcaggaagagaagggatcgcc

SEQ ID NO: 190436 - DNA, 275 bp, Homo sapiens
gctcaggggaatttttctgctcacttggtgccaggcagattgtggagaaggataagcagatatggaagaacaattctcttactgtctgctttaagttttttttacttctctgtggccctagaaactgtctcctccttatattgagatctgggatactggtggtgatagcttcagtgctgtatatttggttttggtattctgcagggggaaggagagccagtttgcttctatgctgctattttgcactagaaaagatacctttttttttttttttt

SEQ ID NO: 190437 - DNA, 452 bp, Homo sapiens
cccaggctggagtgcggcggcctgacttcggctcacttcaacccctcccaggttcaagcgattctcctgcctcagcctcccgagtagctgggattacaggcatgcgccaccacacccagctaatttttatattttagtagagacagggtttcgccatcttggccaggctggtctcaaactcctgacctcaggtgatccgcccacctcagactcccaaagtactgagattacaggcgtgagccaccgtgccctacctcggcctggatgttttcttttcaaggcatttttgtaggtacagaattttatttttctattttatttttttgttaggctccctcaaatcatgggaaataggagattttaatgagtatttaaggacaatattttctgggataggatctgaagccaccaatagaaacaaaagcggttgcagcagatacagaagggtgttg

SEQ ID NO: 190438 - DNA, 394 bp, Homo sapiens
tcctcagagtaagcagtggtggaaacttggtcgaattcagatgaaagaggactatatagtcggggaatcctgaaactctaataaaatatcttatttctcaaatctgcctcacacatttaactgagttttgaaaatcccagcatgactgcagaggtacagaaacaccacagagaatattttgagccttaatgaaagtggtcataaaatcagaatttaagcgttcaaagatattttaaagattacccagtctaatagaagaaaactgaaagtatcataagaacacttttaacttcaggtgaaccagaaccattcctgcttggtctactatcccttcctcagtctactcccgtctcagtggcctcgtaagtcaccacagtgaggcagcgctcctttc

SEQ ID NO: 190439 - DNA, 563 bp, Homo sapiens
aatgccctccagccagagactcctgggaacatacacctggagtggaacaagttgggtttattcctccttgtatggaggggtaatgcacaccttgcagaactgggagtgtcttagcaagaggatgttaggagggaattataagagctgagcttgtatgagatgatatgggggagagcttaagaaagtgggcattgtactggattgcttactttcaggaggcagagacaacgccatgattgattatcttaattaaatcatctgtaaggagggaagaattgagtgaagctaatggtgtagttggtgaagaagcagtcactcttactagctggaactgggaatatatgtttattttgtggcttggagagtgttcatattttgtccatacctgaatatgcagcggtcttgtttttgtcttgatctgttactgtcacagagtggcctcgtctaatgttgctgttctgtgaaattgttcatgttcaacagaataccaagtgagtctcagaccagctcatgataacataaaggccatgctagtaatacaataccagagcagctctcaaata

SEQ ID NO: 190440 - DNA, 469 bp, Homo sapiens
ttccctgagtagctgatgtagagggatttgtctagacaggcagatagatatgatccagtgccaacactgtaatgctggctgaaatccagatggttgtttgattgttaataaaatctatcttgtgggtgggtgggtgtcaggccttcatcattatatggtgcctgtcagatttatctacagacagaaccctgaaaacagcttgtgcctgccccgcatttttgaccccttgccaagatactgtactgaaatctatcaaaatcaggcaacctgggacaaatgcttcgagattccaaggcttaatagcaacagtgctgacttctaagatggagaagattctcaggaagggcatccttgtccggtggggaaaaattctagattaagaggtgaaccagatgctagctctggctctgccgctaatctgagaccctctgggctgtaaaataaggagattgggttagaatggttcctt

SEQ ID NO: 190441 - DNA, 294 bp, Homo sapiens
cgagtggggagagagaaacactataggaagacagtaaaagcatctagactttgcaattgtactgcctaaaatgtttttataacagtaaagttgtactggctaaaatgtttttatacttctgttgtgtgccaggggtcaggaatgccgtggagcaaacagggtgcatcctctgtggtatctgtttaatttaaacatttgttggggtaaaatattatgcattttaactagtaattaatattaaacatagacacacacacaaacacgaattgttttttgactaggaaggaaccacct

SEQ ID NO: 190442 - DNA, 381 bp, Homo sapiens
attatattggagagccactgcgcccgaccgagttgaacatttaatgtcagactaggccagagtttctcaatctttttattctcacttcccaaaggagccgttggagattttcccctcaatctctctccttcatgaaatttcataccacaaatatagtatgttttatttatgtactgcgaccctttgaaggatcacaaaccaatataatagtttttctttttaacccgtcaaggaccagtttttgcccctgttggaaatgcataaactggactgatgaattggtatagatggcttttatcatgaggatcagaaaaacttgaaattccttggctacgacaccccatatttatcaccgtatagggagtaccttgttatggggag

SEQ ID NO: 190443 - DNA, 198 bp, Homo sapiens
cctctagtccaacagttatcactgcgtgagttcatctgtactgcccctaaccattagtgagcagcttgtgcttagacatttgtaattgctaccttggtgggtgtccgttacatttctaaataactgcctatctaagaggttttctttaatgtcattatgatgatttttgaatgaacatttccagagcatcctaagtgg

SEQ ID NO: 190444 - DNA, 415 bp, Homo sapiens
tacagtggcatctgatttctacacgagctcctgtatatttgggacaaaataactcactggaggctttggtttaccactgctggtaccagaactggttgcattttctttgatctgccctttagataaggaactccacagaggttgttccatgtcatttgctttttggaaactgtacatctgcaagctttaaagcagtaggttcagacttcctggaagaactgacacttgaagctgactagggtctacttgagttcatactcactttggctaagccacagtatgagggaagggtgtccaggaataacgcttccatttttatcttgttcattcctgaaaatccaacaggagattcttttcactccctaaaattaactgttctgtgtataaagcatatctggatatctgatcttaaatg

SEQ ID NO: 190445 - DNA, 430 bp, Homo sapiens
ctgcttatgtgaccctgggaaatttcctaacctcactgagcctccattgcctcatctaacaggatgggtgcaatagtacaaatattgagagattagataatccaggctccatgacaggcacccatagatggtgatggtgatagtgatggtaatattggtgagagtgatggtgatgatggagaatatgaggaaggtaagccttaaaggataatttcctaactagttttttgggggtttttttgtttgtttgtttgttttttgatagagtctcactccatcactcgggctggagtgcagtggtgcaatctcggccctacctgcaatctctgcctcccaggagaatcgcttgaacccggaaagtggaggttgcattgagctgagattgagccattgcactccagcctgggcaacaagagcaaaactccatctc

SEQ ID NO: 190446 - DNA, 636 bp, Homo sapiens
cattgccttggtactttctgatgccttcagatttttttattttttagacacagagtctcactgtgtcggccaggctagagggcaaaggtgcaatcatagctcattgaggccaagtgatcctcctgcctcagcctcccaagtagctggaactccaagcacacaccaccatgcccagctaatttttgtatttttagtagagacgggggttcaccacactggccggggtggtctaaaaatcctgaccccaaagggtccgcctgccatcggactcccaaagcgcggggattacaggtgtgagccaccgtgcccagcctttcttttcatttttaacaaattttcatcaatactgtatattctatatacattaggttgaaaaaaaaatccttgtataagttgacccatgatgttcaatcccatgttgttaggggtcacttgtgcatgttaactatttatggagatacatattgaggcagtttcatagaactgagattggtaagaaagtaaaccccagtataggaggaactgcttccaaacatttccaccgttatcaccctaattcaggccaatgtgatctctcccgtgaattctttacagtagccatgatactggactccttgtgactacccttgcctcagt

SEQ ID NO: 190447 - DNA, 398 bp, Homo sapiens
atcagaaactagtataacaaatattcgtaaaacatatggagttggtcctccatatccatgaattcatagatggaaaatatatttttaattgtgtttgtactgaacatgtacagactttttcttgtcatcattccctaaataatacattatgacaactattcacatgacaccaacattgtattaagtattataagtgagctagagatgatttaaagtatacaggagtatatgcataggttatatgcaagtgccacaccattttatatcagggactcaagcatctgtaaattttggtgtatgaagagaggtcctaaaaccagtcccccaaggataccaaatggcagccacactctgaaaaaatagattgtactcaacttttgaaaattctcattgtattt

SEQ ID NO: 190448 - DNA, 297 bp, Homo sapiens
gcaaagacacatacattatgtgcatggtatttaaagatacataaagtaaacatagcaaaatcgttaaccactagtgaatccagataaaggacacacaggtgttcactgttccttttttcgaacttttctctaggtttgatgtttttcctaagtaaaaagttgcagaaaaacgaaaactttcacttcagactctgtattgttagatgctggtgaattttttttataaagggtcagatgataaacattttaggctttagaggtcgtacaatctctactggaactattcaactttaccta

SEQ ID NO: 190449 - DNA, 235 bp, Homo sapiens
gatctaactaacatttatgagtttttgctccctaacaggctctgttttgtgctcttcactaactcttcacagtaacctaatgaggcaggtattgttgtcaccaatttacagagaataataaagcaaataatgcacactcatgcaccactaacattttggtcaacaatagggcgcacatacaatgatggtctgttaagatgataatgaagctcaaaatttcctgtcacctactgac

SEQ ID NO: 190450 - DNA, 355 bp, Homo sapiens
ttggggaggggttgtgtcaggagggtactgaactggagaacaagaagtatggtaggtatcagggaggggcaggctcggaggcagacccggatgggagtctggggaaactcagggcctggagcagtcattgggcaagaagatgggcagttctagtgatggtcatgcttactgtccttggtaactgcaggcaccctcaccgtcttacattcttctttttcactgagttctctccctagggcctttgcccatgatattacaggaggagcttttctcccacatgtccagatgactcacttcccctgcttctttcaggtctctgtccagttgtcagcttatagggggccttccctggcta

SEQ ID NO: 190451 - DNA, 260 bp, Homo sapiens
gggaggtaataatggggacaatgatgatgacagccagtagcatttactacacaacaggaaccacgcgaaatgcttgacaatcacaatcacttttcactcgagtatctagttacctaaccatcaccattaccacgaactaatttaattcttctttgatccttatgagaaagatactatcattatcctaattttagacataaaaaaggatttttttttttttttttacaggaaagagaacagcaaaggcttagtggttatgg

SEQ ID NO: 190452 - DNA, 431 bp, Homo sapiens
gtaaaaagcaaacgtaaacaacctagatgcccatcaaaagtggattgggaaaataaaatatggtacatgtataccaaagaatattatgcagccatgaaaaataatgaaattgggttctttgcagcaacatgggtgcagctggaggttgttatcctaagcgaattaatgcagaaacagaaagccaaatactgcatgctctattgtataagtggaagctaaatagtaggtacacatgggcataaagatgggaatcatagacagtggggactacaaaaggggggagatgcagtggtttaaaaagcacctattggacactatgttcattatttggctgatgggatcaatagaagcccaaacttcagcatcacaaaatatacccatataagaagcctgcacatgtatccactgcatctaaaattaaaaaaaaaaaa

SEQ ID NO: 190453 - DNA, 488 bp, Homo sapiens
agagcctcccacctcagcctcctgagcacctgggatgataggcatgtgccactatgccccacagaaccgttttttaagtgtgatattacataagcgtaaccctaacccctgtccttcatggtatggccaatctatctctaattatctacatctctctatataaatttgtgtttttacttctaagaattatcatagttcattagtagaattaaatattcagtaaatgtttcattttgactactgtttaatcactgttgggagcaatgtgaaaattggtaacaccaatatattcaaatatactatccaaagattttcttttactcaacaaattttgaccttctatgtgtctgtgacactatattagatcctatgggtaatatagagatggaagctttggttttttttctgccacaagacagtgggtaaaagagtttagactgcagtgggtgaggtcacagaggttcagggactgtgctgtggaagtgtgg

SEQ ID NO: 190454 - DNA, 536 bp, Homo sapiens
cctgccaccacacccggctaatttttgtactgttagtagagacggggttttgccatgttggcaaaaaaaaaaagaaaaaaaaagaagggaggacatgcataacatctaacctctcgtgcttccacatttgagcaaaggacagtgatagggcagtgacatctagtggtctgtctgtggaagagcctccctgggctcctcttgcgtgtgagtcaccttaatagctttcaaagttgtggtttatagacttcacgatatgtccagagtggaggtgccattgtttattatttgtggtttttgcatattgttctgtaaacttgggacaggaaagttctgaaatgcagtgctttaaagcattgcccaagaaactcaatactgtccaagaagtcatccacccctctttttatataaaaccatatcagtaatcatgttcatttctattcaattttgttacaaaattaatttttaagaaaatttaagcaatgaaaacacaatatacacagtcagtgttcacatctttaggtattctcgtgctaatg

SEQ ID NO: 190455 - DNA, 486 bp, Homo sapiens
gaataaatgaatccaagcctttccctaattctcactgccttatgcagactttgcctcattacaatagcttaaatgtttcaaataattcttcctaagggggacagcaaaaatggtcagtaggaatccatgccataattatgaggaatcatggaattcttgaagtggggctaaggtcagtctaggtcagccagtcaggccaaactggaagaaatatttcttgccatctccacatctaagaactttcttgctgaaaatagccagagaagctaaactcatctttctttaaactacagaaggaaacgaagggccagagcctccatgaatacttttaaccctggagtctcgaagaaagatcagagctggacttaaggccagctaggagaatgtgctgagaatgaaaggctgtgcaggttaagtgattgggtgggatacactcactgcacagagtaaaagcttgtacaactcagcacatagccctgtgaatta

SEQ ID NO: 190456 - DNA, 918 bp, Homo sapiens
tgggctcagaaggctgatgctgggaccatcttctttcattctggcaaaaccgtgggtttcttcagaatgtcaaagtgcagaagggcgctgtgggtggcaggatgcttgctggccaggtagcagatggaaatcagtgtccctgcccacccaggaggagccaggagcagaaggtgaaacagtgagccgtggagatgctcgactcttcctgagattccttccatgatttccagagacggtgaagtcacgatgcacagctctccagcatgtgcatctcctcctcaaatgccttctgcagggacaaagaggactttatcctcaagagtgggacacagttctgtagcaaaatgtggcaggttgaatggaaataatgatcttcagaactttaagaaggagatgacccagatgaaatagaaattgggtaatttatcagaaagcctggaaaaacatctgagagagacccctgcaggagactgaggtctggaagggctgaggtagcgtattcttattctggcctccacaagccgcatggactcctcctatctggcctcgtcacctggcctccaccagcctttttcctatagggaagccactcacgctccacagttctgggaaacggactgatgagagatttagttctggacagccgcccctcaactgttcctgttccatgctctgacacctcgggttggcctcagacaatctactcaacaccttgtaatacatttatagacctgtggctcaggaaaagctgtggggaaggacagagcttcagcaggccaagtcccaagcctgtggggccttttcttcttgaactcatgcagtggctggcatttctagggagagggctgaagttcagttcacatcgtcccatttatggaggatctctcttggggttattcttccaaggagcatcagcaa

SEQ ID NO: 190457 - DNA, 188 bp, Homo sapiens
tactaagaaaacaactgaaaaatagtaaaaacaaaagacaaaagcaataaaataatcatacgcttaaaaaaactattaaacacaaaataaggcaataaaagaggtacaaacaaacagaaaaagccaaaagatacacaaaaaaacaaatacctggccgggcatggtggctcacacctgtaaccccagca

SEQ ID NO: 190458 - DNA, 409 bp, Homo sapiens
gatttttataagttgttgaaggtggtgataattctagagtgtaggcacggagggggccagcaggcaagaggcaatgggactgtaacgaaacaatcccaagtctggtgggttggtttggggctgctgcagggaggcacgggggcagtgaggctggaactctgagaggcagccccggaggtaaacctccattcctgacggcactctttttttgagcatggaagaagtcagaacacgcgttaccccttgtgttagctctctgcatgagttcagagtatccctgggtctgaattaaacaaatgacattttacagatagattttacagatacgttatgagtcgatatttcttaaagcatgtctaccttccataatgccagaattcctccttttcctttgtgaggtgaagatgaa

SEQ ID NO: 190459 - DNA, 492 bp, Homo sapiens
tcatggagagctaattacagcatgatgactgtagttaattctattgtatacttgaatctgctaaaacatagatcttaattgttcttaccaccccctctcaaaaaaatagcaatgtgaggtgatggataggttaactagctcgattgtttgataatgtaattcacacactgtataccttaaatatatatagtttttacttgtcaattatacctcaataaagctggggggttagggagagaaacaaaggaactctctgaaataacaccactgtagacctaacttcatgaagggctatagggtgtccttttctgcagaaataaagaaagaagccggaccgaaaaaagagaaagaaagaaaagaaaaaactgtcttaaaacccactggctatgaaagaacactgctgttgaccagagtggaaataaatctagtgtcaaagatgtctggtgtcatttttaaaaagcagcagcaggaactatttctttcaaatggatt

SEQ ID NO: 190460 - DNA, 327 bp, Homo sapiens
agcaccaaatgttggtgagggtgtggagcaacaggaactctcatgccttgtgggtggggatataaaatagtgcagctgctttggaaaaaggtctggggctatcctgtaaaattaaacatacacttaccctttgcccagctatttcaaccctagttatttatttaaggataatatgaaacatatggtcacaagaagacctatacaacgttctagccagaaaatagaggccaggtgtccattacaggagaacggacaaacaaatggcggtgttttcttacaaacggaatggtgtggtactctgcaacaaaaacgaatgaattactcata

SEQ ID NO: 190461 - DNA, 157 bp, Homo sapiens
gtttagctacattccaactagccaacatcccacatagcattaagagtgcctgagaattcaaacccactacataagagttgctgagactctgctaacacacatctaattcctgtgccaccaacccccacccccaaacactctgaagagtaattgagat

SEQ ID NO: 190462 - DNA, 897 bp, Homo sapiens
ggtagagacagggtttcatcatgttgcccaggctggtctcgagctcctgtcagctgttatacttctatgtgttcagtgcttttgggaggggtcagagtggtagcagtgcttctcagacacacttttgtgagtgtgatgcttcaggacctccacgttgccccatttttatctggggcccctctctgggctggagcactctcactgggactgtgtcattcatttgtttagtcaacaaacatttatggaacaactgctgggagctcacctgaccagttgatacaaatatgaataagacatggtcttgatcttgaagatgctgtcagcttggtggaaaagaagagcacaaagaccgggcgcggtggctcacacctgtaatcccaacactttgggaggccgaggcaggcggatcagctgaggtcaggagttcaagaccagcctggccaacatggtgaaaccccatctctactaaaaaaatatatatatatatacaaaaattagccgggcatgatggcgggtgcctgtaattccggctactcaggaggctgaggctgaggcggaagaatcgcttgaacccaaggttcaaggttgcagtgagccaagatcatgccattgcactctagcctgggcgacagagcaagactgtcttaaaaaaaaaagagagaagagcgcagaaagaccctcatcatcatcatcaaacatcaaacattgccatcatccgacagtgtcaccagtgcactacaagacatgtgaacaggaaatgatgggcatacggagaagggcccttgcccagccggggattcaggaaggcctcctggaggaggtggaactgagccaagtctcaaaggatgagtgtgagttagtcaaaaggaaagccttctgggtggaggggacttcctg

SEQ ID NO: 190463 - DNA, 262 bp, Homo sapiens
cttggtgatctagaggatccctactgttcccaaacaccatcacctcatcatcatcatcaaacatcaaacattgccatcatccgacagtgtcaccagtgcactacaagacatgtgaacaggaaatgatgggcatacggagaagggcccttgcccagccggggattcaggaaggcctcctggaggaggtggaactgagccaagtctcaaaggatgagtgtgagttagtcaaaaggaaagccttctgggtggaggggacttcctg

SEQ ID NO: 190464 - DNA, 1624 bp, Homo sapiens
atcatgtgagcccaggaggccaaggctgcagtgacctaggaccatgccactgcactctagcttgggcaaggggaataagaccctatctcaaaaacaaacaaacaaacaaacaaacaaaaacaaaaaaagaaaagccctttaaggctccgtgggttccagtacagctctcaatataaggaagctcagagccaaggagggttgggacagaggacagtgggaggaaggtacagtggttgaaagcacagcctctgtggacaggcctgggttcagttcttgtgccacatcctactaagcatgagcatcagccaaattattcttaactacttgttctaattgttctcatttataacatgagaaaaagcttatcctacattgttgctgggtggggcagatgagataatacatagaagcactcagtacagcgcccaataaatgctagccactgtgatgactcctatttacaattcttcactaggtgagttaattaatacatgcaaaggacttagaagaaggcctgcacagagccagcccttaataataacagctgatacatttacaatacttactgtgcattaggcactgtgccgtctgctttctatatgttaacttattaaatctcataccatggctatgagttgacactattgcaactattttccaaatgaggaaagtgaggcatggagagactgaataacttgcctcaaatcctgcagttggggccgggcgcggtggctcatgcctgtaatcccagcactttgggaggccgagacaggcggatcacttgaggtcaggagttcgagaccagcctggccaacatggtgaaaccctgtctctaccaaaaaatacaaaaattagccgggtgtggtggtgcatgcctgtaatcctagctaccggggagtctaaggtagaagaatcacctgaacccaggaggtggaggctgcagtgagctgagatcacaccactgcactccagcctgggtgacagagaccctgtttcaaaaaaagaaatcctacagctggtaaattattatcatcattcataatacagggccatgttttccaattgtgttcctttgaacactgaacgagtactcaggcaggcaatgggaggagactccctttcaaccattcattcattcagctcagatttactgactgtctccggctctgtgccaggaacagggaatagatgggtaatgtcctttctttgtggagtttataagcccatggacagagacagaaaagtgcacacacattagacaatttcagatcatagctgctcggaagaaggtgatatgatggtgatgtccatagattggatggtcaaagaaggcagcaagcttcaaagccctgaggcagggccaagcttggagtgtgcagagaatggttggtcggtggagctcctcgtgcagaagagatagtgagtgaacttcagtgtttgatctcttcttcatgggatctcattggattaaagagagttttttaaaaagctggatcattggataaatagttggaagaaagctggattgaaaaagtttggaaaccactgatgtcaagcaagctttgccattttaggaatacggaatccaaggttctggcctcagctctggccctaagtgctgtgc

SEQ ID NO: 190465 - DNA, 927 bp, Homo sapiens
atcatgtgagcccaggaggccaaggctgcagtgacctaggaccatgccactgcactctagcttgggcaaggggaataagaccctatctcaaaaacaaacaaacaaacaaacaaacaaaaacaaaaaaagaaaagccctttaaggctccgtgggttccagtacagctctcaatataaggaagctcagagccaaggagggttgggacagaggacagtgggaggaaggtacagtggttgaaagcacagcctctgtggacaggcctgggttcagttcttgtgccacatcctactaagcatgagcatcagccaaattattcttaactacttgttctaattgttctcatttataacatgagaaaaagcttatcctacattgttgctgggtggggcagatgagataatacatagaagcactcagtacagcgcccaataaatgctagccactgtgatgactcctatttacaattcttcactaggtgagttaattaatacatgcaaaggacttagaagaaggcctgcacagagccagcccttaataataacagctgatacatttacaatacttactgtgcattaggcactgtgccgtctgctttctatatgttaacttattaaatctcataccatggctatgagttgacactattgcaactattttccaaatgaggaaagtgaggcatggagagactgaataacttgcctcaaatcctgcagttggggccgggcgcggtggctcatgcctgtaatcccagcactttgggaggccgagacaggcggatcacttgaggtcaggagttcgagactgaagtgaattataatcataccatgcactccacacttcagcctgggtgacggagcagacgctatctccttatataaactaatacagaagcttaagtattccttaatagctaaacccatggcaggc

SEQ ID NO: 190466 - DNA, 424 bp, Homo sapiens
acaaacaaacaaacagaaacccctatggtggcacatgcctgtaggcccagtcgctggggaggatcacttgaggccaggaggttgaggctgtagtgaactgtgatcgtgccactgtactccagcctgggtgacaaagaccctgtttcaaaagggggaaaaaaagggttccaaagtgttctttatatggaaaccattttgattctggatataggtctagtgagtctagtgaagaaatgttgtttgttaagcgatctggttacttgaactgacggaaagcagaaagctgttgtttagtctggtatctccaacattaaatagaagtttcctaacaaaacaatttaagactgaatttgaatgtagtgctagaagagcagagcattccattatgatgtttgcagttaactattttagaatagctttagat

SEQ ID NO: 190467 - DNA, 604 bp, Homo sapiens
aatttattgaatatccgcgccaaatgtgaaaaacgaactggttttataggtactccagtacatactggttttgcacgatggtcaagttgaaaaactgtaagtcacggaccacggggacactctatgtacatttagaactaatctaagttcactttcaaatgacactataccacttaacaagtagtacaattactttataacagaatattcccaattcctttgtcctcttccttattgctgtcattcattttacttatccataagctgtaatcactgacacattgttgctattatttgttttgaacaaactgttgtctgtcagttaggaataagaaaaagattttattttgccttcatttattccttctgtaatgtgctttctttccttatgtaggtccaaatttctgactgaaatcattttctttctctctaaagattatctgttatcatttctagcaagacaaactttctggtgaagaattctctcaatttttgtttgagaaagtctttatttctgtttcatttttgaaagataattttactggatacagaagtctaggttcatgttatttttctttcaacacttaaaatatttcactcctct

SEQ ID NO: 190468 - DNA, 520 bp, Homo sapiens
ggaatttcagacaagaggctgtatggggcagatagagaagtcactactaaggcggatacgggctgataaggcagagctactcaccaccccctaacactgagatgacactggctttcagtctgctaagcagagagtttgaaaacacccacactcactcctttttcccttcactactcctactcgcttgatgtaacttataatgcaccaacacacacaagggcaacagcacattcagagcccagttttttcttttggagaaacttaaatcgagacctcaaagctgtccctctgtggagaaaagcactttcctaggctgcccagggctggaacaaggcaaagaccaccattctggtgaaacaagctggcaatatgacaaatatataagaaatttattaatatgcctggcctttgagcctctaactccaactctaggaatctatcaacactagagcagaatatgacagatatacacaaatattcaccgctccaaggtgaacaacaggtcctccctttggtgaaa

SEQ ID NO: 190469 - DNA, 429 bp, Homo sapiens
agggagtttcaaatagggccaagggatgactgttttagtatcaagcttcccaggggattccagtgaaccacccagggttaagagccattggcctgggggccaaaactgtgagggaaaagatcagtcatgttgcctgatgctttcttgggtatcttcaataggaaaaaccaagtccagagcaaactcagggttcactggctagagcttgccctggaaaatttggaaataggcctgtctcagccttcctttccctggtgaccttctgtcattcctctgccagctctttccaaaccctgtccctccagcagaacctgacttctgagccactccttcagggctggttaggtactgtcagcctgcagatgctaccatgcactattcccagggttagggtttcaatacggtcagtgtaaaccatgacctcagcat

SEQ ID NO: 190470 - DNA, 796 bp, Homo sapiens
gctgctaccttccatgcaggcgttgaggggcttccctacgttattacgcacaaagtcctcctcacagtgcctggtgtgtggtcagcatttatatgcctggcaccaggccgggggctatggaggcaaatcagctgggccctgccctcacagagttgacatcacttagtacgtaaccacatgggatacatgtttgaaggagaggacagtgtgtctggccagtgagcaacagtgggccatacgtctccagggaacccccgtggggtgtgggaggagggaagcaggtctgtcctgggggaatgtgtgggaccacgctccacccgacggggtggcagtaggtggatttcaggaccatgggcctgtgctgtttacagaaccttgtccaggtgcccagctgtgggagggcagcatggagaggaggaagagggggcccctagtagcaagcttcagaaacttgccacttcaggctagagagctcgcaccctcccacggcagcagggtagccatttctccctgactggggtgtccaccatggtgctctgcagccacctctcacttcattaagagtccacagatctaggagcagaggactggtctggagctgggcaagggcaggcagcaaatggggagtttttgctgtgtgacctgaggtcacttgcctgccttctctggactgcactgtagggcctggagacctgttcccctgttccaatttccccaccccgtcgggtggagcgatactcaagattctgccaacgttggaagctgttgctgccctggggaacaaagtcgtggaaag

SEQ ID NO: 190471 - DNA, 841 bp, Homo sapiens
gctgctaccttccatgcaggcgttgaggggcttccctacgttattacgcacaaagtcctcctcacagtgcctggtgtgtggtcagcatttatatgcctggcaccaggccgggggctatggaggcaaatcagctgggccctgccctcacagagttgacatcacttagtacgtaaccacatgggatacatgtttgaaggagaggacagtgtgtctggccagtgagcaacagtgggccatacgtctccagggaacccccgtggggtgtgggaggagggaagcaggtctgtcctgggggaatgtgtgggaccacgctccacccgacggggtggcagtaggtggatttcaggaccatgggcctgtgctgtttacagaaccttgtccaggtgcccagctgtgggagggcagcatggagaggaggaagagggggcccctagtagcaagcttcagaaacttgccacttcaggctagagagctcgcaccctcccacggcagcagggtagccatttctccctgactggggtgtccaccatggtgctctgcagccacctctcacttcattaagagtccacagatctaggagcagaggactggtctggagctgggcaagggcaggcagcaaatggggagtttttgctgtgtgacctgaggtcacttgcctgccttctctggactgcactgtagggcctggagacctgttcccctgttccaatttccccacctcagtgaaggcacaaccaacagctgctcccgggcatttccaagaccctccaggccccagttctgaggactaggtggaggcgtgtttctccccagcatcaagtgaccagagaagtgaagtgac

SEQ ID NO: 190472 - DNA, 764 bp, Homo sapiens
gctgctaccttccatgcaggcgttgaggggcttccctacgttattacgcacaaagtcctcctcacagtgcctggtgtgtggtcagcatttatatgcctggcaccaggccgggggctatggaggcaaatcagctgggccctgccctcacagagttgacatcacttagtacgtaaccacatgggatacatgtttgaaggagaggacagtgtgtctggccagtgagcaacagtgggccatacgtctccagggaacccccgtggggtgtgggaggagggaagcaggtctgtcctgggggaatgtgtgggaccacgctccacccgacggggtggcagtaggtggatttcaggaccatgggcctgtgctgtttacagaaccttgtccaggtgcccagctgtgggagggcagcatggagaggaggaagagggggcccctagtagcaagcttcagaaacttgccacttcaggctagagagctcgcaccctcccacggcagcagggtagccatttctccctgactggggtgtccaccatggtgctctgcagccacctctcacttcattaagagtccacagatctaggagcagaggactggtctggagctgggcaagggcaggcagcaaatggggagtttttgctgtgtgacctgaggtcacttgcctgccttctctggactgcactgtagggcctggagacctgttcccctgttccaatttccccaccccgtcgggtggagcggggacctctagatcgaccagcagcagcaag

SEQ ID NO: 190473 - DNA, 355 bp, Homo sapiens
aaacgttttagccaggcgtggtggtgcatatctgtggtctcagctacatgggagtctgaggcgggaggattgcttgagtccaggaggtcaaagttgcagtgagccatgtttgtgcctgggcaatagagtgagaccccatctgaaaaaaaatcaggattttttttttttttttttttaataccatgatcaagagacggtgactgggctctggcacacccttctagtctcatctgctgctctctgccctgctcactctcttccagcctcgccatcgtcactgctgtaggtccagcatgtcaggttagtttctgcctgggcctttgcttgctgttctgcctgtaatgctttctcccaa

SEQ ID NO: 190474 - DNA, 474 bp, Homo sapiens
tcctaccacaatcttagagttgatcattttcattttagagataaggaaagcaagtcttaggaagatcttacagctagttaatggcccaagtatttctgaccacgtggtcatttttaatattctcttgttcccatataatgctctcttgcctcttaatgagtttggaataagatagatttgagttggaatctcattctgttttctagctccttcaacttaggcaagttacttaacctttttgaggcttgattttatgtagtcgtgatagttaccatcttttcagttgtgcatgaggaatgaggtaatattactaaggtgcctaccatgttgtttgtgagaagctacatttgtatggtaaagtttcctatgggtaattgacctattgagtccataacttttaaaaaccaatataatacagttcttggtaatacaggtgaattactgggacaaattactgtttcagtttagtttaaa

SEQ ID NO: 190475 - DNA, 406 bp, Homo sapiens
tctagaatttgtttggttcctttttataatttctatctctttattgatattctcattttgttcatgcatggttttcctgatttcctttagttcttcgtccatgttttcctttagctcgctgaacatacttaagatagttgatttaatgtctttgggtaataattccaatgtctggacttcctcaaggatggtgcctgtcaattttttttcctgtgaatggaccatggttttctatttctttttatgttttgtaattttttgttgagaactggacattatgagtattacattgtggtaactgagaatctaattctgtcatgcctcagagattgctgatttttgcttattgagggctggagccaactatttgtgacttttccaactatttttgtgaagtgtgtattct

SEQ ID NO: 190476 - DNA, 368 bp, Homo sapiens
tttccattttgtcacttctttttatttcattttggttttaatttacaaaactgtttaacattcttacatagtaaaattagtatcttttttatgtcttctaagaaaatttaagcctttttgagatttttgtgattgaataattttgcctggagaatttatattgaacttgatttttgagctcaaagaaattcttagtggagaaaccacctctttttcattcatctatccaagaagtgtgcttgacttagatattttctgaaatgcctctgaaaagtatgcagcaaaatgatgtaggaatcatttatgaaattctacctcccaaggaaatcttagaaaataaatagttctgaggacttccatattccccc

SEQ ID NO: 190477 - DNA, 159 bp, Homo sapiens
cctcacagacctgcccttagggcagaagcaggaagcggaaaggttttctcacggtggctgcaaaatagaggaattctggaggcctgatgtatggattctcagtgtattgggtgtcctcttctctctcaccattccacccctgggcctgattaaaggaag

SEQ ID NO: 190478 - DNA, 718 bp, Homo sapiens
ccattttaaagcaaattccagaagttactggttttttccaattatgaatacttcatagttgcatctctaatctaactgattaggaaattacttaaaaagtaactttttggaagtccaagtccgatgtgaggacaaaaaagagtaacttctgtgtcataataggtaacacatttaatggtaatacctcttccatattcaaatatgaacaattattactgtaatgtctctatttccctattttttctttcctgggtgacagcaagactccgtctcaaaaagaaaaaagaaacaaatatggggacgaacagtgggaatgcacgaggagagggttcccatctgaggaggctggaagaaaaagaaggctgaaaagaaccatgagaaacacatgtctgtcgttaagctatacagcctatggtatttgtcatggcagtctgagccaagagagggagcaatttaattagcatgtgtatgctcttctatctaggtcccatataagatgtgccaacactgttagtgctatactccttttgtgttaccaacggacagatagaggaagggagggaagaaaggaaggatgggcgcagagaaccgacactcgtcacactgacaatgtcttctaacgcattttgggaaaagctatccaaaggcgggggacacagggggtccacgcctggtaatcccaaagtgctgggataccgggggagtcatgggcggtcca

SEQ ID NO: 190479 - DNA, 392 bp, Homo sapiens
aaatcgagctcggtccaattagaaactcagaagagtattttcatgtttgttcaagatcagaatctgaactacattaaaagtacaatgcaagttcattctattaggacaaaagaagttgggtatgaggatattgtgttttctcccttgcgatcagctgtctgttgttagctcttagtgcttagagcattatccagctggattccagacataatgatgtgttgccttctacaccatggaaagttacagagctcagctgcaggccaaactcagttgaaagtttgtccacatgacacaaaattcctttatgcacagaagaacagtaactgaaaattacgactgtcatctgggtcttaaagctggtggcccccaagctgaattccccagagaccaca

SEQ ID NO: 190480 - DNA, 238 bp, Homo sapiens
cccacctcttatgagactttcattttcctaaacgaacctctctcccattatccaccattccagctcaccctccctcccaccgatctcaccttctccctctacacttcctcattctctccaacgctttagcttttcagcttcccatcaattctttagaaatccctccccaaattatccccactctccgtatcccctctacttcggcttctccatccctcatcaattcctcttcccaatg

SEQ ID NO: 190481 - DNA, 278 bp, Homo sapiens
ccaaactggtgctaatggcacctcaactttagcagaagataatgcattcctagaagagggagtggaggcttgatgctgctcctgcatttactcacagctccaccacatctcttgaatgttctgtatttgttccatgcccctcttacccagttttcagatttggtacagattttctcctgtaaaagtctgtcggtaatttcaaatggaatgggaaaagggtattggaccactgcttttacttagctttcttactcataagtcctagacttagtcttaga

SEQ ID NO: 190482 - DNA, 242 bp, Homo sapiens
ttgggggtgcggtgggaaatgctgcttgtcttgaaatacagaattttgatagatcttttccacttggcctaaagctctgatggcaggtgagagatgaagggttagtaggttttgcctgtagtcaagtagtaacttttaacagtgcccctaaatggattcagttgtcacaggggatactgagttccttgacatggtaatatttgggacagtagtttagagcatgatttgttgtagggttctgc

SEQ ID NO: 190483 - DNA, 304 bp, Homo sapiens
aaaggaaggaaggaaaataaaaggaaggaaagaaaagaaagaaggaaggaaagaaggaaggaagaaaggaaagaaggaaggaagaaaggaaggaaggaagaaagagagaggccttgctgagtgccaagcatcagcctcacaaccttgcaaaatggtgtagaagttttctatttccaagcagttctgtgggtgagaagtccaacatgggtctctccagaggctctagggaagattccatgtccttgccttttccagcttctagaggccacctacaccccttggctcatggcccctttctccacct

SEQ ID NO: 190484 - DNA, 433 bp, Homo sapiens
gatgtcccccttttgcagagaaagaaactaaaactaaatgctggtgaggcctaaatatcttacactcacttagcttccaggagacagagacaggacttgattcaattctttgtctgagattcttctagtcatagatcaatgactctctctctttttcaaatttcagtagcctttggagtacaagtggtttgtggttacatggatgaattctgcggtggtgaaatctgagattttggtgcacccatcatctgagcagcgtgcgctgcacccaatatgttgtcttttattcctcatcccacctcctaactacccccaacccgagtccccaaggtccactttatcacttcgtatgtctttgagtcctcatagcttagctcccacttataagtgagaccatataatgtttagttttccattcctgagttacttcact

SEQ ID NO: 190485 - DNA, 223 bp, Homo sapiens
acagaaacaaggaatgcctttgataggttcatcaatggactggacacagctgaggaaaaagatcaatgagctaaagatatgtcagtagaaacctctcaaactgaaatgcaaatagaaaaaaaagactaaaaaataaaacagaagagaatatccaagaactatgggacaatttcaacacaagtaacatgtgctaaattggaataccagaagaaggaatagagaa

SEQ ID NO: 190486 - DNA, 303 bp, Homo sapiens
gtgaagcatggagatgtctggggatgatggttcaggcatcggggcagccagtgcaaaggccctgtggtatgaatgtgctgggcacaccccatcaagaaaaggagtgtggttaaagcagaggaagtaaggatgtgtgtggtagcaggcgaggttaaagaggtgatgggactagaaataaagtcattcactggcttttgagtgagatagagaagctctagaaagttttcggcaggggactgacacgagctgacttctgttttaaaaaagtcactctggccaggtgaggtagctcacacctgcaat

SEQ ID NO: 190487 - DNA, 1003 bp, Homo sapiens
gtcaaatgtcttaagggagagattggttgtatgtctgctatgggttccctcagttgggattttgtttcctaagtaccacagtactgcacaagattgccattttgaccccagccacctcctccaatgtggctcttacagacttttgattgagagcctggtaggtgtctgttttcacagcactataaattgtgttctttggattccttttaaatagaggtggggtctcactatgttgcccaggctggtcttgagcaatcctcctgtgtcagtcttccaaagtgctgggattataggcatgaaccactgtacttgttcttcagattttttgagcctagctctgtaacctcttgccccaagcaggttcaagatctggcagaggccttgcgtggaaaatcagttgcatattggtttcaggcccccttctccatagaagtaccttatctattaaacatcatgatactatgagagatttcactcaacctctctgagctagccccttcctccttgtgtaccatcttagactttcacaaatgttccttggggaaaactggctttgcacttggtttcttctagcttctaatctgttgtacatgaccaccaaaaactctgatggtttcactttccttctgcttgagtcaagtccagtcttcagtccatgcccaaaagcattacacatccctgaaaagaaaatgatcagcaatcatcagttcagctaagataggctcttgctctctagaattttagttcatgttgtccttgttacttccatagctccccagtgtctttacaaatgatttcatgatttcttcttttttctttccagttttgcagcaagaatgcaggttgcagtagacataatgcattccttttgtgtgtgttacatactacattctactcagaagtggaaaccaaatgaaacagttaaagaccgcgttttctacctagagcatattgtttctcctctattcattgtgatttcccttctttgacttcttggtttatg

SEQ ID NO: 190488 - DNA, 366 bp, Homo sapiens
ggcacatgttcatgtcatgcaatgacattagtatatgaccaaagtgatgatatggctaatattcctgggatgcaggaggaagaagattcatttgaagcttctcctctgaacgtggatgaaatgtggtcgagaatataagctctagcatcagataaacctgggtgtgcaccccagctctgcctctctgtgtgattctgggcaggttactcaatgtatataaatctctgtttccccacctgccaaatggagataacagtgagattcacctcagagatctattggaagactatataagcattgtattagactctgaggaggataaatccgagcttgcttaccatttcactgaaacgcaggtcctgcttt

SEQ ID NO: 190489 - DNA, 289 bp, Homo sapiens
tgggcagccaactagagtttcacttcatctatagagccagcaggagagatctggaaagcaaaaaactggtgtctgtcgccccaatgggaaatcacactctctcacccatttactagatctaagtcagttcccagacacagagctcagtctctgatccagagctcagtgactatcaaagagactaggtccatttggcaatatcctgcaacaccactgcaaaaatttaaaataaatatctcctgatcctttcccaaaggaacttgaagctatttaccagaatatcagatat

SEQ ID NO: 190490 - DNA, 184 bp, Homo sapiens
tgccgagaaccaagaggtgcagatttctcctaaagtaagagtcacagccctggaaaagtctctaactactctttggttaaagtgacaaaatgtaggagtctgcctgggccttgagcagggacagagataaaagagaccaaaccccagcatcacagaccagcaggggagggggctgaagaagcag

SEQ ID NO: 190491 - DNA, 584 bp, Homo sapiens
caccgagagtctggacctatccccaaatctaaagtaggcttcctctgttattctctctccttggaaatggttttcacctatttgtgatgccacaatctgaaactacttttgtttctagtttaatggctgttaccctcaccagagggtaactgtttgtggtttattttattctgagcctagcatactgtccagcacagtgtctggaaaacagcggatccctgattcatatttggttgaaacaataagtaaatgagtttcacctgattataacaaattagggtggaaattttgcatggtgtagaaacttagaaaaaaattctagagagcctttgaagcacatgattagtagttggaatgtgaacctaagaaattcatgctctaaggaagtcaaacaatatttatattcagatactttatcattaggataaggctggttgtagggaatgtgctatagagaggttagatattcaaaagatctatgggatgaagggggaatagtgtatatcactgaaagggagaggtatgggccatgagttaaacacagtagcaacctaaattaaggacacctaaatgaagaaaggaaa

SEQ ID NO: 190492 - DNA, 331 bp, Homo sapiens
ggcaggtatatgataaagcaaaaagaaaatattaactgtaaactcctggtggaggagatacagttttcattacagaattctttcaatcctttttgtctgaaaaatttcataataaaatgttgagaaaagcgataagcattcagttttgagtttgggttgactggcgggatactgggaatacagaaggtgtagctaggtcatgtcaattagtgacataagggtttgaggtacccaaggcattcaagtagaaatatttagcaggcagctggaattgcacaagtagagttcaattatagttattttactctgctgcttcctgaacatctctctg

SEQ ID NO: 190493 - DNA, 508 bp, Homo sapiens
caccactattaccactgatatccttttcctattctgggctctgatcttggacctcatgctgtacttagctgtccttccgttgagtctcctttaaactgcagcagttcctcagtcttgccttattcatctacgcttttccagagcactagttaattactttgtagaatgttcctcaatttgagatgagcctgggacatcttaccatgaagcaggaagccatgaagacaactggtcccatcaggaagacacagaggccacagcaaactaagggagggattcccaatagccatgcacggagccacatcaggatcaggaagaatgaacggaaaacaagtcggcagcaatcatgagagctaccaccaccacagtgctcgccttgggactacaggacacccacttattattcccaagatcactaaaggacaacagttatttcaagctgctgttcctcgatgaactgcatttctgaataaccaaaaagctgatcagggcaagaaccacagtcaat

SEQ ID NO: 190494 - DNA, 547 bp, Homo sapiens
ataagtggaattataatattataagtcctttaacgtttaattaaaatgccaagaacgtacattgtgtaaagggccacctgttcaataaattgtgctgggaaaactggatatccatatgcagaaggacaaaacttgatccctacctgtcaccgtatacaaaaatcaactcaaaatggattaaagacttaaacataagaccaaaactgtaaacatactagaagaaaacctagagcaaactcttcagggcattggcctaggcaaaagttttatgactaagacttagaaagcacagacagggccaggcatggtgatgcactcctagtactttgggaggccaaggtgggtggatcacaaggtcaggagattgaggccaacatggtgaaaacccatctctactaaaaatacacacacacacacaaattagctgggtgtggtggtgcacacttgtaatcccagctacttgggaggctgaggcaggagaattgcttgaacccaggaggcagagattgcagtgagccaggttgaagccaatgcactccagcctggc

SEQ ID NO: 190495 - DNA, 603 bp, Homo sapiens
tgctgtttctcttatctgccaggtgtcctcttataactgtttctttggccctgagtacaattaattgtaatgtaagtcagaccacgatcatgactcgtatgtcagtatagtctctgacttatgattctttgacttagaattttgtaagtttatgatggtgcaaaaatgatacacagtcaatagaaaccatactttgagtaccatataaccattttgtttttcactttctgtattcaataagttacatgagatattcaaatttattataaaataggctttgtattttttttcttcttctggtggttctagcagaagttatggggagggttctcagtggttcttactgagacatgggtccattcttgaacaagtcatggtggccaggaggatttagtatggtgagcaaccctggatccacccaaactacatgttattaggtccccatatgaagtggtagttccctagagtaaagtcagtaaggagggtgctttgttaaacagacaaaagctatcatcagactatgatttacgttaacatagatacaatctctttgaacagagatataaacagagtactttggcaataccctgaaggcaacaaata

SEQ ID NO: 190496 - DNA, 289 bp, Homo sapiens
tagcaatctcattgtactagcctttataggaaatgatttggaggaatcaggaaagcattattgttgtcctcaacatttcttgttgccatttactttgttggttctatcagtttccaagagtggcatggttgtagcaatgacagccagcagaaaatgatattttgtttaggacaattttgataactacatgcttttttagggccaacatttactctaccaagaatattattatatttttgaataatcattattattagaattatatttttgatcgaagacagccatttag

SEQ ID NO: 190497 - DNA, 555 bp, Homo sapiens
agtagactgcccaacccatggagctacacgacctcacttcctggtgcacctgccacccctagcagctggaatgggaccagatttttctgggtgaaatgctaggatccgagcacagagtctgacatatggtagatgtgtaatctatattccattcactgatgaatgaatgactctaacttagcaggaagatataccaagcacccaggaaaacagctgccttcaaaatgcagctccttattttttaataatctgaaacaagactaattcactgagaattccaatgtgaaagacctcccaatcaaggttcttatcagcaaacttacaggtatgggataacaatgagggttatgcatatcactttcctgataagtggtgacaaatactctttttaaaatgcctaccaacctcctgagctgagcttcatagaccccaaagtaccctccactctcaagatctttgaagaataaaaaggggtgggcaaggtggagcatgcctgtaatcccagcactttgggaggccgaggcgggcggatcacttgaggtctggagtttgaga

SEQ ID NO: 190498 - DNA, 596 bp, Homo sapiens
agtaagacctcaaagattgttggagtagtaaagagtgaattagaaatatgaagtggtatttaagagtaggatatatgaaatggagattattgagggtttgagattatttaatcatatcagaatctaggatgtgatcagggcatgaggggctgctgtagggcagaagacaagatcattggaagagaggctgtcaaggaacagagagactggaggttataaaagattgtctagatgtatactgaattctctaagaagtaaaataacagtagtgttgaagactgacagtaatgtaggtactaaggtagtggttggcaagctttttctgtcaggggctgaatactaagtattttaggttttgtaggccatactggctctttttaatactcagacctttgttgctgtagaacagagtagccatagacaatttgtaaacaagcggatgtggcagtgttccagcaaaactttatttatggacactggaacttaaatttcatagaatagttttcacgtgttatgaaatagtcttcttttgatttttttttaaaaagccatttaaacgtattaaaatcattcttagctgttgagctatacaaaaa

SEQ ID NO: 190499 - DNA, 324 bp, Homo sapiens
agataaactttagtataattgctagaacatatgctttctgaactgggattatgtcaggagaaactggggaaaaaatggaaaatgaacccagactcaaaggacagtgaagatattgaccttgtttgattgtctcattcttcaaaacaggctgaagagtacaaggttcttctcctggctaaaatatttgcagctatatgattgtataattcaacttttgttcaatttcaataatgaagtgggggagaaaatatagctgcactaaattacctgctccctgcacagatttgaatatttaatacctcaatcaatggcaaagcaattata

SEQ ID NO: 190500 - DNA, 354 bp, Homo sapiens
gccaaaacacacgttcacctatgtaacaaacctgtatatcctgcacatgtacccaggaacttaaaataaaaataaaaattaaaaaaagtataagccaaagtatgaaactgcaattttcaagtgtctctgatgctttctcataaaattttattaaaaattatcaactaggctgggcgtggtggctcacacctgtaatcccagcaatttcggaggctgaggcaggcgggtcacctgaggtcgggagctctggaccagcctgaccaacatggagaaaccccgtctctactaaaaatacaaaattagccaggcgtggtggcgcatgcctgtaatcccagctactcagaaggctgaggc

SEQ ID NO: 190501 - DNA, 156 bp, Homo sapiens
gtatcagtctacaatattcactttttaagtcacttctgtagaacagactattaattttttctttctagttagtgattttaagtgaggaaattgaagagaggtgtcttgaagagatgcggaggaaccagtcaagtaggagacaggtcaaggcttgtg

SEQ ID NO: 190502 - DNA, 236 bp, Homo sapiens
tctcctgagtgcccgtcccgagtaaataagatgctagctcagcttctggccagcaggctgcccacctactcatctccatccacatccccagggagggacatgaattgatgtcttcattcagcagaatgttgattatgcacccattctgtggcaggcacgttttaaatacaaaggcaaagaggtttgaccaagtgtctgccctcttggagctgggattggaatggggcacgaacaca

SEQ ID NO: 190503 - DNA, 812 bp, Homo sapiens
gcagtgagcagagattgcatcattgcacaccagcctgggcagagcgagactccatcttaaaaaaaaaaaataaagctgataaaagtttggttaaggtaataacaatgaagatggagagaaggaaaatggtttaagagatatttaagcagaactataggacttagaaattaggtggaaactagaatggcagagtgatttgctccagacggggccttttagatgttgactgatctgtgactattaagggtagaagataacacctactgagattttgggtgaaaaacatctttaaatcattggaaaaacgtcaaaggttagatgtgcaggttcacttctgtctcttctgataaaaaagcctttctcttagttaatagcaaattgagctgggaggagattcaaagatgctcattcaacaaatatttgttgagcacacattatatgccaagcactgtgataaggatacaatggtgagcaatacagacatggactctgactttatgaggtatataatgaaacaccattaaaagcactacacaccggctgcttgctttgctccatgcctccctgatgaagcccccatcatagctgccgccaagcctgccaccaccacctctgagcagaagatggctgtgccacccaagtatgccaatcttggcaaatctgccaggaatgtcttcaacaagggctacggatatggcctaataaaccttttgaaaacaaaatctgagaatgcattggaatttgaaagcttaggctcagccaacactgaaatcaccaaagtgacaggcagtcatggagaccaagtacagatg

SEQ ID NO: 190504 - DNA, 490 bp, Homo sapiens
cattgttaatagttgtggcaattgcacattttgtagtacttttatattgtgcaatgtttttggatgagcacatagaaatgtgccttgaatataaacaatcactcatagtatgttagaaggagccttaagaatggcaaatacagatgttaataaaacttagtatattaaactaattttttttttttttttaaaaacagggaattgcttttaaataacaatctgttacgggttttgccttatgaacttggtcggctcttccagctacaaactctaggtttgaaaggtaagtgatttttaaacagttttgaggtattctgagccttttaaagagcattttggcctttaaaaaggtcaagttttagtatgagttttagaatgtgactacgtgtactttctcttgaaagaaaagtagtttttgtttgtttgtttgtttgtttgtttgagacggagtcttggtctgtcgcccaggctggagtgcagtggcgcaatc

SEQ ID NO: 190505 - DNA, 404 bp, Homo sapiens
cattgttaatagttgtggcaattgcacattttgtagtacttttatattgtgcaatgtttttggatgagcacatagaaatgtgccttgaatataaacaatcactcatagtatgttagaaggagccttaagaatggcaaatacagatgttaataaaacttagtatattaaactaattttttttttttttttaaaaacagggaattgcttttaaataacaatctgttacgggttttgccttatgaacttggtcggctcttccagctacaaactctaggtttgaaaggcaatcctttatcacaggatattctcaacttataccaggacccagatggaacccgaaagctactgaacttcatgcttgacaatctcgcagttcatccagagcagcttcctccgaggccatg

SEQ ID NO: 190506 - DNA, 401 bp, Homo sapiens
taaataaaagctgtatataaaactgtgaagaaacttaacatcaaattttggaaaggaagtaaaaaaagaattaaaacaagctgcgatgctcttaacaaagacacacaaaacctgttactaggagagtcgtttggtcaaatttcctgttttttcctaagtcctcatttgttttaaatatgtcgtcagcacagagtttattgctgttgattaacgtttctacatgtaaaatccagaaccattctctaggatttcttatttaaagatattccaaacaatgcagattcccttttttctccagattctggtcttcatcatagttaggagatgataaaccatggatttaaatagctgaaaattagtgttagacactagaaaattactcgagtgtgtgttaatgaagg

SEQ ID NO: 190507 - DNA, 383 bp, Homo sapiens
ttctaattgcagtcactgtgagtacactggcaattatgcaccctgccccaaattcctaattgtagtaggaagttaaactggagcattttttttttaaattgctcaaacaagtctttaggaatttaaatgtatttatagaaacgtatgtaagtatgtttacatacatttctataaaaatattcttgtaagtaaatgttatttatatatactgcacatctaatgatgcaattggcttcatgactttagatattagagattagggagtttcttggtcaggacagtcaggaagaagggagagatgcttaaagacattggcagagctgcatggtagaagtctgatagaaagggcttgagtgaaacctggaaagacagttcattaggga

SEQ ID NO: 190508 - DNA, 536 bp, Homo sapiens
ttttagacttaagcaggtgggtagaaaatagtaccgtttactagttagggacaactggggaggaataggctatgcatagcctggggggaaaaggatttatgtaacacaatgggtactttctatcatgaaacataatgctagaggcttacatgactggattaaaatccaaatagaaatgattcatagcaattcattttgttgacattaagtctatggttagaagtaaaagtttgtcagttcctcaaggatggagactaccaactagttgagatcttatttctgaatccatacttagtacctaatatctcacctggtgcggtgagaggctagctacacaaaacaacaccacctatccaccaatccagttttcactggtttggttacacgttgtagctgtccctctagggatggctgcattcctgcctggtccagttgttacttatagttgtgcacgtccacaatcctggggtgctgtgtgtgtgctgtcttccctgcttcatgtcccccaaacacatgcacactctgcagaagtttca

SEQ ID NO: 190509 - DNA, 287 bp, Homo sapiens
agtctagttaagttgtgctgccagccaggagaattttagagaaggaagaaaaatgttttactttctctgatagacagttcatatcctaattgcactgttattcatctaacagattcttactggtggtctagtatatgtgtgcagtaaggtgctctgaatgatacattaaggtgaatagacctgctatctttgggaaagttgctgtgtagtagaagaacataggcatatacacacctaatacttagttgagtgtggttagagttgagcgcagagacaggtcactttgg

SEQ ID NO: 190510 - DNA, 597 bp, Homo sapiens
gtgtggggttgggtggggaattaaaggctgatgtatctggaggaactttggttgggctggaggcaacttctgccctgttctattcaacagttccctcccctccactaccccatttaatctggccacagctcagctacctgtgtataaaatcttgatctctctcctatttcctttctaccttccgtgtttttacttactcgaaaactgttcccctctcctgtgtgtatttttttaattgaaatataccaggcatttaggaaaggaacacgaaacctaagtgtacaggtcaacaaatgatgacacagtgaacacccccatatgaccaccatccagatctagaacgagatcattattggcatcccagataccctccttctatccgctcctggtgactatgccacactccttctcaaaagtaacgtttatctaacactacaggttagttttgcttacttctgaactttatatacatggaaccattcagtaggtattattttgtgtctggcttctctcactcaatactatgtttatgaaactcatccaaaacattgtggtagcagtagcttatttgttttcattgccgtacggtatgccatt

SEQ ID NO: 190511 - DNA, 234 bp, Homo sapiens
attctagtcaggggtcactagtgaaattatattggggttaaacgatgtatttgataattttgcattctcttctaagtgattttgtgtacttttccttgagttcgatgaaatgcaagtaaggtagtgaggacactatttccaatttacaggtggagaaaatgagacaacaagaggagaagtggtggcttgcctaaagtcagtgactgatcaggatgagaactgggtacctgttgc

SEQ ID NO: 190512 - DNA, 395 bp, Homo sapiens
tcccagtccactatctacccaatcccagtagaatattctcaagcaaatctcagatagcatattatttcaacctgtaaatatttccatatttacctctaaaaggatgtaaagcaactacagactatcatatctaaaataaacaataattccttaatatgaaactcctgggcagtgttaacatttctcaaattgttttttctttgtttgaattaggatccaaataaggtctacacactgtgactggatgactatgtctcttcaatctctgcatatgggttcctccccctttacaatttttttttgttgaagaaatcaggttacctggttgtttcctatagtttggattttgccaaatgtattaccatgatgtagtttaataatgtgcttctgactct

SEQ ID NO: 190513 - DNA, 754 bp, Homo sapiens
caatgtcttactctgttgcccaggctggagtgcagtggcatgatcacagctcactgcagcctcaaacttctgggctcaatgcatccttccacctcattctcctgagtagctaggactagaggtgtgcgtcaccaaggccagctaatttaattattattattattatttttgtagatatgaggtcttactatgttgcttaggctggtctcaaactcctggactcaagtgatcccctgccttggcctcccaaagtgctgggattacaggtgtgagccaccatgcccagcaaattccaagtttatatccaagctctctatgactgctctgatgccatatcccaccactcctctcctcactgcctcactcctctggccacactggcctcacctccttgctgtatcctgaaaacctcaagcacattcacaccttggagcctctgaattagcttctgccttttccttgaacacactttttccagatattcacatggctcactcccttcctgcaggtctctgattaacattcccttagtagagaggcctctctgactgtaccatataaaacaacaattaacttggatactctttctccttcagccaagttatctccatagcatatactaccacttatcatatgtaacatttattttattgtctgtctcctcccattagaatataaattccatgagggttggtttttgtctgacttgatcctttatctctagtacccagaacaatggctggcaaatggtgct

SEQ ID NO: 190514 - DNA, 507 bp, Homo sapiens
tttcagaaatgaagacaacaatgtctgagatgaaaaatacactggatgggattaacagcaattagaaactgcagaagaaaagattagtgaacttgaaggcacagtaatggaaattaatccaaaatgaagtacagaaaagaataatttttttaaacatgaaaagatcataatggagctatcattgaacattagagagaaacctccagtggcctactgtatgggtaatggagtccctgaaagaggagaagaaagggagggacagaataatacatgaagaaataatggccaagttttttctaaatttgataactataatctgcagattcaaaactgcagattataagcacaaaaaacatgaagaaaactacaccaagacacataatcagtagctcaaaactgagtgtaaaagaaaatccccaaggctgccagagggggcaaaaaagcatgttaggtacagaggagaaaagatgagggtgatgtcagatttgaaaatacaagtgaaaagtc

SEQ ID NO: 190515 - DNA, 346 bp, Homo sapiens
tcttctcccctgacatcaccctcatcttttctcctctgtacctaacatgcttttttgccccctctggcagccttggggattttcttttaccactcgttttgagctactgattatgtgtcttggccaagtttttttctaaatttgataactataatctgcagattcaaaactgcagattataagcacaaaaaacatgaagaaaactacaccaagacacataatcagtagctcaaaactgagtgtaaaagaaaatccccaaggctgccagagggggcaaaaaagcatgttaggtacagaggagaaaagatgagggtgatgtcagatttgaaaatacaagtgaaaagtc

SEQ ID NO: 190516 - DNA, 668 bp, Homo sapiens
cccccgggctgcaggattcggcacgagggcgcctgtaatcccagctactcgggatgctgaggcaggagaattgcttgaacccaggaggcagaggttgcagtgagctgagatagcaacaatgcactccagcctaggcaacagtgagactctatctcaaaaaacaacaacaaaaaagaaatgtcaggtttctgtataaaattatgagacaagcaaagaaataaagtattgttcttacacaggaaaatagcaatctatagaaactatacttgaagatattttaaatgtgttcaaagcattaaaggaaatcatgtttttaacaatgttaaaaagtgcaatagctgaaattaaaaattcactagagggactcacaagcaaatgtgattaagtaaaaaccaagactcagcaaaagtcttttttgatccattggatctctaggaaacaccagaattatcagtgaagaatatattaaatggctcaaggcctactgtcaggcatatttatatggcttgacagtaaaactcctagacctggttcctgtttctgcaacgaggtgttcctttagagtcaacaataactcacaaacaaaacctacaagttcatgcaggaggcatcttgaagttcttaaaaaagtcagttgaagaaaaattgaagaaaagtcaattgtgatt

SEQ ID NO: 190517 - DNA, 699 bp, Homo sapiens
gccgcggcttccctagattaggcttgggaggcaagaggaggcctcctgacctttcacactgcctttttaatattaagatgaagtcacactccacaactttcttccagccaggcccagacatgtccgtccttgtaagttaaaagcttccatgggagccttccttcctaatcaagatgcaaataatacggcactccgaacagacactaaaaacagctctcatctcaaagaacccagtgcttgtatcacagtatgagaaattagatgctggggaacaacgtttaatgaatgaagccttccagccagccagtgatctctttggacccattaccttgcattctccatcagattggatcacctcccaccctgaggctccccaagactttgaacagttcttcagtgatccttacagaaagacaccctctccaaacaaacgcagcatttatatacagtcccattggatctctaggaaacaccagaattatcagtgaagaatatattaaatggctcaaggcctactgtcaggcatatttatatggcttgacagtaaaactcctagacctggttcctgtttctgcaacgaggtgttcctttagagtcaacaataactcacaaacaaaacctacaagttcatgcaggaggcatcttgaagttcttaaaaaagtcagttgaagaaaaattgaagaaaagtcaattgtgatt

SEQ ID NO: 190518 - DNA, 415 bp, Homo sapiens
tctcccttttcccctcaaaaaagacttaggagacatctctttttttgcaccccttctgtttctttgaataatcatttcattctgattttgtcttatatgtttgcagaattccttacttctcctagaaataacccttttatgagctgaataaaatcatgcagtgtactgtggctttacattgacacttaaatattttcccttttctctcttgccaaatctggcttctgtgcactgccccctagcactgccaaggtgtgctggtttgagaagtactgtggtttgggaaatgcagaggtctggtgggttgctggaagacacagtgtgaatgtattctgtatgctgagacctggctttcctggacccagagccaggtaattgcacttgtgagacaagcctttgaggggaaaagaccaag

SEQ ID NO: 190519 - DNA, 519 bp, Homo sapiens
tccaaatggtataatcaaaatcatgcaataaacactgttaaaagtggaagatttgcaaataaccaagattattcatgctgtctcatcttcatttaaacgtcctcattcttcccaatatcaaaaattttaaagtattttctagataaaattttcatttcaaattactatttatctaaagtaatcccttctccaattactattcatatcacagtttatgttcttcatagcatttactacaattgaaaattatcttgtcatgactttaggctcagtgttctacatcatattgtcactctttcactgaaagaaaatgttatttcggttataggtctcactgcttacaaagttctgcagtgacatacaaagttaaaaactggtggaaataaatgggccccaatcaaagctttaagatggtgagatcttgtctccattagaaagaaagggggataaatgatgatggtgttggttggtggagctaggtcctgcactcagagagacctgggatctagtatacagcca

SEQ ID NO: 190520 - DNA, 152 bp, Homo sapiens
ccaggtacatgcaggatcaaaatcaaagagaagtcgactgtgttataaactgaagagaggaagaagctgaagacatatgggaaaataaagagaaacttaacaaagtaagatcctagagatgagatagcacaagatcaaaagcacaggggaag

SEQ ID NO: 190521 - DNA, 375 bp, Homo sapiens
agtagcaacaaggttaggagaaacaacaaattattttaattacaattctctagccaaggatgataatattgtaccatagcaaaacaaacaagctgaggagtagaggggtgtgtggggcatgtttgcagtatgccaaaggaatgattacgatttgactaccagattttgtttgtactcactgagggctaatgagcaatggagaaaattttatgcaggagctgctcttgtggatggaacagagagagactaggtgactagaagaataaagaagaggaaaagcaaacaaatatctacaaaattgaaaatcatacacatctaagaatgcggcttcctataaatagggagcctgtcaccatgggcatacctaaatgacag

SEQ ID NO: 190522 - DNA, 499 bp, Homo sapiens
tacaggcatgagccaccacacccagccaagaagtttaacaaagaaacagaaataattaactaaacaaactcttggacacaatgaatgaaataaaaaatgcaatagagaggcaacaacagacttgatcaaacaaaagacagaatttgtggactcaaagacaggtcacttgaaattatgcagtcaaaggagaaaagaagaaaaaagaattgaacaaagaaagcttatgggatttacaagtcaccaccaaacaaaagaatatatgcattataggagtctccaaatgagaataaagagaggaaggaaaataagtttatttaaagaaatcatagctaaaatttttccaagtgcagtgaaatatggacatccagatacatgaggcccaaaggttcccaaacaggttcaagccaaaaaaaacttcaccaagacatattataatcaaatgtcaaaaagcaaagatgatggattttgaaagtagtatgaaaagagacctatcacatgc

SEQ ID NO: 190523 - DNA, 490 bp, Homo sapiens
ttgaccaggagcacgtgatacacgggcggtcgatgctaatcgcaggagatccgcaatcaactgtctgcccaggcatgaacttgccactgctgtggaagagtctgactgcatccaagaatgccaaaggttgtggctgaactcacttctcaacagacttggatcatgttcatatactattctttaaaagatcaccatttgtagtagaatgtcaaaaacccaaagatgttgctcccgatgttgagctgtaactattttctgtgttggtggaaaaatatgagagaattagttgccattcatgaatctcagtgatacacagacaaaagcatgcttcaattttgtttctttgtttttgagtggttctgatttattttcagcttttgggtgatgtctggggctgtttattgaggacgggataaatgggggggggaccaaaatatatttggcatttattggtggtgttttatatttgtgacttgatttacttcttatc

SEQ ID NO: 190524 - DNA, 506 bp, Homo sapiens
agtttcagttagactgaaggaataagttttagtgatctattgtactgcatggtgacaccagttaatgatgcatatttcaaaattactaaaataatagatttttaacattcttatgaagagggtaacttggtgaagtgatggatatgttaattatcttgatacatagatgcatcaaaatgtaaacatagatcaaaagatcacattgtaccccataaatatacacaattattatttgttaatccaaaaggaaggaagggggcaagagaggagagaggaaagaaagaaaaagagaaagaaaataaaaaagaaagaaagaaagaaagaaagaaagaaagaaagaaagaaagaaagaaagaaagaaagaaagaaaaagaaaaaaagagagaagagagagaaaggaagggagggagggaaggtaggtcagagaagcaggagagccaagttttgtttttgttttttaaggatcatgaaaaccaagggaagatgtttaaatttaggatatgctg

SEQ ID NO: 190525 - DNA, 570 bp, Homo sapiens
ggagcttgcagtgagccaagatcacgccactgcactcaagtctgggtagacagtgcgagactctgtctcaaaaagaaaaaaaaatttctgtaatttctaaaagtgtgctgcttttgtctttcataggtgttgtatattcttctaatttaatctttaggtctgtctcttgaaactggctataaactttatctctgctctggtgtgtctccagggatttggttggggatggttacattgcgcctttcatgggatacttttgtttaccaaaaataaggccattgaggcagatacaatttgataaagttttattgtaagccaaatttgaggatcaacttgagaagacacaccaacaaatttggatgtgttccaaaattgattacaagttggatgcctttatgagaaagtttaggagaagctggaggactattcataccggaattgtcattttccttgaagggtacaatatagacgttacaatcattgcctatagatgacagctgacaggctaaaatgttctaagtggaagacaatcagcaaacatgattcagaaataaatcagtgtcttttttg

SEQ ID NO: 190526 - DNA, 732 bp, Homo sapiens
gaaggcagcagcacaggaggtaggagaggaaggaatcctgagcaaatagccatgctgtttacttgccaatgacatccccactttgcaaagacatgatatggttattgatctctcactgaacctgtaagaatcaaacacaacaactcagttttattcatttcataaatggtttccaagtgcagtcagacatttaatttgtggaacactgagcgaagaggtgatttctgctggtttaggtaagagagaaacggtctagtgtaatactcaagaatgagctagatctcctggatttaaggcttattctacagcttattagctctgctatgttgggccagtgacttgacatctccatgcttcagtctctccatctgtaaaatggaaatacaaagcgggtgggaggtgttgtgaggattgagtagattaatgcatgtaaagtgcttgcaacgttgcctgacatgtcactgtctgttagctgttagcagtagttgggctttttatagagggctggtgacttgtgcttgtctgaatgcaggaaaccaggcctgtgtagccttcggtctgttctaacactgaagttttgtagttgagtgctgactgtggtgcataaactgagcatttggatacctacatatcacaccacaaggttttggaggggctcactttgctttaatccctgtttcatccagtttctctttttctccacatgccttcacagaggcaaggggagcatgc

SEQ ID NO: 190527 - DNA, 259 bp, Homo sapiens
ctggccaacatggtgaaaccccgtctctactaaaaatacaaaaattagccaggcatggtgatgcacatcggtaatcccagctacttggaaggctgcggcataagaatcacttgaacccaggaggtggaggttgcagtgagccgagatcccgccagtgcactccagcctgggtgacagagagagactccatctcaaaacaaaacaaaacctattacataacacacttcaatgatctgtgactagtatagcttaaataaag

SEQ ID NO: 190528 - DNA, 426 bp, Homo sapiens
tattactccctgacagcatgtgctattaccatgcccttctttagtttcttcatagcactagatattacctgaattatcttattgatgtattattcataatctgcctcctttgtgacatatttatgtccatgagaagagggatcttacctgtcttaatcaccattttcttcttaactcctaaaacaatgttggcactgaataggtatttattgaattacttgtaaattcttcttgtgttgactgtcttgtaggcctacctcattactcgttcttcgcacccgacttttataaaactttttactgcaatgacttgaaactccttcaattgaattggacataaatcctgctctacataaatataaaattagcatttttttctctctttttttttttaattatactttaagttttagggtacatgtgcac

SEQ ID NO: 190529 - DNA, 473 bp, Homo sapiens
tagtctccaagcatgaaaagacaagacttgagactgatcaacattaggacgactcttcccatcaaagttgcagaggtgagtactgaatcctggcctcaatcccaaggctcaagtgtctggggtaaagatgagaccatgaccaatgcaggaagggtcagtcaatcctgggatttttcttgggaaccactgggaaagtactgggttcttttcactgggcattattaggccagtagggtgcgagcctggagctacttgggaagtgagccaacacagaagagctggggaaaggctgagtcccaatcccttcaagggaggtgctagatacagccatacccaaaggcacacatgccacagactttcatttgtgtgagcccacaaatatccctttttggtataaggcagctgaattagattattattaataccactgatagatacagacctttagtattaattattacacaacaaatatt

SEQ ID NO: 190530 - DNA, 735 bp, Homo sapiens
aagcccacagaagtgtgggtctcgcacctcctgagactgcttccccgagtttctcactctcactagtccacaccgagcatccagcaccagcttatggctctggcagtttctgctccaggtaagcggatctcctctgtgtctttccaggtttccagcacagtttgccctgttagctcagttctctgatcgtcccaaaagagccattgattttgaattttcccagctttttctcattacatgttgcagctgaaagcgaagtcaccaccttgtttttaacttgtattttgtgacttgttaccacttcagtgctttagacacataggctcagtgctgcaatattgtgtctaggtttgattatgctaaatttaacctttcttatgtatcaccggagtagtaaggatttcaaactaccctgcctggtagctttcgctttccttagaaaagcttatcacttcttgactgggccccgtggctcccgcccataatcccagcactttgggaggccaaggcaaggctggcggatcacctgaggtcgggagtttgagaccagcctcaccaacatggagaaactccgtctacaaaaatacaagccgtggggtggcgcatgcctgtaatcccagctccttgggaggctgaggcaggagaatcgcttgaacccgggaggcggaggttgcggtgagctgagattgcgctgttgcactccagtctgggcaacaagagcaaaactctgtctca

SEQ ID NO: 190531 - DNA, 300 bp, Homo sapiens
aaaggctagactaatcaaaacagtgtggtattggtgaaaaaatagacaagcagataaatggaaaagaatagagagctcagaaatagacccatccaaatatagtcaactgatctttgataatggagcaaagtcaataaaatgaagcaaaggtagtcttttcaacaaacaatgttgaaacaactggacaggcacaagaaaagaaaatgaatgtaggcacagaccttatatctttcacaaaaattaactcaaagtggattatagacccaaatataaaatgcaaaactataaaattcctagaac

SEQ ID NO: 190532 - DNA, 347 bp, Homo sapiens
tgggatcactgagcagcagagtggctcaggaaggcattcaccagactatttctgtacatgccagattcccttcaagacaggtcttcatagctacaagggtcatcgctgctgctaagaatgtcttcagtggctttctcctgaggcctcatcctatatcctaggaaaaaaatctgcatatcaggtgttatcacttatagaagcactgactatatcattcatgtgactggatcatgtactaagatgattgttatttagggtgcagcaaaaattaaatgcatcttctgcatttaagattaaaagaaagcttaaatacaaaacagcactgaaagaaatgaaaaaagatccaa

SEQ ID NO: 190533 - DNA, 291 bp, Homo sapiens
tgcttttgatttgggtgctaattttaggtcttatttcttgtaggcaagttttattcccttgccatatgtatttcccagccagttaaatggccaaaataacttcagaaagctttaacttctttaagaaaatatccctgataaaggatcgagacgtttaggtgttacccaaacaagtgtcagtatagaaaaggaagcctttgcattctggtatttcccttattcctggcccaagaaatgattgcttacaaaatatatctgcatagtccgttagttttggaggctgagtgaaaa

SEQ ID NO: 190534 - DNA, 389 bp, Homo sapiens
tattggttatcaatgtagtatcattacaagaagcctaaaatggccactttatgttaactggaatgctcaaatgactagtgttttcattagcaataaatggaaagctgaaaagtaacaattttattctttgtaatagatctgtgactttcaagtctttctttttgacatttttttgtagcctggtggggaagcaggtccggctgtgagaggtgtggacagtgacctctcattccagcttttatcatcatcctgcattgtttaacaacagcaccaacaccatgctgcttgctgaaaatgcagatttcattcttggattaatattctggtaccagatgtatgaggctggctctaaagaagctttttctcttaagtactgtcaaaaatagaga

SEQ ID NO: 190535 - DNA, 247 bp, Homo sapiens
aatatttttttgattgtgaagctcatctcatttgaaaatttttggttaacctagaaaagtatagtaaagaatagaatcatcacttgtaatcatacttctcagagactctctgtttacattttgaaatacttcaaatgtaatgtaaggaaatactttccttctgtctcttctccccctgtatttatcacagagacctgattttttttgttagttttttaaaactaaaaaccatactcttgtagcctcc

SEQ ID NO: 190536 - DNA, 301 bp, Homo sapiens
catctatggaaaggagctggatatgaggacatattagtgcagaggaagaacgggtgcagcaaagagagactgggcacgggggcccaagacggactgagaaaaatcatgtcttcagatatttaggcaacactgagtttcagagggcttaccaaaaaaaactttcactttctagaaacaaatggtagctttgcatagctgagtgatgccaagttttaaacagcctggttcagattcaggagagacaggggcagagaaaaaacttctgagacactacttctatttttacagtcactttgcttag

SEQ ID NO: 190537 - DNA, 269 bp, Homo sapiens
tgcgttcagaggatcccagtcggcgaagatcacctcaagaactcatttttctaattcctcctgaaacaggaatcaggcatatgtccctgtgttaagctaaatctttcccattcctaaaatgttaataattaactttccaaacttcattgtatgtgaaaaaatgattcattcttcagggaagtgaatcaccattacagagaccattaagacaacagaaggcttgctgtctccaaagtgcacaccaataattaagtaagagcccccaaatc

SEQ ID NO: 190538 - DNA, 440 bp, Homo sapiens
gttggtgttacttattgagttatttcaggtacattaagggatagttctgatggatggtggtgttggtggtggtagtagaggtcagaatcaagggacatgacaagggcaggtacatcacaaaggcagtttccaagaagggacaaaggtcaccaggtaccagtctatggaagtgtcacaaagatgaaggtctgaaattctagccttcacatgccatgtatcctcaatgggaaatgggaggtttgccattctgactatatagttaaatagaagagccaaacggtttcgtacatgagcatggagtacagataatttctcttaattctctccacttacctttcaggatatccattaattctgcatgaatctgtgctcagtgatagaaaatctgtgctcagtagaaaccaaatgacaaaattaactagcagcaatatggcacacag

SEQ ID NO: 190539 - DNA, 577 bp, Homo sapiens
cactctatcaggctaatgcctaggtcaggagaagacagacgcagtcactactatggatcctgagggcgagaaactctggatgccacaaagtggcatgttcaaccttcctacaagcacacagaggtgaagcctggagaacaggcagggacaggcccagctggccatgtgctcagccacgcctacctcgcaaggtcattctgaggatgaaggcatcatggatccaaatgccaccttgacgctgaatgtactacacaataaaagaaccactgtaaatcacactattgactcttgcttggttgatgttctttcctttacagtaaagtgaactcgtggacaaacatcgtgtccacagaccaccataaatgtagtttgttgttttaaataaaactgaaatcagacttccaaaaagaaacatctaaaaacttctcctctcccatcccaccagagccatggcccacaacacagcccgacgccccgtcacatgctctcacaggacaactgcccacaccagttaacctggtgtcacggtggaggcgaggttgcggtgagtggagatcacgccattgcactccagcct

SEQ ID NO: 190540 - DNA, 118 bp, Homo sapiens
actcacctaggcactgttaggcacagtcatttttaatttaggtgctacttactgaacaccaaacatgccaaggatacaatatgaagaaaaactatttttaaggatcttacatgtgtaa

SEQ ID NO: 190541 - DNA, 280 bp, Homo sapiens
gattgtttaagcctaagagttcaagactagctgtctctctctcttacacacacacacacacacacacacacacacacacacacacacgcacgcacacacggctgggcatggtagctcatgcctgtaatcccagcactttgagaggccgaggcaggcagattgcttaagcctaagagttcaagactagcctgggtaacatggcaaaatggtgtctcaaccaaaaacaataaaaaataagctaggcatggcgacatacacctgtagtgccagttacttggca

SEQ ID NO: 190542 - DNA, 384 bp, Homo sapiens
gcagaaagagaagtaagtatcaaaaaatataaatacttttcaaccttcctgaaagaaaatggccttggctaaatgctgaatctagttgaatatatatatatacacacacacacacacacacacacacacacacacatatatatatatatgtgtgtgtgtatatatatatacacacatatatatgtgtgtatatatatatgtataaatagatgataaatgtacttactatatcagcttagaaacatgcctcatttccaccaaattgaaagctaagagacgttttactttgagtaaaggcattgtgtcactgatgaaattataagagtttaagttaaagatttttaatagattaacattaatgacattggcttatactgctgaaat

SEQ ID NO: 190543 - DNA, 359 bp, Homo sapiens
ctgtttgtttttgttgctgttgttattcggtgaaaataacttctaaatttgaatttgggactactgacgttttcagtttctgcaaagttactgagcccagattgtccgctgttcttaaaccttataacaatgctgaatggtagttacggataattattttattagtgaggaaattgagactcagggagttaagtcctttggctaaggtcacctaactaattattgctagagcctgaatttgaacatagaatcttatagctcaaaaaacctctattaatggacctgcatcaaagtttgttactatcaagagatcaaaagttgtttgatgggcatggtggttcatgcttgtaatccgagga

SEQ ID NO: 190544 - DNA, 295 bp, Homo sapiens
atgagaacacagactgagaaacaggaagaggggtggtggttacggaacacgcacactgggcagttgttgggagaccttttaactcagcagtgaacccgtgctctggtaaggttatcacaggcagctgctaccttttgtggtcccacctgacagtttaaaaggtttattaaagtgccccgttttttgacttctatgatgtatctttaaaaaaaaaagtaccctgttcacagccacaaggtttatgaaagtgccttgtgtaagcagacagtggtgggccagccggtgcattcagcgc

SEQ ID NO: 190545 - DNA, 472 bp, Homo sapiens
ttctcaaacccctgggctcaagcgatctacccgccctggcttcccaacgtgctgagattacaggcatgaggtcactgtgcccagcccattgccctattctttaaacttttttgtagctttgaaatttttcaaaataaaaagtggggggaaatatacatatctgtatttgacaatatatgcacaaagaatctctggaaggatatcaagaaaaaaatatggtaattgtggctctctggggaacaaaggaactgaatggatatagagtaggtgggaagcagaatatttactatataactttataccatttccatataattgatgacatcatcagttttaagacagaccattattttattgaccaaaagtaagaaaaaacattgccaatttgcaggctgggcaccatggctcacgcctgtaatcccagcactttgagaggccgagatggacggatcacttgaggtcaggagttcga

SEQ ID NO: 190546 - DNA, 211 bp, Homo sapiens
acacagaccgtcacaacaagaagtaaggctcctgctcacaccttcttaggctccactggcagacagcttccctcggcctcccaaagtgctgggattacaggtgtcagccaccacgcccggccccatcttaaccatttttaaagtgtgcagttcagtggtattaaatacatccttaacgctgtgcgaccatcaccaccatccatccccataa

SEQ ID NO: 190547 - DNA, 404 bp, Homo sapiens
gcggctgatgtcctgtgctaatgtaagattgtgagggtggtgaggggtcaccttggactgggccaacatcctacaggtccttggactgtcaggttgagtgacaattgatctttatattttttaatgacggaatattgtaggttatccgaagaggaagcctttggtgctgtactaatctctgtagcactccatgatgttttattgccttagaaagagactgcatctttgcagttaatcaagcacttagtggaactggctttctttgactcatccttctttagtgacttcagggcttgggaatgggatctggaagagaatctctcttcatagggacaggaggagccatatgttggcttcctcatttatggtttttttttttgtttgtttgtttttttttttttttt

SEQ ID NO: 190548 - DNA, 466 bp, Homo sapiens
acatcttctgtatcaactctaatccagacagccatactaattgtccagtacctgcagcgagggctgagtttagacagagccttttctgaagcatgctgggaagtatatgtctgttcccagcattcaccagcaaaccggaagcttgtacaggctttactggagaaacatgtttcttctttgcgagcacatgaaacctggggagactccattcttggcatgggactgtggccagattctgtgccctcagctctctttgctactgaagattcacacctgtctacagtccgaagagatggacagatcttagtatattgtctcaacaggatgagcatgaaaaccagcagctggacaaggagtcagccttttaccttgcaagacttagagaaaattatgcagtcccccagccctgagaacctgaaattcaatgcagtcgaagtgaatacttactggatcgatgaaccagatg

SEQ ID NO: 190549 - DNA, 508 bp, Homo sapiens
ggaaggagtggagccataagatgcacactgaccccgcatcaggaatgctgcagataaacccagataagaatgagagacttctgaggcctgaatagtttgttcaaggaagaaagaaaggaccagtggcaggcaagaaaagctcacagaagcccagcccgtgttgcctggcaggagaggtgataaaaggaagggtccccaaattacacctttctgctgaggaataagaagaagaaacctgttgggaaatccagggacacgataccttataaggacttctggtcaccggaacttggtacttttctgttgtttaagccactcagtttgtggaacttcggtaggcggccccagcagacaatgcaaaggtcctcctgcatctagcctgctttcatccctctcctcagctctcagtattgcccctcattcactctcctagcacagccgacctcctcctagtgtatggagacactaggcacacctccactttgggcacttttcagggctgttccct

SEQ ID NO: 190550 - DNA, 547 bp, Homo sapiens
acaaccttctatataaagctcttagcacaaggtctgatatatagtaaatgcaaagtaattattagccacttctgctgctattgtttttaattaagaaaacactgaacttagaatcaggagatctggggctaggcatggtggctcatgcctgtaatcccagcactttgggaggcttaagtgggtgatcacttgagtccaggagttcaaaaccaccatggtcaacatgacgaaaccccgcatatacaaaaattagctgctcgtggtgacctgcacctgcagtcccagctacttgggaggctgaggtgggaagtggaggtttcagtgagccaagatcatgccactgcacaccagtctgggcaagtgagaccttgtgtcaaaaaaattaaaaaagaatcaagagatcttggtttgggcacccattttgcctcttagtgtctctaaccaactggaaactgcttaattaacctctgtgaatatcaataagatcaggataacatgaagatgaaatgcaattatgtatcaagacacataaagcaatgcacaaatg

SEQ ID NO: 190551 - DNA, 431 bp, Homo sapiens
tgggcagctttcaggctcttgggagtgtacacattagtccttagcagcagcagtaacagcaatgatgacagtgggcagggagcctgtcctcagagtgcatgctagtgcatagtggccacgcaggcaaacagctgtcaggctttggggaacatgcacattggctccccttgtttcagcagcacagcagcagcttccctggtgtgccacaccacccattccctgtggtgtgggactcttgagtgggctagagtgctagggaccctgctgcactgctgggtccagccagcatcatgctactgcagtcctccagtgtagggggttgttagtggtgcttcagggatgtcgagatgcaggggctatggcatcccagggcaggatgccctggttgaggttaggcactcagaatggtgctgttctgcagttgcttaggt

SEQ ID NO: 190552 - DNA, 360 bp, Homo sapiens
gactatcggtgtgtagccgttatctcatgtgtctaattcgcattccttaagaaataagatgtggagcatcttcccacattcttattgccattgtgtatcgtctttggatgatggagtttgcatttgctggatgtgtgaatctatgtgtattccaactggtgggcagggaatatagggctacgaatcggcacactcatcttgcaggcattatttttccttcccagccacaacctgctagacacctttattattattattttttccggtcacctctaagatggcttataaggtgactgcgttaactttgaacccaggaaattctctttcacacttgactgccctgccgttaggccgatctga

SEQ ID NO: 190553 - DNA, 379 bp, Homo sapiens
caattcggcaagcggcacaagccggttgggcttggagatcaggtcacccactttcgaggtgttccatgtatgaaattgacctgtaagcacttggagcaattatggccgggacaaacacgtctttggatgatggagtttgcatttgctggatgtgtgaatctatgtgtattccaactggtgggcagggaatatagggctacgaatcggcacactcatcttgcaggcattatttttccttcccagccacaacctgctagacacctttattattattattttttccggtcacctctaagatggcttataaggtgactgcgttaactttgaacccaggaaattctctttcacacttgactgccctgccgttaggccgatctga

SEQ ID NO: 190554 - DNA, 452 bp, Homo sapiens
ttaggggttgcaccctttcaaaatctgaaactttgacatatctagcagtttttacatggtttcagagggttcaagcctcttagagcctacagtagaccccaaattaggaaacgtagagtctcttctaaatcgggattctcatccaaatcaggggatcacagatacctggtctccttgagagcctttcggagggcctgtgatgttagaactatttccatcatactgctaagactttaattgactttttcactgtattgaaatttgtaccgatggtgcagaagcagtagtgggtacaacattgcgcaccttagcaagaagcacagtgatggcaccaagctgacaaccacacaccccagtagaaatagaaacagccagtttcacttagtggtctaaatgaagcaatagaatagattaattgtattatttcatgacccttgtgcacacatggtctt

SEQ ID NO: 190555 - DNA, 344 bp, Homo sapiens
gcaggcaatccatgttttcacatcagacccatgcaactgctaatttagtatatgccttttctggactgtaaatggaaacataccatatgtgggatattgcatcagacttctttcactaagcataatgttttgagatgcatccatattgtagcctatatcactactccattgtatacatatatcatttaaagaaatccaccagttaaaaaaaaaaagaaaaagaaataatctgggtatgttggtgcctgcctgcagtcccagttactgaggaggctgaggcaggaggattgtttgagcccaggagtttgacttcagagtatgcaacatagtgaggcctcatctct

SEQ ID NO: 190556 - DNA, 363 bp, Homo sapiens
aggcaagaaatctctaatataaggagggactgagcctcagcaaacctctagagaagagaaggcaagaaatctctaacatgtggcattgagcctcacatcaaacctccaggatgggaaacaccccacgtaagacaggaaatgaaagatataaagctagtgatgataacaacattccctctggtagtcccttaggtctcatgttaacatactggagggacagtgaaaggactaaacataataaaaaacaacaaatgacaaaatattgttgtttcatttggaccacagagctcatcctcacaccctcagttttctggccaaagtttcagtcaaatgaggattgaatttgtcaacttctaatagagt

SEQ ID NO: 190557 - DNA, 128 bp, Homo sapiens
aaaacaggctggatgaaatccgtctgccaccaccagccaagtgagctgaggcaggttaccaacatccctttgcctcagttttctcatctgtagatccaggcattgaagggtcttaggagaacctggag

SEQ ID NO: 190558 - DNA, 117 bp, Homo sapiens
tataatcggcattgtacatagaaaggatatggctaccttttgttaaatctgcactttctaaatatcaaaaaagggaaatgaagtataaatttttgtataatctgtttgaaacatttt

SEQ ID NO: 190559 - DNA, 431 bp, Homo sapiens
accttatgctctgacccacctcatcgaagtgtagaaagtatctcctttaatgagctacttatttatttagctcagttgctcttgctaagaattaagaattgcattcctcttatggagagaaagtaaagagaatcagaacctttagttatattattttgaatataatgtcatattcaaaatatatatgcatgcctttgaaatcaggtgcctagaagggacaggtatttgcttcagaagttatgaattccttaacagaaagggaaagtgggaaccaacatttcttaaatgcctcttatgtgccctcctggaagcagattatccattctgcttatggtttcttttaagttgcataactgttcattgaagtaaatttattggtacgaaaacaaattcataggttggtgagtttgacttttgttgggtggtcagag

SEQ ID NO: 190560 - DNA, 392 bp, Homo sapiens
tggacatcttaaataacagagatatattttctcacaatgctggaggctagcagtctgatatcaaggtattggaagggttggtttcttctgaggcctctgcctggcttgcagatggccatctgtgtcttcacatggcctttcatctatgtctctttatcctagtctgctcttcttataaggacaccagtcataatggattagggcccatcctaatgacctcattttaacctgattatctctctaaagaccccatctctaaaggcagtcacattcttaagccctgggagttttcaacatatgaatcttgaggagacacatagcccataacacttgccctcttcattttagcactgtgctagctgtcttcctgttccttgaacaagttaagcttg

SEQ ID NO: 190561 - DNA, 323 bp, Homo sapiens
gggcggccaggctggagccctgagaaagcagagcagcctaggggcaggagaagcagggggagcttgagggggtgggggctcctcaggaggcgggacggaggtgttggaggaacgcaccctccctccctccccagatcccacccagacctgggacccctcacgcaggcacagctgggaagagctgtccgtgtccctgcacacggccctgcctgtgcctagccctgaacttggccctcactctgccctgctgctcaggaaggcgtctcctggctcttgcagggtgggtggtccgagcctcagtctctcctagcacgtctgtgctg

SEQ ID NO: 190562 - DNA, 422 bp, Homo sapiens
taaagttgtggggtgaggctgccaggccaggttcaccacctcctggtcgaggagaggattgtccagatggtgcccaagcagttttctttctttttttttgtttgagacggagccttgctctgtcaccaggctggagtgcctcggcctcccaaagtgctgggattacaggcgtgagccaccgcgcctggcccccaagctgtttcttaatggggatttgaattcaggtggtgtgaggtgtgtctgggctctgtgcctttacaaactgagggccatagttccttggggaaaaaaaacctgtctttctcctctttggcctacaacacactctgatgtctacaagctggctgacaatagaaccggaggcagcctgtgcacagcagattctgtccccgtgggtctgtaggagggagtttattttcttg

SEQ ID NO: 190563 - DNA, 306 bp, Homo sapiens
ctgggattacaggtgtgagccactgcacctggcctatataggcttttttcttaaacctatttagtaatgttttcccaagtttatttttgtatttttagtagagatggggtttcaccgtgttagccaggatggtctcaatctcctgaccttgtgatccgcccgcctcagtctcccgaagtgctgggattacaggcatgagtcaccgtgccaggccacataatttttaaacaaaaagtaaaatattaatggacatgaaactcactgacatttacagagctttttttctttatattgatgtatctaaga

SEQ ID NO: 190564 - DNA, 276 bp, Homo sapiens
taaccagtgtctttctggaagccaccctgcaatttaggcctctctcacttcttcatggtcccctgtggaaacagtgggtctcccagccccaaggcccctgtgcttctctgatgccatagctctctctgctctccctgcctccaaatgaaatcagccccactccctcactagaatgtctccaggtcttgggaaaagtcactcaaggtcacatccagatgtctagaactgcagaggtgaaagggcttttagaaagcaccttgttcagctgggcgtggt

SEQ ID NO: 190565 - DNA, 406 bp, Homo sapiens
agaaacaagacccaactgcagtgtcttcaagagacccatctaacatacaatgacatccatcatccataggctcaaaatgaagggatggagaaaaatctagctagaaaacagaaaaaaagtgagggttgctattctaattttagataaaacataatttaagaaaacagtgatcagaaaagacaaagaaggaaattacataacagtaaagggttcaacaagaagagctaactatcctaactacatgggctcaacaagggagtacccagattcataatcaagttcttagagacctatgaagagacttagataaccacacaataatagtgggagattttaacacccacctcacagacagattattgaggtagaaaactatcaaagatttttgacacctgatcttgacact

SEQ ID NO: 190566 - DNA, 371 bp, Homo sapiens
acctcctaccccacgtttcttctcccctcaaccccatgtgagagctggtttctgagtgtcctggcttatgtcgctgtcttaattagatttcattaggaaaatttgccctgggtaattgaggttgttctagaaggtgaaatataccattccccttaaacaatgatgcccagaagcccccagggtggctggaatccccactatgaattgcagaaattttaagcagagcttccactaaagccaaatttaccttccgagattccctctttcccctccaacccccacttttgcctctctcttagttgctttcccatggtgctgttcatcttttctggaatggcctctcctcccctgaaattctttgctgcatcatc

SEQ ID NO: 190567 - DNA, 419 bp, Homo sapiens
ttgacttactgagggttcacccaaaggaatcataaaaagagctcaggcagttctgtggagcacaaaaacactctacttcccatctgtgagcttgattataggtaagagcagaatggctggacagctgttggggttgtgccagctgtggcagcgtgccacgcagacttcccttccagaaagagcctgctgcaaggaatgcagaacgctgacagcttctagtctggatccaccccagcatccagggtgcagcactttctcccaggcagccctctaccaatgactgagcatggcaggggtactagggcatgaccactgccatgcaacgtgggacttttttgagggcaatccttgtgccagagctccctattaggctgaccaggacatttccagagctgcaccacagtctgagactctattca

SEQ ID NO: 190568 - DNA, 351 bp, Homo sapiens
tagagtatccctggtcatccgctacagaaacaacgaagtgctacatgggtgtgttcctctttaatcacaatgttagcgtaaagctttctaacaattattcaaaatccagaggcaataaaaaatcaagaagctgaccgcataaaaggaagaacatttccacctgactgaaaagcatacacaaagtcaaaagacaacttatgaactgggagagaatgtctgcagcatactgcatgagtaaaaggctaatgtccctaccatataaaaaaattcttggctgggtgcggtggctcatgcctgtaatcccagcactttgggaggccaagacaggcggattgtgaggtcaggagattg

SEQ ID NO: 190569 - DNA, 561 bp, Homo sapiens
gataggggggacttctacacaatcattatgactacaaatctgttgacatgtcatatttaaaaaggaaaaattttaaagctgtgacgtgcttagcatagtacctgtcacttagtaagcattctatatattttaaagttattgtttcatggaaaatttcaagcatacacaaatatagagagagtaagatgatgaacccctatcacacagcttcaaaaattatcaacactttgctactctcaggactttttaaagtttgcaactacccctcctttcccattcacagtgcatataggtttttcctatcaaaagtacatgaatgtactgcacactgtatgtaagcatacacaaagtcagaagaaatttacaccaaaattttattcatcgtaaatctcttaacggtagaattatgggtgatttatttatttctcattttatccgcattttctcatttttctaaaataagcatgtattatgtaattttaatagctgattaaaagaaatgaattcaagcaaacatatgtcaaagaaggagaagttgtttccgaattatacttttagatg

SEQ ID NO: 190570 - DNA, 485 bp, Homo sapiens
tggtgactcacatctgtaatctcagcattttgggaggcaaaggcgggtggatcgcctgagcccagggattgagaccagctgggcaatgtggcgaaaacccgtctctacaaaaaatacaaaaattagccatagggatgggggtgggaggatggcttgagcgcaggagatcgaggctgcagcagtgaactgagactgcactacggcaatccagcctgggcaacagagtgagtccctgtctccaaaaagtggatgtaagaagaaaaaaatcaaatgaagattaaattccaaactcctatgccaactcctctgtcttcactactagagtgtagattagactcagatactccatggctatgatgagagcaggtaaacttgctgggctttcctccacgagttttattctataagagtaatccacatcccaggacagttcacatgacctacggcttagctgttccctgcggtgggtcatgtcttattcccga

SEQ ID NO: 190571 - DNA, 626 bp, Homo sapiens
tgacagttattcacctcctctgggcaggacaggccaggctgtaggcgtccgacaggctgtaagcttccctgttagtcccaacatgatattttaaaattctgcctgtagtaagtagtctctgtagtctcagctcagtggaccccaaggcttgctttctttttgctttcagtttacttgaaaacaagatcaaacctatcacaccaaaagtttttcctcctcctttagtcccccgtccccaatccattttatagacactgaaacggccttctgcaggctccacgcatcatctgtgtcatcaacactactacccaatgcttttcatgaagttaagtagttttcttttccttctagcttacttcttaacttccattactcaaagcagctatctttccctgtttgtcccaatccagtctcatttaccttcttgtttaaagacaccttccacattcatagcttttagggatggttcaggctaaaatcatacctgttcccttcccccttagactttcagaaatcactaactgcttgagcgtgaccttcgaattggtctccattcaaggtcttccacgtttacattattcttgccgcatctcagttttccttttcctgaatgttccatccacata

SEQ ID NO: 190572 - DNA, 481 bp, Homo sapiens
atacaatcagctcgtaccatcggaaccaatgagcatccttgagtgttttctgtgtaacttgaggatagtaacaatatcctttacctagaatgtagtaacaaaatcctttatctggaatgtagtgcaaaagatggtagttctaaggcagagagtgtacaggaatagggagaaatagttgttctggagtaaacctttgaatggaagtcagttcatttatggctaagaggttgagtgtgttggtaagaaaatttcccaatgcttctggcttggattttccttgtcttcttttccaccctgtgatgaatagcattaatttaaacctatttaaggctagtgtgggagaaaccacagcctttgttgtggtcactgctgtacacagtaggactgggtgtttcatttggttaaggcctcaagctgcttccagaggacacgggacagcctgtcggcattttaaatcttgcacagaagcagcaacaattct

SEQ ID NO: 190573 - DNA, 330 bp, Homo sapiens
tgcctgcatagggcgctagtttcgcatagttagatggttcctagttcttatgggacagttaagtgtgccacagggtcatggtgctgtgcactgttgccatgaacttccagctgctctgacacttgggataggagagaaaattgcttccatagtaggcagactgcacaacctagttgaagctcgagcacagcttgactagtttttgacattggttccctgccgagggcctggatgctttccccccattccctactggcctctgagaccatttctcaagtccctccatcccacctcttcttttcccccacactgccttgccgaggaactggc

SEQ ID NO: 190574 - DNA, 662 bp, Homo sapiens
acattaaaatctagataaataagaatgtatcccatgtctgtagattcagagacccaagactgtcaattctctaattaacttatttattcaaagcaattctaataaaaccctgacttttttgtaagctaattctaatatttatatgaatgactaaaggctaagaatagctaaagcactcttgaagaagaacatttgtggagatatgtgtgtgttggggggtgggggttgggaggaacttgctctcctggatatcaaatctccttataaagccgtagtgactaaaagagtgtgagaatggcaaagggatagagaaatttaccaataggacaagataaggaacttccaaacatatccacaaacatacatggcaacatatatgataaagtggtggataactggggaaagaaggaccatttaataaatggtactgaaaaaattacttattcaaatggaaagaatagttagatccctgtctcactccgtattcaataatttccaggtgtgagaactaaggtttagaaaaaacaaagggaagaaaaattttctgacgtaggattttttaagatatgaaataagaaactagaaaagattgataaatttgcatacattaagaacttctctttgttaaaagatacaacaaagagaatgaaatacaagccaca

SEQ ID NO: 190575 - DNA, 201 bp, Homo sapiens
atatttgcaaagattgatacaacactgcctctttaatatttgcaaaattaaacttgctgtcagtatacatttgtgaatttgttcttcttaggtggtttccagaataacattttatttcactccccattttcatgttggttatttgacaatcagcttggataagagaaccttgttacagttctcatgacgttggctttttaa

SEQ ID NO: 190576 - DNA, 142 bp, Homo sapiens
cataagagttgaggcaacactgtgggtaaatcagtgtaagacttaattagagacctggtgtgtggtgggtttcttccacaactttccacctaagtacctatctaaattattggggcctactgaatttgctgaagtgtgactt

SEQ ID NO: 190577 - DNA, 248 bp, Homo sapiens
ctgtgtccatttggacatgagaactgcagatgcagactttcatcctcggagcctcgtgtagatgctgcacgggaaacgcagaggtaggactgaggctaccacaggcaacagacttcaggttctcactgtccactctctgagccgctggaagttttaccagggccacatcttaaggttttacacagtaatgataacgaaaaagaacaaaaacaaggggccccaaggcgtatgaagcacatcggtgcgct

SEQ ID NO: 190578 - DNA, 197 bp, Homo sapiens
tcctaaagtgttgggattacaggcgtgagccactgcgcccaaccaggacttaggatttgtgtagggaaagtcagataattatttgcttccaaatcccagactcctttcagcttttgtattccgttgttgaattcatctttggaaccacctgaccttttctgtggtagaaagggcctcagttgaacaatgaattaggg

SEQ ID NO: 190579 - DNA, 316 bp, Homo sapiens
gagagcttcaatatttaaaagggaaaagtgggcttaggggaaagaggaagagtatggttgtccatgtgtcacaagagaaaaggaacaggcaggagaatcgtcaattacacattggtctcatgctcagtaaatgggcactttacagaagataagatgaacatacagtagctacctgtggagatatttaaccttttacctgtagtattctacttaggaacaaaaggaaagacagcttcttgcatgactcagctttcagcttaatttgttccttttggcagagtcaactggggtcctgactttttattttccttttaca

SEQ ID NO: 190580 - DNA, 677 bp, Homo sapiens
ttccaggctcatgctcaggaaaactaataacgttctctttgacaaaacaatttccttaattttctaggatgaatcttgaacatgtttagctcagcctttcagatatttattctttaaattaccatcctgtcaaaattgcctttacgcactgatccagaatcaccaaggcagttgccacgatgcctcccaggactgtgggtgactgggcaaactggtaatgacccgttggctctgcttcacacacacacatacacattgacacacataaatgtacacatgcatatatgtgtgtacaacacaactataaaacatagaaacatatacctgtacatatgcacatgcttacatacacacatatcacagatgtgcatgcacacatacacatgcacaccaccttttacaatatgcctgacacatttgaggcacattaaaatgccttggcaggcccagccctatagttctgtaaggtttggcaggccaaaggcttcggatgtctgcaggataccattgaaaaaatgttatcttccccttctatatgtttcttatgcacgagcacagctaagagcagccaaatagtaagctttaaagaaaagaaacctggaaaagtgaatgtgccttgcaatttaaaaattgctaacagtttcacagtgggaaaattgcatttgttggaattttcc

SEQ ID NO: 190581 - DNA, 532 bp, Homo sapiens
ttctactgtggattcaacgagataatataaataatttcccaacacagtacatggcttaatttaagtgccaaagcaatgtgagttcccttctccccatttatctttcttcattccaacaatatcctctagctgagaaatggttatatcctgtccaaacaggacgttccattatttctagcaaatccattgtgggtttctggaaagataggaggggcaaagcagtaaggatgaaatcttaatagcctagtgttgcagtacccagagccaaacccaaatatagaatatcacctcccctaaaccctgagtggaaaagctcaaaggaagagaagacacacctctacacaacgttcatgagaagaagggaaggatgagttttcttggacagcattttcttggaagtaaagtgtctgggtttcaagaaaaaggttctgactccaaggactctccaggaagcacatggagaaggttgctaagaagtagcatagagccacagtagaaagttctaccgtggctttgctgggcacacttaggc

SEQ ID NO: 190582 - DNA, 626 bp, Homo sapiens
  misc_feature (25)..(25): n is a, c, g, or t
  misc_feature (74)..(76): n is a, c, g, or t
  misc_feature (106)..(106): n is a, c, g, or t
  misc_feature (142)..(142): n is a, c, g, or t
  misc_feature (157)..(157): n is a, c, g, or t
  misc_feature (201)..(201): n is a, c, g, or t
acctggaggctgagacaggaagagngtgaggttcagtgaactataaattgcaccagtgcactccacactctagnnngggtgacagagtggaacctgcatctaaaanaaagcaaaaacaaaaacaaagaaagaaataagaaancaaacaaacaaacanaaacaaataaaaagaaaatttggatataggctgggcatgatggntttatatctgtaatcccttcagcactttgggaggccaaggcaggaggatagcctaagctcaggagtttgagaccagcctggacatggtaaaaccctgtctctaccaaaaatacaaaaaattagctggatgtcatgtaacagaggtagaaggattgtttgaccttgggaggcagagtttgcagtgagctgtgatcatgcctctgtactccaacctgagtgacaaaataagacaaaaaacaatgaagtgaagagcaatgaaacaaagtatgcctgtacactaaaaatcagtctgttgtagctatttgatgttaagaacactaaattctttagtgcctttaggtcatatttgtagtaaacacttctgttaatgttttgaaactttactatttgcaccacccccagttataagtgtacacattcttgca

SEQ ID NO: 190583 - DNA, 656 bp, Homo sapiens
ctccacaaagaatacagagtggcagaatgggtaagaattcaccaaccaagtatctgctgtcttcaagagactcacctaacacataaggactcacataaacataaggtaaaggagtgaaaaaagatattccatgcaaatggacatgaaaagcaaacaggagtcgctatccggagtcgctatccttatatcagacgaaacagactttaaagcagtaacagttaacaaagacaaggagggacattatgtaatgataaaaggactggtccaacaggaaaatatcataatcctaaatatatttgcatttaacactggagctcccaaatttacaaaacaattgctactagaaaacagcagcacaataatagtggaggacttcaatactccactgacagcactagacaagtcatcaagatggaaagttaacaaagaaacaatgggcttgaactatacaacaaaagtgaccaaatgagaatcaaatcaagaactcaactgcttttacaatagctgcaaaaacaaacaaacaaaactaggaatagacctaagagctgaaagacctctacaaggaaaactacaaaatactgctgaaagaaaccataggtgacacaaacaaacagaaacatatcccatgcttctcattatttcttgccccctgctcc

SEQ ID NO: 190584 - DNA, 327 bp, Homo sapiens
cccctcttagtaattcttacattccatttcttactttcttctgtggcatttatgacttccaacttttataattataaaataattttaattttatagctctttaggtgcacacttcttctctcctgctcaatagtaggtttttgatgtgctcaagtcttgtattccctgcaaccttgagtatagtaggtgtctaatgctttctttttgggtaaatgaatgaatcagttagttgaatgagtgcttactacaaaacagagcatgcgataggcagcgggtatctattaaatataaatatcttgttccatggccccaatcagtgaaaaatgt

SEQ ID NO: 190585 - DNA, 310 bp, Homo sapiens
caggattctctcatcacatttagatattatgtcctttggcttcttttaatctagaatggtccttcccccattttttgttactttttaggatattgagttttttggtgaagaatccaagcctgctcttttgcagaacgcccctcattctgcatttttcttatgacttcctttaagtgcccctctgctgtgctattggtgtgctgaagcgctcctgcagttaagatggcgtctgcaggtctgcctgccagaggtgctctcctgtttcaaatagcgaagcgacactattctatggatgttaattccccagtga

SEQ ID NO: 190586 - DNA, 369 bp, Homo sapiens
caccaacccttcccaaggaccctaccatttatgggtccccagccacatcttttggcagaccacctgcggtaggctgccccacaagaccaagcaaggctaggctgccctagatcacctcaaggtgtttgatagaatccccctgccatatgacaagaaaaagcagatggcggtttctgccaccctcgaggttgtacgtccgaagccttgaagaaagtttgcctacctggggcactgggctcagaaggttgactggaaataccaggcaatgacagccaccatgggggagaagaggaaggtctattatcagaagatctgttaccagaagaaaaacagctcatgaggctataggaaaaggctgaaaagaacata

SEQ ID NO: 190587 - DNA, 297 bp, Homo sapiens
taagggtgctttataacaattcaccaagagtagaactctaggcttcccactgacccttttttccctatggcatttggctggaatagaatagttatcgaataaaagtttctgtcatggtaggctgcccctttcctggtcctttagctaggcaatggactttttttttttttaatctgtacccattggcgtttctaggttactggtttcttcagcttcaagtctgggatatattgggcaaaaaggaaacccagggaacttaccaccatgtcatttctagccaccttgctttttcttccc

SEQ ID NO: 190588 - DNA, 148 bp, Homo sapiens
tgcatattagaaaacattttctgtattttagtaagtgaaaatcttataatgcaatttaatgaaattatagtttttggatttaatccacattttagttgtgtgtgtttttaaattttattatgcagtacattagaactgaaataaaagc

SEQ ID NO: 190589 - DNA, 501 bp, Homo sapiens
tgagggtgtctatgatgaaattgatatggaaatcagcagcctctgagtaggcaagttgtcctacataatgtgggtgggtctcaactgaccagtcaaaggcctttttgagtacaacaaaaagactggcctcccctgagagcaggagaattctccagcagactgctgccttcagactgcattagcaccactgcctctcctgggtcttcagcttgccagcccacagtgcagattttggacttgccagcttctgtaatcatgtgacccaattccttacaataaatatctttctctatatatacacacatccttattggttctatgtgtgaagaatgctgattcatacaatggttagtttaaagatctaattgtgaaagaatctgtggatcccaaagcatagcacaatattagttattggattgcactgggaatggccgagcactctgggggacaggatgtgagtttaaaatgactgagggcaaatttaaaatgggcaaattcaag

SEQ ID NO: 190590 - DNA, 514 bp, Homo sapiens
tacagtataaaaaagtcccccaaaaatgttatcatagatggacaggagtaagctgcaagagcctaccagcaggtccttattatagattttccattttaagattctatatactcatcaataaaattaaattttctaattattacagtttacattttgaaaatattatatacatttattctgggcacaagttcttcatgagatacaagtataggaatattttctcccaatctgtgacttgagtttttattttcttaattgtatcttttgatgagtatgttaattgcgatgaagcataattcatctattttttcttgtatggttagtgtttttttggtatcctgtccaagacatttttcctttccccaaggttataaagatatttacttaatgtttgcttttaaaaatgtacagtttgaaggcaaggagtatatgccttctgttcaattttgctgtgaatctaaaactctaaaaagaaagtcttatagtcttaccttactgtttacttttttatatc

SEQ ID NO: 190591 - DNA, 448 bp, Homo sapiens
aaggatttcttctaaccaagttaatttagcagaaatgtgcattgggtggagttacctctcttttcaacttcaaagctgggaagcaatgggaggtgaggaatgcagagaaaataaagaggagggcaggggcttcaggcaaatgagtttccatccattaaggagcggcaatttctgctagctcccctagagaccggtcccctccaataatggcctgactctaatgattcccactcctaagcaacagcctgtgttatgctggtgttgagacgaactgtgccagagaaattccctttctctcagaggtgctgctatcattacacaagagacattagttagccaggaggatgtgctattgatggggagagagaaagataaccaaagagaatgctcttccctagcaggcttggtacagctgacttaggacagaaaaggcggactgagaggttac

SEQ ID NO: 190592 - DNA, 557 bp, Homo sapiens
cttcctaatttctgtttctctgaaaatgtgggtgggtatagtagttccttattttctctgaagatctgagcctgagagcaaaccctggggtaatctgccttaaagtcttcagatgcataatttacctaccagagagctgatggctgcaggagagactgagtggtatcgagaattgtcaattaacttttatcattttgtttaccattggatagaaatatactggacttaacccaataactggtgatctaacccttataattttttcatgtgattgatgagctcgaagtgtgtgtgtgtgtgtgtgtgtgtgtgtgtgtgtgtgtgtgtgtatttagctgagtcaaatatcaccaacaaaacctgctgataaaacaaagcttgaatttcttacgtattttggcaaggaaaacctcaacttgcacaaagctttggcaatgtttcagagggaaatgtctgggcagaatttattaagaattggaagtttgatttaaggtggatatttcaatgtggggtcttgattaagactgggcaagcatcattttacaacaatccaggat

SEQ ID NO: 190593 - DNA, 104 bp, Homo sapiens
aaccaaagatcaaggaagacagaacttcctagaaagaaaagggaaaaatggcaattccacaagcagatggagccaccaagggctgccccacctaggcccctcag

SEQ ID NO: 190594 - DNA, 185 bp, Homo sapiens
taaatgcatcctgcaactatcccgttctatgtccactgccatatcctgccctatctgcgatgatccttctcaagaagggagacaaacacttccttactggtcccttctttgtgactctctattctctacagagtagccagggtaaccttttatttagaaaaagaatctttgcttgtcactttctg

SEQ ID NO: 190595 - DNA, 162 bp, Homo sapiens
ggtcaagtaaggtctctttgtagtgtcatcatacggcaaaaccctgaatccataaagacaggtgggataacaacataatacactaaattggaataatcaatgagagtttatgaccttacgaggcattcttctgaagtaccatcagcactaagaatggctcaa

SEQ ID NO: 190596 - DNA, 173 bp, Homo sapiens
aagcctaatgtcatctctttctgagatttagggttctcctacagcaaattctccttagtagttcagaatgttgtgcagccaattttattcatgtactctcagctaaaactgaaacttggaatttgtgtattaatgtttgaatagtgttactgtgccgaataaccctaatatga

SEQ ID NO: 190597 - DNA, 509 bp, Homo sapiens
aggtgccacatatgtcttgttcaaccaaatattcttaaaacctgaaaaaatagtaggtactccaaataaattggtactgcagacagtgtagtactgctataaagctacttgaaaatgtgggagcagctttggaactgggtaactggcagaggttggaatagtttgaaaagctcagaggaagacaggaagatgtgggaaaatttggagcttcctagacacttgttggatgtttttgaacaaaatgctgatagccatgtgaataatgatgtccaggcggagatggtcccagatggagatgaggaactaattgcgaactggagtaaatgtcactcatgctgtgctttagcaaagagactggtggctttttgcccctgcactagagatctgtggaactttgaacatgagagagattattaagggtatctggcagaagaaatttctaagcagcaaagcattcaagaggtgacagaaaataaaagtttggaaaatttccagcctgaccatacgat

SEQ ID NO: 190598 - DNA, 457 bp, Homo sapiens
gcaagcaggctggctcggctgagataaaggaaaaaaaagaaaacaactcaaaagagatgttgtataaaagaggatttgaatggagaccttgaatcctaggctgacaagtctggacttgagtacaaaggtattcttgttttctatttcaggagcataccccccacccccaacttctaaggatattaaaaataactgtcattacaaagtttgagagctatgaaatactactgctctgatattttaaaaagagaatgtctatgctttactcaattttcatatccctatgtgtctagcacagtgccttgcagatagcagatcctcaataagtgtttgtgaattaaatttagttgtacttgatattatctttcattttcctaaagagaaaaggtatggtgtctaatgggactcctaatgactaaaccatgaagagaaaagctaaatctctgggtacacattc

SEQ ID NO: 190599 - DNA, 382 bp, Homo sapiens
cacctgtttgctggtcgctatgtccacactgcagccagtgcgactttctaaaatgcacatccgattgcgcctctgcttaaaactcttgcagtaagtctctactgtcctcagggtggagtacagcctcgtcaggctggcagagcaggctcccacggacggcaactcaggttcctcttcaccacagtccctcctctcagtgcctcccactctgtcctcctctgtactttcctccttcttctttagattaacaccatctaccatcgccggtactcaaggaggaacttcacctccacagcaagacttatttattagtttcacttctgaaacatttcttgaatttgtttcttcctatttccactgccattttcctaattctagctct

SEQ ID NO: 190600 - DNA, 455 bp, Homo sapiens
tgaaccaggaagaaatagaaaacctgaatagaccaataacaagtaacaagtttgaatcagtgattaaaagtcttccaacaaagaaagttccaggatcgatggcttcatagatgagttctactaaagtttaaaaaagaatgaataccaattcatttgaaactattgcaaaaaattaaagtgtagggaattcttactaactcattatacgaggtcagcataacgctgaaaccaaaagcagataaggacacaacaacaaaaacataaaactacaggccaatacttctgacaaacattacacacaaaaattatcaacaaaatactagcaaactgaatccaacagaatatcaaagataacacactatgaaagtgagctatatctcaggaatgcatggctgcttcaacatacacaaagcaataaatgagacatcacatcaacagaatgaaggacaaaaact

SEQ ID NO: 190601 - DNA, 428 bp, Homo sapiens
aaaataagtggctgtttcttagtatatctctatggcaaagacataatctaattataatttacatcttttttaggtctgaccacattttccctgtctttgccttactgatttccctcaagcactagagaatgtaacttagaagttacgagtaagagctttggaatcagagttgaatttgtgttctagttttgccagttactagctgtgttctaatcaagttactttactgctctgagtgaatggcttcacctagaaaatggagatgataatcaatttacagagtttctgtgaaaaaataaaatgaaatatattcaaacagctttgtaccatgatggccacattagaaatgctcagtctctcatagccattcgaattaatacacctattgcatgccactcatttgtaatgtcttctgataatcagtgcta

SEQ ID NO: 190602 - DNA, 538 bp, Homo sapiens
cgaggcgatccaacccagagggtgtgctccagtggtcaggctttggggtctcacaggccttccactgtcatatcacaagctctttaggtcacgcttgggagaatattcataaatagacttgtacatccctagctcctgtcttctgctgcttttttccttatctgtggccctctaattatcagtgcactttgctgaactggttactgacactgtgatggcagatgaagagggcagtgtaaactgagtgaagctcttgtgttttcacctgctgtctttggcagctaagaaccagctaaagttgcctcactttactgatacatgctgttgacagatgcataaaatgaatataaagtggatatgtgtttggtagcattttgaatctttgtacaggaggagcatgccctacgtgaagtgatcatcctgcaggagccttgacctagagggattcaccgtgttacctatgcattgtgactgttacaattatgcttccggtatcatctcactcgtccgtttatgatcatgatatcagttattaact

SEQ ID NO: 190603 - DNA, 517 bp, Homo sapiens
cgaggcgatccaacccagagggtgtgctccagtggtcaggctttggggtctcacaggccttccactgtcatatcacaagctctttaggtcacgcttgggagaatattcataaatagacttgtacatccctagctcctgtcttctgctgcttttttccttatctgtggccctctaattatcagtgcactttgctgaactggttactgacactgtgatggcagatgaagagggcagtgtaaactgagtgaagctcttgtgttttcacctgctgtctttggcagctaagaaccagctaaagttgcctcactttactgatacatgctgttgacagatgcataaaatgaatataaagtggatatgtgtttggtagcattttgaatctttgtacaggaggagcatgccctacgtgaagtgatcatcctgcaggagccttgacctagagggattcaccgtgttggctaggtttggggtgtttcatttttgttctcggtgtgttctgtttgtttgtttttgtttt

SEQ ID NO: 190604 - DNA, 124 bp, Homo sapiens
aaatggttatagcaactttatttataatagctgaaagctagaaataaccacaatgtcctacaataagtgaatggataagcagtggttcgtccacacaatggaatactactcagcaataaaaaag

SEQ ID NO: 190605 - DNA, 332 bp, Homo sapiens
tccacttgcataccaatacctcctgcacatatcaaaaaaactcagacataaacaaacataaaacgtcataggagtcaacagaaactttgaccactagagggatcagaaaaggcaatgagaaagaggcaccatttaacatgggttttgaaacacggtaggatttgcacagagagcgatggaggaaaaagcatcctaggggtgggagagaagagaggaaagcaacaaatatctgaggaggggaaggaaaagggttagtgtcctcatttggctaaactgtcaaatacctcaaggcaagcagtaaggaataaggctagaagagggggtgggatcag

SEQ ID NO: 190606 - DNA, 188 bp, Homo sapiens
aaggagccctgtgttttgacacaggctagggcttgggaaccgccggcctaggacagacaccatgaaataagcatagcaacggtcacatgtcacccaccgtcagggatgtgcacggccaggtgattgcattgtcgtgcaagcatcctacagggacttacacagagctcgatggtgcggcctcctccaca

SEQ ID NO: 190607 - DNA, 358 bp, Homo sapiens
aggccagtgccaagaagacaaacgaagggcacatcatgtatcataccctactttcttcaaagccacattgtagatgcagggtagtggctacagctggtgcacagaaatactgcccagttgaaaactctcttggagtttgttgcaggggtggggggacatatccatggtcctgaatcaccagtgcctgctttagctgtggtgcactgctaacttctattcaccctcttccagaaagcacatttctggtttgcattttctctcttgattaacattttggaaactttatgttctcttgtcacagaaaccacgactttcacttcataatttaccatatacatagctaatacaatgtactttt

SEQ ID NO: 190608 - DNA, 311 bp, Homo sapiens
tagaggatccccccgtgtaaccgtagatgcagggtagtggctacagctggtgcacagaaatactgcccagttgaaaactctcttggagtttgttgcaggggtggggggacatatccatggtcctgaatcaccagtgcctgctttagctgtggtgcactgctaacttctattcaccctcttccagaaagcacatttctggtttgcattttctctcttgattaacattttggaaactttatgttctcttgtcacagaaaccacgactttcacttcataatttaccatatacatagctaatacaatgtactttt

SEQ ID NO: 190609 - DNA, 680 bp, Homo sapiens
tacctggcggataaattcaacaggctagagtcaattccaacaatctccagagctttctccaataccatactctcactgattacgctattctcagaattctgaattcactaattaactacatcctggctttttaccatgaggtcacactgtcacttttacgaaactattttttcaacagataattataaaatacaaaattactcaaaatcatattacctagaagttaactaatggccaatacacaattctgtgtattcccttcaatgtttctatatagtttaaaacagaaaaactgcataatttgtattgttattcttttcactttgtattgttactcttttatgattatttcccattttactgctaatttttctttttaaaaaattttttaaaattttttagagatagggtctcactctgttgcccagactggattatagtggcactatctcgtgcctcagcctcccaagtagctgggattataggcacgtgctaccatgtccagctatttttgcattttttgtagagacggggttttgtcatgttggccaggctagtcttgaactcctgaactcaagtgatccaaccaactcagactcccaaagtgctgggattacaggcctgaagcaacggacccaggctcttcctgttctttaatatctcttatataggggggctgc

SEQ ID NO: 190610 - DNA, 223 bp, Homo sapiens
tatggctgccataacaaagtgccacaaattggatggcttaaaaatgcagaaatgtattctctcacagttctgggggcagaagtctgagggtggcagcaaggccatgccctctgttaggccccagggaaggatgtttaattgtctcttcctaacttttggtggtttcagtaatccttgatgttccctggttatagacatcccactccaatttcagcctctgctg

SEQ ID NO: 190611 - DNA, 208 bp, Homo sapiens
actggaaatgaagacatgaaaaccagtaactttcagtgatccacgtgttttgaaagtgaattaaaaatatgaccacttagctgggtgtggtggtgcgtgcctgtagttccagctactcgggaggctgaggcaggagaatcgcttgaacccacgaggctgaggttgcagtgagccgagattgctccactgcactccaacttccagcctg

SEQ ID NO: 190612 - DNA, 122 bp, Homo sapiens
atgtttatggaattttgtgtagccacaagtaaggactagaagaaacgttttgaaaaagtggggagggggaggaaggaagagaatgtatgatgaaattggagagtagagaaaagcaggccgaa

SEQ ID NO: 190613 - DNA, 472 bp, Homo sapiens
actgagtggatgtactatttttaaaatttagccatttacatattgttgaatgggagttattgccagttatttgctcttataaataatactcttttgaacatttttatgcataaagccttttcattaaattattttatatgaattcttcataggggaagaaaactggaaagcctgtgtcatcatctttgaggacatatgccagttgactacaatggtgctaggttttagtggggatcacttggcatttcttacttaagatcctcttttttccttttggaaaggagcagtaagaattgggaggggagtaccacctctgaatcagcacatttagttttcttggcagcttttggaagatataatgtattgggacttattgcaaagttggtactgcctagtaattcactgagttatcaccctccttaaaggagtccccaggggtcagccaacactccatgacttaggcccatgatgc

SEQ ID NO: 190614 - DNA, 519 bp, Homo sapiens
agcccccctttccatcacacaaagatctgtcttatcttccttattcttgccattcttgcctagcacatagtgggtacttcataggtatttgtgggcacacgaatgaatgctgtttcttcctaccacaacagcctttggtcacccatccccctgcctatttcccaaacaactcttacttggcctttttcaagattgaatttgagtgtcacctccaccaggaagctttccctgattgcccagagctccttccctcctgaactcctctaagtctggataatgagcttcttcattgtactcagtgcaccctgaatgcacttaggaaataacagtctttacaatattctgaggttccctgttagttgctatgaaccacaagtctatttgtgagctcctcaggagcaaagtcggggggtttcttatctctatattccagcctcagtaccttctagggagtatgctcataggacggatggagaaatgtatatacgtatgggtggatggatgggtgaatggatggaa

SEQ ID NO: 190615 - DNA, 429 bp, Homo sapiens
taaaaaggcttggttgtagataagcagatctcagagtatggtttgaggatttctaggggtcccctgcgattcttccaaggagtccacaaagtcaagtgttttttataaaagcgccaacacattatttgactttttaactttcattagctcatgaattcacaatgaaaatttccagaagctgtataacgtgatatcatcactctgatttattcatttgtattcttttacacttgtatattctattgttataatgtttttgtttaaaatcctaaaatagtaaatatcgatagttatacacatgtaaataaaagctctttggggtccttaacaattttttaaaagttacagagggatcctgagacccaaaagtgatagtaagtggaattaaatgtcatagaagtcatttaagatagggactgtaaaaagtga

SEQ ID NO: 190616 - DNA, 650 bp, Homo sapiens
  misc_feature (102)..(103): n is a, c, g, or t
  misc_feature (105)..(105): n is a, c, g, or t
  misc_feature (107)..(108): n is a, c, g, or t
  misc_feature (110)..(111): n is a, c, g, or t
agtatcttttcatgcagtaactggcagaaaaaaaaaaaaaaaaaaaaaagccaagttcaaaactgttgggccggtatccctagtattaattgaaagttaaanngnannanngtgaaaaggtcaagaggggcagtgttcttctgaatgacatgaagatagactataatcagtaagaaggcagttaaaactaaagttctggccggcaggctggtcttgaactcctgacctgaaatgattcatgcacctcggtgtcccaaactgctgggattacaggcatgagccactgcacctggcccaagatgaattcttgtacaagttgtgtgacttgcctgtggcagaaggaatgaagaggcagccttgggtttgtctgttattttactaaatttcctttaaaaagatgcccctttggttccccactttagcccaagtatcttttcatatgcagtaactggcagaaaaaaaaaaaaaaaaaaaaaaagaattcaacttgggagttccttacagggattctaagagatctctcctctgaaacttttataacctgttattcactacattccctcatacattttactcttctttcccaccttaggtgctacactttcaaacgaccagactcatgagaactcactcaccatctgaagacagca

SEQ ID NO: 190617 - DNA, 688 bp, Homo sapiens
  misc_feature (102)..(103): n is a, c, g, or t
  misc_feature (105)..(105): n is a, c, g, or t
  misc_feature (107)..(108): n is a, c, g, or t
  misc_feature (110)..(111): n is a, c, g, or t
agtatcttttcatgcagtaactggcagaaaaaaaaaaaaaaaaaaaaaagccaagttcaaaactgttgggccggtatccctagtattaattgaaagttaaanngnannanngtgaaaaggtcaagaggggcagtgttcttctgaatgacatgaagatagactataatcagtaagaaggcagttaaaactaaagttctggccgggcacagtggctcacgcctgtaatctcagcactttgggacaggctggtcttgaactcctgacctgaaatgattcatgcacctcggtgtcccaaactgctgggattacaggcatgagccactgcacctggcccaagatgaattcttgtacaagttgtgtgacttgcctgtggcagaaggaatgaagaggcagccttgggtttgtctgttattttactaaatttcctttaaaaagatgcccctttggttccccactttagcccaagtatcttttcatatgcagtaactggcagaaaaaaaaaaaaaaaaaaaaaaagaattcaacttgggagttccttacagggattctaagagatctctcctctgaaacttttataacctgttattcactacattccctcatacattttactcttctttcccaccttaggtgctacactttcaaacgaccagactcatgagaactcactcaccatctgaagacagca

SEQ ID NO: 190618 - DNA, 567 bp, Homo sapiens
aatctggagtcagtctcatctactcacaaaacctgttaccaactcagggagtggcatggccatctcccagtcactgagctcaaatctcagatttagggttgattccttccactccatcccaagacctgctccttcctgtctccaacattctaccttcccagtccagcctctgctgcccacagattggaccacatcaatctcctgtgcaaaaatcctatgatctgtccattcctaggcagatttccaccccaccccatcttcatccatcaacaaagcaacccagtcaccaaatcatttactgtttttcaactgtgcccaacatttctgctttgctccagctactcgcccttggaaacagcctctccacaaatttttgcgtctctaaatcctatagcattcaaagctatgtacaaaagccccttctttcataaagttgtctgagacttactcacaattaagctttctttgacttgcgtctcactgaattctgtacctctattagagcatcggttccagttttccttgtaaagctctgtgatgcctccagagtccccggcgggggaaggt

SEQ ID NO: 190619 - DNA, 421 bp, Homo sapiens
aaataagtcttgtttaacgggtcagttctttaatgatgccactatagaagcttacatgaccataatggcttaaagctacataaagtgatcatcatttaaaaaaccccaaattgtagtttctaattctacaataaactctatgaaaaactctaaaaatatgtttagcaacaagactatatttgataaattattttccccaaagatctttatttaaaaactgttattgagacaaggtttcactctcattgcccaggctggagtgcagtggaacgctctcagttcactacaacctctgcctcccagactcatgcgatcctcctgcctcagtctcccaagtagctgagattacacctgcactccagtacacccagctaattttttatattttttgtagagatagggtttaccacactggccagga

SEQ ID NO: 190620 - DNA, 429 bp, Homo sapiens
ctctttttcctccaaactgaacctctgggaggagttgccgcccctgcggtctccattcccccgctgcggtctccattcccccccaactgcagcaccaccagccctcaggccataataatctggctctggcagctgtcactgcatggaaacgcttctccagcatcacctgctgcttccatggtgccacaggcgcctggtttgcttttctctctggccatggctccctgccatcttggtggcttctctctccctctgtgccatcctgggcctctgccctctctctgaagactctcactctgcattcgtgactttgtggtttttgtggttgaattcccagtatctttattcctgataattttttgttttttttttttttgagacggagtctcgctctgtcgcccaggctggagtgcagtggcgcaatctcag

SEQ ID NO: 190621 - DNA, 376 bp, Homo sapiens
tcatgacactgcactccagcctgggtgacagagtgagacatggtctcaagaaacaaaacaaaacaacaaccagattactctggagtaggacagtgtgctaaaaataatttagattctttgcatttcaagttgtagagggaaagtagagaaattaggctgagtttttctttgtcttcatgtgattaaactgaatgtgaaggtttacaattattcagtaaaaggtagaaacaagcaaaaatgtgcctttatcttcctttattaggtaggcagtatgtctttgaacataagtgaatttcaaattttcatcatggtactttggtttgtatgtctgtgtgttcttgaatggtagccatattattaatgtgtcaggaaatag

SEQ ID NO: 190622 - DNA, 531 bp, Homo sapiens
cagtcagtgatcaatacatcaaaggaaaaaagaattttcagtatagatttctacataaaatgatgagttttttgaatcttacgcttggtatcagatttctctgacctgttatctattatctccaagtctggattctggacagtgaggaagacatgaggggcggtggggaatttgtgtataataggcaactgaatttcttcttgtgcactcagggccttctgctcaggatgctgtagggtgctcatgcaggctacaggacatagtaccaaatggttaaacagcatgggggagatcagaagaatatttgtgcaattgataccaacaagctatttcttgggcaacatacatggccagaattttgagagtacgttgacagaaattagcaattgataatgactatgtttgaattttgcagaccaggaactcaaaggtttttaaaatatgcattaacattaaaaaagtaataaaagcactttctagtttagatgttatgagtcagattgataagtcagaagaaatggaaaacttgaa

SEQ ID NO: 190623 - DNA, 455 bp, Homo sapiens
atgacaggtcccttataatgcaggccagtgtctcatctcaaagtccactccccatcatggggcacacaacttcataattccaaatgtcaagtattaacctagatggattagaggagggggaggggtggtgagaagtcctagagtcaatctccaataacggccaaggccctgacctctttgctctgttctttcctggcctccagaacacaagggatcatggaaagtctgaggtttaccaagtgcctccagctctggtgtccaagtgtccagcaaattcctatcttctaaaaatgggtaagacattgtgctcttcctagaacagacgtacccatccccattcacatgctggcaggaaatcagctacagacatctctcagggaagtcatggggaggagaggacctggcagagggttccagttcattaatgctacctcagagggtataagagaccaaat

SEQ ID NO: 190624 - DNA, 238 bp, Homo sapiens
ctttataataaaatatttcaaatattctaagtaaggttgtgtgctcagtcttccatgatgaagctcactggtatgtagaaaatccttgagccagttatttctctaattatttcgtaggctagaaccttatcaacctagttgatacagtcaccatatgaagtaaatgctgctctaaaatatttacaatggaataaaagaatcatgaaacagtgtatactcttcaaccttttaaagtact

SEQ ID NO: 190625 - DNA, 359 bp, Homo sapiens
accctaccccacccctagcacttcaatgtgtgcagcagcctggatactttccaaaccccatttttgggtgattttgtggatgcattattacatatgcatgattgattaaatcattggccattggttattaacaactttgagtccctctcccctccctggaagttaatggcaagtgaagtgccttcctgaattctgtgagtcatattagcagattatcaaacatgaggccctcctcaggggatcttggaatcccacagtttatagttcattggtcagaagtacaagtggaaatctgggacttgtgactggcacctgcagtggggacagtggcctaaactgtagtgctatgctaattctgg

SEQ ID NO: 190626 - DNA, 435 bp, Homo sapiens
aagaagggacttttgcaatacaaagcagaaaataggtgatcaatacatatttgtatcttgcttaaatgtaaacatgaatgaatgagtaaatgacaggagactgcctctgtccctatactgttttcagtgagtcacaccatttttctcctaaatgagtctagaaaatttcttcagaaataaagtgacttaacctgtctttttttccataaatcatacggtgaaaatcctgaggagagaaataaagaccaaacacttacaaagtataattttctcttgggctttgttaactgagtaatttgtagagtttttggctttaaaaaaaaaaagtctgctttgcaccatagtgttcattatcaataacatcttttggttctgtttatatcttaattttttttgtaaccatttaagaatttagtattctgaaatgaggtgatg

SEQ ID NO: 190627 - DNA, 610 bp, Homo sapiens
ctggctactaagttgtatatatccttaaaaaatgcgagtttatttcttttaaacactttagtttattttacattttgtaacagatccttaagtccttaagggtacattctgtttttattctttttctctgctgcctctcactcataatggatataacacagagtatgaactcttatttcactgatttccatctgcatgaaccccgaggaattagatttgagagtagcttcctctacagaagtttaatgtttgttcctggcaggcacccttgggggctataaacacaaactactttaattcattagcttggagtcttccaaacaccacaggtgaagtaaatttaaaaccacaacttgtgtgagtagacagcttagttacaaattatgagaaaagattaggggttttttttccccctctgtttaaggcaaagtcaagacagacattatatcaacttgaagataaagaggattttttgtgttgttttgtttttctcacctgtccaccttgtcatggatatacagcccccttgtcaatgctggcttaatgccaactctcaatcttcaccttgggtcagctcaaggtcttgtgatctgtgtgtctagctattcac

SEQ ID NO: 190628 - DNA, 236 bp, Homo sapiens
ggtgcaagtcagctctttcctccaggggatgggacaggatgattttatgatcacgatttttggggccttgccatctatcaagttcaaaagaccagtataagagatctcagtgctcaggtacgccagtgctcagccttttcaagaaaatcttatactttctccttttgtgtacatcctactttcagcaagatgtagggactattagaccaggcatcatatgagactaaagcaagaaa

SEQ ID NO: 190629 - DNA, 520 bp, Homo sapiens
ccttgcagtaaccttgtgagcaacgtgctgaaaataatagaactagcatctcctgggttccttgaaggatgcttggagtagaaggcccaccacctggcctgttctagactatttacatgaaagagaaaaaaccttttactcttctcaaggcattgcattttgggtcttccaattggcacagtttagaccatgttaactagtatatacaataactgggcaaagtaggtgatgtcatcattttataggctaagaacctgcagctctgggaatttaagagatttatttatttacccaatatcaggatacgaatgtggagtcattatttgaactgaagtctgtcagtttaaacatttatctcccagaagttcagacctccagagcaaacaggtagcaacagatgacttgaatgagagagggatctctgatttggctaccatgtccactaactcaagcccaaactcataccacctctttccacagctccagctgctgcactgctgaacttgatcttcatgctgga

SEQ ID NO: 190630 - DNA, 738 bp, Homo sapiens
caccgccacagcacctcggcaggcgtggcttttcacctgctcctctgggacagatctgcagggggcagcgtagaaaatgagtccctgagagcatggcatctggtgaggcacggaaggcctcagaagctggggggctgctccccagggagggctgtctgcagagggtggggttctgggggcaggaaggtcttccgggcaggggcacggcttggcccttacttgctgcctgccttcagctcaggctcccagccttccctggggccccactctgtggtcctcagagacctgttccacagggattgagcccaccatgtcacttgcagggactgccccctggagtggtggggactggggcccccatggggacctccctggccctgtctgttctatctgttgactcttctgcaaaaagcaggcagagaggggaagagcaggctggccagctgtgccctactgtgtccccacgtgtcccttcatctctgtgcccagagatagggctgggctaattgtcactgcctcaggttggcccctttcccaccaccagccccagctacaggttcctaccacgctgatctatggtccagcacctggcacctgcctacccacagccccttcccctcccataaaatctagtcccatggagccagacagtagtgcccacagcagggaacagatgggcatgaaggtgctttgaagagggtcctggcctgaccaggggcgggaggctggggaaggggc

SEQ ID NO: 190631 - DNA, 587 bp, Homo sapiens
tgtctcaatcgctacaaaacaaaacaaaaccaaaaggtacgggactgggatgttaggggcatgatatcaaaggaagtaatcagcaactatggagcttggtgataaacacataggaaacagcaagtaggtcttagggtattctcattattaggtgatcaggaagtcagatattgtaaatggccagacaagattagtgttaaattctgaagaatgcaggcttactatctgctaatagaacaaacacacatctgtcaaatacaaggatgtctatctaagaaatgggtgaacctgaaagcaataaagactacattttgtaacaattcaagacttggagatgggggaatgaatcattgctagtagtagactctttaattgtttttcttcaacccctcccccccaaatgaaagacacacactcatatatgcacacgtgcacatatgtgcatgcacacacaaacacacacagttttattcattaatgacagcttctgagttaggtgctggggacatgaaaatgagccctcagagagttaactataatacaatgaaagtttaatagaatgataatactgatgtgtgaatatagat

SEQ ID NO: 190632 - DNA, 383 bp, Homo sapiens
acaaggtatgaggaaacaaaatactataaaccagttttccgtgactaccactttggctaatctatccacctatgctttctctgttttgtaaacggctctataatacctccaaaggcccatcataaactaataataatttctaaaggtgtctgttggcagagaaaatacttgcaattttaagacatgaagaatctacttcatgctgaatttaacccccacatcctttggaacactaatccattcatcttgctgtacacacaaatgtctccagaggctactgagtgatgggtgttgaatgttgaaaggaacaatacctgcatggttctctgatgctcctatatcttttgctgggtatgccaagaaggcaaggccctgaccattgt

SEQ ID NO: 190633 - DNA, 546 bp, Homo sapiens
ctaggaatagggcagtatccccatgatgcttattttgaaggggcaaggaaagacagttaaacatttttatatataaaaaatgagtcagatggtgacatctgctataaagaaaaagcaaagtataaaggaacagagattgatggaggggtgtatattttacatagagtagtcatggaagggaaataaagggagaaagccctcaataaatgttaaggactcaagaaatcatccaggatcatgagtgccgagtagttcgggaagatgtacaatacattattttatatcctgtggctgtcacacaaaagacacttggtgcatatttgctgctgaacagagaaataaaccaccaaatgtatttcatcacacttagagaaaaacaatggggagcctgggcacggtggctcatgcctgtaataccagcactttgggaggctgaggagcatggatcacttgaggtcaggagttcgaaactagccaggtcaacatggtgaaaccccatctctactaaaaatagaaaaattagccagacatggtggtgggcgcctg

SEQ ID NO: 190634 - DNA, 398 bp, Homo sapiens
ctgtcttcggatggtgagtgagttctcatgaggcgtcgtttgaaagtgtagcacctaaggtgggaaagaagagtaaaatgtatgagggaatgtagtgaataacaggttatagaagtttcagaggagagatctcttagaatccctgtaaggaactcccaagttgaattctttttttcttttttttttttttttctgccagttacggcttataaaaagatactgcggctaaagtggggacccaagggggcttcttttaaaaggagatttagtaaaattaacagacaaacccagggctgcctcttaattccttctgccattgtgcccggccagaactttagtttaacggccttctaacggattatagtctatcttcatgccatcctgaaaaacagctgtgg

SEQ ID NO: 190635 - DNA, 408 bp, Homo sapiens
atgaacaggaagcagcagatctaagagccatttaggtgctaaaactgatggccctagctgttgactgaaggtggcaagagaggaaatgggggagaggatgagacctcagcaaacacccaagcctgggtggatggtggaagcttttataaaggaggaggaagggccagttccaagtctggttttagacatgcaagcagaggcccacgagatggtcagtgacacagggctgcagctcagctggtgttgctatagtgtagaccacatccacaccaagtgagaggtaagagtctagggaagttgcacagagcagagagaagaggcccaggccagaaaaaagttgttttggcagcaatagggccaacaacacagcagggcacattcatctaagggatactgtgcaatcagtaa

SEQ ID NO: 190636 - DNA, 545 bp, Homo sapiens
catagtattctcagtaaccagacatctaaaagcagtgataacagggagacaccacgaaatcattctttgcctaagtgtagttcccatttggagataacaattccaaaggacttgaaactaaaagaagcagagaaaactgatgggagcaagatggcccaccagtgtcccgtaccctcaccaccccttacatgcgcttacacagcaaccatagtgttagggtgtgtgccggctgtggttgggcttctttgctgtggcgtgtgagtgatgctctagggccttccgcaggttgtcacggcccagaggctctggcactgaccaacacgaatggataactgtctgatgtcagtatttctttggagctgatattagccaaaatgactaaagactttgcgaagaataacttgatggagtatcataggaaaggactggtccacaacagaaggggacatgagcattttgcctcacagagagagcctggagtcacaaggtggttaaaagatggcatctagttaatgatctgatgtggtaacattttattttttggg

SEQ ID NO: 190637 - DNA, 268 bp, Homo sapiens
aggggtgggacgggtccacggactcagccaagtccatgtccagaaccctttgctcctggatgtgacaaggggcttccagacagaaattgctggcagatcgggcgcggtggctgacgcctgtaatcccagcactttgggaggccgaggcaggcagatcacttgaggtctggagttcgagaccagcctggccaacatggagaaaccccatctttactaaaaaatacaaatattagccgggtgtggtggctcatgcctgtaatcccagcta

SEQ ID NO: 190638 - DNA, 472 bp, Homo sapiens
gacgtgaatatttttaaagccccctccataacatactaataccacttgctattaaacccttaaaaaatacagatactagtagctcctgtctggtatccttgagttgtatggctgaattgcaacatcactggtagctactgctcctaagtagtaattatctctgtcttgtatacatcaagagtgtcctttaacaaggaaatatttttggctttttctatatcattccttagatactttttgatatgaatgaatatttttgggtcatgtatacttttcctctatctttcatactgattatggtttagccacagacatttgaaggatttcactttgaagaaaaaagttatatatggacattaagaattatttcttgttgacttactttggttaacatttgtagtatgctctgaaaccattgtagatatttggaaacatagccaagtttttcactgaagtagagaaaaagggtccc

SEQ ID NO: 190639 - DNA, 668 bp, Homo sapiens
cctagatcttgtgtttgtgacagcgccccctggagctgggaacgccctttggaaagccttcattaatgctactgggacaggaattccaacgaactgatgaagcaaagaatttcctattaaaaccttcctgatataatgcccttcagaaattattttagagagataaaattgggtcttgatatattatcttaaatactctctttgccattgtgaaaaataaaggaataatgatacttccttaattccagatgttaaaacaactgagaaagatccctggaaggcaggggctgctggaactcctgctcctgcttgctgtctctggacatagctcagcaccgcaggcctctgcctgtgggttcatctcagtagttcgggggtgaagtgcagagaaggacccgagagccacagtggacagaccttaggggctgagggtggtttatataatggcacaggctatagagtcacccaggattgttgatagggcagtgtggacttggtgatgggtccagagctccagccacagtgaagagaccctccctgattccatgatgctcaagcagcaaaagctcaggacagatgaaaggaggcatttatgaacatggaagggagtcactagcaaacacacacgtgattgagtggtaaggcccgaaattcaaggtatttgaaat

SEQ ID NO: 190640 - DNA, 518 bp, Homo sapiens
tgtatttttagtagagatgaggtttcacgtgttagccaatatgatctcgatctcctgaccttgtgatccacccacttcagcctcccaaagtgttgggattacaggcgtgagccaccgcgcccggccccagctctgtttattaaaaaggagatacacactgtttatgaaagaggtgacataattttattcatttgtgttccataatgtgtcctggtccaattgtgtcctcaatgtaatgccagctacacaaaaaattttttaaatattatctttattttcattttagtgtttttctttgtatggactattccataattatgagctgggagttttacttctggaacatttttgtttgttggtttgatttttttttccaagaatttattcaatttgtttagtagactaggagtttttctatttcatgttatgtttgggtcagtttgggtaagttggtttttaaatgtggtgcattttgttctctgttgaatttttagaccctcatatttcacaaagtcctc

SEQ ID NO: 190641 - DNA, 408 bp, Homo sapiens
tctgtgcctaatgtagctgagactttaaacgaaagaatcatgtgcaaagagaaaaggccagagtgtacaaaaatagaatcatggaatttcagagctagaagggactttcaagatggtctagagtctagaccaagcctgtcattttctgagtgaggaaactgaggctcagggagcctgaggtcacacagacagtggtggagcagggcaagaatccaggtctcctgactagtaactgttttcttatttcattgtggtggttattacatttcattcaaaagcccttagcatctcaaagggctggtgctgaaagagttaatggacaatgctcagagccccagagcgcagagctattctaagacaacacataacaggaataccaagggtccatgaacccagagggagcaaaac

SEQ ID NO: 190642 - DNA, 396 bp, Homo sapiens
agacttcttaatcattatacaggtgtcatgaagaggcagcatgatacactagaaagaacaaagactctgcagtcagagaacctgggttaggcctgcctctgccaccatcacctgtaattgctccaagtctgttttctcatctttgagcggagataagagtccccttgctgcctgcttcagagagttgttggaagcatcaagtgagatgtgtgtgacaggactctgcaaagtgctgtgcaaatgccactactgatgggtcacactctgacatcctcaagtgccctaatggtgttgcaggtcaaagagccctgctatgcttataaacaccagaggcaccagaggcccaatagctcttctgtgctcatcctagtgtctgttgaggaatgtgggtcagtg

SEQ ID NO: 190643 - DNA, 239 bp, Homo sapiens
cctagtgaggaaagcaaggggacctcagagggaaagctctggcagcccaggttgactcaggggtctaccctgaaactggggtccagaaagctaggaaattgtcccctcttcctcccatctcaaatcctctcttgggaacagagtggccctggctataattttatcacatacatttaattagaatttgtcttcttcatgatggtttcaagtgaagtcccaatagaaacattctaaaagaa

SEQ ID NO: 190644 - DNA, 450 bp, Homo sapiens
gacaggagcccaagagctggaaccaccaagcctgacctagaactttagaggccttgctgtaaacggggaacttgagccttcgaggagaatatgccagagatagcaacagggcagagagagaaggggagaaataccttggcttctctcctttgtcttcgattttctggcagtgcctctgattggccgaaatgggccagaaatggattcacaagggatcctgggaaatgctgtttgcagagatcagctctgtatggttgtcccatacacagcagagcaaaggagagagggggatgattttgaaatcaaacatggacataaactgcattgcactgaaaacttaccacaatatacaatagcaccttgtgcttctctttccttctagtgccaccctgaagaagcaaacactttcaagtctttcagctgattattctatagttttatttatatttc

SEQ ID NO: 190645 - DNA, 468 bp, Homo sapiens
tccacctgacaccacagcattgcctgtcccctgctcccgctcttaagaaaaagcaagaggagcatatactcaaatgattctcttgtttgacagggagggagaagagggcagagaatggaatacactcacatcagcattttgcctatttccccttgatagagatcaaccttttaatgcaaaagatctgtaaagtttcttgccgtaaatttgtggggtttttttgttgttgttgtttgtttgtattttttggagacggtgtcttgctttgtcacacaggctagagaatgagaccctgagtcaaaaaaaaaaaaaaaaaattttttttttaatttggcccattttccccccataaagtaccaacgctttttgactcaaatgtgttaattatttttaagccggggtttttaaattcctaattccaaaacctttttttttaaaaaagacaaatctgcacaggcgcaggggctc

SEQ ID NO: 190646 - DNA, 457 bp, Homo sapiens
ctgagtggctcaaattttaagagatttcaaaattaagttactgatctttagtattattaaagaagagctgaaattggggattttaagtcacaaacaacaaggatcttctgtttctattttattaaccatgttgtatgtatactttgctggtagccccctcaattccttgtggaaaagataaaagataaaaaacaagcaagcaagatcaagatggctgatggaccacccaacacttgccttctctacaaagaaggatcaaacaacaaatagataaccacacattaaatacagcatctaagaattcagcaaagaagagataaagacactctgaggcatggaaacttgagatgtataggatgggaagtaaagcagccagccagaactggcttggagctgagagccccctgcccccttattgcaggaaaaaggtaggcaggagatccccagcagtccacat

SEQ ID NO: 190647 - DNA, 418 bp, Homo sapiens
tgtgttaagaaatggggacataaatttatccaattctaatcaaggaagacctataaaaaagatcaccttggttcttacctatgtgggtggggcttaagtgatagaatttggaacatgcctagttttttattattttttttagggcacaggtttgggagttttcactatattgcctaaattagtaatttaaaaagtcaataaataaaatcagggccattcttgggctaatgatgggaatttgacaaaaactggagttttttttttccataaatttggtacaacaggacttaggtcccttaaaaaaaatctaaatctgtgctgcttcttgaattttctaaaatctagtttttactccacattctgtatgccagatctgacttatttgttatccaatgatggagatcatggctgtcactta

SEQ ID NO: 190648 - DNA, 846 bp, Homo sapiens
caatctatagtgatgctcagtatcagtcaggctaaaccttctgatttctctttaatgtccaagagcttctaacccaagagcctctatcccagtgctccaaggaaatgaagtcacatcatgacattctctctccaaaacccagttgttctctgtgacgatgccataaagtgacatctaatgactcaggtgtgtgtactgggtggcaggggcatgtcacacacaagcattctcaactgcagcctcagtctgggaacgaggtggtgcgaccctcatttccgaggggcagctgctgttttagttcccatcttatcattactggaatttcaagtgtagtaccagaaaccaaattaaaattcacaggaacgctgcactctgtactgttttcagatgttcagatatctacaaacactcgagtagaatcaagattagattttcaagtcatcagcgtgaattaagctttgaatcgatattcaactcagaactgagagaggattttacacacataatagaacatacttagccaaaaagtgcacattctgtctggcacttgcgggaaacagccaggcacagccagggactgcaggggtgtgaggagaaagaaggcctgtccttcagacattgcagggctgtctacctttactctccagagagattctgctttaaccaccaaaagcaataaaggatcctgtaaagggccatttctttgtggactctgaaaccagctttaaaccaattccaagagatactccgaaaatgtttaggggagtcactgcctctgtctgcaggtgggctctctgaagctgacattcatttagagaaagaaaaattccagatgtttacttcaac

SEQ ID NO: 190649 - DNA, 699 bp, Homo sapiens
gaataaaaaagcagaaatgtacaggccacttcctcagataccattctaactagggtcaaattatacatcaggactgaaaccacaaacacataggaaataagataaagtctttggtttttttgagatggagtctcgctctgtcgcccaggctggagtgcagtggcacgatctcggctcactgcaagctccgcctcccgggttcacgcccttctcctgcctcagcctcctgagtagctgggactacaggcatccgccaccacgcccagctaatttttgtatttttagtagagacggggtttagaatcattgtttaaatgttcttgtctgctaattttaacatcttcatcagttctgtgtcactttcaatggacagattttactctttattatgggttgtattctcctccttctttacttgcctcacaatttttgattggatgccagaaatattaatttaacttagtaggtgctggatatttttgtattcctataaatgattttgaattttgcttggagacatagttaagttacttggaagtagtgtgattctttcaggtcttgctattaatatttgctaaacagatccaaggtagtgctttttctagtgctttctattcctcactactgaattctacctataccctgtggtacttatgctattcctgatctcaagtaaatgccaagtactttttcttctaa

SEQ ID NO: 190650 - DNA, 220 bp, Homo sapiens
ctggaggtactctgccatgttaacattccctggttcagttgttgttgagagctagcttctttcttgtgtatcctgtggtttaactattcaacatttcctttgattccacaagtcaatacattttttctttttttctgagctagtttcagttgaatttctgtcacaaccaaagtgatatctatgtcaattaaatattttttctgtgttcatattcataaat

SEQ ID NO: 190651 - DNA, 239 bp, Homo sapiens
cccaaagatggctgccacttattcctgccccttctcccaacaagcagagcctatttcccttccccttgaatctgagctgtctttgtgactatttgacaaacagaataagacagaagtgatgccatgccatttccaggtttggtctctgttaacttaaaaatcacacaatttataaatttagaaaggagatcttatttttcgtaaagcattgcaacctgcaggctggccatctgcaggtt

SEQ ID NO: 190652 - DNA, 330 bp, Homo sapiens
cagggaaaagacaaggattggatagagaaggggagacaatgtcaagaagagtgtggccaagagaacatgacaatagaacaggaagtgagaagcagcacagacaagacactgcttctccagaccactgcctctgtctgaaaagccttctctctcaatcttgccagagatctttgtcattagctaatattggcttttttaataagttaaaagtatattttttctaacagtcctagtaatttaggggatcttttgtttgtgtggcagggcactattttaagatacaaagctgtgcaattttgtctccacacgtgttcatcctttcgctccatg

SEQ ID NO: 190653 - DNA, 380 bp, Homo sapiens
tgagagcatgtctctaaagttacacagtcctgggtctgaatctcagcgctggtacttcccaaatttaacctgaggcttgggcaaatcatgtgacctctcagggatttagtttcctgtctgaaactaaaggggatcaggaatatctatttcattgactttctgtgaaaactcaatgaaataacatatttaccgtgactactagagcagctgtgccatggcatattagggctcaggaaatgggagccaattcactaaaccatgcacatatcctcactcaagttctcttggaaatcataaatgatctcagcaatgtcgggcaataggttcagagtagggcagtaggttcaggggtaaaaccctctctccaagaccagcgacta

SEQ ID NO: 190654 - DNA, 646 bp, Homo sapiens
gttgaaaataaataaataacaaagaataaatatccctttctcttcttccctctgcctgtatccatataggggaaagaaaaaactgctctgagattcagtgagattatgaccttcacaaaatcatgaactttctgctgcctttttaaccagaaatctaggcaggagggtctcaccattttgcatatcctacctgttccttacaggctctaggcttttgagccttcctatcatttgaccagccaagttgcttctcagcaccttttttttcccctttgagtcagggtctgggtccagtggcccaattatagctcactgcagcctcagtatcccaggctcaagcaatcctcccacctcagcctcccaagtatctgggactacaggcatgagccaccatgcctagccttcaggcaccttccattcagaccacattttctgtggcaaactgacaacgccaatgtttgcagtttgcagtttaactacagctgtattttttgccaaacatttacacctaactactcttttccactagagtatataacaatttacagaagcatttaatgttttctgaatccccaagctcatcagcagagaagctccaaaacatgaaggtgtacatccctattttaggccttcatagaaagaaacc

SEQ ID NO: 190655 - DNA, 240 bp, Homo sapiens
ttgtctagaggatcccgggcatgctcacatgtgtgggagggagcaggagttcatgagttcccccagggactttgcacttctgcccaaaacactccttcatcagatgtcaacatgcatagctcttaaggtctctgtacaaatatgagattctatgctacgtaaaatagcaccctggccaggtgcagcagctcatgcctgcaattacagctactcaggaggttaagacaggaggatcacttg

SEQ ID NO: 190656 - DNA, 651 bp, Homo sapiens
gcagactctggggataattcattcacaacactcttacctgctcacagcaggaagcctgttcacagcaccccaggccagatcagccatggagacatttatactagacactgtgggccacctggatgccaacagacacacaagagcgccttgtgttcccatccacatcaactcagctcatcaaaaaacccatcccagggaaaatgagcttgctaataaaccaactaactaagcctaacaagaaataacagcaaattttgaggcactttacaaggagagtcacacccaggtacttgttggacccaagaagactcaggtagcaaggcagggagtggctcatgacaaccgcccggaagagtcacgtctatttagttctcgaaaataatggaaaacaaactcggttttcgcaagtggtatgctgtgtacactgagtccacatcaggtgttcttgaattctctgataaataaaaaccacaagcaactgtggcaccaccgggctggagggaagcgccggctcgcacctgtcaatacgagcagcctgggggccttatgggacagaccctttttctgaactagtggtgctggagtgaacaccttccaggtccccagggctcgcccctcaccctgaaaagattaaatcatttatttataaga

SEQ ID NO: 190657 - DNA, 347 bp, Homo sapiens
tcctggcagccagtgatctgttctccatcaatatagtttatctttttccagatgtcatataaatggaatcatacagtatatagttttttgagtatggcttctttcaccaagtataatgcatttgagatccaggcatggtgttttatagatcaataattaattccctttcattgctgagtagtattcaattgtatagatgtaccatagttactttatctattccctagttgaggaatatttggtttgtgtacagttgggggcaaatgtgactatagctgtcattctaagaatttgtatataggttattatataaatgtaggttttcatttcattttacttgggtaaat

SEQ ID NO: 190658 - DNA, 375 bp, Homo sapiens
gaattgggagcgggcaggaatgtgccttttaacaggttcctgtggtggaggagtatacagcttgaggggttccaagcttctatctccagcccagactggggccccgaattccagacttgtgtatccagctacttacttgacatacccttttggatctcaattttttttttttgagacagtctctgtcacccaggctggactcgaactcctgacctcaggtgatccttctcggcctcccaaagtcctgagattacaggcgtgagccaccgcaccaggcctttaccacggattggaccaaactttgtgctcagcacaaaggacatgctcagtaaacatctgtggactgaatgatgaatgcatgcatgactagatgac

SEQ ID NO: 190659 - DNA, 508 bp, Homo sapiens
  misc_feature (229)..(230): n is a, c, g, or t
  misc_feature (240)..(240): n is a, c, g, or t
  misc_feature (243)..(244): n is a, c, g, or t
gtcaaaatccacacagctggaatgagagacaggtgaggtccagaggctctgcagtggggcaaagaggtatctgatgcagattctccaactacctgcttaacttcaagtctgcttcatacagttgtatggtttgtgcactgcccaaagattcctggctgagggaacaagttgggaccagaatctgacctgagctctctttacagagtcttgtaccccttgtggttccaanncccagaaggncanngggtgcccctttttttttcccaaaaaaattttaaaggctccagggggggagctctcttcacctggttttccaaagtgaccagtcaggggtaggttgccccgtgtattagtccattttcatgctgctgataaagatgtacctgagactgggtaatttataaagaaaaagaggtttaatggactcacagatccatgtggctggggaggcctcacaatcatggcagaaggcaaaagtcacatcttacatggtggcagacgagagaaa

SEQ ID NO: 190660 - DNA, 694 bp, Homo sapiens
ataactgccaaatataactcaagaaataggcaagcagaatatgtttgtaccaattatgttgactgaaattaaggctgtttaggcagaaaaaatttagtaaaggcttactggaagccacatatgaggattgactggggaagacacatcagcaaagtgggtatgttccaaagtctgctacaagtccgaaggcttttataaggaagtttgggagaaggaaaggtgactcctcatatcagagttgtccttttcaccggaaggtacaatacagaggttaagatcattggcaagagattgcaacatacaggctaaaatgtctgtgtgcaagacaatcagtaaaacttcatgattctagaacaaatcagcagtgtctgtgtgtcagttgtttacatgttaatcgatatgtcaatcgtgtgaggaactgacaataaaatttgaggattccttattcaaggacaaaaggttcaccatgaatcataagaccatcaccacgtgggtaatttggaagcttgccaaatgtgacctaaggttatcaattaaataaattgaaggaatagttaatattcttccaaaaaggaaacttcaggaacagagggttttacttggaattctgtcggtatttaaggaataaataggggccaggtatgatggctcatgcctataatcctgactctttgggaggctgaggtgggaggat

SEQ ID NO: 190661 - DNA, 170 bp, Homo sapiens
gtgtatattcagggcaacttcaatctatgctcccagactgcaaaataataataaaagaaaactaaatttaaaaggatctccaaagtgattctcctttttagacccattcctgggtctaaaggaagccagacagtgaacgccaatggaaatctggcaggtccttgaacgac

SEQ ID NO: 190662 - DNA, 311 bp, Homo sapiens
acctggtatctcgtttctctaaaactggagatgggcaggtatgatcagaaaggtgctcaagatgagcaccaaacacaagctctcctaattgggaagtctgaaaaagaactgaaggggaatgactttgtcaccttttgattcagttatttaatgtcctattccattgttatcgcctaaatctataacatagcagtctgttttgtcatattcttacttatgggataggtcttggcctgactttgaaaatcattcagcattgttgtgaagcctctgttctggccactggagcaggttacttgtctttggttctg

SEQ ID NO: 190663 - DNA, 398 bp, Homo sapiens
agcacttcagttctttctcatccatttaatttatgtttgagtaaattgcttcttatctccctgagagaatggaagaggtttacaaaggagaaggagttcagctgtcttcaaaaggtaagttgtacagacagagatgagagcaatggcatgaagtgctctggaaattgtggaggagcagatgggaggaaaagatctgtacaagggagagtgagttctgtttaggacatgcccacgggaccttgggagacacagacaaggacttgggattaagtagcatatatgctgtatttaaagtggatgatgtggctgggtgcactggctcactcctataatcccagaactttggaaggccgaggcaggtgaatcgcttgagcccagaagttctagaccagtctggg

SEQ ID NO: 190664 - DNA, 247 bp, Homo sapiens
gggggtgggattgggggatccggacctagacggtcgtgcgcggggcgggggtgggctctggccctgactcctgcgcccggtgtgggaaggtgggaggccttttctaaggcaggtgttcacaccggccggaccggggcgttacccccacccggcttttcccacgcagctccttcgcgcggtcatttcttgactctctggaagaatccgccttctttatggccactgttcctttccatgtacacaccag

SEQ ID NO: 190665 - DNA, 426 bp, Homo sapiens
gtcttacagtggaaactatttggtttttcaggagaatttgctcatatatttctggcttaaattacggacattttccccttcaagtgtctgactagtcacaaacatctatgtaattttttttaaaaaacagaagaaaagatgccatatatcttacatactttactccttagaaatcccttcaggctctcactccttacttttgctttacttgcaagtttgacttcttagcttgtaatggaaggggtgtaggaggtctctgtgatgctagaagctggtgtccggatagagtaaggggagacacggaaattgtttaaaaacgtgtaaaggaactcataaagcattgccaaataggggccattttgcttagaggcaaaagcagctcctttcccaggggaatcaccaaggtatcagctgaggatcctttga

SEQ ID NO: 190666 - DNA, 382 bp, Homo sapiens
taattagtgctggctccaagcgagaggttttgtagccaacttggcatgggttcgtgaattttgattggcaaatttgaagcaaagttcagccaagctgtacatctattttgcagtgtgccttatgcacatccagagaagccaactcttccgatagatctttcagttttatgattgttggtagctgaagatattagctctttaaggaggcaaatgcttctggcaggctggcctgcactaggaataggagaaatgccttctggtttcttctaaaattaatgtaataagatgcattaatcagaattctatcaagtctacacacttggcccaggcttaagaagcaatactttgaaactgcagttggctaagcttccctattctttgt

SEQ ID NO: 190667 - DNA, 244 bp, Homo sapiens
attcattttgagctaatttctatagaagatgtaaggtaaggagttgtggattttttttttttgcatatggtgtctaattgttccaacaccattttttttcttttacactaaacaagtcctcaatatatacagcacgatttttaaattaaattacattttttttcttattactcaccactatactaacggggacagcaccatttgttaaagacattatcccttcttcatcaaattatcctggcac

SEQ ID NO: 190668 - DNA, 199 bp, Homo sapiens
tcattttcttcacagcatttaatcaccagcatttatcgtttgcctccctcaactgaatatgactgccataatgacaagaactttgttcactaggtgtatccaagcacctacaacagtgtctcaatagttgttaaataaatgaatgaaagaagaacagatattattctggcaagcagaaattgggggcagggagagggtg

SEQ ID NO: 190669 - DNA, 108 bp, Homo sapiens
atattgtatgtattttgctagatttatacctaagtatttcatttttggggggtgctaaagtaaatggtattacatttttaattttaaattctacttgttcattgctgg

SEQ ID NO: 190670 - DNA, 618 bp, Homo sapiens
agaggtcatttactcttcattcatgaagtacgtattgagcacctgctaaatgtcaggtgttctgctaggccctgggaactcggtggtgaggatgcagacaaggtccctgtccttgcggagcttactttagggtgggggtaaggatacgcaataaaaaaggaaaccactttaaagacaagttaatgatataatgattcttagggttttctggtaagggaaggtctctctgggaagatgacatttaactgaggcctgatgacagagtgatgtttcttgtgcttgaggttcattgagcttcttctttttatctgtggatttatagttggctctctctctctctgtctctctgtctctctctcctttctttcttctttcattttattttctttgtttttatagggtctggctctgttgtccagactggagtgcagtggtgcgatcttggctcactgcatgctgcttcctgggctcaagcgattctcctgcttcaggctcccaagtagctgggactacaagttcatgccaccaggcctagctaattttttaaattttttgtagagatgaggtttcactatgttgctcaggcttgtcttaaactcctgggctcaagtgatcctc

SEQ ID NO: 190671 - DNA, 291 bp, Homo sapiens
gctatgtcgatacgaatcgagccggagaagaaaaaagggttaaatgttatcggtgcttcagaccagtcacccttacaaagcccttcaaatttaagggataatccatttaggactactcaggtatatgaattgcatttgattattattttgtgtaaatctagtatcactgaattttggaatcagagttacatgagggtcaaaactctgcctagtaccagagttctttttttctttttttgacatggagtttccaggctggagtgcaatggtgggagccaaccgtggactagt

SEQ ID NO: 190672 - DNA, 269 bp, Homo sapiens
aaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagaggta

SEQ ID NO: 190673 - DNA, 235 bp, Homo sapiens
gctatgtcgatacgaatcgagccggagaagaaaaaagggttaaatgttatcggtgcttcagaccagtcacccttacaaagcccttcaaatttaagggataatccatttaggactactcaggtatatgaattgcatttgattattattttgtgtaaatctagtatcactgaattttggaatcagagttacatgattgataggtcttaaaaggtctgcagtatggatacttatttta

SEQ ID NO: 190674 - DNA, 169 bp, Homo sapiens
aggcttcaagagctgcagccaggagatgggagaggaggtgactgttctagtccagatgaatgatagtggggcctggactgggcagtgtccttggagaaagggctgaatttgacatccgttttggaggctgggccaactggaggtgctgggacaagggggatgactcctt

SEQ ID NO: 190675 - DNA, 369 bp, Homo sapiens
caagagtcatttttgactcctcctcctccttaccttgcacaacctctacttaaatccaatcactgaattttcagatctggaaagaactttcaagataatctagtttgtgctccttaaacataaataagagaccttggggctcagacatattggctgcttgcctcaagttcttccaaccctgattataagacactttctattaccaagacttatttaattgcatttttccaaaacttccacacaaatctttttttttttttttgagagggagttttgcactgtcaccagggctggagtgcagtggcgtgatctcagctcactgcaaaagagggttcaagcaattctcctgcctcagcctcccaagtagct

SEQ ID NO: 190676 - DNA, 500 bp, Homo sapiens
ttgaggattctggggggtgttcattgtgcagatacgttaggtatttcattatggaaagaactgaagcgtttctcagggaaggaaagaagggagataggagttcccgtgaatagaaaggatcgcgtttgaagcaagagggagtgctaaatagtagagaagatgcagggaatgcataatagaatagacagatgtagtataattaataaatattggcctaagtactgaagagttattccagatgggccgggatggcctagttccgaacctgtgtgggctgttcagtagatgacatctggtaagtgtgggtctgggccgtggttggggtcactgagaattagattttagtctgtagtttggtctgtgacattttagacgtgcaccaatgagtatgagaacctctgaagcagaccttgagaaagggtctggcctgtggggattccttaggctatggagcttcgattttagaaaatttgaagtattaacacttacccgaggttggg

SEQ ID NO: 190677 - DNA, 599 bp, Homo sapiens
aataggagcatgaggataaggcaaaaactcagagattttttatcagtcccttgagtccttagaatgagttagggtctggagctgtcaacctatgaaaaagaagtataatatgggctacttacctgcctcacagtgctattgaaagatgtaatcagggtctttaagattctttcaaataacaattctgtaaagtactcagagttatgtgacactagtttttagagaaaggttacacatttacatttaagagttaatatgaagctatataattggtaagaaaacccacacagattataatcaaatcccaagtgagtttattgtaattatatttaattcatcaaatgacaagaaatttaataaagactagggcctggcgcatctcctgaaaagagaaagattctgatcagtctagggtttgcatttttatttttctcattttaactttcaaatagaaaaactggaaattaatagatctgacctgagatccatggtgaagagaaaagttttggattttttatgtgtcttactttaagcaattcacagttcacttaaagcaatagtgctgaaagtctatttagagttgctttccaatgttgtaa

SEQ ID NO: 190678 - DNA, 172 bp, Homo sapiens
aggtgacatttgagctgacattttaggtccaaaagttaagagggaagctgccacatgaagacttggggaggagctggttattttcaaggttttttttcctccccaaaacgtactacttcctcagtctttcccagatcaaaatggcaccaccatccatttggttctgaaacca

SEQ ID NO: 190679 - DNA, 554 bp, Homo sapiens
atactctgtctcaagaaaagagagagagagagaggagagaagaaagagaggagaagaaaagaaaggaaaaggaaagaaaagaaaaaagaacttgggaaaacaaaaactagacccctgtttctaatccctcctttgagtgatgctagttaaaccaaacaatgaaaggatgtatggaaaaaatcaagggtggtgaagagataggctgcccatggtctcctggctagaaaagaatgtaaaatttctacagtagggacagggcacacagagtctttcagaaagcagaaactccccagtacaccagtcataacctttatctactctttctccaacacccccaaaagctgcttggccttttgaaggcctcagaactttgtgccaaagtatcttgagactcactttggaagtgtttttctctgcagttcaatttagacagcaacctttactgagtacctaccatgtgccttgccctttcagaacttgattttgaccaaagagaacatacacacaaataattccaataaaatatggtgagacttatcagtacaagagaactg

SEQ ID NO: 190680 - DNA, 598 bp, Homo sapiens
gagtccttggtgcccaatctctgccaggcagggtcctatcttgctaccccatgatccccacatgatgattgcatggagcagatgtcattatccccattgcagatctgggtctcctgggtccctcctcaaaataagacccattcaaaagacacctcctacaacacgggtctgaactacaggtctcccgaggccactatggaaggatactggcactcattcaacagcaaaactgtcccaaaacatcttctgtagacatctgtccctctccagcgttttgcttcttgtggcagctgttctcttttctccgtctctcacttctctctctactacccccttcttggatcccttttctcacaagagctctaggccaccatttcttactcagagtgacttcctgcttctctgatctgcccatcagttgccccagttagcaagatgaagggtcctcctcaggaaccaacctccttagaaagtattagaattctgtatgctccttattttatactctggctgggtcacattctaacaaggaaactgaagcttggagaaactaagtgtttctcaaggtgctcaacagagttgttttaggaagataaat

SEQ ID NO: 190681 - DNA, 479 bp, Homo sapiens
tgcaccagcctgcgaggttccgagcagagcacgtggcgaactctggatgcccaggctgctgacccaagcacattgggagatcattacatctgtgccgttttaagttgctaattggtggtaatcttttcatccagcaacaaaaaacctttagtacttcttagggcaaaataaccatgaagcataaaggaaaatgtcatcttccctgcacattctcagccccagggacctcttgcacttagtacgtactgaacgcttgctgagtcaatgaagacatgtgttttttcaaacctgactttttaaatggcagcttaaatattttttcctttaatagcttagtggttctctgactcctgttcgctgtccccacatcagaatagcaataataaggaatgattcttccctccccctgcaaatgtagctgcctggttaacacagaacacaagctctacagacctaataaatgtctggaaaacctcttg

SEQ ID NO: 190682 - DNA, 610 bp, Homo sapiens
acaaccaaccctgaaatatattatgccaagaaatcatggaactaaactgccctcacatcacagtctatgtctctattacctatggatggtcaatgactaatgctttgagggcattttacctgagaggagataccacagctacttctgtcttggagaaaccagccccttttcccatttatatgaaccaccccaaaaaaaaaaaaaaaaaaaaaaaaagcttctctgaagtcttcaccaaatcaatgattggctaaggttacttcttttgtttttgttttacctgaaactaaaccaaaagatcatttctttcctatgcaatatcatttgcaacaatatcaacatacagccactgttccaggtacactagtctctccataaactatgcattgagattaaacaggattattaaacaccacatctttactccttattgcaacagtattcctttctgttacctttactcaagatctcatttgatttctaccttcctaggaaacctcttcagttgatcacacatccaccccacacatcctttcctgtcggaattttccgttgtgcttacaacttacttcactatcataataaatttaggatgatgagatcctctaaa

SEQ ID NO: 190683 - DNA, 419 bp, Homo sapiens
catccatgtctgtcataagtaaagggtagggctggggggcagggagtatggtgggtgcagtgctgaggtgcaagagtgccatatatttactgaccccagtctaacaccttcttaaattagaccaagatctttgcttcattataaatactgaggcgttctttggcttaaattcagaaatattaaaaagcattttcctcactccaaaactggcttcacgtgatcactgcctgaagggatattataatggccatggctttgtcatctctcctgacccagtgatacacgtgcaaactcataattcactttattgtcttttgtgatctgtaatgctttcttcagtagcttttgtgtctatggtgcaatttttaagttttataataacctctatcttgttctttcctactgtgagattgtatttc

SEQ ID NO: 190684 - DNA, 399 bp, Homo sapiens
tttgatgattatgaaatatccttctttattcctggttataatctttattctgaaatctgaagtttactctgtttgatattaatatagcccctctgactttcttttgattcatgttagtatatttttctatccttttaaactatctgtgtctttattatttaaagtgtgtttctggctgggtgcagtggcttacacctataatcccaacactttgggaggccaaggagggctgatcacctgagttcaggagtttgagaccagcccagcaacatagcgaaaccccatctatattaaaaatacaaaaattatccaggtgtgcgggggtctgtcctgcagaccctgacccaatgatggatgaataacgtgcactgatacagatactctgctttgccagtctga

SEQ ID NO: 190685 - DNA, 269 bp, Homo sapiens
atgcccccatccagagctgattctctttcttaaaccacagtatcaacaccttttgaggcactttcttctacctagtactcagttgtgtacatgtctcatctttcccattaatgagaaaatcatcatgggcacaatctctgtcttggtcattttgtatgccctattttgctacattaattaaacttgtatttcactaaagcatataataaaaagaaaggggcaagaatctaaaagttaaaaaaaaacaggcttttagtatgcattcattt

SEQ ID NO: 190686 - DNA, 1898 bp, Homo sapiens
ccctttatgaaagatttttatttcaaattgcttttccttttattatttttagggcttaaaagacaaccttcttgcttctgggacatccagcctgacagccaccaaacagttgcatcgtccaagaatcacgagaatctgcctcagggacttgatattttgtatggaacaggaacgggagatgaagtattctcgagctctatacctggcccttctgaagtgaccactccactcttccatccagatccttgctatttactgccaaagaagacacaaagcattgttgcactgtcctgaaatttcaatttctggaaaataatcaccaacatgaaagagcattgtttacagttagaaactttattaactcttacctatccatctcatgggactcttacagactcagattcatctttgtcttctgaaaatcagttatgaaatacactttgcacagaattaggcatctgcctatctgtgcattaaattaaagcaagttaaggccctatttgttactacctgcctcatttgccaaattgtagcaggtgaggtgtccttccctaatacagcatgcattgagatgcaggagaaaggaagaggcataagaaaatacaagaatgactatttcattctatattgaacctgtcccaaagtggtaggttttctgggctggaatcagaagttgcttagctaactatgacagtcaccctctgtacgtgacaggccactgtggtgactttggtcggctgagttccagtgttgtcaaaacaagacaaatggggatagattgtgcctggggttgctaattctctgcttcatatcaccatatgccgtttctggtaccaagtgaggggacatgcttgtcagggaaaccttaaaattgaatctactgatatatcttgttgaaaaaatggaaaaggtgcaaagtattagaaggaacgttagggcgttgctttcaaactgatgagggggaatgtgaaaatggtatcataaaacaggaaatgtgcttcatatgcccaagaggggaagaggtggaatcggaactccaaaacaactggtacatgttttgttgatgggcaaaaaaaaatcacagcacaaccagaaaggagaatgtaccagatgttttcaaattagagtatttcaaaaggaaaatgttattttttgttttgtattgttttaaatcccaaggatagtttttatagttccttctgtcataatatattttagttatcctaatttttaagcatgttggcacatttaaaaaatcctaattgatgatgagaaatttttaacaataggactttatgttggattctgtacttaaaaggtactgtcaatatctcactcttggggatatgagctctaaatatgagaagcaagttatatgtgttcacctgaggaagaagctgacggacaaagcaaaccctctttaaaaaaaaaaaaaagaaaattccacgtgtgtggaatacagccggtgaaaaataatcactgtagttagaatcacatacagaaaaaaaatgattgaatcctccaagaaggtatttcaaaaatgggaaatgctatacttataagaattgaaggaaaaaaaaaaaaacacctcacgtatgttattcttcatcctgttcttcccattgggactgttatggccatattctacagtatagtaaattttaaattggccacatttttttttgtttcagcaagttatgtaaaatgctataaattatgtgtatgttaaaggagtactttaagaagagatctttatccaaagttgtttttgtatatttaaatgcttacctttattttttgtaaagtgcagcatactcatttgtgtataatcttactgatcagatgtttaaaattattccaaatacttcattaaaataattattttattataagaataa

SEQ ID NO: 190687 - DNA, 4203 bp, Homo sapiens
  misc_feature (1928)..(1928): n is a, c, g, or t
gggaccctggtgaccaaagtggctccggtcagcgcccctcctaaagtcagcagcggccctaggctgcctgctcctcagatagtcgccgtgaaagcccccaacaccacgacaatccagtttcctgctaatttgcagcttcctccaggaaccgttttgattaaaagtaacagtggtccgttgatgttggtatctcctcagcaaactgtaacaagagccgagaccacaagtaacataacctcaaggccagcagtaccagcgaatcctcaaacagtcaaaatctgtacagtgccgaactctagctcacaattaatcaagaaagtggcagtgacacctgttaaaaaattggcacaaataggaactactgtggtaaccactgttccgaagccttcctcagtacaatctgtggctgtgccaaccagtgtcgtcacagttactcctggaaagccattgaatactgtaactaccctgaagccttcaagtttgggagcatcatccactccttcaaatgagcccaatcttaaagcagagaactcagcagctgttcagattaatctttctccgacaatgctagaaaatgtgaagaaatgcaagaacttccttgcaatgttaataaaactagcatgtagtggatcacagtccccagaaatggggcaaaatgtgaagaagctggtggaacaacttttggatgcaaaaatcgaagcagaagaatttactaggaaactgtatgttgaactcaagtcttcacctcagcctcacctggttccttttcttaagaaaagcgtggttgccttacgacaacttctgcctaactcccagagcttcatccagcaatgtgttcagcagacttctagtgacatggtcattgctacctgtactacaacagtaacaacttctcctgtggtgacaactacagtgtcctcaagccagtctgaaaagtcaattattgtttctggagcaacagcacccagaactgtgtcagtgcaaactttgaacccacttgctggtccagtgggagcaaaagctggagttgtgacacttcattctgtgggcccaactgctgcaacaggaggaacaacagctggaactggtttgcttcagacttcaaaaccacttgtgacatctgtggcaaacacagtgaccacggtctcactgcaacctgaaaagccagttgtctctggaacagcagtaacactgtcccttccagcagtaacttttggagaaacttcaggtgcagctatttgtcttccatctgtgaaacctgttgtttcttctgctgggaccacatctgacaagcctgttattgggactccagttcaaatcaaacttgcccagccgggccctgtcctttcacaaccagctgggattccacaggcagttcaagtcaagcaactattctcattgtttcagtagttcagcagccttcaggaggcaatgaaaaacaagtgaccacaatttcacattcctcaacattgaccattcagaaatgtggacagaagacgatgccagtgaacaccataatacctactagtcagtttcctccagcttccattctaaagcaaattactctgcctggaaataaaattctgtcacttcaagcatctcctactcagaaaaatagaataaaagagaatgtaacatcatgcttccggtctacttttatatgcgtatattaaaatgttcaccatcggtctttttttctgtcgtgttctgtcatctcttggttggatgaagttcatctgctggtaaattcctcaggaaaggctcacagagatgaggatgacatcaatgatgtgacttctatggcaggggtcaaccttaatgaagaaaatgcctgcatcttagcaacaaactctgaattggttggcacactcattcagtcatgtaaagatgaaccatttctttttattggagctctacaaaagagaatnttagacattggtaaaaagcatgacattacagaacttaactctgatgctgtgaacttgatctcccaagcaacacaggaacgactacgaggccttctagaaaaactgactgcaattgctcagcatcgaatgactacttacaaggcaagtgaaaattacatcctgtgtagtgataccaggtcacagctcaaatttcttgaaaagctggatcaattggagaagcagagaaaggatttggaagaaagagaaatgttacttaaggcagccaagagtcgttctaataaagaagatccagaacagctgagattaaagcagaaagccaaagagttacagcaattggaacttgcacagatacagcatagagacgctaatctcacagctcttgcagctattggaccaaggaagaagagaccactagaatctggaattgagggcttaaaagacaaccttcttgcttctgggacatccagcctgacagccaccaaacagttgcatcgtccaagaatcacgagaatctgcctcagggacttgatattttgtatggaacaggaacgggagatgaagtattctcgagctctatacctggcccttctgaagtgaccactccactcttccatccagatccttgctatttactgccaaagaagacacaaagcattgttgcactgtcctgaaatttcaatttctggaaaataatcaccaacatgaaagagcattgtttacagttagaaactttattaactcttacctatccatctcatgggactcttacagactcagattcatctttgtcttctgaaaatcagttatgaaatacactttgcacagaattaggcatctgcctatctgtgcattaaattaaagcaagttaaggccctatttgttactacctgcctcatttgccaaattgtagcaggtgaggtgtccttccctaatacagcatgcattgagatgcaggagaaaggaagaggcataagaaaatacaagaatgactatttcattctatattgaacctgtcccaaagtggtaggttttctgggctggaatcagaagttgcttagctaactatgacagtcaccctctgtacgtgacaggccactgtggtgactttggtcggctgagttccagtgttgtcaaaacaagacaaatggggatagattgtgcctggggttgctaattctctgcttcatatcaccatatgccgtttctggtaccaagtgaggggacatgcttgtcagggaaaccttaaaattgaatctactgatatatcttgttgaaaaaatggaaaaggtgcaaagtattagaaggaacgttagggcgttgctttcaaactgatgagggggaatgtgaaaatggtatcataaaacaggaaatgtgcttcatatgcccaagaggggaagaggtggaatcggaactccaaaacaactggtacatgttttgttgatgggcaaaaaaaaatcacagcacaaccagaaaggagaatgtaccagatgttttcaaattagagtatttcaaaaggaaaatgttattttttgttttgtattgttttaaatcccaaggatagtttttatagttccttctgtcataatatattttagttatcctaatttttaagcatgttggcacatttaaaaaatcctaattgatgatgagaaatttttaacaataggactttatgttggattctgtacttaaaaggtactgtcaatatctcactcttggggatatgagctctaaatatgagaagcaagttatatgtgttcacctgaggaagaagctgacggacaaagcaaaccctctttaaaaaaaaaaaaaagaaaattccacgtgtgtggaatacagccggtgaaaaataatcactgtagttagaatcacatacagaaaaaaaatgattgaatcctccaagaaggtatttcaaaaatgggaaatgctatacttataagaattgaaggaaaaaaaaaaaaacacctcacgtatgttattcttcatcctgttcttcccattgggactgttatggccatattctacagtatagtaaattttaaattggccacatttttttttgtttcagcaagttatgtaaaatgctataaattatgtgtatgttaaaggagtactttaagaagagatctttatccaaagttgtttttgtatatttaaatgcttacctttattttttgtaaagtgcagcatactcatttgtgtataatcttactgatcagatgtttaaaattattccaaatacttcattaaaataattattttattataagaataa

SEQ ID NO: 190688 - DNA, 4083 bp, Homo sapiens
  misc_feature (1808)..(1808): n is a, c, g, or t
gggaccctggtgaccaaagtggctccggtcagcgcccctcctaaagtcagcagcggccctaggctgcctgctcctcagatagtcgccgtgaaagcccccaacaccacgacaatccagtttcctgctaatttgcagcttcctccaggaaccgttttgattaaaagtaacagtggtccgttgatgttggtatctcctcagcaaactgtaacaagagccgagaccacaagtaacataacctcaaggccagcagtaccagcgaatcctcaaacagtcaaaatctgtacagtgccgaactctagctcacaattaatcaagaaagtggcagtgacacctgttaaaaaattggcacaaataggaactactgtggtaaccactgttccgaagccttcctcagtacaatctgtggctgtgccaaccagtgtcgtcacagttactcctggaaagccattgaatactgtaactaccctgaagccttcaagtttgggagcatcatccactccttcaaatgagcccaatcttaaagcagagaactcagcagctgttcagattaatctttctccgacaatgctagaaaatgtgaagaaatgcaagaacttccttgcaatgttaataaaactagcatgtagtggatcacagtccccagaaatggggcaaaatgtgaagaagctggtggaacaacttttggatgcaaaaatcgaagcagaagaatttactaggaaactgtatgttgaactcaagtcttcacctcagcctcacctggttccttttcttaagaaaagcgtggttgccttacgacaacttctgcctaactcccagagcttcatccagcaatgtgttcagcagacttctagtgacatggtcattgctacctgtactacaacagtaacaacttctcctgtggtgacaactacagtgtcctcaagccagtctgaaaagtcaattattgtttctggagcaacagcacccagaactgtgtcagtgcaaactttgaacccacttgctggtccagtgggagcaaaagctggagttgtgacacttcattctgtgggcccaactgctgcaacaggaggaacaacagctggaactggtttgcttcagacttcaaaaccacttgtgacatctgtggcaaacacagtgaccacggtctcactgcaacctgaaaagccagttgtctctggaacagcagtaacactgtcccttccagcagtaacttttggagaaacttcaggtgcagctatttgtcttccatctgtgaaacctgttgtttcttctgctgggaccacatctgacaagcctgttattgggactccagttcaaatcaaacttgcccagccgggccctgtcctttcacaaccagctgggattccacaggcagttcaagtcaagcaactattctcattgtttcagtagttcagcagccttcaggaggcaatgaaaaacaagtgaccacaatttcacattcctcaacattgaccattcagaaatgtggacagaagacgatgccagtgaacaccataatacctactagtcagtttcctccagcttccattctaaagcaaattactctgcctggaaataaaattctgtcacttcaagcatctcctactcagaaaaatagaataaaagagaatgtaacatcatgcttccgagatgaggatgacatcaatgatgtgacttctatggcaggggtcaaccttaatgaagaaaatgcctgcatcttagcaacaaactctgaattggttggcacactcattcagtcatgtaaagatgaaccatttctttttattggagctctacaaaagagaatnttagacattggtaaaaagcatgacattacagaacttaactctgatgctgtgaacttgatctcccaagcaacacaggaacgactacgaggccttctagaaaaactgactgcaattgctcagcatcgaatgactacttacaaggcaagtgaaaattacatcctgtgtagtgataccaggtcacagctcaaatttcttgaaaagctggatcaattggagaagcagagaaaggatttggaagaaagagaaatgttacttaaggcagccaagagtcgttctaataaagaagatccagaacagctgagattaaagcagaaagccaaagagttacagcaattggaacttgcacagatacagcatagagacgctaatctcacagctcttgcagctattggaccaaggaagaagagaccactagaatctggaattgagggcttaaaagacaaccttcttgcttctgggacatccagcctgacagccaccaaacagttgcatcgtccaagaatcacgagaatctgcctcagggacttgatattttgtatggaacaggaacgggagatgaagtattctcgagctctatacctggcccttctgaagtgaccactccactcttccatccagatccttgctatttactgccaaagaagacacaaagcattgttgcactgtcctgaaatttcaatttctggaaaataatcaccaacatgaaagagcattgtttacagttagaaactttattaactcttacctatccatctcatgggactcttacagactcagattcatctttgtcttctgaaaatcagttatgaaatacactttgcacagaattaggcatctgcctatctgtgcattaaattaaagcaagttaaggccctatttgttactacctgcctcatttgccaaattgtagcaggtgaggtgtccttccctaatacagcatgcattgagatgcaggagaaaggaagaggcataagaaaatacaagaatgactatttcattctatattgaacctgtcccaaagtggtaggttttctgggctggaatcagaagttgcttagctaactatgacagtcaccctctgtacgtgacaggccactgtggtgactttggtcggctgagttccagtgttgtcaaaacaagacaaatggggatagattgtgcctggggttgctaattctctgcttcatatcaccatatgccgtttctggtaccaagtgaggggacatgcttgtcagggaaaccttaaaattgaatctactgatatatcttgttgaaaaaatggaaaaggtgcaaagtattagaaggaacgttagggcgttgctttcaaactgatgagggggaatgtgaaaatggtatcataaaacaggaaatgtgcttcatatgcccaagaggggaagaggtggaatcggaactccaaaacaactggtacatgttttgttgatgggcaaaaaaaaatcacagcacaaccagaaaggagaatgtaccagatgttttcaaattagagtatttcaaaaggaaaatgttattttttgttttgtattgttttaaatcccaaggatagtttttatagttccttctgtcataatatattttagttatcctaatttttaagcatgttggcacatttaaaaaatcctaattgatgatgagaaatttttaacaataggactttatgttggattctgtacttaaaaggtactgtcaatatctcactcttggggatatgagctctaaatatgagaagcaagttatatgtgttcacctgaggaagaagctgacggacaaagcaaaccctctttaaaaaaaaaaaaaagaaaattccacgtgtgtggaatacagccggtgaaaaataatcactgtagttagaatcacatacagaaaaaaaatgattgaatcctccaagaaggtatttcaaaaatgggaaatgctatacttataagaattgaaggaaaaaaaaaaaaacacctcacgtatgttattcttcatcctgttcttcccattgggactgttatggccatattctacagtatagtaaattttaaattggccacatttttttttgtttcagcaagttatgtaaaatgctataaattatgtgtatgttaaaggagtactttaagaagagatctttatccaaagttgtttttgtatatttaaatgcttacctttattttttgtaaagtgcagcatactcatttgtgtataatcttactgatcagatgtttaaaattattccaaatacttcattaaaataattattttattataagaataa

SEQ ID NO: 190689 - DNA, 173 bp, Homo sapiens
cgtggaataatataagaccacttatttgataaactcttaagaagttgagagcataacattaagttgtaattctggtaaagtatttgtgtagggagccaaaataatacaaaccacatatatatctttgtggtgaagtaatttgattacagttagaacatagaaaatcagtgtgg

SEQ ID NO: 190690 - DNA, 178 bp, Homo sapiens
agtttcatgattttagctcctatgtttttgatccattttgagttaaatttatatatggtgtatggtaagagtcctacttcatttttttacatatactcagttttctcagcactgtttattgaaaagattgtttttccccccattaaatggtcttggcacatctctctttcctttcttt

SEQ ID NO: 190691 - DNA, 442 bp, Homo sapiens
cacagggcaaccctggtgccagggaggctggcattcccgggacctgaacaagccacgtagggccaccggcatctgattacaggctactgtgacctcaaaccctggccggcatcctgcaggctctgggaacctgccgtgcctggagtgtctggggaggaccgagaagtcaggacagaaggcaccttagctattctctcagcctgtagacaccctgcattttgctgagccacactcagccttccagaacttgtatccttcagcccaggtctgcccccaggagccatagaggcgtgatgttgtctcagagccttctcttcacaacccacccatcccgtggcaggatgtgagtgtcatcctgctgcagtcacaggctggagcccacaggacctgcccttgtccaggggtgcattagtctggtcccacttctcctctcccgggcaca

SEQ ID NO: 190692 - DNA, 205 bp, Homo sapiens
ttaataactccaactcctccacatttctgctcaagcatcagtttcccagagaagcttttattggcttttatcaccaggtcaaattcctatctcctagtactttgtacagtccttcatagtgctcatcaagttggaatctgacacatatatatgtgttattatatcatctccctcactagtctaagccataaagtcatggatcatg

SEQ ID NO: 190693 - DNA, 528 bp, Homo sapiens
atagggtgtttacctctcgcaagctgttggtgtcactgctggctttccgagcctcagggaggaagagtgttgctattgtagtgaaagctccaccctgtttgttaatctgtcttaactctataaattatggactctgagacttagtctaattacaattgaaacgattctgaagcattgtaatgcagtgaagtattcaaagtaatatgaacattgcatttacatttttctaaatgtcaaattgacatcattctggcctcctaccatggcacaagttttaccaaataatagctaatctgacaacatgtggtacactccagtattttgttttccattctatttcattccatcccactccattccattccagtctgttaaaaaaaaattatttcacaaaccatttgaggaagccttaatgtgagataactcacagtttgagaaacactggttcacttaataaccacctacctgtatacagcactcttccaaagaagcagtctttgtcctttataaccgtacaccctatgcagc

SEQ ID NO: 190694 - DNA, 472 bp, Homo sapiens
agtgatgagcatatggtaaataagaatttaatagattttagtgaaagcaaaataaaaggtcctatcattgtccttaaggagcttacgaaaacagagctatacgcacatccgtagacagttaccacactcaggaatagtggaaaactgacaagaccctggagatgctgtgtggggagggataatgggaacgcaggtcagcatgctctaggaatggtaagagaaactcccaatctgaacggtagtcaaagaaggtcttcttctctttggagactgaaaggctgagagggtacctgccctgctaaggaaatgaacaggacggaagaatgatggagggagaatgggaagtcctcagcacataaaagtttgagctggaaatgaaatatacaactctgcatagtcagcagattttgctgggctgggccagttcagctcagcaaggattgctgggcatgtgcttgaaggagaaaggtga

SEQ ID NO: 190695 - DNA, 248 bp, Homo sapiens
actcgtatcctccactattcctgagtgtggtaactgtctacggatgtgcgtatagctctgttttcgtaagctccttaaggaaatgaacaggacggaagaatgatggagggagaatgggaagtcctcagcacataaaagtttgagctggaaatgaaatatacaactctgcatagtcagcagattttgctgggctgggccagttcagctcagcaaggattgctgggcatgtgcttgaaggagaaaggtga

SEQ ID NO: 190696 - DNA, 478 bp, Homo sapiens
gaaatacgtacagttttatttagtgctgagttattttttctgtatccagtcatccattaagagttatttttaatctaaacttagaaataatgtaaacatccaaaccaatagggaaatggtaagtttatggtacatggtagataagcagttgttaaaacttccttaagttcttcttacatgtggcaaaaaaaaagaaaagaaaaacttgtttaggagaagttttaaagacatgggaaaaatcaggccgaggcgggtggatcacctgaggtcgggagttcaagaccagcctgaccaacatggcgaaaccccgtctctactaaaaatacaaaattagctggggtggtggcacatgcctataatcccagctactcggaggctgaggcaggagaatcgcttgaacccgggagacagaggttgcggtgagccaagatcgcgccattgcactccagcctgggcaacaagagcgaaactctgtctc

SEQ ID NO: 190697 - DNA, 649 bp, Homo sapiens
ggtcatccgctacaccatgcggagtgcagtggtgcagtcatggctcgctgcagcctcaaactcctgggctcgggcgatcctcccaccttagcctgccctgagtacctgggattataggcgagtgtcaccatgcccagctaatttttaaatttttttgtagaggcacgggggtcttgccatgttgcccaggccagtgtcaaacttctgggctcaaacaatcctcctgctttggcctcccaaagtgctgggattataggtatgagccacacgcccagcctaaagctaagttttatgtcagtaaatctgtaattaggaaattcagggtctttattttccatttactttaggaacttgtacaagccatttattctacctgtttctatatcttaacttgcttcgtatcaatctttggaaagatcttgaaggatacacaaggattatgtattacttgtgaagagctctgtcttcataagaaattgaccccttctctttacaatagacactattcctaaattgaggttgaaatttttttcagtccattattgccagtccatgttagtcttcttccagaggctgttgagtgtagaattggattagaattaatctaattaattagttgtctacaatctactgcacgatattgtttcca

SEQ ID NO: 190698 - DNA, 457 bp, Homo sapiens
actaccttgatttgtactaagacaccaacagttatctccattgcttttgtaccatcagcacacaggtgaacacagtgaaaaagacaaataacatattattatttgatcttgaagatattttgagtactactagtttataaccaatccaaaaggtattattgttccgtttgttctggtgaagaagttatagttcagaaaacttaagagaattgttcagggtcacaagtcaagagatagtaaagctagaatctgaacacagcagaaatgattacagagcttattttctttatccgttccaagggagtagcacctaatagatgacagcaagtgtccattcccatccctcttgcctagtcaaggttggtaaaggaaagggtgttaaagtcttgttaagtcagaagtacagttggttaatcgcatgttaccattttaaagggaagttattttaaagaaatac

SEQ ID NO: 190699 - DNA, 658 bp, Homo sapiens
actcaaacaatttttcagtaatatgtgctctttaatggttaactgagaaggtggtaagcttctcagttgtttgtctaagactgcagtttttaattgtaattttggaataatttcaaacttacagccgagttactaatacagaacagaaatctcccatgtatccttcacccagatacgctgttaaaagaatatctatacagtagttccctcttaaccatgaaagataatgctccaaggccctcagtgtatgcctgaaaccataaatattaccaaactctacataaattatgtttctgcctacacattaaccgacgggtagcatatagagtagatacactgcacaaagggatgatacatgttccagatgagacacagcatgacggttcaaaatttcatcatgctactcaaaatggctgcaatttaagagttatgaattatttctaaaaatttccatttaatatttttggaccacagttggccaaaaactgaaaccaaagaaagcaaaaccacgaataaaatgggactactgtattttttcctttattcttgcacgacagtttagcgaagtatagaattcttggttgacagtgcttttccttcagttctttgcagaagacctctattgttgctgatgaaaagtagactatcaatctaattc

SEQ ID NO: 190700 - DNA, 325 bp, Homo sapiens
taaaacccaaattaaagtatgaactctgcccatatccctggcgactgctgtgagtatgcagggaagaccccaggaaccgtattaaaaaaaaaaaaaaaaagtggaaatcaaataagagataatccttgaaagacataactataatagctgagctatgcaagtttgctgctttttagaaaaactgaggaaattttctgcctgtgcttagcttgtgtgggaaaaactgaagtctttctgccttagttggagtcccataggaaatgagagataaaggggtcgaaaattatttgaagacagtggcagaaaacatcccttatttggttaa

SEQ ID NO: 190701 - DNA, 547 bp, Homo sapiens
aggcagagggcaaagtgtatgcttcagcaattgcaattgcgaggatggatacggtgagaggtagaggtgggtgggtggtgatgacactgctgaggaaaaaagcttacgactaactcccaggactttgggaggccgaggcaggcagataatgaggtcaggagatcaagaccatcctggctaacatggtgaaacccagtctctaataaaacaacaacaacaacaaccaccaccaccaccagcactaagcgcacaggaggaggaaaacctggattcattatccaacaaagaggctgaagcagaaaaaagatgtggtacttggcctaaaagagtggtggcaagaaaaccagaaagaacacatgtggcacactctgaagatcaattctacagaccttggcctaccagcaacaaaaatggtgatgttaattttaaaaagaaattcataatgagaatatggttgtggaacgagttcagcattcatttgttcaacatttaccaaatacctactgtatactgggcactgtctttgcgtgtgtgtgtgtgtgtgtgt

SEQ ID NO: 190702 - DNA, 563 bp, Homo sapiens
ccaccaatgtgagtcagttgttggttgctctctgtggggtgtggggcatggagtggctcccatggccaggaagctccccttagctgagggcagttctccagagaagggagtgagctgtcagcagcccaccctcactgcagccgggcgggtgtaccagccccaaggaggggactgcacctgggaagtttgcttaattctttggaccttgctttgctcatgaatctttccaaagtgagcataataacagcgcccacctcccagggtggggctgacggactgtttagcacaacagctcagaaagggcttgagagttgttatttttatgatgttaggattgcttgcaaactgggggtacatgctagttctttgaattgggttatccttgctaagtgtcatgtgcgtgcgtgagtgtgtgtgcgtgcctgtgtgtgtgtgtgcctgcgtgtgtgtatgtgtgtttagctctctttaagcatcccagagacaaagtggttctagatgagggatgagacagggtcaagaaaaagaaaaggaaagctacccagggtttggcaacattagac

SEQ ID NO: 190703 - DNA, 524 bp, Homo sapiens
cgtcagcaggatccgttggtcgatcactgtactgtgtcagagaggaaattcagtaacaatataaaatatctgcttttcagaagcatatattcttgttgaagaaaacagtagacactaggcagcttattaagcaacataatgtgtgacctgaaaatataggtgctattgaaagtaatgaaacaatgagatcaagatgggtggggacagttaagaagggggttttctctcatcacctctttcttcttactttacaatctaattccggtctttactcaattgcaattgtaccttgaagaatactactgacttaattgtcaaggccttactattcaaaggcctttttcagttttcaataagcctcacccccttaaaatacaggacacaccgaccattccctacttattaagaatctcttctcctggcttctcagacaccaccttgttatgtctttagtatacttctgttttctttttttttattattaagatgggtctcgctctgtcgcccaggctggagtgcagtga

SEQ ID NO: 190704 - DNA, 228 bp, Homo sapiens
atttcttgatcgatgaaaggcaggtccaaggatacagatgcagagttgatacttttgcagaccagtcacacagagtgattcctgctaggtaaagcctagcacagtacactcgcatagatgatgcttaatacacatttgccataaaggatagcacccagaacaatgtaacattttaaaaccagtctggatagaattctagatatgtaaccatcatgaaagctttatttc

SEQ ID NO: 190705 - DNA, 541 bp, Homo sapiens
taatcctacttcagcaatcctcaccaagacctgggggtctgggtgaggaagagaaatttgaaggagaaacagaaaagtgatgctgaagaaaatggtggcactgtcaggcagaagcaggaagcaagggtcttggtgaggggcaaaagcaggaagcaagttcttcctcctggtgggagatggataggggaggcagtaagataaactgaggcgatataagtaataagatgaaacggggccatgtgatcacccgaccccagggcagatggagggtgtggggaccgccacaggaagggacaatggaatgaaccccacagggcgagaaggggcagcctgcaagagacgggggtggggaggcccagtgagggcaggctgaggggctggcttgggggctgtactgggtcagggccatggactctgttgttggatttgctatgatatcctggtgctgcccccacccagcatgtaatatgctcaggtggattctctcccaagcccagcttcatgggctgaaaaagggatgggctgtggaggggagaggaga

SEQ ID NO: 190706 - DNA, 163 bp, Homo sapiens
aatgagtaaggccagtgcttttcatcaccatgcatttctagcagccacactggctataagccctcattcatggataccatggtacagtgatttcctggtccttcataagaattaactttaaccttatttcataatctactttattctcatccaattgtcacgt

SEQ ID NO: 190707 - DNA, 195 bp, Homo sapiens
tttaagtaattctttcttcttttttatatccccttaaatttatggaacttctgaaatgaatctctctcacaggcaacaattttagttttcaatgtaacaaagtaaatttattcacttagttagtattgcattccattttacagaagattcgtatctgtgagtttccccacctccttgctcaagctcttcccaagc

SEQ ID NO: 190708 - DNA, 510 bp, Homo sapiens
cagaatgattggataaatttaaaattatattttagtaatcactggtaatgtcattgcaaagatatgaacttgcatgaaattgttctggcccttattctgtaatgggcattgccatctgttcagcataatcagttctttcatacttccctgataaatgaaaacaatacaaatttctattgaaacaatatatcagggaaagaatatgttctactgaatgaggaaactaaaaaaagaaagtcatattcagcaacctgggatgatttctttcaattttaaaagttctgagaccaataactttccttaagaggaaagctttataaaattggttgaaaattcaacaaaaaatagctcctgttatcaagtccataagtatcttatgtccatttaaaaactgaaggaatagctttttccataatcctttgacatttttatgcgcactgcttccatgatcaagccatttggcagtaataaaacagaaagctggctcaaccattatcctccacattaaaa

SEQ ID NO: 190709 - DNA, 216 bp, Homo sapiens
cgttgtcagtgctaccattgataaagtccagcttgttgaaagtgtctggaaaagtaaatctctcaattaatttcataaaaggctattactgaaatcagcatgaatatttccatgtccagccttggatatgcttaggtctttgacagcttgactatctctatgattgggcaacaaggacagggttttaaaggacaatgtctttttactctattgctt

SEQ ID NO: 190710 - DNA, 580 bp, Homo sapiens
gcctgctgctcacttgctgctatggggcgtgattcctaacaggccacagaccagcagcggtccgtggcatgggggttggggaccgctgctttagtgtgatgcagataaagatcatgagaagcaagccacacgaggaagtaagtaacctgttgctattattggtatggaaattgagacccatggaattttgacatgctcttggctatacacatcagaataattctcctagaagagatgtgaagacttacatccaggcgttctgtttactacaagaaaacaaaattaattgagtcagagttaataatctggatgcataaaatatatattgaaaattaataggctgggcatggtggctcatgcctgtaatcccagcactttgggaggatgaggcgggtggatcacctgaggtcaggaatttgcgaccaacctggtcaacatggcaaaaccccgtctctactaaaaataacaaaattatccaggcctggtggcacacgcctgtagtctcagctactcagaaggctgaggcaggagaatcgcttgaatccgggagatggaggttgcagtgagccgagatagcacc

SEQ ID NO: 190711 - DNA, 460 bp, Homo sapiens
attccagaaacagtataccaccacgtggtaaaggcttacatttgagccttagttattttggagatcattttcattgtcacctatcatcatggcctcccaaagtgctgggattacagatgtgagcaaccacacccggcctacatttggaattctttgtcacatttggtttagcacaggcaatccgtgttgagccttagcattcattacattaataaatggaatgaatacgttcacctgagacaattaactagcttctgctagtatttaatgctcaatagtatagctgaaaagatgataattaaatgggattttattttattaaaaaacataacttcctcagctgagcaagggattttataactttaaaacaaccttattattgtaaacatagtatatattattattgaacattaggagatgacagaaaactaagaaaagtaaaggaaaaaaaaggactgta

SEQ ID NO: 190712 - DNA, 365 bp, Homo sapiens
gccctagaggatccggtcactcatccatgctacacacccggcctacatttggaattctttgtcacatttggtttagcacaggcaatccgtgttgagccttagcattcattacattaataaatggaatgaatacgttcacctgagacaattaactagcttctgctagtatttaatgctcaatagtatagctgaaaagatgataattaaatgggattttattttattaaaaaacataacttcctcagctgagcaagggattttataactttaaaacaaccttattattgtaaacatagtatatattattattgaacattaggagatgacagaaaactaagaaaagtaaaggaaaaaaaaggactgta

SEQ ID NO: 190713 - DNA, 541 bp, Homo sapiens
agactagagagagccatcaaggaaagttgatcttgaactcagtttggaaagatgattacgagatcgtttaaagaaggcacagtggcacaaaatagagtcatattggaagaacagatggattaattgcatggataagagaagtaggctgctgactgagtccaaaacaagaagcctgggccacacaatgaaagatcttaagaccaaatttaggagatgaagaacagctatttggatgtcttctggttttcttaaactgaattcaaaactaagatggattatctcctgtgttcacagaacattcctaattggacttctgacaatccaggtttgcaagtttaaagctaatggtcctctttatctagctgctttttgtttttcaacatgcatttccaattaatcatcatactgtattgcctttacaccacgaatgtatcacaattcagcgtttaaatatagttatcccttcaattgtcctttctaacactgctccttattcatcacttactcagaagatttcaacaatgaagcggctcccgtgcat

SEQ ID NO: 190714 - DNA, 142 bp, Homo sapiens
ggctggagatgtatttagctgtgcagcagtgactgctgttctgtagagttctaaggcagcattacagggagaagccgtcttgaactgactctctaggtttgttgctattgtagtgttcggttaaaaaattcaagcccttggg

SEQ ID NO: 190715 - DNA, 944 bp, Homo sapiens
ttcccccaataaaaagctctggggatgaaagttcttttggcttttatcttttcgatttaaaaatttgagaagaaaaatgtgactagagatgaatcctggtgaatccgaaattgaaacacaactcccccttccccttcctatcctctcggttttagaaccgcgctctcccgccccaggagattccttggggccgagggttttccggggaacccgggcgcccgccccttctactgtccctttgccccgcgggcacagcttgcctccgtctgctttctctacttctggacctctcctcgccgggctttttaaagggcttctgcgtctcaaaacaaaacaaaaaaaccctttgctcttcccaaccctttcgcagcccgccccagcggtggcgcgggaccagcaaaggcgaaagccgcgcggctcttgccgggcgcggacggtcgcgcaggggcgcccgcggcctccgcacccggacctgaggtgttggtcgactccgggcatccacggtcgggagggagggctgagctgttcgatcctttacttttcttcctcaaagtctacctgccaatgcccctaagaagaaaaccaagtatgtgcgtggagagtggggcggcaggcaacccgagttcttgagctccggagcgacccaaagcagcaactgggaacagcctcaggaaagggaggtcgggtggagtgggctttggggcaggagtcatggggcccgggccccggggacgacctggcgctcccggccctgctgaacgctgagttgcgcctagtcgggttttcgaagaggcccttgcgcagagcgacccacgcgcgcggcagcatcttcgattagtcaggacatcccagtaactgcttgaactgtaggtaggtaaaattcttgaaggagtatttgctgcgtgcgactctgctgctggtgcaacggaggaagggggtggggg

SEQ ID NO: 190716 - DNA, 459 bp, Homo sapiens
accacatagatagtcaccgctccctcctcaaactccctgggagtgcaaagggctggatctgcactgaaagtgagatttaagaatgagaaaatgcaggagagacactccaatgggaaaaacccatcacatcccatgacaatggcaaccagtcggtccctgctccaaaaggagaggactctaagcagttcgtcaagagcccaaggacgtgggaggaggcctcttttcagaggagtgatggcttcctaagaacaacaatggccctgtcgctttttcagcttcccattaattttccataaagagcagttttcttgacgagcgcttgtgtcaggcagggcctgatgcttcagaaacctgtaattattcttggctccccaccccctacagcctctgcacctgtgtcagttcaaggcaccagctggccatgtcttgccccctgcctcttaagagggggagcggtgg

SEQ ID NO: 190717 - DNA, 411 bp, Homo sapiens
agggagacttccagaatggaagctattcttttcactagttgtgatggttcagaatggctgctaggaggaatcagaatatgactgagctgctgcttgttgttctgcaagggaagataatgtcctacaatggagatgcctggatgcatttttagctacgaggtagctatccttattaggctcaaagcagaatgcatttaaataggtcttggttgttttctatgacaagctgttatctctgtgatcttcagtaagataagtaaattttctaagtcaccctctttaaatcttattttgtggtatgatgatcatacattcagggtacctagcatataatgttcaaaatagtagatggttattgtttcattgatcaaaaagattaggtatataatctattcttccacagcccccttc

SEQ ID NO: 190718 - DNA, 116 bp, Homo sapiens
acagtgagctataaggtcctaggataaagagtggaagtcctagcttccgaagcctttgtagactggaccttaagctctgagggacccaggtgaacatctctgagaaccaatcagac

SEQ ID NO: 190719 - DNA, 172 bp, Homo sapiens
aaaaggtaaggcacagaggtgagtcaatgcagcaatcaccagcagcttgaagttgtcagtgagtaaagcgtaagtcaggcagtcccaggagaggaggctgcagatgaagttcagctatcagaccatggacacacgcttgatcctcatatacccccagggtttaaattctcag

SEQ ID NO: 190720 - DNA, 407 bp, Homo sapiens
acataaaagtatgaggcagtaggaaaaaaacatgcttaatttcatcaactattaatatgaccttgtattcagaatatgcatgatgtcaggcacataacagatactcaaaatatatttgttggttgaatgactgagtcttgcatattttcagcatctgagttgtgcaaagatcttagctttcttttcatgaaaagaacactaacagttttactaggactaggtgttttcttgccagaagaaatgcttttaggcatatgggaattataataagtatcccaatatgaaatttccttcttcagataaaaaatgaaaatgtcaagatggttccatttcttttcaatcttgcccttctcctttctcaaagaaagccttgctgtttctgaacagtcattcatacatacatctat

SEQ ID NO: 190721 - DNA, 562 bp, Homo sapiens
tgactatagtcaataatttaattgtcacatttaacataactaaaagaatataaccgcattgactgtaacacaaaggatggttgcttgaggacatggataccccattttccatgctgtgattacgcagtccatgcctgtaacaaaacatctcacgtaccccataaatacatacacctactatgtacctacaaaaattaaaaattaaaaaaaagaaaaggagggaaaaaagaatcccttccagagtgaaggaatagggtaaatgacaaagaaagaagaaagagcatgaaggtttggtgggagagtgagagtctggctgtgctagaatgtaaactgcaggcagaaaacagttggaaatgtggttggagaggaaaattaagctgagtttggatttcaggccaaaggcaaggtaataaatagagggcaaagatgactttagcatgctaggttgcttgcagaaactgtgctgaaattaaactttattttccaacccagactgttaaaccaattgtgtttatctctaagacaaaactgatctgaaaacctccctgagaaaatgtccatt

SEQ ID NO: 190722 - DNA, 459 bp, Homo sapiens
gccacatatggaactaataagtcaggcaataagtggctttgtgtgaatgaatacagtttggaagggtggggacatgtgtgtgtgttgtctaaactgcatttctcctgtgccaaagccgaaatgacacaatgattcctgaatccccagaggctttcctggcctggaaaaattgtgtttaaaaaataaaaataaaattgagcactttgatattaaattaaacctctcagctcaataggaggatgcttactgggtgcaagaacacagcattattcccaacagtcaagagatggaaagcacccaagtgtccatccctgaatgaacagataaacaacatgtggcatctacacacaacagaatgtcactcagccttaaaaaggaagggaattccagccaggcacagcggctcacacctgtaatcccagcactttgggaggccgaggcaggagaatcacttgagtg

SEQ ID NO: 190723 - DNA, 354 bp, Homo sapiens
atggaaagcccctgacataagctagaagtatctggggtccacagaaaggcctggaaaagaagcaaagaaaagatggagtttttttgttttgttttttagagatggagtatcactctgtcgctcaagctggagtacggtggctccatcgtagctcaccgcagactcagctgcctggactcaagtgatcctcccacctcagcctcccaagcagctgggactacagactagggctaccacacctggctaatttttgtatttttcgtagagacgaggttttgccttgttgcctaggctgatctcgagcttggtctcgaactcctgggctcaagtgttctgcccacctcggcctgccaa

SEQ ID NO: 190724 - DNA, 290 bp, Homo sapiens
gctgctagtctacacaaatatcaaatatatgagatcaaaccttttgcatcacattgaggcacaaaagcagagggcaggaaaatttgtatgttgtatgttattaatcctctaagaactcaataatctatgtaggcatggaggtaaattttagcagaaagaacccgataacttatgaaaaaattaagaaaagcaagcaatatgaagaaaatgcaaaactaaccaaatttcttcagtttgtgaggtgtagtgtctgtggtctttggggacgcgggatacattgatgatgaagg

SEQ ID NO: 190725 - DNA, 122 bp, Homo sapiens
tttagcaagtgagtcacccaaatgaccatcaaacaagcaagtagcagagatgggacttgaagccacaggaccttggctcctgggctcttacccatgaagctacactgtactcctaaaggcaa

SEQ ID NO: 190726 - DNA, 419 bp, Homo sapiens
catggacctttggaaacctaaccccaatgagaaatggaagagacagcattgctgtggactgtcacctctgcaagagtgggactgtccctctttgcagacatgagcagctctctgcccccatctttgtacaaacacttcagatatacacacttggggctttcaactaagtctctgttcctgctactgtgtctcctgaagaatactggagtcagccatgcagcactgtcacatggggattcaggtacccagctttgctggtagacaaaacacaggaagcccactgtttactaagctccccatagttcaagaggcccctgcaggggaaagaagatggcagtaaggtcaaggaatcaacatcaaggactcatcaagctgaggtatgcagcaaagtaaagatggaggccagggatggccaccag

SEQ ID NO: 190727 - DNA, 257 bp, Homo sapiens
tgctaaccatattacagtaatttttttcatttattaacaaatatttattaaattgttgctatattctacgcattattataatctccagggatagacaaaagctctttccctattggagcttacttcctggtatgggagagataaacaataaataataaactcagggaataagtaattatgtatacgtaagaaggtgataaattccatggaataaggaagaccaggtttaatgtttagtgggtggattgaagttttaa

SEQ ID NO: 190728 - DNA, 305 bp, Homo sapiens
agatgcattaaagcaatctttgtctatcaagttatggaggtgtatctaaattttatgccttttatagatttccttccatgttaactatacagtgaatcatgccccataatcttactgatcaggtttataagaatatcatgttagctgtaggtaacagagacccccttttatgatatgaagcagtgttgttgttgttctttgagatggagtctcgctcttgttgcccaggctggagtgtaatggcacagtctcggctcactgcaacctccgtctcctgagttcaagccattcttctgcttcagcct

SEQ ID NO: 190729 - DNA, 341 bp, Homo sapiens
tgggctttgaagatgagggaggcgaatgcaaggagcagagatcagcctttaggagctgtgagcaactccccactgagagcaaggaaggcagggacctcagtcctaccaatcataaggaaataaactctgccaacaacttgaatgagcttgtaagtggattcttccccagagccaagctttgattttaacctcctgagattctatctagagaaaccagtagagaccctctggacttctgacttacagactgtgagatagtaaatgagtattgttttaagatgctaagtctgtagtagtttgttatgcagcagtagaaaatgaatataaggccgggtgtggtg

SEQ ID NO: 190730 - DNA, 908 bp, Homo sapiens
gtgggagaattgcttgagcccaggagtttgagatcagcctgggcaacatagggagatccccgtctctacaaaacataaaaaaaaatttagctgggcttggtggcacatgcctgtagccctagctacatgggaggctgaggtgggaggatcgcctgtggctaggagttggaggctgcagagagctatgattgcactacagctaggaccacagagtgagatcctgtctctattaaaaaataaatgaatgaaacaggagatgtggctgtggtaggtgagggtgggagggggagctatcttacctccattgttcagggacattctctgtggaagtgacatttaagctgagacccctctccctctcggctcttccttacttccttctgctttttctcctgtgaactcttccgttcgcttcagtttttgccctggagttccccctgtgctctggtctgtggcttctctatttctttttttgagacggagcctcgctctgtcaccaggctggagtgcagaggcatgatctcggctcactgcaacctccgcctcctgagttcaagagattctcctacctcagcctcctgagtagctgggattacaggtgcccgccaccacgcccagctaatttttttgtatttctagtagagacggagtttcaccacattggtcaggctggtctcaaactcctgacctcgtgatccgcccacctcagcctcccaaaatgctgggattacaggtgtaagccaccgcgcccggctggcttctctatttctcaacctgtgtctccctcgaggagccagttgctgtcttgtaactgcctgcttacagcatccgtctctcctaccaggctggagctctggggaccacatcctattcactgctctgtccccagctcctagcagtgtctgttt

SEQ ID NO: 190731 - DNA, 413 bp, Homo sapiens
tatggtagcaacgaggagaatacctcaaagtacgtgtcatcctcccttataaaagcaaacagaagaggacaattatgtctcttttccttatgtagccatggagctatctagttcaaacacagggcttttgctgatacagcacggtctgttctagtagtctaagtttatttcctatgatgagcccttatttagtaaaacagcatcttactctactctaccaaagtcctaataaatagaaacatgtcttcatcaactgtgatttactattgagatgcctcattaacacttctgacttatagctaatctacatatgtctaaatccaaagtgttaatgtgtgaatatcctactagaaatgtgaaagtatgatagtctgtaaaaagaacacatccacaaacatctgaaaatcaaacaa

SEQ ID NO: 190732 - DNA, 373 bp, Homo sapiens
gttgggcatattgtcatgttatctaattcatcttcaaaataatcctatactaccatccctatttttcagacaaaaaagttagaatcggattacataacatgcttgccatcatataagctagtaaaatgtagagcttgaattcagatttaacatattttatttcctcatgtaggcatctttccataatactgtaacaccttaataatgatggcgattattacaacaatgatgaaaaaataataccattaatataacaattctgttaccacctggcatcagtgaatttataacattttctcttacattgtctcatgcttattctcatttcatacacaattgtttaaaacatatatttatatactaaataagcatc

SEQ ID NO: 190733 - DNA, 224 bp, Homo sapiens
cagtactacaaaaatatcttcatgaatattgtcttctttcatataatttcatccattatttatggttcttagtatgcattattaaactgctttcttaagattgtacacttatactttccattaatcctgtagagtataccagctctacaacactctcattctgcagtctgtgctagagtttcttttactaacttatttttcctcgcttctgttaaagaaaactt

SEQ ID NO: 190734 - DNA, 548 bp, Homo sapiens
attagaggataccgtggctcactgcaaatagactgtaactcagatggactcgggacaagccgtgaactgagtaacgcaaggaaggagtggaccctcatgttcagcagatgccaatacctgtgtggcctcctctgctcccagttctctaacatggtacatttctgcatcatggggtagaccagactagcccttctgggggattcagctggtcctttgccctcattttgcccatctgttgagtgcctttgtggtgagcaaagtcttccctagcatcttccatttccctacggagggttggacatcctttgcagttcatgcttggtttgagaagtagagctggcatccttctctcctccccatcaatgtaactgtgaccctcaccttatcctgtgggtagacttaggacatatgctaggaagagcaagccccgagatggtaaacaccttccaggaaacatgtgtagggctaacttggaccccaggagcccataagataagagtaccccaaagagacacgtcagtattcctgctctgcatgataccactctg

SEQ ID NO: 190735 - DNA, 257 bp, Homo sapiens
caggagacattaactcaactacataaatggatgccttagcacattagggcttcattctctggcagaatcctcagtggagcaggactgcagagggagaggatgagggaaaatgaacacacaatttctgccacataaaacaacgtatatgaatcacagccatattcatgtaaaacaaactggaatgcagggggaaatcatctgtggtgacggaggtgaagacagtgaccactctcaggagaaaggggctttcctgggac

SEQ ID NO: 190736 - DNA, 180 bp, Homo sapiens
gtatgacttgtaagcccctgctctgggatagcctgccgttcaggctgaaccaaacgtataccttccatgcactgacttacatctttgcctgtaactcctgtttacctaaaatgtataaaagtaaactgttaccagccaggcacagtggctactgcctgtaatcccagcactttgggaggc

SEQ ID NO: 190737 - DNA, 125 bp, Homo sapiens
gaatgttagttattagcattttaaaaggttctacttcagcataaaggtcatttccaatcaatgggaggtccaatataattaaaaggtgcctaaattattattgaggaatcactttctttatgtca

SEQ ID NO: 190738 - DNA, 311 bp, Homo sapiens
tttaggctaacactaagaagctgcaccatgttaatattcaaaaattccagtactaaactatttgaaggaaaggcaagaaattcacattttatgcaagcagcatgtaagaaacacttgtggttttttccaaaccaaaaaatacaatgctaacaccactgccactttcacacatctttgtgtgatctttgaaagtttcacagaccaagtaatgttttgtttccaaatgtgaattcattgtaagtggcttgtcattgtaaggggctaatttgacagcactcaaggttgcggcagtaattgcccttacttgttaa

SEQ ID NO: 190739 - DNA, 273 bp, Homo sapiens
ttcatgtcatctctggataacttttgattgtttgatttttctcctcattagtggttgtgttttcctgcttctttacatgcctgatagttttcaattaaatgccagacattgtagatcttccttgatgggtgctcattatttttggatttcaataaatatacttaagctttgttctggaagagttgttacttagaaatagtttgattcattctggctttggttttatgatttgttgggaaggtctggagcatgctcagtcatgggttagttatt

SEQ ID NO: 190740 - DNA, 1054 bp, Homo sapiens
attaaattaagggttgttacagaattatgtcaagtgaaaaaaatgtataataaaatcggctaatttctttgtagacattggccaattaaagggagaaaagcatagtttctacaactagtggagtaaagttattagttgataccaatggatattagcagaaaattgatgaaaggttttaaattttggctctatgggattccatttttgctaaatgatataatattctcatggtaggaaaaaagttctctgatttacataaaatgcgggtatagcaaaagcaatggtattttaacttaacaacagccctcaaaacacccttataatgttcttggaacaaatgctgtaaaagctgaaagggttcattcctaggtgttcctattggcactattactagtgctaatagaaagcacccagaaaactgaatcagggagataaactataccttcacacaatacataacaacagtaataatcatagtactttgcattggcattatgttttacagtgtacataaacatgaagtatgcccttgaacttgagtatattacataaaacacagatggagtgggcagcttcaaaggaagtatcatcattatttatcatttttgtctttctcatttccaaggttagaaaactgagatttagcgaagttatatgacttatccaaggctatatctcaatactattggaatcaaaagtagatgtggctgagtcttctgaattctagggcaaagtgttttctcaagtaatactgtctcaactgtcaagagtacagttctaccttataactgaaactatcgtaggtatcagaagagggactatatcaggagggcaggcggaggagctccatcatgatggtcctaaaccttgaaagatgggtaatgcttaactaatacaagaaaaaaatgaaagaaattctgagcaaggcaacaccttggataacgattagaaaattaacatttgttgactgatttaataagtattaagcactcataagcaccagctagtgttctaggtactgcgatttggcattgagcaagagacaccatcttag

SEQ ID NO: 190741 - DNA, 267 bp, Homo sapiens
ctgctatacaccatgaacaccatgagtcaagccgcagagccaggtgacctctcagatcttcttcctagggcctgagccaaacatcacatggtttcctatgacatgaggttagatcatcttcaccaggtggtaacctttgagtcaagcagtcaacttatatttagtgagctcacctggtcttgcagcagcaatggttccaagttactactgctgaagcaaagaaagaagtatctcatacctaacaggggggtggtatagggtggtata

SEQ ID NO: 190742 - DNA, 667 bp, Homo sapiens
ctcatgcaaaaatatacatacacacaacctgccacagtatgctaatgcatcaaaggcctttctactctgaatttaaaacacagtttttttaagttgcaaaagatagtcaaataatctgggcactgccaggagctaggattgatgcttacgaaggccccacatgctgcagtgacggttccaaatgccccattcccaccgttcacagttaggtaaaacattcaacgtgcaaagactctcagagagatgctgattcagtcccatggagcttctcaacagacaaaactttccactgttgttgtcaaccttgggagtaatgttcaggatgaggtggggggtcctggaatcatacaagaacatgccctaatcccaaccctggatttcaaaacaaggccgttcttgttcctgcttctgtgccccaaaatatgtaacacctaaaatggaggactcgacagcctcaacccaatgacatgactgcagtttgggcagccaacagcagaagggtcatgaccagcttcattgggtggaagttccagtagtcttctgcaattcccaaaggaactgcagggcacctctgtccacagagcctctggggaccatggtcgcggaatgctaagtgccagtaacataagccacctgaatggctgtggatttgcctgtattcccacag

SEQ ID NO: 190743 - DNA, 645 bp, Homo sapiens
gctttccaaaactatgggaaataaatgtctattgtttataagccacatagtttattagtttttatcacatagccgaaacagactaagagaataatgaaataacaaagaagcaagagaaggaagtgtgccttgcttgggcagagaaaaaaaggagaggaaagagggaaaagtagggaggagaagagaaaagagggcacaggaagaaaaattaagaatgtgaacacaaagggtaaggacagaagggaacagagataagagaagggtgctatggttggaatgtcctcccaaagtgctaggattacaggcatgagccaccgtgcccggcctcattttgaaatttaattgtcattgtaacagtattaataggtggaacccttaagagatcattaggccatgaaggctacaccctcttgggtgggattggtgctttatgaaaaggcaagtatggccctctccttcccctctctttgcttttctcctcttctgttgggtgaggaatagcatttctcctctgtggaggatatggcattcaaggagccatgttagaaatgaggagggggccctcaccagacaccaaacctattggcaccttgatcttcccagcctctagaactgtgagaaataaatttatgtttcttataaatt

SEQ ID NO: 190744 - DNA, 159 bp, Homo sapiens
gggggacttaatctgacctgaccacgatatcaaatttatagtggatattcatatgttttaagatacttacatgaaactcagtcagaggtcaattcttttctcatgggctcaatgtggattgtcttaaatttcaactctttcaggcaacaacatcctaat

SEQ ID NO: 190745 - DNA, 351 bp, Homo sapiens
tggagtggaacagggcttggcacattttttcttaaaggcagattgtgagtattttaggtcctgcaagctgccaacaggaggatcacttcataaccactcactaccagtgaggccgaaagccgctgtaacgacacagacgggcgccgaaagccgccgtaatgacacagatgggcgctgtgttccagtgaaactttaccactcactaccagtgaggccgaaagccgccgtaacgacacagatgggcgctgtgttccagtgaaactttaccactcactaccactgaggccgaaagctgccgtaacgacacagatgggcgctgtgttccagtgaaactttaccactcactaccac

SEQ ID NO: 190746 - DNA, 142 bp, Homo sapiens
ctcagcgtgcttgttacagagcacctgctcaaggactgctggctcaaaggccctcttggccaccccctccctcctttcacatgagtgtctttggttttggcactggtctcccaaacactgaccatcctcaatttgcccaggc

SEQ ID NO: 190747 - DNA, 473 bp, Homo sapiens
atctgcttttcaaaagaacccacatcaaggaacataatgatgaagaattaaatacacagagcaaaagaaaacaccctaaagcctcctggggcaagatgataggtcatttgcctttacgggaagcagaaaaaactttagacttctcacagcaataattgagcaatgtcttcaaaatgttgagaaaatgggcagggcacagcaactcacgcctgtaatcccaacactgggaggctgaggcaggaagatcacttgaggccaggagtttgagaccagcctgggaaaacacattgagaccctatctctacaaaaaataggaaaattggctgggtgtggttgcatgtgcctgtcctcctagctgctctggaagctgaggcaggaggatggcttgatcccaggcatttgaggctgcagtgaaccatggtcacaccactgcactctagcctgggcaacagagtgaaaccctgtgtcttaaa

SEQ ID NO: 190748 - DNA, 643 bp, Homo sapiens
catattattccttcttgggggcatggtgtaatgtagactaccctactgttggacatttaggttatttccaatttttggctattatagataaggccctgataagtaacgtcctgcataaaattctagagttcatcccctaccctgtatttgggtggctgttactgttattatcttcagctagattccccactgaaaatttctgagccaaagagtaggaaaacaaggtaatgggtgttttcttgaaaggccaaaggtttggcttgattcataagactgaaaccaagaagacaatcttggatatttgaggctcaaatggtcaaaatggtgatagggctgagaaaacacatttgtgaggaaactgaaaaaacatgggtatatggtaatatcattttagttcaaattctcccttcttccttttccctagtctttccacttctccatattcttccactccatacaaatgcatggtttttgtttggttggttggtttttgagacggagtctcgctttgtcacccaggctgagcaattagccagtgcaaaagccctgaggtgggaatatactaggcttgttcaagaaagagcaagaaggccagtttggttggtgcacactgaggggagaatggcaggaaatgaggccatgg

SEQ ID NO: 190749 - DNA, 888 bp, Homo sapiens
aattttggcttcagtttcatgtaaacgttttatatatacaaaacagatatgaagcaaaacaaagtaatacaacacatttccaaaatgtaaaaatgaaaactgaacaattaaactagctgtataaatgttggcatgaacaaatagagaaaaattatatcaaatgattttgtggaaaaagtattctgattatgtacccaaaaaggaaagaaagagagagaaaagcaaggaaggaaggaaggaaaacaaggaaggagaatggatggaaggaaacaagggaggaagggaggaaaggatggatggagggagggagttagggagggagagaaaaataaaaacaagcaaagaagtaagaaaaaagagagagagaataaaagggagggcagagggagaccatgttcaactgcatacctgggcctagtgttttagtggtcattatagtattgcttatgttgttatagacataaggaataagcaccactctcagctgtgatctctggaccatgactggatacatgattcagtataaatacccttcccatttgctgtccaaaatatctcgcttcacagctggaccctagttgtacctgtgtgtcataggaagcagagtgagtgggcctcccccatgtcctaggagagctgagagaaccttgctctcagccaggctgcttagctgaggcctggagatggcagcttgatcttcaggaaagttgtgggggaggggtggggaacagggtgcggctgctgccaggacagtgtgatattaggagggagatcaggagttaagctgtctttctcttgttcagaatacagtaaatttggtgacaggaaatgagagggggcggctctatcctgtgaaccagaggcagccacaaggcagattttcagtgt

SEQ ID NO: 190750 - DNA, 705 bp, Homo sapiens
aattttggcttcagtttcatgtaaacgttttatatatacaaaacagatatgaagcaaaacaaagtaatacaacacatttccaaaatgtaaaaatgaaaactgaacaattaaactagctgtataaatgttggcatgaacaaatagagaaaaattatatcaaatgattttgtggaaaaagtattctgattatgtacccaaaaaggaaagaaagagagagaaaagcaaggaaggaaggaaggaaaacaaggaaggagaatggatggaaggaaacaagggaggaagggaggaaaggatggatggagggagggagttagggagggagagaaaaataaaaacaagcaaagaagtaagaaaaaagagagagagaataaaagggagggcagagggagaccatgttcaactgcatacctgggcctagtgttttagtggtcattatagtattgcttatgttgttatagacataaggaataagcaccactctcagctgtgatctctggaccatgactggatacatgattcagtataaatacccttcccatttgctgtccaaaatatctcctctgaaagctgagttctcgggtccttgtgaaggagggaagcttgcctgccttggagcgtgaaaaagtcttgctggacagaagtctcacggtttaaaaatgggaagggagaggattgagatcacactagaatgcacagaaaattctt

SEQ ID NO: 190751 - DNA, 192 bp, Homo sapiens
acacacacacgactattatcccaataatgattagtatgcacagcacccagatcttggtttctaagtatcattccccactaaaagcaatcagagctctacagaatctgtggctgaggcagggaatatacaagataaacctaatatcttactgtaccagaaaacaaaggttcatatggatgacagacaggtaga

SEQ ID NO: 190752 - DNA, 253 bp, Homo sapiens
gagaaagaggagtaatctctatagaagtaaagtcatggggcaaggtcagtgtttagacaaagacatgtaaaagagcattctttatgttatttgaaaaagaatgttggagtgttggggttttgtgcctctgaggcctggtgggccggctgctagctgttgtggtccatgatggggatacatctgagatgtggaatgaagaccaggtgagccagatgagggacaaagacatcacactctaacacgggtgtctggt

SEQ ID NO: 190753 - DNA, 560 bp, Homo sapiens
cgcattccccgctccttcctgtatactctgggtattcacacgttgcctaaatgaaagcatgtttatggtcactagtgtttcatgtgtcaggtgtaaaaggcaccagaatgatgcctcttctaaaagtacacatggatgggggatggggagggtcctactgaatttctgggactgtgagcccaggcacagtattttggggaaaaacaaaacctgcccaggtgactctgatctgcagccaggattgaaatccactgaattggagtcatgacaagaaaacaagtgattcagccagtgatcttctgtccttggcttcactagtctccatctcctaacaaatcttgctttacactggatcaattttccaacgtgctctatcccggggccgctatggcagaatcctcgaaggaatcccatcgttcactgcacctcatttcaaagcgatttaacagcaggaccacagcaataatgaaaagaccctccctatctttttatgggtaatttgattatacacggtgcttgaatgtttacgataaaactcctttgtatgctcagataagaaa

SEQ ID NO: 190754 - DNA, 337 bp, Homo sapiens
aatacccagaccatgcaaggacttttagactcagagtctgagttggctctaaaagcaaggaattgaaaatgctattgtgacccttcattagaaagaggcatgtagaagccaggtgatgaatagaatcctggcccatgtccatctcatagtcgtccaatggggccgcaggcaacctgtgtggttatttgcccagtccctcagtacaatcaagattggttcctatgggtcaaagctctcaggtcatcactctggcctcactgtttatttcagaaattatgaccaccctatttctgtgaagacaaattagcctctcctatatgagaatcctatcattccc

SEQ ID NO: 190755 - DNA, 382 bp, Homo sapiens
ctaaattttagtatatttcgcccagttgacaagagtggaaactggtccatgataggctctcagaatgattgtgttctgaagaaagctacctggcagctactcagtcaaggctgtacacctcattttttcctaccttacatgttgaatataaatggcaaaagcaaaatcattagcagtgaggcagaccaccaactcacttttacacagggtatcttatggcctatagtttctgttagtctttataccagagagctcaggtcagcaacatgtctacttccagggccctaagttatcccagccccagtaaaggcatcctcaaaatggaaacttaataatataagatcaacattaaagcactttttgtgcaaaatggcaaaacttt

SEQ ID NO: 190756 - DNA, 437 bp, Homo sapiens
ggaggcagaggttgcagtgagccaagatcttgccactgcactccagcctgggcagcagaaccagatcctgtctctggaaaaaagatagcagcagtcacccctaggtgttgggattggaggtgatcttattttctttttatttttctgacttttctaaatctctgataaacttgcaattaaagaaaaaataacagaaaatgtgttatatgcagtattattggaggtactattaatatttgcaagtgttcagacctaattgcggggaaatgatggcaggattctacaggtatattttagagcagttgtgagatgcatgtaactatttgtaaaggttcatacagatgattactagatcagcataaataatatgtctgtggacgttttctgcaggactttgataacttgttacctgagtgaaatttaattcctgggcgatt

SEQ ID NO: 190757 - DNA, 891 bp, Homo sapiens
tcccctgccaagaactctgaatggtactcctatcagaactagaacatagcaggaggtgggcaggtttatggcctctgggaaaaggcaggtttatggcctctgggaaagcagtaaagactggacaagcatggaaacaaaactcactccctggcaggagacgacagcctatggagtcagaagtgaaatgctgtcccagtaaacctttcccagtaggataatcacattctaaccttaggtcaattttcatgtgcttcgccggctgtgacctggaccctgcagtgtggaacacggtcacttctacaaccctgtaagttaaggtctgcactccaagcacttgtgagggaagagggactctcattggctgtgttgtgcaatctagtctgtggccaagggcaaagcagaagccacagatgacaggccctcccacagggagaggaaagctcctccctttccagaacacagcctaaggctgccacagagaggtgctgtttagtgacagaaatatttgtcaggagtggccggaggaatggccactacatacttcctctttctcaccaactgctaccatcagcctccactggctgcctctcaaaagcctgcagaacctccggtggcaggagtgttctctgagtcattccctcaagagaaaagggaaagtgggcctgactcctgggcctgaagaagcctcacagtgccctcagccagcccttgctgcagagcaaaagccaaggattgaaatcctggacagcctactcttcacccacacctgcacacagtgaatactcttcacccacacctgcacacagtgaatactcttcacccacacctgcacacagtgaatactcttcacccacacctgcacactgtatacctcctaagccgggacctgca

SEQ ID NO: 190758 - DNA, 599 bp, Homo sapiens
cagaagggaactcattcactcattcattcattcaagaatagtatagactctgcacagtagagaaaacatgtatatcatttttccagattcaacagctagtgaatttcctgtatgccaagtctttagaactcagggatgaatgaaatttcacaggctattctgtctctgaaaatcaagtaaggcaacactcacatcccctctgggaagccaaccttagcctcgtagtctggataaaatttcactattatgtgctacctcagcagttatgtactgtagcatcagtcacatccacttcagtgtaagttctgggaggacaggacatgtgtctctagtagcagaagagattggcatgacaacaacctccagtaggtgttctactaattaagtttagaagaatttaactgtggagcccgaggcacggggatcacttgaggtcaggagttcaagaccagcctggccaacatggtgaaaccccatctctaccaaaaatacaaaaattagccaggcgggtggcacacacctatagtcccagctatgtgggaggctgaggcaggagaattgcttgaatccagaaggtggaagttgcagtgagccgagat

SEQ ID NO: 190759 - DNA, 350 bp, Homo sapiens
acaggtggggaaactgagggctggaaggaggcagagcatcagaggcaaggtggccactaacagtagattcattcagcaccttaaatcagccaatgaatttccaagtatccctttgcatggattcttttaatccttataagccctctaagaggtgtaaatgccacaaaagctacagtgaccagctcgtcccaggacacttccagtgttagctctgaaactctcgcatcctgggaaccccttcagttctgggcagaccaggagcgtgggtctctcatttatgattccacttttctgatgaggagactgaggcacaaggagatggagtgagttgctgatggtcacgaggctgg

SEQ ID NO: 190760 - DNA, 269 bp, Homo sapiens
atttatcccttcaacccctcacccactcatccatttctccacccactcagccatcccttcactgactcaaccatccattcattcgtccacctgcccacccacccattatccatccatccacctatgtatccatccatctgttgtccttctgttcatttatgccacaaagactcgttaaccacctgctagattctggggaggtacctgctctagtaatggagaacatggtctctggaatatgattccctgggctcatactgagctgcctc

SEQ ID NO: 190761 - DNA, 553 bp, Homo sapiens
taaatggcatggtgattcgtatttctaccagcaagtctttctgtatcttgccaagggacgatgcctctaaattgcaagaaagggtgggatgccttgtccatttgaaatccaaaacatcaagacaaatatggggcaataatatgaccatcacaataatatatataaaagagaattcattaagggatgattatcgctttctagagttgggttctggggaagtattatttatagaaatgagccttaggaggccaggcacactggctcacgtctgtaatcccagcattttgggaggcagaggcaggtgggtcacttgaggtcaggagtttgagaccagcctggccaacatggtgaaaccccatttactaaaaatacaaaaattagctgggcatggtggcacatgcctgtagtcccagctacttggggggctgaggcatgagaaacacttgaaaccaggaggcggaggttgcagtgagccaagatcgtgccactccactccagcctgggtgacagagtgagcgtatgtctcaaaaatagataaataaataaataaata

SEQ ID NO: 190762 - DNA, 786 bp, Homo sapiens
  misc_feature (92)..(92): n is a, c, g, or t
gatgagtcggaccaaggtatcagcagagaagccacaccgcagccctacctctgcctaatcacactactctgttttactctgatgagtcaggncagcctgagaggacttctcctttcagattcgacatatgaagcaaggtaaatgccctaggtctggtgttcatgtcaacctacctgaagcagaaaagagcgtccttcatctgcgcccttataaaatctgcagtagatagtctccaaagatggccactgttgattcatctctccctatgtgtgcatattgttcctcctttagagaaatagaagccatttcctctcccttgactcagggcaggctttgtgacttgctttgatcaacagagtgcagtggaagtgctgttctgatagctctgagcccagaccttaaatgcactggtaacttcctcttccttttaattggagccatctaccatgtaagaagtccaactaccctgagatcaccatgctatgaagaagcccaagctattcatatgtagaggctatatgaaaagagacagagagagagagatgccagccagccagctatttcagttatcccagctggaggcatcaaacatgggaatgaagaagttttcttgggtattccaccccaacagatactccatgaacagaagaacactcagctgagttcagtcagatacagaactatgagacaggtcaattagtctagccctagtttggagggttttatcagatattatgaaaacccgcgggctaccagcatttaattgcccataaagtggccggtcaa

SEQ ID NO: 190763 - DNA, 275 bp, Homo sapiens
tattgaggctgacaagcaaaagcccttggcacaatttaattttcacataaccactttccattgtccagctgcaggcaaaagaaatgagcaatgaaagttttgaagtctaccccagtaccctcatttcctgtctttatttcctttactttatagatgtattctatacctgctatgtagataatgctctagttttccctttagtgccaactggaaaaggagagttggctttacaggggctgtggattaagagccaggcttcattccatcccagggag

SEQ ID NO: 190764 - DNA, 464 bp, Homo sapiens
ggctaacccaccatatatgtaatgctcctttcccatctgtatttctagttccaaccttccttttgaactctagaacaatgtttccagctgcctgttgggatatctcttacacagtctccgtatgacatttctgaaactgaatttattatcttttctcatatgtgtattccttaccctagtttctacttctcttgtatctggtattgtagttatcaatatctccatatattagttgctgaaattaaaatccacattatccatgagtctctcctcatatctctgaaattcctacatataatagctctttaggtactgtgtctggttgattctatctcttacataacttttgaatgtttttccttattttcattccctttgctattgccatggcttagcttggtgctttctccaaacttacagtagcttgccagctggcctccttgctgcagtccatccttcattct

SEQ ID NO: 190765 - DNA, 485 bp, Homo sapiens
cataacaattagtattgttaatgcaaagtgctgtgcctatttttgccgaaacgggtgtcttttacatgaatttgccaccattttagatgtctttgcatctaaaatgaaatgaggaaaaccatatctgttattaaactgtgcctgtctttgtttagagctactgctatgagccagaaatcttggaaaagtttttctgcatatccccagcatgttactgaagagtttcttactaccctgaagacagatatttcttcctcatctattgggagactccaggagtcagtcttaagaaggtcttattgtgtgcatagcctcatgcccctgcccacattgataactcaccaaggggttgagattttataattcagcctgattaggctgttatccatcacatcattacataaaaccctactataatggtacacattcaactaaagcatcaacacaatctagatttaaagaatgagttaagtaagacaaaaaaa

SEQ ID NO: 190766 - DNA, 423 bp, Homo sapiens
tctgtgtgtatgtaaaatttatttagtggaagaaaagaaagtacttgaatcatatttaagtaaggaactagattaagaagccaaaaatgcaggactatgacaccacctaagggaaaaaatgtcagtaaacagcacacagtgtaacagtggcttcaggattcagacagctgcctagaggccagaggttggcaaactttttctgtaaagggccacatatacactttagattttgcccgccatatagtttttatcacaattatttacctctaccattgtaggagaaaagcagccatagacaacaagtaaaagaatgggtgtggctatgtttcagtaaaacttttattttacaaaaacaggcagcagataatagtttgtcatcgtatattcaagaggtcagctggctggagagcatgcctttccagt

SEQ ID NO: 190767 - DNA, 503 bp, Homo sapiens
tgctgggattacaggtgtgagccaccatgcccagatgcagtgttgtctcttgttctcaattgcttaaatatattaattgtggtcttttaactccataagctccatgaaagaagacatcattttattgttctccacacatgtagttgccttcagcaaatacacatttagctgttttggaaaggagaataaggaatggtgttctaggatttctgctgaataccttttgggtccctcttgtgttttagagtctctgtccttggtcagctttccttcgttgtttatttgaagagattaaggccatttcttgtgagtggtttctatttctcctttggtaaactcatactgggccatctaagaaatctagtatgagcaggtctcccccttcttttggctctctggtcctgtgactctatttccacttctaagtgtcttacataccacaggaaactctatctcacaacagcttccaggctcttatctgtagaaataagaaacaaacaagt

SEQ ID NO: 190768 - DNA, 691 bp, Homo sapiens
gtcatatagatttactactatattttcttctagatattttatcctgttaactcttacattagatctgtgatctatttgtggttaatatttgtatatgatgtgagggagggatagaactttatacttttgcatgtggatatcaagttgccctagcttcttttgttaaaataatgttctttcttcattgaattcccttgtccgagatgaagtgaccgtcaatagaagaactcactcattccattgatctgtatgtctgtcctgccagtaccatacgatcttgattactgtagttttgtagctggtttttaaataggggcatatgagtcctctaactttattatttctgaagatgtttttgggtattctcagtcccttgcatttccatattgaattttaggactagattgccagtttctgccaaaaaagcaactgcaattttgataaggtgtttcacggttttgcaggtatcttttaatgtcttaacagctggattctcatctctgctcctgaattcattcccttaacgttattttaatgaagtaaggagtacttgaatagtttttcaggtagttgaatattctttgataccgaaacttcataagtgatagtttgcaaagaatagttacactatgcaatctgaaatcatattgatgaatttgcccaactccgcaggtctgctttatacttggaa

SEQ ID NO: 190769 - DNA, 355 bp, Homo sapiens
ccagatctgctgttgttcctgggaagctggcgtatcagtcagaataggccaggttatgctgcagtgacaaacatcccctacatctcaatggcttgatggaacacagaaaaacgtattctcctcttcacattgtcaacacagcctgggcactgctcccaggctgctgacctccttgtggtgtctggccagcctgagccagttagagttcacgagttgtccacctccatgtgaggtcaccatggggcatgcacagactcccatgtccctggtgctcacaccccacacgatcacacttagctgaggggtgctggagaggagagtcttgctgtgcccgggaagcggagaaaaaacaggt

SEQ ID NO: 190770 - DNA, 299 bp, Homo sapiens
tatttggtgatctttgtaaatagattaatgcttaatagagatctattctctgttgagtgagaagaaaacagaatctgattctttagtctctttctgcttttctattatgtaagacttctcaagttgtaagcaaaataatgagccactggaaggttttaagcagaagagtaacacaatctgatttatatttgttttgtttatatgtatgtgtgtgtgtgtgtgtgtgtatatatatatatttattattattattttaagcaacagggtcttgctctgtcacccaggctggagtgcagtag

SEQ ID NO: 190771 - DNA, 142 bp, Homo sapiens
tccggttgtttccagttgttatgaataaagcttcattgaacatttaaatagaattctttgtgtttattttgaggaaataactgggagtggaattgttggccataaggcaagtatatgtttagctttataagaaaccatcaaa

SEQ ID NO: 190772 - DNA, 479 bp, Homo sapiens
  misc_feature (393)..(393): n is a, c, g, or t
  misc_feature (414)..(414): n is a, c, g, or t
  misc_feature (453)..(453): n is a, c, g, or t
taggaaaaatatctgtcagtaaagaattctttaagtaattcaagttctcttaagaaaagtcaagagagcagagccgtaagaaccagaggaaaacaaagttaagcctgaaatcagtcctattcagacttccagctatatgaaccaatagacttccttattaaaaactgatttggtttgtttacctattggtaaaaactttgtaaggacttaaagaccgtgacattttaattaaataatcatatgtgtttcaccccaatcaaaccctatatgtttttatgagtatgggcaaaaggtgtggaagagttcacatctaggagaatgacaacaggcattcaatagagttacaaagaggtttttttttgtttttttattgagatggggtctcactatgtngcctaggctgaatttgaattngggcacaagtgatactcccacttcaaccagcctcctggntagctggaactacttgctatcatcgg

SEQ ID NO: 190773 - DNA, 352 bp, Homo sapiens
ccacgggacagcacacagccccccacggaacggcacacacacccatggaacagcacacacactcccacgaacagcacacacactcccacgaacagcacacacactcccacggaacagcacacacacccacggaacggcacacacacccacggaacagcacacacactcccacggaacagcacacacacccacggaacggcacacactcccacggaacagcacactctcccacggaacagcacactctcccacggaacagcacacacactcccacggaacagcacacacacccacggaatggcacacactcccacggaacagcagactctcccacggaacagcacacacactc

SEQ ID NO: 190774 - DNA, 602 bp, Homo sapiens
tgccaagcgctgtgccagatactaggaatgcagtggtaaagaagatccgcaacagatcagctctcagggaatttgcattctggctgggagcaatgaagagtagacaatgaaccagaaagataccagatggtgatataagctacgcagtgaataagaatagatcctggtgaaagacagttactagaggctattagagattggttgatctggagggttttctggggagcaatttagactagatctaagtcaaaaatcaaaagccagcaggataccatgggggtggggggtttgcaggggaacatcccagtggcttgaaagtggcaatgaacttggcatatttaaaggaacaaaagaaggcctgggtagcttgaacctacccccagccagctattagtacttgactattacactaatcacctacagttcacctcaggcttatttattataagatagtctttcaacaacatttattgaacacctcttatgtcaggcattgtgctagtttctaagatggaaagatgactaaaaatgcaatcaagaagctcacaatgaagtgtatataaaaggaagagcgagagagataaatcattataattgaatgt

SEQ ID NO: 190775 - DNA, 535 bp, Homo sapiens
caggctgatctagaggacccctgctgcctgacaatcagtgaaatcatatatttgatatgagactagtatccagaatatatgagaaacacctaactcaacaataaaaacaaaaataaccctatttttaaagggaaaaggcaggtgtggtggctcacacctttaatcccagcactctgggaggctgagacatgagaatcacttgaacctgggaggtggaggatgcagtgagctgagattgagccattgcactccagcctgggcaacagagcgagactcttgtctcaagaagaagaaaaagagaaaaagaaaaagaaaaagaaaaaaacttttgatgccagtagttctgtgaaggacaacaaaaaagcagggctttgagagagagcaatgagggcataggtggctgattacatcagatgggttaatctccaagtgaaatttgggggaacggtgttccaggcatagggaatagcagatgtaaaggccgtgatttgggaataaacttggtgtgatggtggaatggcagagagggcagaac

SEQ ID NO: 190776 - DNA, 141 bp, Homo sapiens
ctttttctagttcttaaggtgtaagatgaagttgctgatttgaggtctgttttctttctttctttttctttctttctggtctgttttctttctttctttcttttctttcttgttttggtgttagggtgataatggcttcat

SEQ ID NO: 190777 - DNA, 297 bp, Homo sapiens
ggagcatcaccttgtgagggagaaaggtggaaattgcttagcacttgaacaactctccaaagaaaattctctttctttgactctgagaaccttgaggaaggtgttgggttgaggtgcaaaaccagtttttggccactttgaaaatctttgcatgtaaaaaacagaatcacataagagccacaacactacttatatatgaacgtgtgtgtgttggggggaggggcgttgagggattaaaatgccactggggggccaggcacagtggcttatgcctgtaatcccagcactttgggaggc

SEQ ID NO: 190778 - DNA, 537 bp, Homo sapiens
gaaccctggaggtgaaggttacagtgaacggagattgcaccactgcactccagcctggacaacagagcaagactctatctcaaaaaaaaaacaaaaacaaaaacaaaaaggccaaaagagaaagggactctgtagaagagttaggaagtgtcccttgagaaggctaggggaggggagaggcatacagcacagcattgtatctttgaccgatggtaggaaggcactacttctctatcaaactgacttttaaaccaagactccatcaaaccgatttttataccaaggttaggctttaaaccatgggtgctaaagagcaactaaggagttttaggcaagaagtagcataatcagatgtacaaaaaacagtatcatgcctgtaatcccagcactttggaaggccgaggaaggctgattgtctgaggtctggagttcaagaccagcctggacaacacggtgaaaccccgtctctactaaaaatacaaaaattagccaggtgtggtggtgggcacctataatcccagctactcggaaggctga

SEQ ID NO: 190779 - DNA, 553 bp, Homo sapiens
gaaccctggaggtgaaggttacagtgaacggagattgcaccactgcactccagcctggacaacagagcaagactctatctcaaaaaaaaaacaaaaacaaaaacaaaaaggccaaaagagaaagggactctgtagaagagttaggaagtgtcccttgagaaggctaggggaggggagaggcatacagcacagcattgtatctttgaccgatggtaggaaggcactacttctctatcaaactgacttttaaaccaagactccatcaaaccgatttttataccaaggttaggctttaaaccatgggtgctaaagagcaactaaggagttttaggcaagaagtagcataatcagatgtacaaaaaacagtatcatgcctgtaatcccagcctataagttgacttctttaagtcatgagttttccagctgtttatgatatattgccacttggtttatccactgataacctcaaatttagtgttttcaaaagtaaacttactaatagtgtctttcattacaaaagtgattcctgctgtcctgtgtttcacattgggcg

SEQ ID NO: 190780 - DNA, 721 bp, Homo sapiens
ggaaacctcagggccaaaggctcctgtctgtccttttccgccctaaatcttctgtgaagaaccgtacttggcccgtacgtgctcagtaaatgtttattgaatgaatgcacttttctaaatcacaagctggcagaagggggggcctttctcaaactccatctctagaggtttatattgctgtcctctcaagagattccagattcagaccttgagttctgtggctgtgggcaaaagccaacaaagacccaaatcctctgtccttgggagcttgaggagagtttaccagttcgagttcccactgggtctgagaactttgcctttaaaatccattcctggtccctgcctaccacttcctgctctggggaatagagttgagggggccaccctccatcaccttaatgtgactctccccacagaaacaacagaagaaacaagtggaacatcagctggaagaagtaacatgatttctttgtttgctcgcgacatgactgctcggtttgggggacactcagatgtagaggccccgagtctcgtctcacccactcccagcctggggaagaaggctcaccccccagagtccaccccatcccccacagggtctctgataacccggtcccatgggtgggcctgtcccggggcaggggcagtggtggcattctggggacatgtctcttgcagtaccatctctgcctctgcctggttagatctctgtcttcctctt

SEQ ID NO: 190781 - DNA, 607 bp, Homo sapiens
attctggtttttgtcctcatacttagggttaattttgatatctttttagctttttcagtttaatttttattctttcttatttaacgataaaagtatttaaaactaagaaattttccctgagtataacttgtaaaaaatcttacacattgctatgttaggttgaaccaataaaattggcaatagttgacagttttgagataacaaaaatgataatttcatatggatcaacctaatgcacagtgttattgacagaattgttttcttaatattctataattacaatttgatatgctttcttgtttcaaagattatttcaagtgagagatttaagtgttcttaatgacttaatttttactcacatttttctcaaaacatttttaaattctaaaaatttgaaagaattaagaattctaaaacatagctctaatgttctctttttactcaaaaaaaatttcccttgttctaaggtggcagtcattacccaccacaccacctctcgacacacagaccaaccttaccccagtgtaacagccagaccccatccttcccctgccagcgtctggcatgaagaaagtcaattcatcttttttttctttttttttttttt

SEQ ID NO: 190782 - DNA, 293 bp, Homo sapiens
aagatagtaacactctcagctcatagggttgtggtgagatttaaaatgtgtgtgtgtgtgtgtgtgtgtgtgtttgtgtttaaagtgcctgggaaataataaacactatgcaactgttacctattatctgaaattattccattcctctgtttgtgtttatattatcagtctttcctcactcgaatataaactccatgaggacaggaactttgtattcccagtacccagaatgtttcctgggatacaccaagcaggcactcaattgcttttgcagtaaatgaataaaagaggaa

SEQ ID NO: 190783 - DNA, 640 bp, Homo sapiens
ctaagcccagggcataaaacccctcgtagcctctggaaagtgcacagacttgttggttgctctcccaggctagtaaacatgttctccgttacctgaagcagcagagcatgttctgtatgtgtttatatgcgtcactgctatttttctacccccacgtctgcacatcctcaccacctgctttgtttaatcaccaacaaacagtgtgggctcccagagctcggggccttcgcgcctccataccagcattggccccctggaaccaccttatgcactcttaacttgtcttttctcattcctttgactctgccagattttgtagcccccacggcctagtgttgggtctgatcacctcaacagatatcagataaggtaatggtgatctcataagaagttaggtagtattcctctctcttctgttttttagaaaaatgtcagaaggattggtgttaattctttttaaaatatttggtaaatcatcaagtttggtacttcaccagtgatgcaatttggtcctgaaattttctttattaggaggttttcaattactaatctgatctttcctgttacagatctgttaagattttctaattcatcttgagtcagtttaggtaatttgtgtggaatttgttcatttcttgca

SEQ ID NO: 190784 - DNA, 426 bp, Homo sapiens
actagattatgctgtcctttctccctctgtgtaactgattcagatttgtggtcaagatgaaacctaaggaagtttatgcacaacactgaaacatctaagagaattttttagggctgtttcacttgtaagtctaattaacttataagaagagttaagtacttgaggtttgtgttaatagactttttaaaaatagaaaccaaatattaaattagtaaaggcaagcttaaatgttgaagatattaacgagtttataaacaagactaatttgtaattcaaaatcccttaaaagtgattaaaatgtttaatttataaatgagatttataagctgaattttttaaaaagtgtaacagtgtccttcaatttgcaactttaacaaattgaatatcaatttttttaaacctaggtaaaccttctggacagtcatt

SEQ ID NO: 190785 - DNA, 311 bp, Homo sapiens
tttgtaagcctatcaaaatatatttttctcatttctccaaaaaagtttatattcataagaactaattgtatttttaaaaaaagtcaactcacctgaaatttattatttaacaatggagaacatgagaacctttttaaagttttctttaaaatcgtatctatccatttaaaacctgtatttcctttaaattttgacactttcataccttctctttaaatatatataacttcactatacatttattagagagcagaataatgaagaccttaattcatattacatttaaagaaatatttttagcataatattca

SEQ ID NO: 190786 - DNA, 350 bp, Homo sapiens
acatgtgactcagatttcaacactacatatgcaacttgaacctttccttgtcaactaagaagtatatatgcaaatctcacatgctgagagagattagaaggctatacaccaaaatgacaggatttgttatctgtgagagatacactgcatttcttcatgtttttatttaactttcaaaatattgttaaagaatacaaatcactttagaaataaaacagccatactggccgggcgtggatgactcgcacctgtaatcccagctgcttgggaggatgaggtgagaggatttcttgagtccaggagtttgaggctgcagtgagctatgatcacactcctgctcttcagcctag

SEQ ID NO: 190787 - DNA, 556 bp, Homo sapiens
cttgtttcctcactccatttcaaactgcctccaccatcccactaaaactaactcactcatgcagacacttaactgcctaaacaatgtctccagttaacaaccaaagccaaaccccatgtcaaaaactaaatgcataatctttccttacaatctgttcctcctccagggttgttgtttttgttttgtttaattttttttttgagatggggtcttgctatgttgcccaggctgatcttgaattcctggcctcaagcactcttcccatcttggcctcccaaagtgctgggattacaggcatgaaccaccacgcctgtctgggacagagaataagtcttgatggactggctgtgggaaaggggagaagggtgtcagggatgactcctagatttctcttgagcatgtaagtcagtggcatgcaaagaacattggagggacctctgcttttggtcaacttggtatgtcagggactagattcaccttcttacctgaaacagtttttttaaatggaaaatatatgaaataatgattttcaggatgctggacatcaggcaacaaa

SEQ ID NO: 190788 - DNA, 517 bp, Homo sapiens
gctcatgaagtttgaggaatttgtgtacagctgcagcaaatactaaacaccatcaacaagaatgaaaactagcacctcgatctttccaaaggtgaagaaacacatttcctttccagcttaaacatggcaaatacttaagcaatgcttagtgttggtgtgaggctggctaggacggaagaaataatactgaacctggccaggagagaaggagcagtatctgctctaaaataaaagcacaaagcactctaagctcagtatattctttcttaatcatttagctaacactcaatcttgattttggtgccaattccccttcagctcatttcaagacacattagcaatgacaagtatgtaacttagaactcttagaatttctcatgagactggatgtagaggaaaaaaaaccaacccagaattttaacacttaacccagtaacttgcatgcatacattatgtttaataatatttttagtgacaaactgcagaggcaaacaaaacaagctttttcttccctcca

SEQ ID NO: 190789 - DNA, 565 bp, Homo sapiens
tgaaagaagccagtctcaaaagcctccattctgtatcattccacatttatgacattcttaaaacgacagagaacagatcagtggttgccaggggttaggtatgtgagaaatggtgtgactataagtatgggggggggtttgggggtgctaaaactattctgtatcccaactgtgatagaagttacacaaatcttcatgtgtgttaaaattcatggaattgtacagtaaaaaagaaagtcaaatttactgtatgttaacgtaaaaaacaaaaatacaaagcaaaataggttgcctacatccatactccaacttagtgaagcaggatctccagtaatgtgacgtagttggttgtatttttaagaagctccacgggtgatcttggtgtatttgtatagccaaggatgagaacttctgtttttttgtttgttttgtttttttgtttttgagatggagtctcgctctgtcgcccaggctggagtgcagtggtgcaatctcggctcactgaaagctccacctcccgggttcacgctattctcccgcctcagcctcccgagtagctgggagt

SEQ ID NO: 190790 - DNA, 554 bp, Homo sapiens
gagacacactcactcccacctcagggcatgtgccccactgttccccttccccagatctttgtaaagctgggtcccctttgttcaggtctctgctcaaatgttgccttccctgaccacccgatctaaataaagagaaccctctgctccagcctttgccttagtccactgagagcccctgatactctctgaaattttggtatccatctatccatcatttattcctgttcaccggaatataaatccatagctgggggagggagaaatcttgccttgttcacttctgtaatcccagagctgaggcagtgcctagtacagagtaggcacttaagaattactggtggaatgaaccaatgaatgaatgatggcagatgaggcgctccttagggtaggatgagtggggaagcagtgctgtggaggcgctgtgtcctctgtttctggcacagagcagacccatcaccccgggaggaagccctggccataagaggcccactgaccctttgaccagatagcactggctacaaaaaacctgggggtgtggggcgtgctgtcaatca

SEQ ID NO: 190791 - DNA, 1311 bp, Homo sapiens
agacctaattcttaaaataataataataataataataataataataataataatttttaagtgacctcttgaatgaagtcttccttcatgtttattttttacaaacctttcttaggttcagaacagcttgttcaatattaattccatagaacagagccgaccacactatgagaactcaatttgaaaacaacagtatatcaaaaatatcagtgattttcaaaaaattcctcttttccagactagaaattattaatcaaaaaattatgaattagcagtttttagtaaagttggtatttcaccaattttgttaagtcagaaaactccttataaacacctgtttcatgttttcagaaattttcaaatgattccacagttgctacatggtcaataaagaaaaacttcatgcttttacttcaattagaattctctgttcgcagtttgggggtctcactggccagtgtgtgtatgagaacttaagggatgtatgcactttagagctcagctgtgcaagctgggctttccttacctacgctgctataaacatactgctagaggagggacatttaagctactctcatgctgctacaagattaaatgcctccctacctatttaaaaaaaaaaaatgtcagtggagaagaaggaaggagggagggaaggaaactcagcttgaacgtcagtaacttgataagcatgctgctgataaagaacaccctggactttgtagcaattgccaataaccaaaccaataagcaaacaatccaaacttaaccgtaaccttaaatttttttcccttttcatgtttcatttgaacatgaaaatgttcaaatctcttgcatacgttgttattcataagtgagctgcagggggaaacccaagcctagatgtaagatacactcttttcaacatgcatgcaggcctcaccagtgatgtctctggaggcatattctgaccagatcaactgcctcacctgcgacatcgccgtttactgggtctcactatatataaataacttctctgcttactcactaaagccttgtgcaggtccctcttacctcctcaaatacgtccacatgtgtaagcacacatatctgcacatcggtttgctttattcacaggaatctgagaacccctatgaaacggcagtgaggaaggggagagagggtggaatgggtaccagaagggagataggaagacaatgtacaggaaaacaacaacaacaacaaaaatcctaagtagttgtgttctccaaagaactaaatgtaaatggtcccagcacaccttagaaaaacaggagcagcagggggtatgtg

SEQ ID NO: 190792 - DNA, 1024 bp, Homo sapiens
atccccagtgctggacctgtgttcattttctccactgagctactgagtgccactgcataacagtgtgctgactgactctattacagatttatgagctctagccacagcctggctctcaatcctatcctgaaacctttttattctcttctggttgactgccattcatttttttctgcagcagccattccagtctttcaccattctcttcaaacttgttgctccaccccaccttataaactctcaataagtaatttagtcttttacgtctcaatttatctgtaggctttaccagtccttaccacattccctcctatttcagaggcaggtctctgggcatatacatatatattttgtgttcttagttcctcccttcctagtgactgtttgtaaagatattcaggttttctccatcctaagataaaaattcctttaagcttatctcttcttcagactaactctctgtgcttttttttttctttaccaccaaactacctcaacagcctttcttctacttctttagtcatcgtgagccactatagccaaggtttgtgcccaccatcccaatgaaaggctcttgtttgtgatgacttgcttgcagaactcagcagcctctttttgttctcacgctgtttcatcttgtcacagcatctgacaccatttggacctctttccttccctgactgtgtgctatctctggatgagttgacctactctggtgatttcatttaggaatttcatctgtgtgtacagtgatgactctcttgtcagaatctgtaactacctattgtatgagcttttcccccaggtccaaacttgtatttccaaatgactactctccttttccactttgtagcctacagaaatttgcatgtaatgtatccaaaattcagcttatacaaccactatggagaatggtttggagaactaaaaatagagctaccatacagtccagtaaccccactccttaggtttatacccaaaagaaaggaaatcagtatattgaagagctatctggactcacatg

SEQ ID NO: 190793 - DNA, 116 bp, Homo sapiens
agctcggcagggttgtgttccttagcatatcatcttcctattcctcccttctttccaacttccagaaatttcttgaaagtgtccatctagccactctccctgtcttcctcagatgc

SEQ ID NO: 190794 - DNA, 103 bp, Homo sapiens
gaaacttaccaactcccttttctccccgctatttcttccttccatggcagggactttcagattttctttcttttactaacaaggcactaagcatgattttctc

SEQ ID NO: 190795 - DNA, 192 bp, Homo sapiens
ggttagatctagaagactaagatctaattccacggtgagtgtttatctcaaagataggtctaggtgagttgcctttactactgccaaacccagatctaagagttgtgcctagctcctaaaatgagtcacaggattagtagttgacctagaaaaggcaagggaagggattctaccctggagcctccaaaagga

SEQ ID NO: 190796 - DNA, 678 bp, Homo sapiens
taaaaagattattcataatagcccagggatgcaaacatggtttaacatacacacatccaccagtgtcatacatcatagcaatagaatgaaggacaaaatccatatgatcatttcaattgatattgaaaaagcatttgataaacatccttcatgataaaaaaaaaacccctcaaaaaactcaggttttagagggattttaaaaggaacatatctcaacaccataaaagttatatatgacaggcccacagctagtatcatactgaatgaggaacaactgaaaacccttcctctaagatctgtaacaagacaaggatgcccactttcactagctattaaacatagccttggaagtcctagttagagcaatcagagaagagaaagaaataaggggcatccaaattggaaaggaagaagtcaattattcttgtttgctgatgatatgatcttctactggtactgagaagctattagaactgataaaccaattcagtaaatttgaaggatacaaaacctacatacaaaaattagtagcatttttatatgccaacagtggacgatgtgaaaaagaaatcaaaaaaaggaatcctatttacaatacccgcaaagaagatacctaggaatagacataaccaaagtagtgaaagatctctacaatgaaaactataaaacattgatata

SEQ ID NO: 190797 - DNA, 160 bp, Homo sapiens
actcaaagtgggctctggtagcctgcctgcctgggtccgcagtctgacttccccatttattgtctgatttcaatcaaaatctctaggcttcactttcctcatctgtaaagtcagtaataacaacactgccttcctagggttgagtatgatatgaaattat

SEQ ID NO: 190798 - DNA, 284 bp, Homo sapiens
tcagaggatcccgttggtcgatcactgtactaagcttccccatggtcttccatgggatagtcatacgggactccatataaatatttggctacatctatccatcctttcatgctacataatttctgctttcttcttttttttaatccaaggctattattgagcttcactatcttacatccacatgcacattgtttattttttaattcagttataatatacatgggataaagtgcacaagtcttaacagttccataacttttttttttttttttttttttgggaca

SEQ ID NO: 190799 - DNA, 371 bp, Homo sapiens
cactgacattccaggctgggagtagcaggttggacgaggggaggctctgggggcagggagggaggttgcagagtccagagcttggaagatggaagataagggcacccagtgtagggcaggagaagaaaggcaactggaaactctgggacaaactataaaaccccacggaaaagacaggtgtaaggtgactaccttgatccgagggtgatctgagtggctggtacctttgtgctcacagcaggactgtcgtaaagtaggtacatccatgacttctacttgacagacgaagagactgaggccgagaaattgaaccagctcacccacgctgcccttgaacggtggtcgtgagaggggaacccacagcctaccag

SEQ ID NO: 190800 - DNA, 677 bp, Homo sapiens
ccacaatctaaattactctaaaatgtagatactgttattctccccatttattttatttattttatttatttatgtatttttgagacggagtctcgctctgccatccaggctggagtgcagtctatcaaatgctttcttttcctactgaccattgaaatgggcaaggctcaggctcatggatctgtttgacttgcaggaacaaagcaatcaatcaccgtgactatggacagcatctatgctactatgctttggggcacaaaaatgtttttcaatgtgaatgaggtacattgtagttcaaattcagcagcatattaagtgcctaaatgctgacaggttttattacttgactctggaggcaggagtaaaaggaaagcaaaattatttaagtccttcaggaaataaaagcatgcttgctggctttattatgagtatttgatgataagtaagggttaagtagccttcgagtctcagggtcagtattctttcagcaaacatttattgaatacatactcattttcctttatttcatgagtatacgtttgccctcctggcaagcatttaaggtggctgaaccctattatattccaagctttgtgctaggtgttggaaacacaaaaaattatatatagtccttgccttcatggatcccatttatcagaaacataagtttctaggga

SEQ ID NO: 190801 - DNA, 423 bp, Homo sapiens
aaaggagtgcaatatcctgattggtcagaagcaaggagtaaagacaactttatcagcagcacagagctttacatggggataaaattcatgtcccagagggagagcaagttgtgtttactagaaaaactcatataatgatgtccagataaaaattcagtacccccggtgaggtatgaccagagaataaagtaagacaatcacttcctttattatgaactttctatgtcaacatgggagtaagtgagatagcatattctccattccaaaactatcaggggctgttatttctatcctctgtctgtgctggtagcctatacatggtggggacattgtatcaacataaaacattgttttttggtttccagaccaaagcatataattaagatgagctggttttaaaaagaagagagaattgtataattg

SEQ ID NO: 190802 - DNA, 700 bp, Homo sapiens
tcagccttagggggccatgtggatggaatgatccctgggcaccatgcctggggagtgccccaaagctttgccccccagctctcacctgggacctgaagtgcacagtcagctcagataaggggctggagcgtgaggggtggggtaagagccagcagaaggcatccctgaagtaccccctcccacctgtgtctgttctggtccctgtaggaccagtaggggctgtgagcagcattcccagcctttccctggtagtacagggtcggaaggagccgtgagctctgtcccaggcctgtccctggctggcataagaccattaggagctgtgagcagcaccctgggctgtctctaattgtgctgccctccatatatgaccgtgagcgaggcaagcctgtgtttcctggcctcagtttccctatttgtacagcataggtggggctttcctccaagcagttgggagggagacctgtgagtgaaagccatttctggggccttggtgggtgggttgccgacccagcggctccgagcctgtcagaggctgcagctctttaaagaggctgaggaatttggggttttctgtccaaaattgcttcagctctggccagccccccactatctgtctcgtgtcatgctcaggggcccttctcaatctgggtctccactggaatcgccgtgtggtccccctgggttggggacagctgca

SEQ ID NO: 190803 - DNA, 111 bp, Homo sapiens
aaatctctacttcagtttggaagtgtaccaaaaactgtccacctcttcagaaaatcatgtcaccagtggcaaagtggctcataatatatgagttgccaataggacccctct

SEQ ID NO: 190804 - DNA, 222 bp, Homo sapiens
aaactagaaaaagcatagagggatgcttacgtttgcaaatcgtggcagaagtcagaaagtagaaaaattgctactgacttagatacacagttgtctctagcgtatacaaagtctacctatgcactaagacttgcactgggaacttttcttgaatgtcattttgacagatgtgtcaaacggacaatctctttgcccaggaaacagagttaacctggaacagtc

SEQ ID NO: 190805 - DNA, 1297 bp, Homo sapiens
ccccagcaaggacatccggagccgatgggtgacgtgtgcccgcagactcatgcccgccatgttccaggatccgggcacagcgctggctgcccccatggctaggcgggacctgtggccaggccggccctttgggcgtgttgaccactcaggattgtccgcgctgtgtccaccagtcctgaggcttcgcacccctcccctgccgcccagcaagcgcgccgcatccaacctggccttatatgggcacgttcgggtgctgggtggcgggcggtgaccaggtgggccttatgccacagcacccccccctaccccccgcctgcccacatgggcctggctgagcggctgctctgagggcccggcagcgtcctgggctgtgtgggcactcaggccatactgggcgagcccctaccatggccagcggcctggacttgcattctctttgatctgtttggcctccccaatccctacacctgcctgtcctctggccactcggccagggaggctctggaggcctctgtcctgccatgtttcctggctggggctgaagctgactggtggatggccacggtcagccatggcagtgggcggcagagcccgcctcttcgtggagacgccccagcggccacccccttcgccttcgtcctcctcagctgcggccttggggctgaggatatccagccctggctttgcgtggcaaaggccctggcggcactggggagctgggatcaagctgctttccaagggcaggggcctctgtggtttgggtggaggtggggaggaggttcttccggactgtgctgattttcctagcgtggactagggcgcgaggtccatccaagtgtgtttctcctgctctgaacagcccactgtgcaccttcgttaggccaaggaccagcatgcagagggcttgggttatttttgaaaagccatttcccgctgggtcataagttctggaatcggcacatcgctacactcagatcatattttaaaagttcctcttttcccaaactttcacaatcttggtggatttgtcttaaactgctttttttttttccaatttgaaaaaatataggaattggctttctccctttccattttatttctcacagtgggaactcggtcagaggtgagaactcggtcagaggtgagaactcggtcagaggtgagaactcggtcagaggtgggatctcggtcagaggtgggtactcggtcagaggtgagactcgctcacgagctgggtaactcgcctcagaggtgtgaacatcagtccagaggtgggtactcgctccatgcacggtga

SEQ ID NO: 190806 - DNA, 526 bp, Homo sapiens
gggaaggttgtactggtgtctgtcccagaactagggaccagtgaggtcaccagatctgacatatcaggtgagatagttgtcgttgaaacagctgaactggcttctggcccaggactggtgatggctactgggagtgtggtgtctgacttactatgggaaaacttgggagttgtcctgggaaccattgtgttggtctctgcaggatgaatgagctgtatggctgttgtctctggttcatatggggtctccgtcagtgttgggaaagttgtagtgctgtctgtcccagaactgatgaccagtgaggtcagcatctttgatgcaccaggggagacagggagagttggaatggctgaacttgtgtgtgtctcagaataggtgataaatgaggttgtggtctctggctcaccagaagaaagagtcagagttggaatagttatactggtgtctgtcccagaactagtgacctgtgaggttaccatatctggtacatcaggtgagacagttattgttggaaaatctgaagtgg

SEQ ID NO: 190807 - DNA, 341 bp, Homo sapiens
tgtaatgttgagattatatgttacattgaaggtaatttgtattgtggggacatttctagctttaaactgctatcaagttaggaattagtcattttgcattttctttgttaaataggcaaaacacaaatagttaaacaatattgtattcatagtgctttctgttggaaccctataaaagtgagaactcaccacctatgaggagactatgagctggtccccagtggtcaggggagatttcatgggatatttgatggatagaccttgaaagaaaggtggttaggacttgataaccatgaagacgtatcaggaattgtgattggcaggcataatgttttagatgt

SEQ ID NO: 190808 - DNA, 374 bp, Homo sapiens
gtcgtgtcatggtctctggggagcacaagataagagagcatagaagactgccaagtaggagaagtggcccagaggccctagagaatgtgaccaaaggggatcttcgatgaggggctagtctgcggctcctaatctgtggctaaagtggggtgagctgctgtgtggggttacgtgaccagagtggcagtgagactaatgcccatgacccagaagctgtggctggctcggaaagccttcatagtaagggcgcagttaagacttggatttcctgccattacacacagaactgacagctcacaaagcactggatattcaggctcctgcttttgcttttctccccatatcggggtctgttagtatctataatatcgtgg

SEQ ID NO: 190809 - DNA, 395 bp, Homo sapiens
ccagaactgagttctaacgtgccctctcaatgactgtgatgcagatctaccttacagcgctgctgtggtaacacggttccccatgttggctcctcagcttggcattcaaagctctagaagatctggctccattttcctactctcccttcttgtactctacgggtactcatggcattccttgaatactttcctgtgttttgccctcccattttccttttgcaagtttagagtattttccccaagatgtctgtctgatgttacacaatggcccttcaaagtcctattcaaatggcattgttctagtaacatcctcctgggtccaaattgaaggcattttttcctcttctatgttcgagaaacaatttatccctcctagtgcccacatccatttcttc

SEQ ID NO: 190810 - DNA, 790 bp, Homo sapiens
cttagagtctgcctgatcatccaaccaattcatgatctccagggcaaccaagggtgtgaaatatgggaagcttgggcaaatggctcccttccaagtacctgtcccattctccctggggcttggggtcccagacactggccctggacccggctcttcatctctactgagattgcccggccctcatttcccagtccccggaacaggtcatcctgttgtcaattaatctagtgagctcagactccaccttcacttgagcagagggtctggctgggcagctgcccctgctgggccatctaccagcatttccagcttcctgtcacagccttgcgtacaggctggagggcggaagaggattgaaaagaaaacttgagaaagggacttccaggagttttctcaagcaacagtagtgagggacaggggttgggcctcttccacttccacttctgggagcagcagagagaggaattcacaaatcaagccacatgtgtgctcatgagctgtcttgggacagctagcatttattgagctactactgtagcctagaacttcatattccatgttttgctaagtcctcatcacagccatataaaataacaagaagtggaggctcactcaggatgggcgcccagggaaatctcaggggctgcccagttctgggccccgcacgcagttttatctgcagattcccagcgtgcaaacagataaaaagatctgtggttgacaaagctgggggctggacttctctttttcctcccttccgcttccccttccccttccccaggctctgact

SEQ ID NO: 190811 - DNA, 252 bp, Homo sapiens
ctaggaactgtacaaagttggtaattcttgggcatacagtgatttcagggtgaggacactaaaacttagagaatccaagggtcttgggataaggtcatgatagctaacagaaccataagaaattcaactcattctatagtttttgtgtgctttctaccacacaccagtgcttcttaagtttcagttatttacatatattatgtaagttcctagataaatctatacagtgaagctgaatccctggaatgtgct

SEQ ID NO: 190812 - DNA, 667 bp, Homo sapiens
tcccccataattggccccaaccttctaaagaaaaggctctgcagacagcagtgggggaaaatcagtctgatgtagtctggagaaaatctttgtcctgccctgttttcctgtagctttgaaaatctcaaatgcaaggccaaacaacgaattattattaacgtgatagaggaagctggtactattaatgtcatgcaaggagaaagcccattttgagtagaaacagaaggacatttatgaggggaaagttggctgggtagggcaaaactgagtagtagaaaatttaactgtaattattccattgaatttttttagaaggactcttcaaattattgaaagttgcttagtaattagcatagtaaccatttacaaaatacactctgacctagagcaacagggaagggagtcagagagacaagttttgtgcagactgtcagctacagcaggaaagtatgcacggtgaatttccacgttaggtcaggcccatgtaaaatttacaaatggcagggggtatggaggaataaaggcattagcattgcatatgacctggtggccctttgaaaactgtgtttggggtttatgtttctagttgcagctaaatctgaatttgaggttttaatccttttgaaccaagctaggtctaagaattagacatttgatctcatgcatc

SEQ ID NO: 190813 - DNA, 224 bp, Homo sapiens
ccgccagaaaaaaatctctagttatctgcctaaaaaaaaaaattctcatggttcagtaaagagtaaaaacagagtaaagagtaaaaagatattgttttattcaacatttagaagtttttaaagatttggaatagaaaaaaaacagcaggaacatctaaactgatttgagagaaagtgagaaaattatacttctggaatgaaaagtggtagtcataaaagtggta

SEQ ID NO: 190814 - DNA, 165 bp, Homo sapiens
tacaggtgagaaaaagtgagtcccagaaatgtaaaatagtttgctcaaggtcaaacagcattcattcattcattcattcattcattcaatgtgccagatacttgtatttggtctcactagagcctaagagggttcagcagaggagtggctggttgcctgcaggaa

SEQ ID NO: 190815 - DNA, 168 bp, Homo sapiens
cccagggcttgcctcaccccaggcatcctctgggagtttagaattcttccactcgtccacactgcccatggacacacaggcctcggtgctgctctgcaacccccgtcagacacctggggaggtgatcccttaaggacatatcttcctggactaaaaggctgaggattg

SEQ ID NO: 190816 - DNA, 549 bp, Homo sapiens
caggctttttctaacctcaaaaaaacattggggtttgatgaggttcagatttggggcaagtttcaggatagtgtttgttctagcaacttccttcccatctctgtggaaagtctgttagagtttgttgtggttctggaagccacactctgaaggctctaggctggggcatccaatctgctatttgtgcctctgcccacgcttccttcgctgtgtttcttggaactgggctttcctccactgcaggaacttgtacatgactgagaggagcccagaccccttctcctccaaactttgatggtggagcctctgcttacttcccacctccaagaatctccagcgtgtcctgggccccagtgccttcagatgggtggctgtccaattcctgcctttagctgagcttcattccactgctctaagccttaccttgggtctggggggatttcttatgttcaaccagcaggttcttttggttgtatcattcattcagctctggaaatccactgctttctgggatatatcttctagaaggaaaaattatgatgtctgctg

SEQ ID NO: 190817 - DNA, 462 bp, Homo sapiens
ctcaactgaatttggaaggctttggaaaattttggaaaagattgtgttgcaactcactgagtggttggtaactggctaaaagacattctccccggtctgttgtttgtttaagcaccagtcattttttttctaacccagttttttctcgccaaattaaatggtgattgtagtcttccaagtgaattagccagagcttgtttttgacctggctacacagtagttggattgtttgtgtcttacttggtcagcatggatgttaagggcagagaagtaagctagaaggcgatatagtctttaaaccttaagagaaaggaaagaatgaaaccccagtttgtctttattggttttaagaggtgggagctgtttatggtaagagtttagtcaggttcattgttatttcccctcattgccattttggttccattccccgcaaccttcccgagcttttgaactaggtttgct

SEQ ID NO: 190818 - DNA, 380 bp, Homo sapiens
aaaagttattgatgtgggacaactttgcatatcaatatacaagcatttattttatttgttttaatagctgcgaaatatcccattgtatgaagagactaaaatctgtccttctattgtggatatttggaatgatgaaccattggaacaaaacagagagggcaatcaaagcatttgacagcctggcaggtcaaagtgagaggtttattacagaagacagtaatgctaaaaggggaggagagctaagtgaatccacctgctgcaatgagagcccagaatcccaccaccctaagaggcaggagacaacgtggccaaaagggcagaggcccccagggctcccagcagtgccagatgcaaacttgtcatcccaccctgtgtgtggg

SEQ ID NO: 190819 - DNA, 179 bp, Homo sapiens
cctatggttcaggtaaagtagggagtgtggaagaggtgctctgttcttctgtgtcacaggagcatctgtgggataccaggatccaaaagagtttgaactgtacatcataggaatgactagactacttgccctggagagcttgatatggaatcttagaaatacccacttatggctgggtg

SEQ ID NO: 190820 - DNA, 105 bp, Homo sapiens
gcagaatttgaatagatatcaaggacgtcaggacattccttgggtgaggaaggtttagtgaagggtggtgaaggttattgagtccatgggagaagtgaaaatgag

SEQ ID NO: 190821 - DNA, 448 bp, Homo sapiens
tcagctcttacccgtcctacatcgtgtttcatctcatactctattaaacattttcaacttttcttatgcattaagagatccataaggggaaataagcaagcactttgtagccagaaagaaccaccatgggattcttgaggtcgcactagctcactggataatattaggcaagtgactgaccctgtccaagattctattctttaaaatcaagggtaattgtacccagtttgcaggattgagttgataagaaacacacacacacacacacacacacacactacacaatacactacacagtgcctagcacatgaaagagctatggtaactattgtaattatgagtctttatattgccaatggcatgtatagattgttttaagcaagaatatgatagaacacgcatccctggtaacctgtcatgaaatgctggggaatgtgataactgtaaa

SEQ ID NO: 190822 - DNA, 392 bp, Homo sapiens
tcattaagtgcattcagtgtgccagcattgtgctaaggctgtggataccagatgaagaagatcctgttctcatcttcaaggaccatgcagttttgtggaagagacaggcacatacaaaattacagcacaaaagccaggcacggtggctcatgcccgtaatcccagcactttgggaggcaaagggcgggcgggcgggcggtggagggggtggtggcggctgatcacttgagggtcgggagttcgagaccagcctggccaacacggtgaaaccccgtctctataaaaaaaaattggctgggagtggtggtgggcgcctgtagtcccgggtactcgggaggctgaggcgggaaaatcacttgaactcgggaggtggaggttgcagtgggccaagg

SEQ ID NO: 190823 - DNA, 377 bp, Homo sapiens
gataggacctaggagagcaggggagacgttccaccaaagctgagttctaggggtggttttaagcaagggagagctgtgctttctttgtgaaagaaacagcccttagttggcaagttctccaatgcataactcccccaggcatggtaatgctgtttacaagcgcaggaaacccatggtgagaacaaaacttttcaagagcaacttctctcttgcccttggagatttatttagttgctactgaggtgcctggacccaagctgagatcccttgtgaggaagttgggaacacgtcctgtgcgtttcagaaatctctgttctttactttttctacaatcaacaccagcacatggaggggagagggaaaatagtgggatgggc

SEQ ID NO: 190824 - DNA, 440 bp, Homo sapiens
cgtcctccaccatcccccgggtgctgtctgatcaccctgcctgccttcagcaagaatcctgttgggtcagtttcgccagaatcctccctgcccctgatgtttccccttagtgattttccatccactgcctcccaccctgctccttggctataacccccacttgcccatgctgtatttggagttgagcccagttctataccgaggtctctgtctttattgcaatagttttgagcaaatcctgtttttactgctttaacgaccatccagctctggtttttcattggtgcctaatggaaaatgagacatgaaaccagatacaatgtcctggtttccaggggtgtggggtgtcactgggttggagagacagcagagtggtgaccctggaggctgggcggggaggtggggaaggagtatggcgcaaaggacgtgggcagaacgtt

SEQ ID NO: 190825 - DNA, 324 bp, Homo sapiens
tccgaggtcactggcagcactagccccggctcctgtggatcacagcctgctcgtcctcagggcagcacctgggcttgttgcagaagctacatcttgaaagagcccatggcctaacgctgggcgctgcagtgagccgcacggggccggagaaggagaggactcaggggagcttgtgttcaagttcactccagaggatccagtgccaggtcctgcaaagaattctaagccattgagaaagcagtggatggtttcaccatggggcttcccagtatcacgtggggtgttagctgcacccgtcttggggaacagaggtggctgtgcagc

SEQ ID NO: 190826 - DNA, 495 bp, Homo sapiens
gtgagctgtgtttgtgccagtgtactccagcctgagtgagtacactttgagtgataccctgactcaaaaacaaaaacaacaacaaaaatccctgtagctttgattatttgtttaaagactgacagaatagttcatttggattctttttggctttaacttcaagtttggacaacagaacaagaatgaggaaaagtttgtagtatggacaagttttcaaaagaatgagtcgtgtagttagaaaattgaagctgttgatcttgtcagctgaatgagctttcttaaagcttataaagggatatgtttgaatatagttttataacctttttcagtgactaatttctgtagtaaatatttggaaaagcaaatcatcacataattcctgcaggtctctttgtgcctggctccatgctaagctcttgggacataatagtgaatcagatggatattcatggttcctgccctcatgaagcttgctttctttttttttttaaaaaa

SEQ ID NO: 190827 - DNA, 587 bp, Homo sapiens
tgaaagactaaatcatgaaagagtaagacacagatacagcaaacaggagcccaacacagaagacatggcctgggaggcccacagaggatggcgagaagtgatcctagggtggcggctctgcaccagacgtggagggcaactgagccatactgcagcagtgcaacccaccgagaggtgaaggcaggccatggtgagcttagaaacaggaagtacagggcagcccccttgctctgactgtatttccactgcaggtccagcgcctggtccccaccttggccctgcctggtgcctgactatgctgagccctgtgtttcccaaaactccaagatcttgctcacgacttcctcaggaggggctttgtcagctcccggagaagcagaagtcagatcacaacctggagattgatgcgctcacctcctggagcctccatccagcaggggcagtgctgccctctccttgcactgccagtgtgcacctgctctctgctttaatattaatcatctttgatattcatttacatgtagttataatagctgcccaaatagtgaaatagtaaataaaattaccaaatgatcttctgtgaaaaa

SEQ ID NO: 190828 - DNA, 558 bp, Homo sapiens
tgcaatctataaacactcaaaataaacacatctctgcaggtggtatccccaaaaagcacaacagtcattatctaaaaccatccccctctgcagaaggacatcccgcgtgaaaatacacaagagtttcctacaaactgtatacagaaaaactccatctggcgctaaccccgggcagctttaccaacacagcccattaatatttccgcagtcacatccctttgctcttaattggactgttgatgggtcccgtgctctgctaatgggctcttctgaacacagcccggctgctcactcgaaataagaacatttaatcgccaggctactctcctcaagcctaccagtaagagcactttgtcacgtcagtgtttgtggaacaaataaaaatacaatctcactgttatctctgttggcaatgagggctcctgtcattgtcctcaaagagacacagataagggtacccacccaggctccctaaaaatcaataactgaactgcaaaatacgtcccgctctactgttgatttgcattcagcagttaactggaagagatcgcggtgagg

SEQ ID NO: 190829 - DNA, 308 bp, Homo sapiens
aaagtacagttttaaaatatcaagcaagcatcatgtcaaaaatgaaattttattaaaggagctattctagacgattaagaaatgaaaacttagagttctaggggaaaaattcagaaccacgtttaattttatacttggaagcgcgctacaaatgacaaggtaatttttatatgtatatttatagatttaattagcagttattccattatatctttcatataactataaatggaaaatgatttcagacaagaggctctcatcttcaagaattattgttggtaaagttatgggagagctgatttctcagt

SEQ ID NO: 190830 - DNA, 336 bp, Homo sapiens
tttgatatacttttcaggagccaagaataggaaaggctgcataacagactttcacaagtcaggtgtttttaatcctgtgctttcaacaaaactgaagcaatacctaattgagttaacagctgatagatcttcagaaaatagactggtgaagttaacagtaatggaccagtgttgatttccttgttgtgaccatgtgtaccacggttatgtgagatgttaacaatggggaaactgggtgagggatattcaagaactctctgtactatctttgtaacgctatgtaaatctaacactattctaaaatgtttattaaaacaaattgatgagattacacta

SEQ ID NO: 190831 - DNA, 424 bp, Homo sapiens
agtgtggtggcgtgtgcctgtagtcccagctactcaggaggctgaggcacaagaatcgcttgaacccaggaggcagaggtggcagtgagccaagatggcgccactgcactccagcctgggtgacagagcaagactttgtctcacaaaaaaaaagaatattacattggaagcatcatcagggatcacctagtctaagagaggaaactgaggctcggaaaggttagaagggataagtcattctggataactctggagggtaaatctagaagcaacaggtagatggttccagggaagctgtttttatattaacacaggaaagactttcttagtattaaagctgtcagaaagtggccagtctcatgtgtaatgaactcctcgttactggaaagattcaagtagaagctaggatttccctctccgacct

SEQ ID NO: 190832 - DNA, 429 bp, Homo sapiens
gggaggctgacttcagggcaggcacttgatccctgtgcagatggtgctgactcctagaaggctggttgatagatgccttacttgatttatatattcctgagaaagaaagcaaaatcttgttgagatgctctgcatctatgttcataaaggatattggcctgaagtctcctctttttgttgtgtctctgccaggttttggtgttaggatgatgctggcctcatagaatgagtcgggtagtagttcttcctcctcaattgtttagagtagtttcagtaggaacggtactagctcttctttgtacgtcttatagaatttgagtgtgaatccgcctggtcctgggctttttgtctttgtttttgtattttggttggtaggctatttattactgattctaattcagagctgattattggtccacttaaggattc

SEQ ID NO: 190833 - DNA, 338 bp, Homo sapiens
agctcgaacctgtggttgatgccactccagagttcctggggatagggagagaccgaggtgtgtgggtagtttgcgccttcacgtccgtggccctggaaggatatgacactcaggaccgtgggtggcgtttgtaaagcccatgtgggaagctggcagtgttaaaaatatcgtttgcagagcgtgtgaatccctggagtgtgcagcgccttgcctaggtggtgtgggtgtgggagcaagggtctctccaccagtgtcgcctgcgacagctgccaggtccacatggcctgtgaggggatgtgtgcgcaaggatgtgtgcggggaatcatctaaagtcgacc

SEQ ID NO: 190834 - DNA, 307 bp, Homo sapiens
tatgtggtatagctgagtagaactgtgtctaacactattcttaacctttcaacataaatactccaactctgagtcactcctgcattgccaccaattcctaaccaactaaagtggatttagggctgagagccgtggctcacacctgcaatctcagcactctgtgaggccaacatgggaggactgcttgaggccaggagttcaagaccagcctgggcaacacagcaagaccctgtctttacaaaaaaatttttaaaaattagccaggcatcgtggtgcatgcctgtagtcccagctactcaaaaggctg

SEQ ID NO: 190835 - DNA, 404 bp, Homo sapiens
ttttatctttgaagttaaacattctttatctgccttttatttttctgttccttttttcttgcagtattttagcacagattccatgcttttccttttttgacaaccagctttgaattagttaaggtttttctgcaccagctatttgtacaaagtttatataagggaaggactgggtatttcaagtaacgggaattttctttttgacacagggttatgtcagcatccttttaaatctttctctctcccaagccaaaagagataggcagctctacaagtatctcatctaccctctctaccacttgaacagattgcttaatggaaatatggcttgatccttgatcagtccctcctccactgcctcttaggatcaaaacgggtccagagactctcctatcatgacctgt

SEQ ID NO: 190836 - DNA, 298 bp, Homo sapiens
tgggtaattatcaaggagcatgactgctagattgtatggtaagagtatgtttagttttgtaacaattgcatttttgacaatgcagtgcttaatcaaaaacaatgttttgggaacaaaactactcttgtaggctgtctgtctgacagcatcaataactggattgtcacttgtagctttaattaccttactcatggggttaaaaggttcttttgaagggcacttacaattttgagatcataccatgaagacagtgctttaaaaacagttctgttcacaagctagtggtagactgtgaaaa

SEQ ID NO: 190837 - DNA, 249 bp, Homo sapiens
cagcctcaaactgtcttatgggtagtcaccagagtaacagatctcagattccactaaaatagctaaatgtatataaaatgtttatatcacacataaatgtttctgaattacaaaagcatcattggggctctagaggaaaatgaaaacacaagtcccagaaatctgaaaaatgaaaaacaggggtgaaagataatgagaagtacagtcacatctaaagtcaggtcatctgggaaccctgcccactggatg

SEQ ID NO: 190838 - DNA, 454 bp, Homo sapiens
ttcatacccaactctccatgaacactgtttctcttcctgtgtccatctcatggaacagcaatagctttcaccacattttcccacttagagatttggcatcaccatctgtccttctttttcattcaaccacatcctgtcaatcaccaggtctattttttctatctctttaatatctttttagctaatttgttattctccatactgcctaccacctctgtcatccaagtgacagtcatctcttgcttgggatgctctacctttctaactatccttccttctttgattcctcctcttcaccttctaatccatttgccacacaagcccaagaagatttattccagtgcaaatctgaacatgccttacttataatattcagtggcttgccattgccaatggaataaagcccaaactcttcaagactagtaggtcttcatacttagaggtttcacatgat

SEQ ID NO: 190839 - DNA, 290 bp, Homo sapiens
gaggcaggggcagaggctgaactctgaagactactcctcctgacccaccccaaggcttttttgccttgtgatgcctccactaggaatgccagctggcttttttggtggggtacatggactgctctgtgtagtcactctcctgttctggacctcagtttaccccctcaacaaggtggcatcgttagagtgtgagcccctgctgtctcactgagaggagctgagaagaaacatggggcgtgcattcaaggtgttaccagggagctggtgggagaagcagtctcagtctcaaa

SEQ ID NO: 190840 - DNA, 121 bp, Homo sapiens
ccatatgcaatggaactgggttttcttgctgtagaattgtggtgtacttttggtcagccagcactctctgtggcttagcaaccccagcatctcctcccaacaagcagggaatctgttagca

SEQ ID NO: 190841 - DNA, 455 bp, Homo sapiens
gcgaatggcattttgtttggtgttttctccattgtaagtcctgttgcctgaggtaaggtaaaattctttttcctaacataaatttaggaagttgagtatgaagaagaataaatgggtctaggctggaagaacttgattgattgaaataaaaaaattaaaggctttttgtcccacagtgataatcaaaacatccttctattatttaaaaaacaaatcttgatgtctagtataaaaaaaaaaaaagaacaaactggctgcaagttgtgaattcattttgcctgtctgtgccagttttccaaactggcagaagggagactttatttctgagtatgtactccattaaatatttcaagttgttagaagtattcttggtttttgttgtgttttattttgatgttaagatgggttctcagaccctagcctaagatctggatttctgtgttgtcttcatgaca

SEQ ID NO: 190842 - DNA, 391 bp, Homo sapiens
atcttccaccacgattgtaagtttcctgaggcctccccagccatgctgaactgtgggtcaattaaacctcttttctttataaagaaaagtaactctcattcaagttacttcattacctttcatcttccagcatattgtgttagttactgacttttatttttcagagataatttcctcatagccaaatgcacagatcttacctgtgtcattcaatcagttttgacaaatcaaattcccacgtaaccagcacctctgtcaagacacagaacattttatcaccccacaatgttgcctgtatagcttttccctaaaagctaccactgatctgatttctggggtttttttttgtttttttgtttttgaaacggagtctcactctgtcacccagtct

SEQ ID NO: 190843 - DNA, 245 bp, Homo sapiens
ggttccagtttctccacatcctcaccaatacttattatttgggggacttctggtgataatagccttcctaacaggcgtgaggtagtatctcactgtccatttgatctttaaaattatgactattcttgagacatttctgtaaattttatatatcagagcaaaaacaaatttcagtccagtttttcttcaaatttttttttattctgaataagaggaaacaaattaggcttcaaaaagctagtctt

SEQ ID NO: 190844 - DNA, 409 bp, Homo sapiens
gaggatgtatccgtatcagtacaggaatacagtgaagatacttataaaatacagaaaaactgcccagcaaatcagggccggtaaacagttggtagattccataaattcaactggctaccatgtatagccctcactgtaaggtaggtggttctcctctactttgtggctttgacttttggacacatgtcctctgtagttctcacagaaagaaaacagagctagagaattatacaggatattaagggccaggcttggaaatggccttccgttcaatacattctagaacactttatctctgacctgctacaaaggagaatggaaaagatagtcgtaatttgagctcagaaagagaaaatagtgtggtaaatgcacagcattgtttttgctgcagtgcatatgtctgcttatt

SEQ ID NO: 190845 - DNA, 443 bp, Homo sapiens
cagtgcccaatgccattagtaattaggaaaatgtaaataacaaccatggcgagacagccctccacacccactaagatggccaaaaatcaagaagactgtcaataccaaatgttggtgaggatgtggagcaattggagctctcctctgctcctggcaagagttaaaaaataatattggctaggcattgtggatcactcctgtaatctcagcattttgggaggccgaggcagtcaggagtttgagaccagcctggccaacacggtgaaaccccgtctctactaaaaatacaaaaattagccaggcgtgctggtgggtgcctgtaatcccagctactcaggaggctgaggtaggagaatcgtttgagcctgggaggcataggttgcagtgacctgagatcacaccattgcactccagccttggtgacagggcaagactatctctca

SEQ ID NO: 190846 - DNA, 274 bp, Homo sapiens
aagacaacatatgtatacacaatcttacaactcaataattcaataatttaaaaaaccctactaagccgggcgcagtggctcacacctgtaatcccagcactttgggaggccgaggcgggcggatcacgaggtcaggagatcgagacgatcctggctaacacagtgaaaccccgtctctactaaaaatgcaaaaaattagccgggcgcagtggcaggtgcctgaagtcccagctactcgggaagctgaggcaggagaatggcgtgaacccgggag

SEQ ID NO: 190847 - DNA, 434 bp, Homo sapiens
gaagatttttttattgagaaacaatattacaaattaattaaaacatattcctgggcacccttaaataaatatagtggaataaagtacaagataaaaatctacttaaacacataattagcttggctaatctttcttctccctattctttcttctccctattctttccttcctaattgttataatattgacaatgttattttttcatagatttctattaaagatttttttcccatattgtagagataatggtcacagatgttagtagttcctgattccttatctctccaaactttaccttgatattgtgaataaatttcacagaattaatttcagaataaaaagagaaaaaaccataatttctggtcatgtttttatgcctgtttgtggtttgtaaccccataagttgtcaaactttgtgttcagtttacagattt

SEQ ID NO: 190848 - DNA, 271 bp, Homo sapiens
gacgatggcgcgtccaaacagtgcagctctggtcgactgtcctctgttgggtgcatacccaggagagggaccgggggtcacaggcctgatctgttttcagtgtcagtagttacctgcagcctgatgacgctccagcacagctgtcctgatctccgttcccatcagcagtgagagaatgcgccgctggtgccacatcagtacttagcactgcctttttggggtggggggatatcctgaggactgcgctatcggataccgggatactcaagat

SEQ ID NO: 190849 - DNA, 235 bp, Homo sapiens
gcaataatatctttaggagtttctaaaaagtctattggaaatcattttataataaagatattaggagccctcatgtttttgaaacgttctaaaagttattttggtaaatcattttctccactttatttgttttgtaaatcctaagccttatgtgttgggaatttgtttagtactttattttaaactttacaactttattataaactgaggatgcaaggaacaacatatttttctg

SEQ ID NO: 190850 - DNA, 1007 bp, Homo sapiens
gaaaacaaaacagaaaaactctaaatggctttccagtgccttaaggacaaaagtttataatgtagcctcaagggtacacatatagttggtgtacatatagctttacatcccttaacaatgggatacattcagagaacctcgttgtgtacctcatagagtatacttacacaaacctatatgggacaacctactaggcacctaggctatgtaatatggcttaatgctcctaggctacaaacctgtacagcatatgactgaactgaatactgtagactattggaacacagtgctgtgtaggtatttatttatctaaacatatctaaggacagagaaagtacagtagaaatgtggtataaaagagaaatggcatgcctgtgtagggcactgaaccatgaatggagctgtcaggactggaagttgctctgggttgagtctgtgagtgagtggtgagtgaatgtgaaggcctagaacattactgtacactaccgtagactgtatgtaaacactacagttaggctacactaaatttataaaaagtttcttcagtaatttaccttagcttactgtaatttttttaacttaataagctttttaacttttttttaaactttctgtctttttaaataacacgtagcttaaaacagcctcataatatggatccactgtagtatatgtggtctgttgtgttgacagaaatgtcattaggtggtgcatgactaattacttttgggcctcagcctcatcttgtactgtttttccccttgctttcctttgctccagttgtgtggggcctccttcattctcctgtgctcaccatattctccaccaggaatcttggcacttgttcttttcctctgcctggaatgcctttctttgttaacagttattcctggtctttagagtttggctcaagcatcacttttaatgaaattttctgtgtgcgtgcttgcacattttcataagataaagagattggactgtactgatattcatcaccgactccaaca

SEQ ID NO: 190851 - DNA, 146 bp, Homo sapiens
actgaaaaaaacgctttaaagctaaaccatttatttaaaaactctataattccaccaagtacaataaacaatcttaacttccttgagcaacctatgctttttctacttaaaaatctctctctcaatgaattcatgcctaagtcttt

SEQ ID NO: 190852 - DNA, 322 bp, Homo sapiens
agaagccagtcaaggcctatgccctggctcaggcaggctgagacactgaatcaaaacggagaatctgagaacagctgaaagagcatttcttgatttcttttttctttttttaattaaaaataaaagagatccaagtaaggtttacacattgcaattggtggatataactcttaggattttttttttctttttgaaacagggtctcactttgtagcccaggctggagtgcagtgacgtgaacacagctcacagcagccttgacctcccaggctcaagcaatccttccacctcagcctcctcagtagctgggactacagacatg

SEQ ID NO: 190853 - DNA, 392 bp, Homo sapiens
atccttccgtttcatttctatatttttcttttcactgctggtatagaaagatttctaatgtaataactataagaaaaataggccgggtgtggtggctcacacctgtaatcccagcactttgggaggctgaggtgggctgatcacctgaggtcgggagttcgagaccagcctgaccaacatggacaaaccctatctctactaaaaatacaaaactagccgggatgttgtcattttttaaactttttccattcaagaaaaaagctcattgtttttgttttaaaaaaaatatactgtggcttttaatttacatttcactgattattagtgaagtatatgtagtaaaaaatgtaaggcagcagtctaatttcaatccttttaatttattgtactgg

SEQ ID NO: 190854 - DNA, 293 bp, Homo sapiens
tccagactctaggtggttaccaaaatgcttttctttctgggagtccccagaccctccctgtctcctccatttccaaggagttccacatctctttggtgggattcagggggttttctggggtgggctgtcatgtcagacctgtctcaagcacacactgagaatggtccctggggtgctaagaggatccagtagcccctggtcctcattcatgggctcaggacttgggtgtccagggcacagtggcctccctgtgggaagctcagaggctggggagcaggatgctgatactcttg

SEQ ID NO: 190855 - DNA, 697 bp, Homo sapiens
agaataaaggtgatttaagattggttttacaggcactcttgggctgtcagctagttggcttttcagatgatgatcataaagacactccccctcacgcaggtatatgagtaagtaaggtctaccccatccacactcccatactgactttccattcccaataattgcacagactgcatactctgatcgcttattaaacatttctaaggaagccgagatggatctttgatgtaattttctcatctgtatacccagccagtaagtcagtagcacctaagatttctttcccttcaagattgtattctaagcagtagaattaaagtgttcttcatagaaaaagtaacttttaattagaggctgtgcaaactctggagaatcagtctttgttaccagataataatgtttttagctttttctgctgagaggaaaaaatgctttgaagaataaaaaatactagagcataacaagcttggggagttaggaaaaaatatattagggcagtaagaaccagcattacgtcttctctgcaatgcttgaaacattcagtattaaactttggattaatccaaagtctgaagagaaatacaccaaaatgctaaagccgtttttggttaggatagtggactttttttttcttcttcagaatgtttgtaatgagcctatattttataatggaagcaataaatgcaaatgtgaaatt

SEQ ID NO: 190856 - DNA, 505 bp, Homo sapiens
ttctgctcaagatgggtccatcgccacccacgttcatgggaggaggggtgaggttggtggcaccagggaagttgagaaaggtcaaggtgcaaagtccataagtcagtttctactagctgccttgtgggtgcttgtccttggcttaaaatcagagggacatacagaccctaggcccaccatcaacacaacaaggacgaccagcacacaggtctggatgaaacattttgcccatttcttattgaactggtgattctaacctctggatctctgagcctgacattcccatgtgagaatctccccctgctgattctgaaaatgaatggatgtcatggatatgccacttgcaagttatgggactgcaggtatattgctgacctatccaggacacagcctcctcatctgttcaatggaaagaagaattttatccaaagtgtgttgtcgtgaggactaactagttaatatcagtcacagcatttgctattgccatagtcagaagactgagaag

SEQ ID NO: 190857 - DNA, 140 bp, Homo sapiens
gctcctgagtactctgcaaattgtttttgaatgactgctagtatgtgggtttgaattttggtatttatgaacattatttttttttgccgtggggaacggagtcttgctctgttgcctgggctggagtgcggtggcacgat

SEQ ID NO: 190858 - DNA, 344 bp, Homo sapiens
tcgactctacacggcatcccccgttagatatatttgctagtgggctgatagctgatatttcagaaattctatcccctccttagagcactatggttctggaaggcgggtttggaaacaacagctctcagcgttcataccaataatactcttgataatgatccttggtcaatttcattatccacagacacaatccttccaatactcagcctcctggttcctactccttgctcttctccaccaatcttgtcctttatggcattgcggccactacacccctatggccgttcccttgactgtgtcattactcccagttgtgctatctgtactatcttgacttcaaacat

SEQ ID NO: 190859 - DNA, 464 bp, Homo sapiens
agatccccccccaaatgatccctttaagtctaattacacttgccatacctcctctccagaaatatatattggtttaaaagagtaaaacagcagaccctaaacatctggtgtttttttttttgttttttgttttttttccttcctcctcttctttgtcctgtctttcttttgatttttttaacttttgactttcatctttgtttgggtctttttctttctctctcttttttttcattttaatgttttcattccctcaattttttcttgaaaatgtcagttttcatttttataatattaaatgttttgtgctcgatgaaaagcaataaggattgaaagcacatctatttttgtacttacacacttttacttttttacccttttaatatttagaaaccacacaatataattatttttagaaattttgaagagtaaataaggttacgttattaggattcaattatgta

SEQ ID NO: 190860 - DNA, 580 bp, Homo sapiens
tcacgcttatctggaccatactggcttacaaactggaaaatcagactcagaaggtgctggaaagtagttctttgttcctgaggttcatatagaaattgccacttgttccacaatgtattaggctggaaacaatacttggttcagagtgcttaaggaggccaagcacggtggctcacgcctgtaatcccaacactttggaaggccaaggcaggtggatcacctgaagaccagcctggccaacaggatcagacctactaaaaatacaaaaattagccgggcatagtggcatgtgcctgtaatcccagctacttgggaggctgacacaggagaattgcttgaactcgggaggcagaggctgcagtgagccgagatcgcgccactgcactccagcccgggagacagagcaagactccatctcaaaaaaaaaagaaagaaagaaagaaaaacagtgataaggaaccagtagccaactccaggaactagtggtcaattctagtgcttaggagctggttcacatttttcaattgctgggttgggaaggggggctcaggtttacagtgtgttgggagctggtggtgta

SEQ ID NO: 190861 - DNA, 258 bp, Homo sapiens
  misc_feature (15)..(15): n is a, c, g, or t
  misc_feature (21)..(21): n is a, c, g, or t
  misc_feature (70)..(70): n is a, c, g, or t
gtgtttgttgcattngctttngggttcttggtcttgaactctttgcctaagccaatgtctagaagagttntactgatattatcttctaattgttatggtattaggtcttagcttgcaacacaggttcctgagtgtcatttgaataaaaagttaagcacgactataatacatataaattaatgtgtgccttaaaaaataaagcactacataaaatgtgtggtagtatttttatgtacatatgcatctacatgcatcact

SEQ ID NO: 190862 - DNA, 262 bp, Homo sapiens
agggtgagattgttaatcctaacaagtactttgatcttacattttcttattctttgatttttttatggcatatggcataggcttaaagacaaaataggttctatgtaaatcctagttggcgtgtgagatattttagcataagagtccgtgaggttattttttaatgttgtgtaagaagatacaagaaaaacaaaccaaagtgttttttcttgcctattctctctttcttttttaaagagacagagttcctctctctcacata

SEQ ID NO: 190863 - DNA, 450 bp, Homo sapiens
atttcttaggtcacagaatttctgggtcataggatatgagtttacttgactaagtggtgccagattctctccggattggttgtaggagtccagactcccaccagtatggaatgagagtttccatatcccacatctgtatgaacacagcactgtgtagctgtctcatagttatcagtctaaacggtataaagtagtatttctttgtagtattaatgtgcatttctgattgccagtgattttgaatagcttttatgcttgttagctttttcagcttgtttgtaaattgccttttgtaccttttgttaaaatgtaattgggattagtctttttcttgttaatttgcaaatgtttatgttttctagatattaactctctgatagttttagactctgctgataccctcttatgtattattatactttttattaaacagaaatacttattttaata

SEQ ID NO: 190864 - DNA, 310 bp, Homo sapiens
ctccaccatcctctccctcacttggtttttgaacagtcgtctaagttgacatgagttagatgtccagagcaagaaaagactggatggaggggtgaggcacattccttgttctctaaagtccagttcccaaatgaacaaaaccctcaccatcttacattcatatctttctcaatttttctaacatgagtccattccatctcacacaacacaggagtcctccttttggtctgaagccagtatggttctggctctgctgaggagagctcatcttgaaacatcttttcacgtggatattgtgggaagagagcct

SEQ ID NO: 190865 - DNA, 320 bp, Homo sapiens
tactattatgtcgacttcatatgatttaaactctccagaatagacagagttttaaaagtaaggagtagagtgatgaatgaactgggaaaaggaacaaggatcaatctctccaggaaccataaacccatgagaaattccttctcaattgacacactcatacagactcttcttaaaatgccaggtacaagtaaaacttaagttcacgttcctctctactaacatttcaaaaaagacaaatgcaatttaaacattgagcattacttcatcttcatttcttaagttaaaaaaaaatcctctcgtttccgacattcacagggttt

SEQ ID NO: 190866 - DNA, 231 bp, Homo sapiens
ttcttaataccaactcttttctgaaatgaatgcgagttccttaatcttactgtataattaattatttttccttgtgttccccatcttctcttgctccaggggagatctttaaatatgcaaactacttataaagaaatggtgacaccatgctgagcctctaatggacttgaaaaatcagcatctctacttgaaagctatgaaaattaaaaagaagccacacagtactttcat

SEQ ID NO: 190867 - DNA, 499 bp, Homo sapiens
aaataagcattttttaaaaccaacaaacaggctggacaccgtggctcccgcctgtaatcccagcactttgggaggctgaggcaggcggatcatttgaggtcaggatttcgagaacagcttggccaacatgtcgaaaccccgtctctactaaaaagaaaaaaaaaaaaaaaaaaagaaaaaagaaaaattagctaggcatggtggcacttgcctgtaatcccagctactcaggaagctgaggcaccggaatcacttgaacctgggaggcagagcttgcagtgagctgagatggcaccactgcactccagcctaggtcacagagcgacaccgtgtcccaacaaaacaaaacaaaaaacagcaacaaacaggctatttcagtattatggtaaatgttgcacttttcaacagatgcaccctgagttcttagattatctagttcctttatattctctccttttaaaaactggcctgcattttagtcacttcaccagcgaagtta

SEQ ID NO: 190868 - DNA, 526 bp, Homo sapiens
attttctctctctccatctttcttgccctcagaatgctgggaacacaatgtagcctacgaagcccaaggaataaacattgtgccaataagatgttctttaaattctaccgtagagtccatcctgattggctgcagggtcattgtgtacaaaacccactgcattaaagcagataacatctgtgagtcctccgatttcctatttggctccagtgtcaatataataatagtgtcttgtagatatttttactctaggataaacagattaagctccacttctatatacaaggatttgaatatggcagaagaagccaaaatgggggctttctgtgtacctcctgtaaaataacctgctcatcacattccttgccactgacaattcaacatgcttgacattcgcacatcggaaggggagtgcagtggttactcctcttcaaatgtattccctacccccaagaaaactcaaacataatcaagggaaagataatcctactttgacagaaaaaggaaagcaagatctgtgcgtgtt

SEQ ID NO: 190869 - DNA, 236 bp, Homo sapiens
ttgtaacttctatacatatgtttatataaacaaagggaaggaaaagaatgaacaaaaactaacaaaaccaatatgccccactggcatccaaagagagcttaaatctaattttaactaattcctcaaatttcaagcttagctatttctaaaagaatgagactaggtaacacttggaagtctacgagctggtcccgccttctcgcctcacagcctgccacgctccagctcaggctgtt

SEQ ID NO: 190870 - DNA, 95 bp, Homo sapiens
tagtgtagacacagggataggaggtggaggagaggggaggctgggagacttccataataaaggtattttttaaagcagtgctcactacctaacag

SEQ ID NO: 190871 - DNA, 465 bp, Homo sapiens
cacgcaataaagatgagctacaagactgagaaaggatgaagcaagaaggaggagaataggctttatttggccactttgcaagaaagaagcctgtctccaagtatggttctaactaccaattaggtgtaggtgtatcaaggtttactaggaaggaagaagacttgcttaatgattaataattagtaacctaagctttggaatcagacagtcctgggtgctaatcctagctctgtgtgctcagctacatgacctaagccttgtaaatttcagtttcctcatctggtaaaatgggaaccccctaactcattgtactgagggtcaaatgggagataaatgtacataaaactcgtggtaaattctcaataaatattgatattagggttggttagccaaagagaacttttcaagggagaaaatatgtcactctcactttctctctcaatgtctcatacttcagggaatctt

SEQ ID NO: 190872 - DNA, 418 bp, Homo sapiens
caggcgttaatacgtcgtcagtggaaaaataaccttcaaaggcagaccattaaatccctcaaacgacacctaacagcaaaatttaaaatcatttagcatcactaagctttaattacaactaagaagttccgacggtattttttggttaaaaaaaaaatgtatgctctttattcattctctcccctagacttgggaggcagaaatgcagggataagcttgcaaacgactggtgtgccaaatgcaaaagcgcggtaggttcctgacacagaaaacgagcctgatctaacacgtagaccacctatcttctgcctcatcgcccaaacttccaaaggatctgcccttaatggaaacacagttaaacctatatcaacaatccttcggcgataacaagaaagtaaaccacaaataacctgtcccg

SEQ ID NO: 190873 - DNA, 352 bp, Homo sapiens
aagtaaaaggtttctctccagtatgaattctcttatgttcattaaatattaaagaccatttaaaggctttgccacattcttcacaagtgtagggtttctctccagcatgaattaccttatgttgagttaggtgtgaaaacttctgaaatgatttgccacattctttaaagtgtttctctccagtatgtcttgtcttacgtttgtttgaatttgaaaatttactaacaactttgacacttgctttacactgaagtattttgctctgggtagttgacaagcattcattaaattcattataacctcctttctgcaacttacactcattcaaacttttacagccttttcttaattg

SEQ ID NO: 190874 - DNA, 180 bp, Homo sapiens
atgatagaccaaatccctctgtgagaaatccagaaaccggttacaggttgctttaccacaagtgagactaaaatcaacggcatcaaagccaggtaggaaaattcaactacctgtcgcttgccagagcctcccagcccccaacccctgcacagcgtggagcaattgggaggaaaccttcaa

SEQ ID NO: 190875 - DNA, 462 bp, Homo sapiens
agtagcgacaccgtacctggagagcacctctcttcccaagaaggaagttttggcagcactctccgctggtggagcagtggtctatggaacggaagcatggccaggggccctgccctggacctcaggtaaaccacagctgaccctgtgccagctgtagtctgaagttttcctccccaagagccagcggcgcaggaacagccccaccccgacctctgagacggtgtgagcaaagcggtgctctggggtggtcatagcccgggagcgtgggcagcacacctttctctggggtcctgatctgctgctagtggaggggtggttctcccaggtaaaagtcatggaacctgcattcctacagttttttcacggggcatttcttggaggaggaggtggttatgatggagactcaagccagactgcctgggtcggaatctcagctccatccctgctggacggtgcaactct

SEQ ID NO: 190876 - DNA, 257 bp, Homo sapiens
tcttgccaagatctgataattttgtctatttcattttagccattgatctgtgtgtagtgatgtctcactgtgcttttagtttgctttctctgatgactaatgaagttgggcacactgtcacacttttaatgtccatttggatatgctcttctttgaagtgtccaagtagttttttgcccattaaaaaaatgaatttttttttgtatttgaagaagtgtgtttttgaagacaaagttttgctcttgttgcccaggctg

SEQ ID NO: 190877 - DNA, 249 bp, Homo sapiens
aaaggaagaggagaatttcttggaaggacaagaggagaatgggcagtgcaggtggagagagaagctgggcagaggcagcaaggccaacaggcagaaggggccagcagttcagtaaagataatctcagtagtggataagtatttatcataaaccagaaggaaagattatgccaagttgcaggattgctcccccacagactgtgccctctaagtgtaaaggcataggattatgtgtctacaagttcctcag

SEQ ID NO: 190878 - DNA, 269 bp, Homo sapiens
gtattacctgtacgcatgttactgtactgagtgctgtaggcaatcgtaacacaatggtatgtgtatacgaggctacaccatctaggtttgtgcaagtacactgcatgacgttcacacagcaaaactgtctaatgatgcatttctcagaatctaccccagttgttaagtgacccgtgactgtcctgtcctataaatgactatcattgcaattactctggaaaaattataaaacaattcatcagtctcagtcagaacaccagccccgacag

SEQ ID NO: 190879 - DNA, 124 bp, Homo sapiens
ggacagaagaggctgctggcatgggccaccacacaggcaatgggctaagaaagaacagtcaggatgcaagagagaaatttctccgagttcataaccagccgattgtgcaggtgcaaactttgtg

SEQ ID NO: 190880 - DNA, 320 bp, Homo sapiens
aaatcagtatctacttctctaggggctttattccacattcctggagtgagttttagaaagttggtttagaaagttataaatctttttttgtttccctgagataattgtctgaatgttaagatttactaatatgtttctcggcctttatccatggcttgcaatcctcatcacatcatgacttcataggcaactcctttttaattttagcttactttggaggtaagggaaactccaatctaggggataagataaaaatcatggaaagatggcaagcaggtactcctgaagtgacaattcttttttggtgttttttttttttg

SEQ ID NO: 190881 - DNA, 684 bp, Homo sapiens
cctcatctattgattatataaactaaagaagctaagaacaattaacccttacgaggttacacagtcaggagatgctgaactgagattcagtgtagaaagtctgtcttcagagcctatgcttttagtctttatgctaagtttaacttgtttaaatagcaagattatgaagcactatacagtgacctcgtatagacaaaaatatagtatattgattattagagaaactacatattagactgttgtacatacgtgggcaagtatttgttaaatcatttcagttgcctaaatttaagcaactgtgctgtttaaaacatgctcattcacattttttcttaatctagaaagtcacttctgaataattgcttgtttagattttctcatttggtgtgggaaatttatattaaaattttaactaatattctaacaatacagagtctgaacctaaagtccagaagaattttaagtcatgccgcagacaggatgaacagtatagcaaatcagaataatagactgtttgggggggttggggggaacccatgagaatttcaggatttcaagataaagcttggaattgaggtaaaggcatcagataaggaagtgatcatttcataacttgtttttgcttgaaatatattatattttacatcacaaaagtagtataactgttattttgctaatgcacag

SEQ ID NO: 190882 - DNA, 224 bp, Homo sapiens
tccagcctgggcgaaagagcgagactccatcaagaaagaatgggaaagggaaaggaaagaaaggaaagaaaacaaagaaaaaagaaaaagagaaagaaggaaggaaggaagggaaagagggaggggactctgtccattggacaaagcatcccatctagcatgcctcttatcaacaagcgagatgctgctggagctaccacttgggttgagggaatggagggcag

SEQ ID NO: 190883 - DNA, 445 bp, Homo sapiens
acctgacggctccagggccctcttgcgagtggacctgcgggagctgtctttttctgactggcttatttcacggggcacagtgtcctccggcccgtcgtgctgcagcacgggtcggtggtcattcctctttatggctgaattattccattgcggggagaggctgcatttccttgactcactcatccatcggcacagcaggtgcttccgcattttggtcattgtgaacggtgctgctgtgaacatggcgtgcaagtgggactttcagacgctgcttttttatgtttgtttttggtttttggttttttgtttatttttgtttttgtttttgacggagtctccctctgtcgcccaggctgaagggcagtggtgtgatctcagcttaccacgacctctgcctattgggttcaagtgattctcctgcctcagcctcctgagtagctgggat

SEQ ID NO: 190884 - DNA, 443 bp, Homo sapiens
tggctgggcaggaggacagtaatcagatgggtagtcgattttttcaaaaagtatagcattagtgatgcaaaatggggtgctaatgatttcctagggcttggcatgaagcagacagtaaattatattaaaacctatcacagtgataacagtgacaatggccaactactcagccagagtgcaacctgggcctggcatggtctaagcgcttctcatacacgagctccctactcctgttaaagaggaggaaagagaggctcaggaggtttaaggaacttgcccaagctcacgcagatgattgaagccatggagaattcagtgtagagggccaatcctaggatggtaggatttctgagatccaaggcggctcaggacttgtggggctgccaggggcagtgaccccgagtgccccaccttgcagcaagattcagcctgggaccccagca

SEQ ID NO: 190885 - DNA, 359 bp, Homo sapiens
tgatgacttaacataacatacatctatacagagttccaaaaaagagagagaatgggataatattctaagagataatgatcattttttcagaaccactgcaagatccaatccagattcaagaaacaacaaattccaagctggatacataaaaagaaatctacaatcagcacatcacacagttcaactacagaatatcaaagacaaaaaggatctttaaaacaaccaaagaaaaaagattatcttcaaattggaaaccattaagactgatagatgagttttgaaaatcaacaatggaagccagaaaatattgtcagtaagaatataattaggggctgggtgtggtggctcatgcctgtaat

SEQ ID NO: 190886 - DNA, 446 bp, Homo sapiens
tatacaggaagatttttccagatgatgagtaaacagcaaactttcaagatcattctttggcagagattctactgaggtaggaaagtggcaggacttatttgcggttgtggcccagttgatcagagcaggatctggtccaaacagggtgcagtaaagaagctgaccaaaaccagcagatggagacaaaagctacctctagttgctctcactgctcattagcataaagacactcctttccagtgccatgacagtttataaatgccatgtcaacatgccatggcaatggccaggaagttaccttatatgcttctggaaactcctcatcccttttccaaaaagttctgaatagcccacttcctaattagcatctaattaaaagcatctaaataaatacagctagctagcaacccacacactgcccatgggttagccttcctccacgagaa

SEQ ID NO: 190887 - DNA, 239 bp, Homo sapiens
gagtgacagtgaacagaagtttgtcctgagccccatgagcagatacaagtgatcccttccatccaagaaataaacagagctaatgaggatgcttcacattgttcactctgaccctttcacagcacaaattccaaaactgagaatttttggttctgcaaatggaggcattaaaaggaaaataccagtttaaagtaaaaccaagttttggaaaatttggaaagggatttttaaagcctttg

SEQ ID NO: 190888 - DNA, 494 bp, Homo sapiens
aatcccagcgtttttccatcctgagcagtgaggctgcatcatgttccttctctgtcttccctccatccaggaaaaggacatttcactatgcagccccacagaccacagtgtgcaagtagcatagcttgaggaattgatatgacaagaaaaccttttcaactactattgagctctgggcaaacacaccataaggaagattaagacacccctttccccccaaacctcaccaaataacaaacggggggaagaggaagagaaggatgctccagaggcaacaaaacagggtctgactgcatcctcgctcctgagcgtagcagtcacgggaaaggaggatgtttgcagggcaagcgtcagagaggggaccctgacagcacagggcaggatggagaggggaccctgatggcacagggcgcgccagagaggggaccctgacagcacagggcaggatggagaggggaccctgacggcacagggcaggatggagaggggaccgt

SEQ ID NO: 190889 - DNA, 759 bp, Homo sapiens
cacattgtttgcatgtgtctgcgaatgtgcatgtctatctgcgtgcctgtgtgtatgtgtgtgtgtgtaaatgcgggtgtttaccagcgcatgaatgcccccgtgtccacgtgtatctgcgtgcatgtgcttacacgcgtgttcgtgtgtatctgcatgcatgtctccgtgtatgtgcgcgctcgcccgcccgcaggctctgtggtgagggcattccgaggcggagtacggctgtcaggggacctctcccactccactgcagtcccttcccactcacagtgaaccggtgcgctgcctgaggtgcagcctagacgcttcctgcaaagtgttggctcggcacggtagaggcgcaggaaccaaccggtgagccctctcctaagagacccaggggaagacccaaaggcagcaaaaacaagagtccctctaaagcagctcaaaaggaaccaaccggtgagccctctcctaagagacccagggaagacccaaaggcagcaaaaacaagagtccctctaaagcagctcaaaagaaagcagaagccactggagaaaaacggccaagaggcagacctaggaaatggcctggaagctagcaaaagcttttgcagagaactgaaactgtgtcacagagcaccagcactgtatttgttatcattttggccttcagttttattaatgcttgtttgatgtgttaagcccctagctaagacaaaaagacagaactttagggtttttgtttgttttagcagtaataaagtctaga

SEQ ID NO: 190890 - DNA, 679 bp, Homo sapiens
gcggacgctggtgatcaggaccacaggaagccctatgggaagaaggctgtggcgtcagtaaggcaatggcttccggacctcagtgtgtgcaaaaatcaagtggtgagctgttcaaatgctcatccgcaggcctcactccaagagagcctacgtcactaggtttggagtgaggacagaaatctctcttaaataaacacccacaacctggatgcaggtggtgcctgcaagacccgtggagaaatgactgcactgagagctgcaaagggaccgagccgagtctcagcgagccggggatgggagactcttgtttagccttccagcttcatttccatcaacactaaaaatgttataacattgtaacaagtgcactgaaagactttcctttcagagctaagaattctctatacagtaaaagcaaaatggtttcttagaagattctaagatcgggtgacagaaggcaagtgagggagcctcagctcatgatgaaaaatcaaaggacatctccaaacaccaaagcaggtgttttctgattaagggaaaggcagtcagaaaccaaagaaaaagattgctaagaaaaggaaaggtgaggggtgttcttttcaaaatctaccagttcctcctggtataaccaattcaataaacccaacaaaagaaacagttctacatatctgaggatcag

SEQ ID NO: 190891 - DNA, 413 bp, Homo sapiens
tgagatgcagagatgttaagttacctgcccagggtcactctggtcagatttctttcactgtcatactttttctatgtcaagtttttctcactgtcataattttttccagggcactttcattaggagcaatataaacacagtggttctgagaatgtcttctggagccaggctgccttcacttcaaattcttgctttcacatcctccttccctggctaagtgaccctgagcactgcatcttgcttccaacctccaagcttcccttgtccattcctggacataagccaggctaaatatgagaggagtttagttccaagtctaagtgtgaaacaaagatgatagccctttcccgagacaaacctcttcctttcttggggatcagacctccttagcaaagttaacaaattaggcacga

SEQ ID NO: 190892 - DNA, 514 bp, Homo sapiens
ttctggaaaggagttgtccaagcagagatgacttttcctagcctccctgataatcatatggagtcagggactgtgtcttgcttattgtttgttttctctgcctaacatagtacacagctcagaggatgttctcaataaataagtatgagataaattgatactttacctctctggttgcagcttgtctttttgctaattacacagatatgggaaggttgtaggattcaaataaattttacaataagctgtttcctttttaaacttagagagcatctctcaagtctaggggcatgtcacttttccatcagcttccctgctatgaacactttgtgaatcatcctaaattacatcaaaagaaaagacatcatgttctcttctgcttggtgatacaagagggcttttccactggaaaaaatactaaattttctatttcctgtgtgttaccagcaaaaacttttttcacaagctgctgctttctgggttagagtgaataagtaactaaccaattagctcg

SEQ ID NO: 190893 - DNA, 467 bp, Homo sapiens
taatcccagcactttgggaggctgaggcaggaggatcgctttcatccaggttcaagaccagcctgggtaacatagtgagacccccatctccacaaaaaaataaaaaattagctgggcgtgttggcatgcacctgtgatcgcagctactcaggaggctgagatgagaggatggcatgagcctgggaggtcaaggctgcggtgagtcatgattgcaccactgcacttagcctgggtgacctagtgagccctgtctcaaaaaaagtagaaaagaaacaaatgcacttattccccctggagctggtcactgaggtccccacaagcctccttagggaaatcttctaagattcactcctccccagagctgaaggggtggttgaacagtttttccaatttgcagagactgacttcccccagtgcatcagtcaccataacacacaccccagtgaggacggcatataggtgtgctc

SEQ ID NO: 190894 - DNA, 164 bp, Homo sapiens
ctggctatttttttgttatattttgtagagacagggtctcgctatgctgcccagacttgtcttcaactcctggcttcaagtgattctcactctttgacctcccaaaatacagggattacaggcatgagccaccatgcctggccattatttttatctttaaattt

SEQ ID NO: 190895 - DNA, 417 bp, Homo sapiens
tataatgggtttgtttttagctttttaattttctaccatccccttgacctcttggaaatgaggccgccatctgctgtagtagttgcactcaaggtacagcctggagtacgtcggggagtaatgaccatccaggtagatctgaggttgtcatgaaagaatagagggatgctcctggctgaggggacatttatagccagaggattcttttgagtagtattaataaactctggtcttgctacctttatttcttgcaaatggtacatctccactgccccaactgaacacaaacttctttctaggagcagaagcagcagttaagtgttgcctctgtgaagttggttcgaggtgttttgtgcttgaaagccaggaatagttgcaatgcagtgtctttccctgatcctcatggcttataaataa

SEQ ID NO: 190896 - DNA, 201 bp, Homo sapiens
cattttccaaatttgctgaacatatgtaccagctcttggtgggggtggttaaaatatagatcttcagcctagcccgcagagattcagggttagagtgttgattatgggcatgtttgggaaaggctgccttaagtagaggtggcctgttgttctttagcatctccagatgtttttctctctccccaggtacacatagaacag

SEQ ID NO: 190897 - DNA, 390 bp, Homo sapiens
ggcatgagccaccacacccagcctatttgcttatttttaaggcagggtctcgctatgttgccaatgctgatcttgaactcctgggcttatgcacttctgccttggcctcacttatgcacttctgccttggtctcacttatgcacttctgccttggcctcgcaagtagctgggactacaagtgtgtgccaccacacccagccattttttcaatgtaaagactaccttgaaacattagatgaaaatgcttacatactccaaaattgcttttaccccaaaactgctttcacttgtttttcacagtgactttaacattgtagacactcaataaacaaaggatctttgagtttaggattttaggtaaggtaatgaatgatgtttgcaaagaataa

SEQ ID NO: 190898 - DNA, 374 bp, Homo sapiens
gctgcttccatgaggatgactttctgtgggaacgtggagagagtgcacagtggggaaaaatcaggtcacagggagagtggtttggcagccattccactgtctaacccaaggtggtgccatggtttaggaaggcagaagcagatggcacagcaattctgaaggtagaaccaacaggatttgataacacatggatatgggaagcaagtaacagggatgtgtctaggatgatgccaaggttttttagtgtggccacctggacatgggagttggtatagctttgaacagaaacaggaaataaatttgcttgtagggcagccactgctggctagatccccacagccattcacaactcccttctccctagtctgtacctt

SEQ ID NO: 190899 - DNA, 396 bp, Homo sapiens
gcctcccaggttcaggcgattctcctgcctcagcctcccaagtagctgcgactccaggtgtggtggcggtcacctataatcccagctactcgggaggctaaggcagggaattgctcgaacctgggaggcagaggttgtagtgacccgagatcgcactactgcactccagcctggacaacagagagagacttggtctcaaaaaaaaaaaaaaaattgttttgtttgttgtttgtttggtaagagacaagatctcactgtgttgctcaggctgcagtgaagtggcatgatcatagctcactgcagcctcaaacccctggcttcaggctgtcttctgcgttggcctcccaaatgtttggattttttttttttttgaataaacatttattttctttcttt

SEQ ID NO: 190900 - DNA, 709 bp, Homo sapiens
cagctcccccacacacctagccaacaacccactctcaaggtgggaaacaccattctaaggactcgcattaacccatctgaataaccctgggtaatctggagcagaggtcgaaaccactgaatggctcaggtacggtagaaaatggcctctgattgattgttttggacatcgctgctattgcaacagagaaagatcaagccccatcacctagaagggatttcattctttgcaacaggaaagatagttcagaatccagcgccaattattcccagaaaaaaaataccatttgaaacattacaaatgaaattgagttatataaaccgccttcctcatcccttccaaggagggtggattctgcggatgtcaagggtgactgtggcagactggaagggtgggaaagagatcaaattagagaaaaccaagggaagagcaactgccagccacctaggaaaaaggagagaggcctaggtgacaggaccccaagttggagagaaagacacacagaggggtgagtcagaggaaagctacagaagggtgtgctggggacaggcgtcaagaggtgaggctgcctcagggagaggaagcacgggaggagacctggcccaggagagtttcagaggctccacccagcagcgtgcaatagtacctcctcccccaagaaatcaggattgtgcaggaaacactctcctacttctcagtggccatctgg

SEQ ID NO: 190901 - DNA, 446 bp, Homo sapiens
gtggtgcccacagcttagtgggagagataagggaagtaaacaaacaacacgagacaatacaaagtggaaagttcttctggccccaggagaggtccggaggctgaggcaggttagaatggcttgaacccaggaagcggaggttgcagtgagccgagatcataccactgcacttcagcctgggtgacagagagagactgtgtctcaaaaaaaaaataataataagtaaatacatacaaaaatgtaaattcttgaactgtattcacatattttaggctggtacagtgattgccctttggccttgtatattggcattttacatgaatcatgaacctagattgtgatcatttatttcatttttttaggctgtcatatttcaacctagaagtctgagaaaaaaagttgaaaacacttcattgtacttggatactttactgtttcaatcacct

SEQ ID NO: 190902 - DNA, 393 bp, Homo sapiens
gagggactctgatagttatgtttgtttccaagtcttcccatgctgctcaagatggcaaagtttttcagtaaccttgtgtatcactccagacatggcagcagcccacacatacctggaatttaaatgccatacttccttgggatccagtgtgccagagacgcatgtcctcacctgaccactgtgttggagaggtccttcctcctttcaggctggcctcagcaggtggcagagatcagagagaggccaccagcggtgatccagacagccacgccatgtctctccctgttcccactctccctgtcctctcaatgcccagggcagccggtgctcctacctccagttccagctgtggggggctccagctgtctttctcttgcctttgttcctggagct

SEQ ID NO: 190903 - DNA, 450 bp, Homo sapiens
ctgtacacaggttttaaaataaccctaaatttattatgtgtgggtgagcaactcataaataaataaagtgcttccatctctaaaatgtcaaggggaaaaaaggttttacttacactcaaatgacaaacactgaaaaacaatagtaggccaaacgcagggacttgtgccggtaattccagtgtttgcggaggcaaaggagggaggatcacttaaggccaggagttcaaggaacaacctgggcaatatagtgagaccccatgactaaaaaatttaaaaattagctaagcatgatggtacacacctacagtcccagctacacgggaggctaaaatgggaggattgctcgagcttgggagttcaaggctgcaggatcacaccgctgcactccagcctgggcagcaaatcgagaccttatctctaaaaaaataataatcataataaatttagggt

SEQ ID NO: 190904 - DNA, 846 bp, Homo sapiens
gtgggaagaacaccattcagctaaaatgcagcttttattctgatcttaaacttttagcgtgaagcgttgtaatccaaataccccagggcacaatggtcagagaacacagacaatttgttgaaaaagaaattaaagtgtcaagattatatggaaaaacctttaccttcactgttataataaacatacaaattagaagaatgagctatctatttttgcatgtcaacttgacagaaattaaaaataattttcaaccagacagataaaaagacaatccagtttaaaactgggcaaaggagagctgggtgtggtggctcacacctgtaagactagcactttgggaggccaagatgggcagatcacttgaggtcaggaattcaagaccagcctggcaaaaaaatggtgaaaccttgtctctaccaaaaaatggaacaattagccggacgtggtggcatgcacctgtagtcccagctgctcaggaggctgaggcaggagaatcacttgaacccaggaggtgaaggttgcagtgagccaagatcataccactgcagcagtccagtctgggtgacagactgagaccctgtttcaaaaaaaaaaaatgggcaaaggatctgaattgatatttcttcgaagaagatatacagttggccaataagttcatgaaaagatattcaacatcattaactgtcagggagacacaattcaaaaccacgatgtgagacagcacacacataaggtagctgtaataaaaaagatagaccagcacctgtattggtgagatgtagatgaattggaactctcatcctgttagttgggttgtaaaattgtataaccactttgaagagcctg

SEQ ID NO: 190905 - DNA, 605 bp, Homo sapiens
cagggagggtgactgggaggcagccacttttgaccttatactaggatccttaaaaggtaatttttgcaaaaatattccaaagcagcgtcagtgtccccaggccctttcctaggcctttgactttcagatgtactgtttggagctcctgtgtcctcagcctggctggttttctgttcctcggaagtggggctgcccgttgctggggcttcatatgacttgagcaggtcccccgcatctcttgtaagatttgcagttttacttcacaagaccagcgaaaatgtcagtgtgcaggatggctgcacgtggtgggcggggagggcgttgatgaggagccgatttcataagtggccactttgttcatgaattttgtgttgtgatgacatttgcttcctcacgctgaggccgggccaccactgccaccctaccctgtagctgataaagctgcaggtacagtagtaatttatttgtgtttcttttataacaataaggaaatgtttgcttcaattttttaaaaagacgtgcaaacgaaagagaattaaaatgtatgtgatcctcctaagcgggtaccgagccgaatcgtatctgcttcttttcccgggaggaag

SEQ ID NO: 190906 - DNA, 123 bp, Homo sapiens
tgttatcagttggtttgcatattttgtgcatattaaactcttctctagtttaagaaggatttaagggtaataaatttgtatgtagtagatggtttggaggagagctttctgaattattgcttg

SEQ ID NO: 190907 - DNA, 941 bp, Homo sapiens
gggctggcccacctctaagaccacactgacttcttcctggggctgcaagtttctggaggcccccgggagccttccagacatctgcattccttctggactctccaagtaagcacaggcttctgtcctactctgtaaccctagagggcacctctgctgaggtcagacatctccttgatgtctgtgatcaaaccatgacaggatgcaaccacaacacacggctatgatcatgacaaccacggtccccaccacgacacaatcacgttcacaaccacaaccacgcagccacagctataaccagcccgagtctaccccacatgaatgcacagcccagttacagggcttcaagcttcggttcctgcccactcctaaccattggtggtgagtctccggcttccagggatctccaaaggtcttcctatcagtcctggagaatcagagcaggaagccctttcaacctcattgtgtagcagggatgctcaaggcctgtgaggacaggaggcatctccaggcctggtcctcatgtgctgctttccctgcacaaccacaccacctcagcatgcctgctctttcaacagggcttgcttgacactcctcccaagccttcccctgctgtgaagataagagagcagggtggccaggtgcagtggctcacgcctgtaatcccagctacttgggaggctgaggcacaagaatcacttgaacctggcaggcagaggttgcagtgagccaggatcatgccactgcactccagcctgggcaacaaagactccatctcaaaaaataaacaaataaagagcagcggcagagagagcaagggccaagctgacagcaaggctttgttgggggatgcaggaaccacccagcagggggcacggtggtggtcaaaagcgtgggggtgcacagctgggacctggccgctcctccactgctctgggccaata

SEQ ID NO: 190908 - DNA, 408 bp, Homo sapiens
acctcctaccccacgacctcctacccacgaagaaacatgcactttaaaaaataatataggatacatacattgtctcagggctgcattttattttactttgagtaaaacagtttgtctgtccaggagtcatggtcttgctaacattttgacaatttgtatgaacctctcttgagtttactagcttgctcagttccagagtgggagtagttcccacatggaggacgtgtgcatttgcccctatgtcttgggcttatcctacttctgatcaattccttcttattctctgtggtgggatgggagaagtgccagcctgtgtcctaagaagcctctcctagaattctaccttattctatgctgcaaatattgtcccaccctgacaatatgcttttcttctctgaaacctttctt

SEQ ID NO: 190909 - DNA, 402 bp, Homo sapiens
tagagaattaaactcacttaagattgaagtagtagtcatttcatactttgtgtatttatccatgttttgagctaattccagaatgttgtcagtcatattgggatgcgatatagtaatttggtttttaagtatgattttggaactctaagttactaaaatagtagcttaatttttgttcaccaaaagaatttataactgaaacttccattagagattatatgctttttatttactacttttagccattaaccaattaattataaaatatagagattttatgttttcatctacatatacaaaattaccattaagatgaaagtaattgaattgattgcatattcagttatagaattccaaatttaagtagacacagaaagtcataagtttacatctaaaaattca

SEQ ID NO: 190910 - DNA, 235 bp, Homo sapiens
agaggcatttatgaggaaggagttaatggttattttttgctgggcacaagaataactttacaggtgttgcatttgggcttaaataagattgccttatttagtttcgaaaaagagtgtaggtgtcaacattcgagcagccacaaatgtgtgagaaagtaaagggtatgagacatgacggaattaaaggtgtttgctatgttgttacaccgtgtgtcaggctgcaagctccctttgt

SEQ ID NO: 190911 - DNA, 485 bp, Homo sapiens
ttgagcagtattgtgctgctcctgctttgcttccacatgaataaaagctccctgaggccttcctggaagctgagcagggccatgcttcctataaagcctgcagaaccatgagccaattaaacctcttttcaaattacccagtctcaggtatttacagcaatgcaagaatgatctaataccttgtaccattttacattctcaccaatagtgcacaaaggttcaaatttctccacattcctggcaacacttgttatgttttttttttaaattaaccatcctattgagtgtgaggtgatatctcattgtgtgcttttttgtttgtttgtttttgttttcgtttttggttttgtttttcagactgagtctcgttgtcactcaggctggagtacagtggtgcaatctcagctcactgcaaccttcgcctcccaggttcaagtgattcttgtgcctcagcctcccaagtacctgggactacaggtgcatgc

SEQ ID NO: 190912 - DNA, 364 bp, Homo sapiens
caaaatgttcagacatttcccaagaaaaaggaagttgatctcttcagtgtggcctcaagagggcagaactagcatccctgaatccttaatcccactctcaccgagggaggaattctaacaaaacagctaataaggggtggcttcagcaagacgtgaacctccttttcactggcacgtggctctcagactttaacctgtttgttgagcacttacggattgtttttgcaaagcagatactgaagaaccagttccagagattctcggtcagtacgtctgaagcagggccctggaagctgcatttgtaagcaaatgctcctgtgtgaatctgacacaagcagtccaggatcacacaggagaaatactg

SEQ ID NO: 190913 - DNA, 335 bp, Homo sapiens
gtggatgtgcattaacttgtacaactttctacactaggagggagcagagcaaatagtaactgtaaaaactgtgaagttaagtggctattgctaagtgtcactgaaaggctaaagagaaaatgacagggccagggtgtttcatcaccagttcaaagccaagtgttgcctctttggaaacatttatttcctttagatagagaactgatgatactaaagaccaggcctagcactaaattgtaagtgtgacagaatttaagaactctgaatcccaggcaagtctcttatgtcaaaataagagttatgatatgaaaaaagtgaagtctaaaggatatctg

SEQ ID NO: 190914 - DNA, 405 bp, Homo sapiens
gcttatttgtatggtttatactaataggttaccttgtacttctgcttctggttgggctttgtctcggggatccctaggaagagatcaaaaggaagaaggagattacgatcaaggtatttactcctccaggctgcattcttgtgtgctaacttcaggctggccagatctatcaacagaaggccactcttactctaagggctgcaaattcctgtcacctctttcccttagggtccagtagccattccttcccttcatcccttctggctcaggtggagaaacagcttgcttgctacatgcccttggttaatgcactaaccttttgtttcccctataatcccacctatgctttttgtaaagagttcttttataaataaaacttcctccaattctctttgttcaatgtgt

SEQ ID NO: 190915 - DNA, 370 bp, Homo sapiens
ctcatgataaagtggtttcattaaagttaaaacaaacaagttacagtcttttaaggccatggccagagagatcaattcaaatatttggactccatgttagatttcacagcagtacagtttaagtataatgaatagttcatgtattttgttagatcatgagcctctcttatcactcaagaaaacccccgagtcttatttattcaagattactttagaattcccagtacatgttcagtaactattaatgatcacagtggtaatagagaacgaatgggaagctgggttgccattgcaatcaagtttcttctagatttgttaatgtacctgattgatagaattaactgaggaaagttttttttttttttttttg

SEQ ID NO: 190916 - DNA, 548 bp, Homo sapiens
tcctccaaaagtctgaaatattcttaatagaacaaaattaaaagacatggtttatgtcaaaggcatgcatttgcacagaaaatatctgctttcatgaactaaataaattctttcttgaccttagtatcagatgctagatccagtggctatgaccaccttcaagagctattcacaatggggctggccaagttctaccttgaagggcctcataagacctataaaatgtgtctcatgccacaaacactgtgacctccaaaccatctctcttctccaagtgatctgtcccacatacctttggaataaaaagtgaatcaggcttcactatatacatgctagagacacacacctgaactcataagataatgtacctcaattttttattttgaccatgactcgcagtaataactacattttcaaatctgatattgtatcctcatgcatgtgtacttataaaacagaaacaagtttcattaaacagcatttgcctttaatacactgaatacactacggtgtcttttttttttttttttaaggcagagtctcgctct

SEQ ID NO: 190917 - DNA, 163 bp, Homo sapiens
tggtacccatcggaaccaatgagctccttcccatatgttcttcactcagatccaccagtctctgctacatgtgctttatctttttctatttctcggtatactgagagctgcagatgtcacattcagtctttttttctttttttttttttgagacagagtttcg

SEQ ID NO: 190918 - DNA, 298 bp, Homo sapiens
tactttatacagcaggcaggtgtcactgttccaaagctatgaaagtgaacaggctctcaatcacttcttttcgctttatcattcacccatccattcattcaacaaatactcaaaagttatacgccaacaaactggataactcagaagaaacgcataaattcctaggaacatagaacctcccgagattgaatcatgaagaaacagaaaatctgaacagattaatgagtaaggattgaatcagtaagtctctcaccaaagaaaagccatggtttcactgctgaattctaccaaacatatg

SEQ ID NO: 190919 - DNA, 301 bp, Homo sapiens
aataccaagattaccaaaagttctacaaaatagaatcaaagcattttttttagttctgcaaatatttatcttgtttctagtttataagtaaacctgaaatgaaatagacattttctcttttaaaaaatttgacaaattctaaaattgaaaaaaggtattagcttttttggcgtgttaaatttaaatttacttgctgaataaatattcagtggctgagttgaataatctcttctagtcagcaaggcatgtaattgtctaaaatgctttcgttggctgatttaaaaccttatattgtgctcat

SEQ ID NO: 190920 - DNA, 446 bp, Homo sapiens
aggccctttccattcccctgtgtgtggctaaaatggaattaaagaaaaggaaggaggagagtgctgaatatagagtacctggaaaattgactcaaggaaaacatgcccacagtgggaaaatggtctcacgcagtaatacaatctagaaggaaatacccatggcaaccatctcagaccccttgcttccaattcctcacttgctggtcagctcttgtactgacttatgtttctcatagcaagtcacttccaggcctcaggctccagctattaaaaaggggatgggtgtaaggcactggactggacatctaaggactgtttaaagacaatatggaagaacaattctcatatgagcagttatagttttcctgctgagatttcctagcaaggaataattgcttagtagttagaactagcagtagcagtttcagtttcaacaccagaggaaa

SEQ ID NO: 190921 - DNA, 260 bp, Homo sapiens
agatgtgactttgctcctccttcgcttccaccatgattatgaggcctccccagccatgtggaactgtgagtcaattaaaaaacctctttcctttataaattacccactcttgggtatgttattagcagtgtgagaacagaccaatacaaatatgaagtatgaagttacataatttactacttcataatgtagacattattatctactactgaggacctagagctatatgatactgatgacatttttgtcaattacaatgt

SEQ ID NO: 190922 - DNA, 386 bp, Homo sapiens
tgaaaacagggctcccatacaaggagagaggacccaaacagggttgcccacacctggctcgaatgcctggggtttatagcctgatcattgtccctccctctgtgctctcaggcaatatatgatttgactatttctttacctcctgcttttagcccaatttgtattttagtgagccctctttactacctgattggccgggtgtgagctgagttacaagccctgtgtttaaaggtaggtgcggtcaccttccccagctaggcttaggaattcttagtcggcctaggaaatccatctagttctgtctctcacttcctttgattttgaagtaaacaatctcttaactttgggatagcctgagacaccacctctgacttctaaatgactca

SEQ ID NO: 190923 - DNA, 524 bp, Homo sapiens
cagtagaggagtttgtgtcaggcttggaaccatctttggaatactactttcaatcactgctgtaggttttattttctctatggaattctggttcctttgaggcccctgggacaagcagatggagagctttgctgtggcccagagctcccagctgatggctgggcaagcttcagaccctgccactcaacctcctgaaaaggtgggatgggggcaatggattctgggatgcggctgcaaacactcagagccaccaagggaattggaggaggttgtggtgtggtcagaatgcaggaagctcttagcagtcaccttccgattggggttgattgggttaaggccttctgggatggtgtaaaacagttctgaactcaaaggactgctgatggaaggatgatgaatcgaaagaaatacaataaacagattccttgtcatgttgttggccttgtagcaaacatgttttctccttgggattacgtgaacatttgcttttctttgatttctggttgttattttcagtatttctt

SEQ ID NO: 190924 - DNA, 173 bp, Homo sapiens
tgctttctgtagttccagaagtaaatatctaaactaaggtctacatcagcttgaggggaatacaacaagtttctgaaattatatgcagaaatgtggccatatgtgtttccccttcccagaacaaattatatagctttctatcagattctaaaaatgttaagcagaataaggat

SEQ ID NO: 190925 - DNA, 419 bp, Homo sapiens
tctaagcaaaacacaaaacaaagacactataaaggggagatcgatatttttaagtacataaaattaaaattttttgcaaagcctagagactgtattacacaaagtacaaaaaatagggtggaaatagttatagtacgtatgacaaaagattagtattctcaatgtataaataattcttataaatcaaaagacaaccccagagaaaaacagatgaagaaatgaatatacactttctctactattctttccttccctttccctcctcctttaattttttgagacagggtctcactctgttgcccaggatgatctcgaactcctgagctcaagtgatctgcccacccctggcttcccaaagtgctgggattactctttggccgggcatgagccacctgcctggcaccccccccccccaattt

SEQ ID NO: 190926 - DNA, 439 bp, Homo sapiens
  misc_feature (22)..(22): n is a, c, g, or t
gactccagagtatcctcacctnctaccccacggggggatatttcagcatgttcctatgcaaaaagtgaagtgtcggtgtcgagggacacactaaagataaaggaagaatgggagtggggctgggttgggggtaattgatagatggaggcccctgaaggggtgaggaagaatgagctctagagcacagatagaaggactgacttccaatggacacccttcttctgtattaggagaaatcaagagggaaagataaaatggcttatagaggggatgagggggaaggaagctgaagcagatattgacagatggcccctttttgctctgggaggccagaggtcaggcactggctgagagcagaaggggatggatgaggtctaggcctgagagagcggcaagcactgaaagcagtggctgcaaggggtggaagagaggggaccaa

SEQ ID NO: 190927 - DNA, 480 bp, Homo sapiens
cagtgctggttgtgtcagacttccttagatgggaaagcccctgaggccagtctccttgtctgtcttcattgctctgtaggttacctagaacagtgcctattcagattactggttattcctgaaggttctttaaggcaaatactctaggcccagaccaagaactggagggcctagactgaggttttagcctggataggatctggccttattgatgagtgcatcccatcagattcaccagagatgctcctctcactcacccaacctgggcaggtgggccccatcttttaagagaacatctccggacaatgctgctcacactttgcctcccttttgctcttcttatctcccttctgagaagccatagtctgggaggcaggacacgggagtcctagtctatggctgccagttgtatgaccttggggaagtaatttcagctctctgggactcggtttcatcatattaaaatgcaagggttctacg

SEQ ID NO: 190928 - DNA, 165 bp, Homo sapiens
gttacaaatacagggttcatcgataaggggcttatgtccaaatgcaatgtctccccaggcccaagtccaacgcaaaccagccaaaagattccctggcttcctattctcctttctacgctctgtttctggtttcctctccaccttcaggtttcatgtcgttttgta

SEQ ID NO: 190929 - DNA, 129 bp, Homo sapiens
ttcattagttaagacttttgcctcaaggaaaaccagttaccaaagagttacttgtgcctcaaggggtataaatactacagctgtttgtgtaactgtcacattcattttttctatcaactgtctaaaata

SEQ ID NO: 190930 - DNA, 166 bp, Homo sapiens
gcacattaaaaaactaataaataaataaagtggataagcagtgttgttgcccccatgtactttctgcatctgagaagtacttatgactaaaagcttttagatattaatcgatgcttttaaatgaatttgcattttactgatcacaactacatgcacatacatctgt

SEQ ID NO: 190931 - DNA, 265 bp, Homo sapiens
tcacagctgagtttccttgacatgaagtctggtgagtgtggaatgaactagggaactgggagcctaaatgcaattctaagaaataaaaattacttctaagatacagtgaatggtttttaaagtacccaatgtaacatttgtttagttatattaacattgatctctgccagaaattagaaagtttaatgtttctagggccgggtgtggtggctcatgcctataatcccagcactatggggggccaaggtgggaggatcgcttgagc

SEQ ID NO: 190932 - DNA, 703 bp, Homo sapiens
ggtttctcttgccctgcagacgtcatccgtggcgagtgcccttgaacactgtgtggcctcttcccgcactcagccctagctctgcacctgggtggttcctacctgtcattctcttcactgtagtttgatgtctgtattaatctaattatcatattttaaaatgtaattatcatataattataaataaaattcaatattacatttctgcagcctttgatacttggaaaacagagtccttgctactaaagaatttattaaatattaaataatttattgaatgcatcctaaattatgcttgagcacaattcatatataaccaaatacaaactgtaagtcaggcaattttgtaattatactaattatccacagtgatttaggataagtgcagtgtagatcattgttagctgtgtgtgcaacctcactgtatgatctcataattgcattgaggcacttaacaaaacaccagtgtctagaaatgttcacgtaaagggctagcttgtatgttgttttcgaatgtgtggtaggaatttacctcttttaggaatgagtttgaggaatgtcctgtgagcacagcccaggctcactctctgccctctcacagcaggcctgggctccagctgcactgctgcctccccctgccacctctgtgccagcacgggaactcttcctcccttctgccccgtccggccctggtcctgtgtga

SEQ ID NO: 190933 - DNA, 253 bp, Homo sapiens
cagggaagatgtcatgtctgtaatgatgtcttaggaagcacatccatgaaatgagccctttactccgttgtcacttggaaactcaggccagttgtccttcaggctggcaccagaccagctcagtattatagtttagagaccttgaagtcatttgctgtgtgctattggagctcaaggtcatgttgaatacttaacgcgatgaacagccgtataccaccaccaaacggccggtctgtgcagtccaaaacaaaac

SEQ ID NO: 190934 - DNA, 498 bp, Homo sapiens
tgccacccctgagcttgcaggaaggcttcttaaataaatgcaatgtgtgaactgaagggacacgtggattagttcaatcaggcataagcaaaacacaaatacctgccgcctctcgtctggtgtatggaggccgagtctgagcccagggtctttaggggagtcctgggtgcccacctttgagactgagggtgttctgagcctttggcatttccccaaggggccttggtctgggaccaggatggacctcccactgcagtgactagcagacaccccattaggcttgggtgatgaccccaaggggcaatcgtgcgaaatcaggtgtcaggaagggctccagcttgggcgtggtgagagaaggagcagtggctcccagcacatgctgccaggctcctcccatcagggtggatggaattcgccaagggagcccatctttacagcaccccccaggctggcactggggcaccatgcctgccggggtcctctagagtacctcagcac

SEQ ID NO: 190935 - DNA, 626 bp, Homo sapiens
aacttgctttcacttcacactgcgggatcaccctgaattctttcttgcacaagatccaagaaccctctcttggggtctggattgggacccctttcctgtaactatcatgccactgcactccagcctgggcaacagagcaaggccctgtctcaaaacaaaaaaaagtaatatgacttaatacattcattttggagggtaagtctctcaaaataggcctttcactgggggaaaatggtaaaaatactccctggtaattcaagaattgcagactcctgagatgctgctcatatcagctgaacacttaccaatacttcactttcttccatatatactcaaggaacaagtgctatttaaagtgtttcactctgctgtgctaggtgcaagactataaagaggtgtgaggatcaacacttttatgaaaaccaatgtcattctgaatatagtttcagatgctagtgcaaaggaagttcttggtatatggaagaagtattcaacaataaattaggcatggttgcttccattttctgcctcacatacttttttttcgtggttaaagtgatacaatgtctatgatattttagattggcagttgcaaactagtggtcctcagcgtgctttttatgaca

SEQ ID NO: 190936 - DNA, 158 bp, Homo sapiens
gcaaaaacctcaagtcagcagtcattattattggaagtgtcttatgcacagtaggttcttgataaatattaacttatatcatccctcatttgtgtagaggatcctgaagcactcgtgcttcctgatttcagtccatgaatcgtggactgaaatccatg

SEQ ID NO: 190937 - DNA, 472 bp, Homo sapiens
aatgattgtgaaacttacagcacacgttgctgactagtgaactgagtaaccgccattgattgtgaggcagtgacttctatgtcctcttccccatctcattacttacaagtcatgtataagagtctcctttgttctataatttctctgacagttgtgattgaaattttcaatttttgtcaagctggctaatgtaaaacatcatcctgttctatgtttaatagcatttccctgattactaatatgaagcattatatattgtctattcatgtttcatattttgtataatgtctatatcctttgttcattatttaattgtgttatttgtattctttatgtattattctttaacacattgctgtttatatgttggttatattttacgttttcttctagtttatgggaagtctttttcttttcctaaggcaatctgttgataaatataacctgtgaatattaaagttattaaagttat

SEQ ID NO: 190938 - DNA, 530 bp, Homo sapiens
ctcgaattcgacggtttctcaaaaaaacaaaaacagatctgccatatatccagcaatctcactgctggatatatttccaaaataaaggaattcagtacatcttggccgtgcacagtaaaaaatttttatgaacttggatttggttccttaattataacaaaagtactgtataggcaacaaaagaaaaaatacactgggcttcattaaagtgaaaacttttgtgcatcaaaggctacttactatcaagaatgtaaatcatatacctgataagagataaatacccaaatatataaagaactcttacaactcaataacaaaaagacaacccaattaataaaagggcaaagtcactggacatttctccacttaaatgtatgattaaaagtggtaaaaaactgcaaattttgctatatatatttaccacaattaacaaaaaaattgtttctgacacaataacttactaatttccataaagttatgtaactacattttgaaaaacttaaaaaaacaaacaaacaaaaaaaaccaga

SEQ ID NO: 190939 - DNA, 1000 bp, Homo sapiens
cgggcgacttgagatccgcgggtctccctgctccttttccgtctgcgtcgggagctcccgggcacgtgaggccgtgccgcgtttactggcgggcgggacggcctagccgggcggcgcctcggaggaagccgcggaccccttaggtgctgggcccttggaaatcggcgcgtggggggcggtgctcgagctgagcgcgagagggcgggagagctcgtggggtgcgaggggagcaggacgcccggccgggcagcatgagtcagcagcggccggcgaggaagttacccagtctcctcctggacccgacggaggagacggttcgccgtcggtgccgagaccccatcaacgtggagggcctgctgcccctcaaacaatacaggacttaacttctacgaacgagtacactgtaccaactactgtgctccactgagaacaagctctagccacgtgacagagacctcgcttctcgactgctactcggcatgcgtttactcttaactcggaaacatttactggactcttggtcagatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggataggatctgatcttagcaattttggagcagttccccaacaaaagaagctacaggaggaacttgctgacttaccagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgagaagtg

SEQ ID NO: 190940 - DNA, 910 bp, Homo sapiens
cgggcgacttgagatccgcgggtctccctgctccttttccgtctgcgtcgggagctcccgggcacgtgaggccgtgccgcgtttactggcgggcgggacggcctagccgggcggcgcctcggaggaagccgcggaccccttaggtgctgggcccttggaaatcggcgcgtggggggcggtgctcgagctgagcgcgagagggcgggagagctcgtggggtgcgaggggagcaggacgcccggccgggcagcatgagtcagcagcggccggcgaggaagttacccagtctcctcctggacccgacggaggagacggttcgccgtcggtgccgagaccccatcaacgtggagggcctgctgaagctctaaaagtgaagagacctcgttttgatgtatcgctggtttatttaactcgaaaatttatggatcttgtcagatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggataggatctgatcttagcaattttggagcagttccccaacaaaagaagctacaggaggaacttgctgacttaccagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgagaagtg

SEQ ID NO: 190941 - DNA, 738 bp, Homo sapiens
tgcgaggggagcaggacgcccggccgggcagcatgagtcagcagcggccggcgaggaagttacccagtctcctcctggacccgacggaggagaccccatcaacgtggagggcctgctgccatcaaaaataaggattaatttagaagataatgtacaatatgtgtccatgagagatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggataggatctgatcttagcaattttggagcagttccccaacaaaagaagctacaggaggaacttgctgacttaccagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgagaagtggagcagggtcagaccagtaacaaaaggtctgaaggtgtcaggacctcttcatctgagagcactcatccagaaggccctgaggaagaagaa

SEQ ID NO: 190942 - DNA, 241 bp, Homo sapiens
gccatattggatagctcagcagcaggccctgcagtcatcctgtgtgagtcccagtaattttcactcagtaggtttttcacttgggtcagttaaactgaccatctatttttcattgtcatcagtaacactggatagcagtctcttctttgcggagtaatctaagactaaataatttaatatctaggaagcatggactcagtggctggaatttagtgtatttatgcatccaataatgttgact

SEQ ID NO: 190943 - DNA, 229 bp, Homo sapiens
tccctctgtagcaacctcagggtgttatggtgaggaataaggatagcactattcctaaaatgccaagctcggctattccccttctaggtgaataccccaaagaactgaaaacatggactcaaacaaatacagccaagcactgcataacaacgttctggtcacgatggaccacatttatgactgcggttccataagattatgattccatatttttactgtgccttttcta

SEQ ID NO: 190944 - DNA, 378 bp, Homo sapiens
tgatcaccctgacataacactcatcattactgtggtccatggaccaagatgcaggatgtggccctgagaaaggcccttgtcatgatgatgctctgtgtttgagaaacagaactttaaaagttaaaattggctgggggtggtagctcatgcctgtaatcgcagcactttgggaggacgaggcaggcaagaaccaccatgtccagtcctgtgctgtcttttaccttcattctcttgaatcatcacacatggacccaagatgagccctgttttacagatgtagaaaattgaggcactgagatgcctttggtccacagccccgtagttagtaagggcagcagtcaagaccggacatggtggttcttgcctgtaatcccaaca

SEQ ID NO: 190945 - DNA, 308 bp, Homo sapiens
attccatcccagcccttgtgcttagcaagggatttcaagatgaatgaggcagctctcagagttctccctctatggggagaggcaggcctggagacagataatgaggacactgtgggataaaggctgcaacagcaagaagagagagtgacgagcagatccacatggctcaggctgacccaggtctgaatcttgaagctgccaccttgtagctgggtgaggatggacagaggccttacctctcaagcagataagccacctccctaagatgatgatgtgaggagagaagtgagacactgtggataaaaaac

SEQ ID NO: 190946 - DNA, 376 bp, Homo sapiens
atgtatgtgatgctgaatttacttatctcagtaggcagcacagcctcaccaagagtggttatgttttaggctttgtaagaacaagatgtcaggggttttgctgttgcatcattctgcaacaccttatttcaactctgtgctgagctggcaaaagctctaaatcaacccagctctgcaacccagctcgcttagcttacccttcagatgttccagtagtaggacgactttgcaatattcactggcaacgtgacacactagtaacagtttgtctagtcatcacacgctttgaatgtctccctggtatttctctgtccttgtccctctgtgctgcattttccttactaaatatttctgataatattttcaaccaaaggac

SEQ ID NO: 190947 - DNA, 359 bp, Homo sapiens
aactaaaattatcttgaacctgatgaatatttttaacagattgacacagaataatgtgtaatatctttgtgaaataacttatattccactttcctcttcaatgtgtcattatttggttctactttataatagtatacttccctttaaccttcattttttttttcacgtattataacaaaatgtaaaacagctgggaggcatgctgtaatatctttgcgttttcagtgaaagagaaattcaggaaaatagctttgtacaggatactctgagaccagagaagagagcaacatctgacatgttagagtgtggtggggaccaagtaaagtttacttgggagttgatgcttaagatgtttaaga

SEQ ID NO: 190948 - DNA, 360 bp, Homo sapiens
catgtgccccataaatatgtacatctactatgtacccacaaaaattataaattaaaaagtttttaaagataaatatcactttacacctacccagaataataaaacttagaaaaactataaagtaagataataccaagtattgataaggacataggaagacaagaacccttatgtactacttgtgtgagtgtacactgaagcaactattttgaagaacaatcaggtggcaatttttaaaactacatatacatatactctgtcatccatcaatcccacttctgggtaaatacttcacaggatgctgttaaaaattagccaggtgtgggccaggcgaggtggctcacgcctgtaatcccagca

SEQ ID NO: 190949 - DNA, 257 bp, Homo sapiens
agtagctgggactacaggcatccaccaccacgcctggcttattttttgtatttttagtagagacgggatttcaccatgttagccaggatggtctcgatctcctgacctcgtgatccacccgcctcggcctcccaaagtgctgagattacaggtgtgagccaccgcacccggccaaaaacattaattttttaaaatggcagagccataagcatttttaatagctgatgggaaggatctagttgagggagacattgaat

SEQ ID NO: 190950 - DNA, 168 bp, Homo sapiens
ctccccataccactgacccttctccctctatgccagtatcactgcccaacacatgcacacacatgcacacacctgcacatgtgcacacacacacacacatatgcgtacacacacccccatgcctgctgttagatggaaattccctctgactcctcatcctttccctgg

SEQ ID NO: 190951 - DNA, 289 bp, Homo sapiens
tgccatgttggccaggctggtctcaaactcctgacctcaggtgatccacccacctcggcctcccaaagtgctgggattacaggcatgagccattgcgcccagcctcatacacttatttattaattctataaatcttcttaatttggcgaagtctaagaccacgtaagagactgagcttgtatgatgtttctgatttctacacttacaagacataaatgaaatttgtagatttagaatgacatattgggaagtgccttgtttggaatcacaggaactgccacacacaggc

SEQ ID NO: 190952 - DNA, 177 bp, Homo sapiens
actttgagggatcagcagctctgactcctgtttcccaggctcatgcaggtcggatttggaagttctactttacaactacgatttaggcctctgtggaattagatttctttactgcattatgggtagctgttagtcattttaagtggaattgcttcagttaaagaaggtgttataatg

SEQ ID NO: 190953 - DNA, 264 bp, Homo sapiens
cattgttttctaggcattttattgggagagaagttagtatgatataatgtctttggctgatattaactcttctaagatgcattgtttctgagaacaccattgtctgatttcattcagggaaatttcacacaagccagtagagtcaatacttttttcaagacctgttaattgatatatataaaaacttgccattgtttacatgcccatttcagatcctttatgtgacctaagctagaaatgcattttaacagcatttgtttttcc

SEQ ID NO: 190954 - DNA, 341 bp, Homo sapiens
ctgctgttcaccgcggcaacctcacacccagggaagtgccaggcatgtggcgatcactgactaaatacatgctgaataatgacactgctcatgctaaaaggggacaagacaggatggaggctcccagggaaatgtggagctcaaagaaaccttccatcaacatttgatccaaattcttaattccaaacagcaaaataaaagtttataccagcgattccaatctcaggactcctccacgggggtcctcagtctatttttcgaagggtcaagaagtctaccagaaatttcaccttcctttccaataagaccacggttgtcacctaaaatatcaagcttctttg

SEQ ID NO: 190955 - DNA, 208 bp, Homo sapiens
attgcccatcaggcactcaagccaaacacctgggaagtcatacttttcactagttcccaactcttctttcctcaacatctattctttctggtcatttctcattttcattgccaccactggactccagatgctcttcacctagctggcagcaatggcttagtttcctacatttgctctcaaccctctctaatcaagccaattaaaagga

SEQ ID NO: 190956 - DNA, 365 bp, Homo sapiens
gaaaaggtttctcgctctcaagaaagtctattcctctgggttatctgaatgttagaaaaatgatgatgcacaagttgagtccttaacttgtgtgatgtgggaagattttttagtacgtaacctttgtcctttggtctgggaagcagtcactctataaggaacaggcatagaagattcttgatatcctgaccctggattccttcataataaacattactgagaaaatcgtaaatatatgcatgctccactgtgtttcacagcattccaggtgggtgaagggaaagattttgttttgcaaagggctacactgtcaccaaagcaatatttaatatttacacaactccaaaccccaaggtattttataa

SEQ ID NO: 190957 - DNA, 293 bp, Homo sapiens
ttagggactggggtgttccaagccatacccctctggtgacccccacccattccccctgccttgtcttaaatatccttctgttttgcttaaggttacctgtcattggatttcaggcccatcataaatctaggatgacatcatctcgagatcttcacttgattgcatctgcaaaagacccttttttcaaataaggaaatattcatagcttctagatgaacatatcttttgggagctaccattcaacccactgcaagtaacgatgtctcttacacttttctaactagttgttcaat

SEQ ID NO: 190958 - DNA, 455 bp, Homo sapiens
ggatggttcgttatggattcaaaaggttttaatgggagggccttggaacctgatcttgattaatggggaaatgtgtctgagttctaaacaaatgtttattcgcttgagggaaagaacccatctgtttgtctttgactccttgagagtactgtacatgcctcgaatcaaatgcagtgctggacagaagtctgatatgcggtggatgctcaaaggaacattaagtgagtctggcaatgactgttcagaactcgttttgttatttggaggcagtctgaagtattcttttaagcatgaaatgccataaaggagagtgatcattgtcatcattaataactgcccaagccaaatctctaatgaatatggacaaatcaacacagattatagaatctaaatcatttctggaggggaaaatggagagattaatgggtgaaaggcccaccttgatgccttccatc

SEQ ID NO: 190959 - DNA, 382 bp, Homo sapiens
cctgacagccattgtagtaggtaacaatattgtactatcttggagacttggggaagccttttttccccttttctaatatctgaaattaatctgtattataactatgcatcttctgagcccttgcctcttgtatacctgctaattacattaatatttgagccagcatgagaatcagacagaaaacaggtatctcctatccacacttttgtgagaaatcaggcgcagaaaatcaggggccctctcataggcacctcaaacccagcatatctcaaattgaacatgtttccaacttctagctagttatccctctttttatgaccttcctaactaaagacactcatccatctagtcacccaagccagaaacctggatgtcagccatg

SEQ ID NO: 190960 - DNA, 525 bp, Homo sapiens
cttcatagtagtctctactatgtggagaatcttagaaatgttagcagtcatcattgaagtatagcttaagactgtgtttggttaattgaattttctggttatctgagtttgttttacatggattatcattatcgtttttcaaaatataagagaatatgattcagaccattagaagattatgaagataataattattaacatgtaataattattataatttatcatgtgcaggcattgttgctcactttacaggcaatctcatgtacatacaactttatgacatagttactgttattatccccaattatagatgaagaaactaggttttaaataggttacatgacttgaccaatgtcacataacttgtacaggtgatatctgaaccaaagagtctgaggccagaacctgcacttctaaccaccttactatatagcctcaaaaattcagacatcatctgatcagcatcatcagttaattagtatatgcaatgttagccttaaaataaaaatgatgatttaagattca

SEQ ID NO: 190961 - DNA, 688 bp, Homo sapiens
ccatagaactaacgggcatggctagcattttatttacaaaaatagcagcagccgtggtttgctttagaagttagagttggtgagtggtcagtgtagtctgactcaagaaatctgaactggtcttaaatgggatgtggactcttggctttgttcttttcttataacaaaagtaacaccattatttttacagtacagatgtgaatatcagtaagtccaacatcatcctcagcttcttccctgggtaacccccgttaagtgtgtaaatgctttttaaaaggtaatatgtggcatatccataaaggtccggcagtgtcttataaaggtaaatatatacccacccctgagccagcagttctactcttaggtgtgtttatccaagagaaatgaaaacatacgttcacaaaatgctcttgtacaaaaatattcatagtagccctattcataatagttccaaactgggaacagttcaggtttttatcagctaggcgatagataaacttgcatgtctacacaatggaatactactcaatggtaaaaaggaatgaactacagatgtacaaaatgtgatgaatctcacaggttgactgcgaacgaaagccttaccaaagagagtacatactatatggttttatttatgtgaaattctaaaataagcaattcttacctatgctggaaaaaaaaacccaga

SEQ ID NO: 190962 - DNA, 378 bp, Homo sapiens
ggtgactcctagaggatcccactcgatcccctgagccagcagttctactcttaggtgtgtttatccaagagaaatgaaaacatacgttcacaaaatgctcttgtacaaaaatattcatagtagccctattcataatagttccaaactgggaacagttcaggtttttatcagctaggcgatagataaacttgcatgtctacacaatggaatactactcaatggtaaaaaggaatgaactacagatgtacaaaatgtgatgaatctcacaggttgactgcgaacgaaagccttaccaaagagagtacatactatatggttttatttatgtgaaattctaaaataagcaattcttacctatgctggaaaaaaaaacccaga

SEQ ID NO: 190963 - DNA, 530 bp, Homo sapiens
agcataaaactaatgctctgacccacctgcccatgtgcatgctgccaccacaggtgaaaatgctgctgctgaaaccccaactaaggttgaagccaaggaagaggggggggagacgcacgaggatatggcatttggtctcctggaaaagcattagcaaagggcagaccatatgcaactgcaacgttatatcccgggctcctgtggagtgagactatgatactaggacaatccagggtttcaatcctttccgtggcttcggaatgccctgcacttccagctatgaacacaaaacctctccaggcccactcgctgcttttctgaaacatctcaacaatgatttcctcaaaaggaaataatgaaataaagttctggcatacgttaatcttccgcgtcaagttcacagtgttaaacacactgaagccagccacacaaacaaaaccaaactccacaagattaggttgggctgaagttacataagacagactaaactgcggcttttctcctgtcattcctcccgccttcctgtgaac

SEQ ID NO: 190964 - DNA, 548 bp, Homo sapiens
accatctcttttcagtttccttctttctctttctcaccttcttgatgtgaataattctcttaacagaatagttcattagtagtccaggaatgtcaaatatgtagcaacctaccaatacatggttgtgtaaatcagatgattctgagaaaactcacgtgggcctgggagatagggaactgagtgagtagtcttgctaccctctcagattacaaaaaccttgtcctgtaatgttagattataaaataatctattgaaaataagtttttatttatttatttatttatttatttatttatttatttatttatttttgagacagagccttgctctgtcgcccaggctggagtgcagtggcgcaatctctgctcactgcaacctttgcctccagggttcaagcgattctcctgcctcagccttttgagtagctgggattacagatgcgcgccaccactcccagctaatttttgtatttttagtagagatggggtttcaccatgttggccaggctggtcttgaaccctgacctcgtgatccacctgcctcggcct

SEQ ID NO: 190965 - DNA, 773 bp, Homo sapiens
ccccagagcctttgagcccacattcatcggtgtacagcagcagtgggacaggcctcagtcgaccctccagcaccagccacgcctctgccacacctatgccctcaaggaggcatctggcagcctgggcctagctctgcaggtggttagaagagccctagctctaccacttacttacctttgaaaccttgggcaggacactaactggaggttcagtttgctttcagtaatagggggcccgtaagcaggtcctgttgaccttcttactggaggaggagagggagggggtctgaaaaggcgcagagcaaattccagatcctgtcctggatggctgatccctcaccccagcccagaacctgaagtggatgctgccgggatggatgaatgagcattattatggaaaatacttaatccaagcttactgtctagtatcaaaaagttaacctacttgggaagctgaggcaggagaatcacttgaacctgggagacagaggttgcagtgagctgagatcacaccactgtactctagactggtcgacagagtgagaccctgtcttaaaaaaaaaaaattccttgccttcttccaaaaatgattttagtcaggttagagacacccagaaagagctgggagacagctgctacaacacagacaagagtccctcttgccacagatttgtctcagcttcctggcagccaatgcaaaggattctccgagagaggacagtcatttgtggaaagagaatgctgctgcttagctccattaaagactctgagaa

SEQ ID NO: 190966 - DNA, 391 bp, Homo sapiens
ttgcaacagtcaaacacatcaagaccatttttcagatccaggtttttttcctgaagacatcctgtccagagcctgctctaagatgtgcctgttgctctctggactgctgcagggttcttctccggtgactttcctttgcctatcttttgtggtgaatcccgtttcccagacttaatttctttcttagtgcaagtccttcatcttgctagagttcctccttcagtcacttcctgaaaaaaaggtgcatcgaaggtaaatttttgagatagtttatgtctgaaaatgcccctattctaccctcccacttgattgatagcttgattgggactggaattctaggttggaaataattttgtctcacttttggaagcatgacttcattgtcttgtag

SEQ ID NO: 190967 - DNA, 968 bp, Homo sapiens
ctgaattattttctgaaataggttgtatgtagataaatacaaaatagaataaatgctaccatttaggaaaattttaaaacacatgaacctatatattattttgtctttatcctgtgttatgttttcctgaaagatataaacacatttaatatttttgtgtgtttcacttgcttgctttttcattgttctgtaactttttcttcttttttgaaaaacattattgttttccgtaagatctttctcttactgattcttgtattttgatgtttgtttactagaccacagcagtttacgtttcaagattcaaataattctgttgattcatcagcttctgatagtgaccctatgagacagagattttctataaaagcacactcacggttaccctacctcgttatatctgatggatatatggtcacaacccttcgatttcttgatagcctatctccatcagtacacatgagatcacttctacttgattcaacccagaggcttgagaaaatatatcaaagtgtgatattgtctaagccaaaaggcaaaggactgaacttgcgatcactgaattccctaaggtctagcctgttagaacaccaaggaaatgaaagttcagccgatttcactgtccccaaattcttgcaggcagaagaaacaataaatgaaaatgcagcagattttcaggattttgaagcagaagaaactaacgaaggcagacactttccagacaacttatgtcctttttggaacaaaagagatgatgtgctgtgtagtagtatgaaggaaggaagattggaatttgcatctatgtttgatacgatacatgcaaaggatgatagtgaggagacagatagaaccattacagaactgcattctatccagaaaagtctacttgcagcgtggactataggaatttcaaaaactgtgacagaaaaaaatttaatgttaaattacatagtagtttgtatcactca

SEQ ID NO: 190968 - DNA, 413 bp, Homo sapiens
atgagaatcgcttgaacccgggaggttgaggttccagtgagccaagatccaccactgcattcctgcctgggtgatggagtgagactgtctcgaaaaaaaataaaaagaaaataaatcaagtgatggactttaggcctcacagctggcagagctatcatttaacaccaggtctgtgacatatttcaatgtctgctctgacgctcatgatgctagagtgtgcatgcgtgaatatgtgtgtttgaggtaaaattcacataaaatattaaccgtctaaaagtgaacaattcagtggtatttagtacattcagtgtgtgcaaccaccactttgatctacttccagaatgttttcatcatgccacaaacaaaccccacatctattaaacagctactcctcatttccttctcccctccag

SEQ ID NO: 190969 - DNA, 519 bp, Homo sapiens
tctgcttcaacctcctaagtagctgggattacggatatgcaccactgcacctggctttcactgatgcctttaatatttctttacttctatttttttctgtgttccattttggatattttccattgctatgtcttcatgttcactaacctttctctttttttgtattaagcaatgtgctgttaattccattgagttactttttcatctcagatgtagtcttcatctctggaagttcagctcaagctttaaaaagtatgttccatatctttacttaaacatctgaacagcatctcaatatgtaccttattctattctatagagtacagttattaataacttttagtgcccttgtctgataattttaacatctctagcagttctggtttgactttgattgaacagtttctcctcattatgggtcctatgttcctgctactttgcattcctgataacttctgattgggtgccagacagcaagacttttacattatttggtgctggacaagtttatatttctat

SEQ ID NO: 190970 - DNA, 602 bp, Homo sapiens
  misc_feature (446)..(446): n is a, c, g, or t
  misc_feature (561)..(561): n is a, c, g, or t
  misc_feature (563)..(563): n is a, c, g, or t
  misc_feature (586)..(586): n is a, c, g, or t
  misc_feature (588)..(588): n is a, c, g, or t
taaaattctagtaaatgcaaaataatctatgataagaaaacagatcagtagttgcctaaaggggaagaggaaggctaggaagtggccgaaagagccagcgaaggagcaccaggaagtctttggagttgaaggatacattctttattctgattgtgattatgatttcataagtgtacacatataagtgtacaattaatttcttatatatgtgcactttattgaatagcaattatatttcaataaggctttcttggaaaagctgtaaatgaataatgaactctggtttatttttttattgtacttatttacttatttatttttttgagacagggtcttgctctgtcacccaggctggattcatagctcgctacaccctcaaacttctggcctcaagtgatcctcctatctcggcctcccaaagtgatgggattataggcgcccaccancacaactggctagataatgaactcttaaaaatactttgtccacaccccctttcatttactcccatgtattactaatcctgctgaggccgtcttggtgtgacctccttcctcacantnacccctcttttctctctcagaantncttactttacaatc

SEQ ID NO: 190971 - DNA, 461 bp, Homo sapiens
atttggaactgagaaacctagattccaaaacttaaggaactggaggggaaggatcaaatagaaggtggcatttgaatactcgctatgtgttagacactttcaggcttccttacatgtattcaagtttaatcctgaccacaccacggtcttgtaaatcaggaaggaaacttggaggaggaagctgcccacagtcagtaagtttctaagtggtggggagagtgctttgaccacaaatttcctcctcttttcactttaggatgctacctacatgtcgaaattgtgaattcattctcactcgtacacttcatttccttagaaagctaagtttaggaaaggtgcatagaatcactaagccaaggaaattggcttctagaatcactctaaaccaaagctagaagggctcacattcttctaaaaagaaacttagctgtagatgtaacataacatactgtatacacaaa

SEQ ID NO: 190972 - DNA, 441 bp, Homo sapiens
agccagtgtttcagtgtttcctgccaggaacctcaattttctaagccaaaatatgtttgacattaacccaggttgctattaccattagacgtcagtctgagcagtagtccttacttgtctgtgaagtctacaagtatggaaatctcttgtttagcctgtatcttcatctactatgttcacttaaagtttccacgaattgtttatttcattaactgaatatagaaatacccccagacaattttgtgtgtctgtatgacctcacacaaatgcattattttgttggttcacatgtttttcttgagtagaagcttccttgtttagtactttttatccataggcacagatgacttcagtgtgtgctgaactgggaatcagaagaaagttatagccttgactctgttacttggaaccactctctttgccctgaggcaaaaaaaaaaa

SEQ ID NO: 190973 - DNA, 515 bp, Homo sapiens
tcaagtcccgagcttgctttattacatcatgctacagtcttaggaagatacaaaaatcaacaattccataagacgttttattcaccaactcttacaatcagttcagtctccttgaacagggaggaaactaaacagaaggccagtgtgctttatttcttgcttgacgtggcagtgactcacccacttctttgtgagactacctatgttgtcacaagaatggccacccccagggctctgactcaggggaagaggaagagctatgatgagtgggttctaggatcccgcagagctccaaacctctgcttttgtagaaatcaatgcatccataagcattagttcgcttacaggaacagtcctggctgtgaggttatcagtaccctctttatgaacttttagcctctcagcatgaaagcttgtcacagcccccagcttgatgttagtctgttagtagtcctgttgaaagaagccactgtctcttacagcacagccccccactgctgatgtaagcaattgtg

SEQ ID NO: 190974 - DNA, 360 bp, Homo sapiens
gcatgcacatacaaatacacaggtgtgtacatggatgtgcacatctgtagacacaaatttagattacacgtttgtgcacacatgcatgtgaggcaagagaatagggtctggaggcagggaacctaaggccaattcgtgctgacttcctagaactgaatcaaaatgaaaaccccacctctccatgcctgaggaacaaaaggttcagcagctactccctttgctataccccctttccactgcatctcagatgaaaatggaaagtacctcggattggtcccctcccgcaaccaaccagactggtcatcggccaagtcttcatgtgtaactttgtaacttcccttcagcctctgattggttgcc

SEQ ID NO: 190975 - DNA, 482 bp, Homo sapiens
gaatgaactcctttgaaaacaaaggcttagagggggctaaatgtcttctatagcagagtcacacacctggaggagcagaggcaaccactatggggacccagaggctttgatcctaacctgtctcctaaatttaacacctcactaggttttacttcttcaatacaggttcatgctatgagcactttactgcatcatttattattgtctgttatataaatttcttccaaagagcgcagagctcagtgaacatcaggagaaatgctgaagatcgcagtaaagttcctttcatgggaagccttttaaattataactttagccagactgacttagataggttggatgctctgtttggagacagggacagaaatctgaaagtttatcccaaacccaggattctgtgatcatctcactgtttcccaaactttcgttttttctttcttttttttttttttttcagatggagttttgctctgtcacccagg

SEQ ID NO: 190976 - DNA, 105 bp, Homo sapiens
gaccaccaggctgaggtggtatttaacacatttctccactgtgaaattaatgtggagtacagttactccacatttgccacaggaaagttaatattcctgtttgtg

SEQ ID NO: 190977 - DNA, 298 bp, Homo sapiens
aaaaaatttgtaggaataaactaaccatatctgttaacatttacacaaaattaactctgacatctgatcagagttgataaaatgatcaactagcagaaaacatggttctgctagttgtgcagtatgtaggttaagactggaatttgaagtagaatttggaaaggacactaagcacttctttaaaaggtgtctagagtttagagctgaccaacatcacgtgccgacatttctaaaggcccttctcattactttagggctggacagtagactgcctgtgtttcacaagtacaaggaagtt

SEQ ID NO: 190978 - DNA, 463 bp, Homo sapiens
gtgacacaatcatggttcactcctgtcttgacctcctgggctcaggggatcatcctgtctcaacctcctgcgtagctgggactacaggcgcatgccaccatgctcagttaatttttaatttttttggagaggtggggtcttactgtgttgcccacgctggtctcagactcttacctcaagcagtccttctgccttggttttccaaagtgctgggattagaggcataagccagcatgcctggcctgtatatcacattttccttttttttttaaaaaaaactttaagttcaggggtacatgtgcaggtttgtttataggtaaactcgtgtcacagggtttgtttataggtaaactcgtgtttacctatgtttattagggtattctaataaacataaaaatcttaatttttatgttctcatacagattttctttaatggttcatgctttttaattttcttaaatca

SEQ ID NO: 190979 - DNA, 476 bp, Homo sapiens
caacttatcttcactcttgaacatctatttcatcacattaatctgttgttcaaaaaaatctttcatttttcttaaccaggaccttcttctctaacttggtgggtctacttacattttttcattgtactttctcattcctatgcttgcccacaataaattccacagctagaatacacatcctcctaattatcatctccaaatcctgactgttttcaatggtggttcaagtccagtgtctgcagtgaagctttctgttgtggtcttgaatttacgactttacttattcaccacctttctttgtgcacaatttccaactcctttatatattagccttctgaatatatctgtcttatcttcttggtgtggctataggaaccaaatcatacatgtctttatcacttctgaaactatcccaataactacattacattatttattatatatttttaaatgaggcatagtaggagaatattgga

SEQ ID NO: 190980 - DNA, 373 bp, Homo sapiens
gctatatagagttttaggctttccaaagcatggttactaatgcaaaattgtcattgattgattgggttgagtttaaaactggttctgatggtgacttgttaccaaaatcaaagaacaattcatttccgttcttaaaactagagtacaagaactttttcatggtaaacaacatttaagattatctattgagaactcccaagtgccagctactgttctagacagtggggattcagccataagcagaacagataaagcctccattcttgcaagttcatctgctgagttttgagatacaaaccgtaaatgctacaaaaataagaatcaaagtagttgtagtggatttcattcattcattcattcattcattcattca

SEQ ID NO: 190981 - DNA, 599 bp, Homo sapiens
aattcagttattacttttctagaatgcctcaagtcttggtgaaattataatgcttctgacttttcaagagaaagcaggttttcctctccacttagcacaacttgtcagctcttttgtttttgtgccgatacctttcttttccccgctgggtagtgttttttttcttccaatccaaatctttaaaaatatagaattgtcagtctgttccatattccagattattttttttgtttcttaatacattccgtgtgtgtgtgtgtgtgcgcgcgtgcgtatagcctttgaaaaatgacttcacctttgtctcttcatctttagggtggagggtggtggggttgatttctgcattccgttatgcagtgactactccacctttacttaaaaataatggaaatcagagtagaatgtgcttttagcctcttgggtggtgttggctggggagtcctagaaatggctataaattcatgacatgatttgcaaagaacttcccagttttgttccaagaaggtcatattctactgttttgtcattagtctgttgtgtgtcacaactgtataactctttgtatgtgtattggcgggggtgggtgtgtataccaa

SEQ ID NO: 190982 - DNA, 187 bp, Homo sapiens
gactctttgtagccataagataccaaattccaacctgactctatcaaatgacagataaagaaggaaatcaaaatatcttacccccaaatatgtttcttcaccatattttgaaactgctttttgtatctgtaaatctattaactagctctttccccttccaagtcctcccaccttgaagagagttatg

SEQ ID NO: 190983 - DNA, 421 bp, Homo sapiens
attttttctctcttactacgctgtttcaaattcttggcagattattggaaacaaggaaagtcaagaattctcccagtgactacccatagaattaaatcaacaaaaactgttgatcattgactgtgcatatggcactgtggcagcttcccagatctacaaagcaagtgagacagtatctgttgtttaagaggtcataatctctttcggattaaggtgatacaaaaataataacacagagaagctgaagcatcatggagaggcacacaaggaatgcttattgaggtctgaatttttaaaagactggacacgtctttaaaatacatttggtgttcgttaaaataatctagtgtgataacctctggaaatcacattattttaaatggagggaactagccttctttaattttttttttaaaaagca

SEQ ID NO: 190984 - DNA, 369 bp, Homo sapiens
gagatggggtttcaccatgttggacaggccgatctcgaactcctggccgcaggtgatctacccgcctcggtctcccaaagtgctggaattacagacgtgagctaccgtgcctggccttacatttatttctactttttagagacacggtctcgttctgtctcccaggctggcaagcagtggcacaatcatagctctctgcatactcaaacaccagggctcaagctattctcctgcctcagcctctcaagtagcggggactacaggcatgagtaactgtgcctagactaaaattatttctagatattaaacaatattatttgcagactgcagtgaatggtcaggaaacttcatatatttgctgcactgact

SEQ ID NO: 190985 - DNA, 657 bp, Homo sapiens
tacagcctccagaaggaaccaactcagccaataccttggctttagactgctggcctccaaagctgtccaagaacaaatttctgttatttttagtcaccctatttgtgataatttattatggcaaccctacaaaaaaaagtttcaggtaaaaaccagtcatacttaggatcactaaacacatcttaaagttctataattaaaaaacagaggcattaattaccatttatattattcaaaaataattagaaactattagggcattggctgggcgcagtggctcatgtctgtaatcccagcactttgggagtacaggcaaccgcaccacgcctggctaattttttgcattttttttagtagagacggggtttcaccgtgttagccaggacggtctcgatctccagacctcgtgatccacctgcctcggcctcccaaagtgctgggattacaggcgtgcagccaccgcacctggcctttcatccacttttttagttttactttattctaactagtatattggaattctacattgtgtagtagggaagtgtgtatgagtgtgtgcgagaaagatctttgtttccttcatagattctatctcattctgtatctatacaagtcatgtctatgagtatatagttgtcatcccccaaagcgaattcg

SEQ ID NO: 190986 - DNA, 435 bp, Homo sapiens
tacatccccagtttacacatcacccagctttaacattttgctttcctagagacattttctaatgagggtaggcataaagcatttgagtttcatattaccttttccactccttgacattaggttttaagcaaaattgtctccagatttacttcagcaaatttaggtacatactagttactcccaagactagttgtagagaagtgataattgaatttggtctttcgttagaaatgtactgagtgtaaaaaagattgttgttagagatgtcctttacgaatagattaagtttattatatatcactgttaggctcaacgtagccaataggggacctctactttcttttttctttttttgagacggagtctcactcttgttgcccaggctggagtgcagtggcgcgatctcagctcactgcaacctctgcttcctgggtt

SEQ ID NO: 190987 - DNA, 693 bp, Homo sapiens
cacagatcaaaaatactgtattcaaaaaaattctgtattgaacatataagactattttttggccattatttcctacgcaatagagtgtaacaagtatttacaaagaatttacattgcattaggtattactagtaatctggagatgatttaaagtatatggggggatggcactggttatatgcagatactgtgccattttatatcagggacttgagcacctgtggagtctgatatccgcaggaaggcccagaacaatcaccctcagatacagagaaatgcctgtatattctttccaatagacctcagacatgaccatgttaatacagtagacaggttctaaccacgttacacactcaaaagaaataagtgctgtatccacaaaaatacatatatagaatgttcaaagcagctgtgctcataatagccaaaactgggaaaacctaaatttgagggacaattgagtagataaatcatataatctacagtggagtattgtatagtaaccaacaagatgcctgtccttccagagggctccttgaacccctgcaccatctgcccacctcttcccaagtgaccagattcacattccaaaggatcttgggagaggtggcctttgaaggaacttaaaaggtctttctgtgccctttccctgaggcccaactggacttctgattttacattccataactgaga

SEQ ID NO: 190988 - DNA, 374 bp, Homo sapiens
aaacctttaagctaagaggtcaggataatagcctaggtgttgatagctgctgccatagcaaaacaacatattaaataaagatggtttaatatatgcggtagcctgaggtggagagatgtagaggaggggaggggtaacctttatcatttgtgtgttcatgtttagtcttctgattttaattaaataagatgcattttattttagaaaaggctgagaaatttaccttataagtaagagttttagttcaaggactgaaaactacaaggatgtagtccctttcttggcccttaactattctgaagcattagtttttgctctaggagaaaattctgccctggagatctgaacacataatctacactaatgttgtacaa

SEQ ID NO: 190989 - DNA, 1023 bp, Homo sapiens
  misc_feature (122)..(122): n is a, c, g, or t
  misc_feature (124)..(124): n is a, c, g, or t
  misc_feature (127)..(127): n is a, c, g, or t
  misc_feature (131)..(131): n is a, c, g, or t
  misc_feature (136)..(136): n is a, c, g, or t
  misc_feature (143)..(143): n is a, c, g, or t
  misc_feature (146)..(146): n is a, c, g, or t
  misc_feature (157)..(157): n is a, c, g, or t
  misc_feature (176)..(176): n is a, c, g, or t
  misc_feature (185)..(185): n is a, c, g, or t
  misc_feature (222)..(222): n is a, c, g, or t
  misc_feature (562)..(562): n is a, c, g, or t
  misc_feature (597)..(597): n is a, c, g, or t
  misc_feature (611)..(611): n is a, c, g, or t
  misc_feature (632)..(632): n is a, c, g, or t
  misc_feature (635)..(636): n is a, c, g, or t
  misc_feature (652)..(652): n is a, c, g, or t
  misc_feature (827)..(827): n is a, c, g, or t
  misc_feature (897)..(897): n is a, c, g, or t
  misc_feature (943)..(943): n is a, c, g, or t
  misc_feature (976)..(976): n is a, c, g, or t
  misc_feature (988)..(988): n is a, c, g, or t
  misc_feature (1005)..(1005): n is a, c, g, or t
cccgtcaccaaggagggccgggcttccatcgtgcccctggcggtagccagcggcctgtgcgagctacctgtccgtcaacagctgcatgggccgtgtgaggcgcatctaccctcagctgctcntngcnctgntcatncaggtcnatnaccacatcggnctcaacctgcctggctgcntggctcctnccaaggacaccaagaagggtgcacagccctctccctncgtacctgtgcgctgggtggtgaaagtggtgaaaaccctgctactgaggatgggctgctcttatgagaccacgtttctggaggaccagggtggctgggagctcatggagcaggtggagagccaccaccgcggagtggccttgctggcaagggccatggtgcagtactcctgccaggagctgtgccgcatcctctacctgctcatcccgctcctggagcgaggcgacgagaagcacaggatcacggccaccgccttcttcgtggagctcctccagatggagcaggtgcgccggatccccgaggaatactctctggggcggatggcagaaggcctgagccancagaccccatcatgaaggtgctgtccattcgaggnctggtcatcctggnccgcaggtctgagaagaccgncanngtgaaggccctcctgncctccatggtgaagggcctgaagaacatggatgggatgctggtggtggaagcggtccacaacctcaaggctgtcttcaaggggcgggaccagaagctgatggacagtgcggtctatgtggagatgctgcagatcctgctgccgcacttcaacgacgcacgagaggtcgtgcgctncttctgcatcaacctgtatgggaaggtggtccaaaagcttcgggcaccacgcacttaggccatggaggancagctggtcagcacctttggtgcccctactgctgaccatgcagganggcaacttccaggtaagccaaaagtgtgtgaanaccctgggtacnctggttcttactttatnggttgggagttgccaaat

SEQ ID NO: 190990 - DNA, 1075 bp, Homo sapiens
  misc_feature (122)..(122): n is a, c, g, or t
  misc_feature (124)..(124): n is a, c, g, or t
  misc_feature (127)..(127): n is a, c, g, or t
  misc_feature (131)..(131): n is a, c, g, or t
  misc_feature (136)..(136): n is a, c, g, or t
  misc_feature (143)..(143): n is a, c, g, or t
  misc_feature (146)..(146): n is a, c, g, or t
  misc_feature (157)..(157): n is a, c, g, or t
  misc_feature (176)..(176): n is a, c, g, or t
  misc_feature (185)..(185): n is a, c, g, or t
  misc_feature (222)..(222): n is a, c, g, or t
  misc_feature (614)..(614): n is a, c, g, or t
  misc_feature (649)..(649): n is a, c, g, or t
  misc_feature (663)..(663): n is a, c, g, or t
  misc_feature (684)..(684): n is a, c, g, or t
  misc_feature (687)..(688): n is a, c, g, or t
  misc_feature (704)..(704): n is a, c, g, or t
  misc_feature (879)..(879): n is a, c, g, or t
  misc_feature (949)..(949): n is a, c, g, or t
  misc_feature (995)..(995): n is a, c, g, or t
  misc_feature (1028)..(1028): n is a, c, g, or t
  misc_feature (1040)..(1040): n is a, c, g, or t
  misc_feature (1057)..(1057): n is a, c, g, or t
cccgtcaccaaggagggccgggcttccatcgtgcccctggcggtagccagcggcctgtgcgagctacctgtccgtcaacagctgcatgggccgtgtgaggcgcatctaccctcagctgctcntngcnctgntcatncaggtcnatnaccacatcggnctcaacctgcctggctgcntggctcctnccaaggacaccaagaagggtgcacagccctctccctncgtacctgtgcgctgggtggtgaaagtggtgaaaaccctgctactgaggatgggctgctcttatgagaccacgtttctggaggaccagggtggctgggagctcatggagcaggtggagagccaccaccgcggagtggccttgctggcaaggtccccctggggctggatacctgaggggactactcccccttcccacccccagggccatggtgcagtactcctgccaggagctgtgccgcatcctctacctgctcatcccgctcctggagcgaggcgacgagaagcacaggatcacggccaccgccttcttcgtggagctcctccagatggagcaggtgcgccggatccccgaggaatactctctggggcggatggcagaaggcctgagccancagaccccatcatgaaggtgctgtccattcgaggnctggtcatcctggnccgcaggtctgagaagaccgncanngtgaaggccctcctgncctccatggtgaagggcctgaagaacatggatgggatgctggtggtggaagcggtccacaacctcaaggctgtcttcaaggggcgggaccagaagctgatggacagtgcggtctatgtggagatgctgcagatcctgctgccgcacttcaacgacgcacgagaggtcgtgcgctncttctgcatcaacctgtatgggaaggtggtccaaaagcttcgggcaccacgcacttaggccatggaggancagctggtcagcacctttggtgcccctactgctgaccatgcagganggcaacttccaggtaagccaaaagtgtgtgaanaccctgggtacnctggttcttactttatnggttgggagttgccaaat

SEQ ID NO: 190991 - DNA, 233 bp, Homo sapiens
agttcactagttagaaatatttaatgagttcagattttcttagctttcttaagagttttatttgtgcttaaatggtagctttccatttatgatagttttaaagaacgagtaagaacatatctggaaggaatgaatgttaaattggaaaatataatgattagtcctagatgggatgtgtggtttatagaatgttttattatttaccattttgcatgatgctcctgtgaaatctt

SEQ ID NO: 190992 - DNA, 445 bp, Homo sapiens
agaaattgggattgaaaatgtgggatttcataatttataatttttaaaaaatgatggtccggaaattgcacaatcctcatcaggacgttttttttccctctgactctgtggtttttgtcttagctgatgcagcactcaagacaatcaaagataaatctccctcgggctggaccatgatgtcctcgcagccttgcaagaggggtctttgtccaagagtactcgtcattgtacagcctggggtagaaggcagggctcccccagggcgatgtctcaggattccctgcctgctgctgctgtgacccaggtggcacgccaacactgcccacaaatgccaaatgccagggcttccctgcacccatggagaaggccagcaacacattctggaatgacatgacctgagttgatgcttcaagaaggaactcaaaaaagaggccacagtctcctc

SEQ ID NO: 190993 - DNA, 403 bp, Homo sapiens
ggaagaatggcagaaaagaaagggagagaggaaatccacttctgtttatggttacatccactgttctagatgtaataaaggaagacagtatgggattcaagtccaaaaggcagtgaaaaggtatcatggtacaatttacactgtaccgtgccttactgtatgtaaaatataacatacttcttgagggctgagtgaaaccgtaatgagtacgctgtgttaattactcaataataaacatattttgccataaaacattcagactcactgaggtacagagtaaaagacaatctattcatactgcccgctcagacgtaactactcttaactactattaacacttcaatatgcagactgccagttcttttaccatgtgattataaagtttatctttaaagtaataggc

SEQ ID NO: 190994 - DNA, 106 bp, Homo sapiens
ttcccattcactgcctgtcagtctgtaattctattaagtctgtaattttcttgccatcctccctgcctccaccaattctctactccagaagtgttttattttttct

SEQ ID NO: 190995 - DNA, 185 bp, Homo sapiens
agcgctggaggccggcctgcctctcttcttggggggggctgccgcctcccttgcgcacccttcgcgggattagtgtaactcccaatggctaccacttccagcgaccgccaaccctcaagcgaagactgactttggctccctgcctggacggaggggcccctgagccaggggtgacgatcccgccc

SEQ ID NO: 190996 - DNA, 328 bp, Homo sapiens
tcttctcctgacaaatgaaggaggcagttgtgatcattgctggtggaaccatagctcagattttttttttaaagaataatgtattaaaaatggaaatcattttgcttctagattggccagaatcttttaattatctgtatgagaggatttacagtgatacttcacatttgaagtagtgttgtatagtttttcaaaaaaaatctttcacattttattatttgaccctcataataaccctgaaaggtaagcaggacagttatttggtccatttgagagattaggaaactgagacccagagggtttaaatgatcagagcatttcaaagtaa

SEQ ID NO: 190997 - DNA, 576 bp, Homo sapiens
cctttttgctcacaacttgtgggctgttgacatttccagaagccctgactctggagaagatggtggcttgttgtgatgaggtcagaattttttctcacatctcatgggtcagaagaaataaaaacaaacagaatctttctttctttcttttttaagagatagggctggctgggtgtggtggctcatgtctgtaatcccagtacttcgggaggctgaggccaggagttcgagaccagcctggccaacatagcaaaaccccatcttcactgaaaacataaaaattagctgggtgtgggccgggagcggtggcttatgcctgtcatcccagcacttgggacgccgaggtggacagaaacctgaggtcaggagttttgagaccagcctggccagcacggtgaaaccttgtctctgctaaaaatacaaaaattagctgggtgtggcaacgggcgcctgtagtcccagctactagggaggctgaggcaggagaatcgcttgaacccgggaggcggaggttgcagtgagctgaaattgcgtcactgcactccagcctgggcaatagagtgagactccatctca

SEQ ID NO: 190998 - DNA, 553 bp, Homo sapiens
atggagtctctcctcattctgtgtatgtctttgggtgactgtataatatctgtccctccccaagcctgtgtgctccaggaagggtgtggactagcagggactagactcaagagatgtccttggaacgcatgaatgaagagatgctccgtcagcatagcagactaccccgctccatgacatgtccctagtgtcagttcagggccccacagagctgccttggaactcacttccagccatgtgctgcttggagcatctatgcccagatgcctgccctgccagggaccccagcaccaagcaaggctttctgcacgcacaggatacaaggcactggagtctggcagagcagctccactacccactgtctgtgtggacttaggtctcagtcctctcatttgtaaaatggggccaatactgctaatcccacaaggttgttctgaagattaaagaagggaacaaatgtgcttagcacaaaataggtcctcagaaaattgcagtttggccccccatccagtgagttcacaggtgggtctgaccctgtctcacctggatggcg

SEQ ID NO: 190999 - DNA, 159 bp, Homo sapiens
cctgaggtcatagaactgatagatagaagggacgtggtgccaatttgggtctgtctgttgccaaagctcatgttgcttctgttctgtctctgtctttagagcaggtgtctgtgggtctggagcccatgtgtgacctggcagagtttatgccacacccgg

SEQ ID NO: 191000 - DNA, 275 bp, Homo sapiens
aaattgctgtccctgtctactctattctagtccctgcctgccccatatgtaactttacttatactttatacaacattttacattccctgtttttttggctattatccgttggttccctactatgagcaatgctgaaattaagttagtaacttccttctcctgtctctaccccagtattttaagtgatatatttttatttacagtgaatacctataaccagtgagcttattttacatttcatatattctccccacattcttgataattaaacttta

SEQ ID NO: 191001 - DNA, 633 bp, Homo sapiens
ggattctattctcagcttactgttaactctaccccctctgcttgggcaatctcatctattcttgtttcctatccatactactcacatgttgatgattccaaatatgtatctctccttcaagtttacatgcccactcatatctcaaaatccaaatgtccaaaactcaactatcatcttctttcctccccacaatctgctccttgctcctggttccccattgtggtgaatggcaccacccagtcccccaagctaaaaatcctgcagtcatcctagagtcccccttcctttcacccctctctctaattgccaaggcctgccaccttttcctccttaatacttcccaaagctaatctttccttctatcctaactgtggttgccctaattcaagcccttatcttctctcatttgggctattacaatggcctcctaatagtccttccccctactaaccttggcctcttcaaggctttttcacagaacatcctgagggctcttcctaaaatgtaaatctgatcacctcgcttcctgcctaagatatttcaaaggctctctgatttctctataagactctctcctgccctgctctccctctcacctccaaccattcatgaccacgtatgtgatacctccgt

SEQ ID NO: 191002 - DNA, 469 bp, Homo sapiens
gctgctcaagattccttctggcgaatcccactctacaaacactcaacaactaagagtgctactggctcacatggagggctaacaagacctgcaaatccaggctgctctgaaggacggtggaagataaccaaccccgagccacgagatttaggacccgacttttggttaactttcaaatttcttatgccagtaatatacttcagagtggcgcggagggaattggaaaacatcaccaggcaaaaaaaagaaaaaaactctttcacgaaacaagacttccaattagaacacgtgtggggacaataagaaacacgttctaaccacccccaaaattaaaataaaacacagcgagcaacaagagagacctgcgcgcgccccaccgcccgcgcgcggctctccgcagggtcaccgaggggtgaggccgcgctctcccggcggccgtccagggggaggaggccccgcgccccgcccc

SEQ ID NO: 191003 - DNA, 648 bp, Homo sapiens
cagagaccgtcactgccatgagcagtctgcctgatacccatagcaggtaaactgtctggttccaaagtccaggctcagaaccactccagtctttagacacaacctagacccagacacaaggctgggtctccctcaggtttggactattacttgtggcatggaccctaggggagttattttgccttttctaatcctcggcttcctctaggaaactggattaaatcagagaccacacattagacaactccaggaactgggaaaataaggctcagtgcatgaagctggtggaagacgatagagacgatagagagtggtggggactctggcaaaccaatgtgtttatgcactggctacaggtttcaagttttttgttttgttttgtttttgtttgtttgtttgtttgttttttgaaacagagtctcgctctgtcacccaggccagagtgcagtggtgtgatcttggctcactgcaacctccgcctcctgggctcaagcgatcctcccgcctcggcctcccaaagtgctgagattccaggtgtgagccactgtatgaggccagctctaagtgttgggggctagggtactctttggcacagatgttggaaaagtagattaatgcatccttgtctccgggtttatctgctcctga

SEQ ID NO: 191004 - DNA, 151 bp, Homo sapiens
aaaggttatgtttaatggacaaatgcatgccagtaaaaatgtgttttgtcagtgtttgtacattcaagaatgtcctggccagtcacttaaaatgaaatcacttttttaaaaaaagattgtatctctaaataaccaccagagaatggttttt

SEQ ID NO: 191005 - DNA, 427 bp, Homo sapiens
tttgtaaaattacattgccatagtggtatatgtacttaaaatcccaagaagaaagccgtctctctggccagaggaattgggaaagagaactctggaagctggagcatgctttggaagtctcaaagagaagacacctagtttggggggagattccctaattgcatgtatgaacacacaaaggtcctacctactgcatccatgagctacacgtacatggaacagagcgaaagaaacatggcaaagacctagagagctgaactatggtgtaaaccactgctcaaatcccagagttgcccctgagagatgcatgcggaggatagatttaagcagcattgtgaacgctttgaaaactgaaacaacgattggtactgtggcctgttaggaaccaggccgcacagcaggaggtaggtgactggctagtgagcat

SEQ ID NO: 191006 - DNA, 334 bp, Homo sapiens
gcggtacgggagtgggatctggattggttggtttgcatttgaaaggtgtgctttgtaagctagcccagggaagggcagctagccctgggagctggagtcagtaagaccccagatgtcaaaacatcagaataaaaagacatgcttaatacagtgcctaactcaagttccctggctaaccaacagacactaaaagccagggagggaatgcatcctagtttgatcaccacccatccgatgcccacggtcaggagtagctttctcacttctgccaagaactgaagcttcccagaatggggagatgcccccccaccccgttcctccacatccagaacag

SEQ ID NO: 191007 - DNA, 326 bp, Homo sapiens
ggagggggttcccatgacaagtccatggcaggagctactgaagcagaagcacgagtctccactgcctttctttgcctcggtttttccccctgtgaaatgggcccatcaccctgtcctgtctcttggggacccctggtaaggtagcgtgtgtggcagctggaaacagacctactacgtgccagccccgggttgcaacctagggagagaggcccattgctgccttctaggttcccacaactgagaaggcagcgtcactaatcccagcttacagactggaaacagtggggagaggatgagtggcttgcccgaggcccaggacacacagg

SEQ ID NO: 191008 - DNA, 561 bp, Homo sapiens
cacgtgccttagcacaatgtgaatgtacttaatgccattcaactgtaaacttaaaagatggttaagatggtaaattttaggttatgtatattttattataattgttttaaaaagtgctgattaagaaaaagtatgtatgcttatcatagaaaatgtgaaaaaagaaaaaatcatcatcccactacttagacaactttcaatattttattggtttcaatactttgttatattcgtttccagtcttctatgcatatttgcacacagttgagatgttgtgatattaccatgttattgtgtcagctaactgtcatgaacatgcattctgcagaacaagaaacaggtaagaacgtggctgtagagccagaaagcctcggttcaaattctggctccctagttcttgatgtgcaacagtagccaagttacctaacctcctgtgccttggtttcctcatcaaaatcattgcttctcatcaagagcagttttgctcaggagacacttggcaatgtctacagacgtttttggttttcaagatggcagaggggtcaggggtgctcctggtat

SEQ ID NO: 191009 - DNA, 630 bp, Homo sapiens
  misc_feature (604)..(604): n is a, c, g, or t
ccgccccaccagctccttacacagtgttcacagaactacctaagcaaactcctgccacaccatatgtcaccctgtgttctaacctgctgtatcctacagtgtggggtggcactactggcagcccaaatgattttagatggcacatggataccatattaattaacaatgaatcacaaagtgagaaagtcattctctttccagttctctttcaatctctctgacgacaatgaggaagggtcagtatggtgctggtgtattaaggtggtgattaacagcatggcctctggagccagactgcctgggttcaatctctgctataccacttaacagctgaatgggttctctgtgctgtatcccccagatcccaacacacagccaggcacacaataaaaatttgccaaatgaatgagttcagcaaacattcttagaacagaatcaatgggaggcactcctaaggcttgacagaggacagatagatgccttccgagttcatgaacctgaatccaagagagatgtttatagtctaacacagttccttcacgaacctgaatccaagagggatgtatataatctaacacagttccttcacgaacctgaataaacnctatgtaggacgggtaacgagctcga

SEQ ID NO: 191010 - DNA, 666 bp, Homo sapiens
tcattctctttccagttctctttcaatctctctgacgacaatgaggaagggtcagtatggtgctggtgtattaaggtggtgattaacagcatggcctctggagccagactgcctgggttcaatctctgctataccacttaacagctgaatgggttctctgtgctgtatcccccagatcccaacacacagccaggcacacaataaaaatttgccaaatgaatgagttcagcaaacattcttagaacagaatcaatgggaggcactcctaaggcttgacagaggacagatagatgccttccgagttcatgaacctgaatccaagagagatgtttatagtctaacacagttccttcacgaacctgaatccaagagggatgtatataatctaacacagttccttcacgaacctgaatccaagaggatgtatatagtctaacacagttccttcacgaacctgaatccaagagggatgtatacagtctaacacagttccttcacgaacctgaatccaagagggatgtatacagtctaacacagttccttcacgaacctgaatccaagagggatgtatacagtctaacacagttccttcacgaacctgaatccaagagagatgtatacagtctaacacagttccttcacgaacctgaatccaggagggatgta

SEQ ID NO: 191011 - DNA, 459 bp, Homo sapiens
ctaccaacaaatactgattccttctttaaatgaaatagcccaactcctgaagcctctaaattactaccaaattaattcatagagagatcttcgtgcaacttgaagtactctcccagccccctttgtctatttattacactccaaaggcagtatctgattgcttttatctatcttatctgacttccggtgaatttttttttttaaatgaaatttgccagaagtccactagatctgcgctggtggcagctacatggtgcattcatataccccttcaattattattaaaatctttcacagtatttctgtgcagttttgaatatgcattttgtttttcctactgtcatacaatattgtctttataaaagcatcaacaattatttgttttcttatatcccatttttatcagcattactcttcttgaacaatatagaagtaaaaagttttccttctgcttttagg

SEQ ID NO: 191012 - DNA, 295 bp, Homo sapiens
ggctcatcccacaccagtccttcgtgatcctcatagcagggatcatatctcccctcaatgctgaatcacctaaaatgtatgtaaagcaagaaagaaaaactataaactgaattccctcccaggattatgataattttacctggacaggcagcattcttggccaccagaaggtggctttcttctactacatttcttccaccaccctctaatcccacatacaactatggcaggtataatcgcggacattgagaaataattgattgctatgcaacaggatgctgaggggaggaggagg

SEQ ID NO: 191013 - DNA, 738 bp, Homo sapiens
  misc_feature (15)..(15): n is a, c, g, or t
  misc_feature (18)..(18): n is a, c, g, or t
tacttttccacaggnttnccatgtttgcaggtaaaagatttgatacagacaacagaggcgatgatgtttattgaggaagtatgtttaagccttttgcgtcatcctgttttctggaaaattcagcttacccagatgagtcttcagctgctgtgtgtcagtgaagtcagcttaaagataactggtgaatgttcatcttcaattcaccttttagagcacagtgttgaacttctgaaggaggattttcctgttgaactggtcataattggaatagctttactacttctacagactccagcaagtcagcagaagccaatcttaaatctagctttgaagctcctctctgttactgaggatcagaaaatcccaaagtcctctctgctgctagtgatgccaattctgcagatactatcttctactgccttggaagactgtatatctgtggatgaagaaggtccctctaggcagcagttggctctaaaccttttggaaatgatacagcaggaatgttacagagatgaccaccaaaagctctcctacaagcttgtgtgccctgtaaccagtatgtatggtacaatatttacagcctggaggattcttgaagtaatgacagactcgtctgctgcaagtgactggttggcttcagtagagtcattgcttcctattactgctgtgatccctgcgcctgcctttcttctgctggctcacctccttgttgaagacaaaggacaaaatcttcac

SEQ ID NO: 191014 - DNA, 170 bp, Homo sapiens
ttcttacactacgtgaccttccaaaggcaaaaagagttggttaataacacagacatagcatcactgtcttcaaagacagagaaaaatcttccatagccagaaacacggtttgttcacgcttttcctgttgttgagcttggtgcccttctgctgagcccctgttaaaaatg

SEQ ID NO: 191015 - DNA, 562 bp, Homo sapiens
tgaaaacattgcttttctagatcacatttgtttagaacaaaccatatacttcactgccttaaaatatacttttatatcattttgcctaatatatatcttcataattagactaaccttgaggagaaagctgttgtagaattttttggtatcctcatagaacttggttaaatgtagagcacatagcggtatttaatggaaaaggaatgaataaaccaactagggttcatctatgcaatggcatagcattcagtgataaaaataagctatcaagccacagaaagacatggaggggccttaaatgcatactgcactgtgaaacaagccaatccaaaaaggctgcatactgtgtgattccaactatgatattctggcataggcaagactatggagacatgaagaagacagtggtttcccaggatctgggggagacagaggggatgaacacgtggagcacagatgattttcaggccagtgaaactatcctgtctggtactgcaatggtggatgcatgtcattaaacatttgtcaaaactcataaaatgtacaacacaaagagtgaacc

SEQ ID NO: 191016 - DNA, 645 bp, Homo sapiens
cgcgtccaggagagggcccagctcagctgactgttgtttcaggtagctgctgcaagtagatctgtgattacttgttgattttagtgggtggttctctgtccttctggacgaatactctttttctttacttttcctgcagtgagctggagttggtaggtttggggtggctcacatcacagtgcttgcttgtgcatattcacctttcccatggaaatcttccaagtgtgggagggaagtttgtatttcacgcactgtgccttcaccttgatcagcaaggtgaacctgagttcctgggtttcagtgtctgaggttggatagcacagagctaaggaagcgttttctgagtgtgccagcaattctcgctgggctgtgcatgctctgtttcctggaggctgcacatgctgctcatcgacattcgtggtcaggttctttccctgcagcaaaaacccttggttcagacctcatttaactcacaatttctcacctctgctctaggggtacccaagatggtggctgtgtctccccacttctgcttccccatcaggaaatagagccccaccatgggtgtctacacaatagatgaagctggtcaaataaacacgaaatctgactggttttgtgtgggcttccccgctccccctccct

SEQ ID NO: 191017 - DNA, 612 bp, Homo sapiens
ttctttataaaagaatcttagatgtggaattattgggtaaaaataattaattttctaaaagcctcttgatgcatactgtcacactaactttccagaatctagaatacatactaacaatatgtattagttgtctttggttgtcttatgctgtgtacaaaaattacccccaaattgagcttaaaataataagcatttattaatgggtcaggtatctggccgtggcttaactcaattcctctggttcagggtctctcataggactgcaatcaaggtgtctgccagtggtgaattatctcaaggctccactgaggcaggatttgcttttgagctcattcaggtcactgttggcacacctcaggtcctcgctggttcttggccggagaattatctcaaggctccactgaggcagaatttgcttctgagctcattcaggtcactgttggcatacctcaggtcctcgctggttcttggccggagatacctggtccttgccacattggtttctccataggccagctcagaacatggcagctgcttctctcagagggagcaggggagacagtaggagagaggaagcaacatgaaagtcatgggttttttattttttatttt

SEQ ID NO: 191018 - DNA, 643 bp, Homo sapiens
gacctcaaaagatcttggagcatacccaggcaagagaaataaaagggtattaaaataggaagagaggaagtctgttggtagatgacataattttatatttgaaaaaccccatcatctcagccccaaaacgttttgaactgataagcaacttcagcaaagtctcaggatacaaaatccctgtgcaaaaatcacaagcattgggttacaccaataggcaagcagagagtcaaatcatgaatgaactcccattcacaatcactacaaagagaataaaatacctaggagtacagctaacaagggatgtaaaggacctcttcaaggagaactacaaaccactgctcaaggaagtaagagagggtttcaatccctggtggcctcttttcctcatagtgtgaacagagaggagttgtaggctgtgcgtgtgtgagagggcctggtgctgtaggtgggtgggacagttcttctgttcatgtgtaatagctggttggctgagcctgggagccacgcataggaatcctatgtatctttttttctttcataggtatgggaattcagggaacatgaaagcagattttctcattaccaccaagaagtacagttttaagggcagataaaagatattctttcctagaatagcagggct

SEQ ID NO: 191019 - DNA, 282 bp, Homo sapiens
agtgcctcagtgccccatgctccctgctacttcctacaacgcacgtagcttgacaccctgtcaatgttcaccttcacctttctagggtatgctttactccacagacagcctgacctctctaaactccttgcactctgcctccaaatcctagtgatccttcaagaactgctctaaaacccaaacaccctatgaggctaccatcgctccacttccccagcactctagctcataatgagcatttccttttctgaatgactgttatgctctaccagcacaccattt

SEQ ID NO: 191020 - DNA, 463 bp, Homo sapiens
gaagtgccctgtgactggctgataccacgaggccatgttggtgacaccccgagctgctgggaggtatctcagcaaaggcaagcttactgccctactcctttctagggctgtccaagtcacttgttgggagcccaaagccatgagaaaggcagagatttgcattccagcaatactgtctgaacattaacctcaaaccccaacagctgttgggcagtgtgtgagctgtctgtccagcattccacatgagctcagctaattgaagaaccctgatcaaacagtagtatagaaactcccagctcagcagtcaaatcaggttcccctgtcttcctgccgttggcccttctctcagcccccatgggctcagtgcctgtctcatacccacctgaggccccacaggcccagccctagccctttccccagaactttccccatcccagacctagttctgtacaatgtcctccca

SEQ ID NO: 191021 - DNA, 357 bp, Homo sapiens
tacgtaacacaaatgatttctcttcttactgttggtttccaataccccaaagtaaaattagttcctccatccgtggcatttaacacaccacatgaatgcttacatgccatgtccccacattgggcaagtactattctgtatactatttgtataccagaagggtatagtttgtcctttaagcatgcaacttaaaaggatcatctggtttaacaggaatccaataatctacaagccaaaaacgaacaaaaatatagccctcgcatcttcaaagtcatttaaggacaaaaaagttgaaaaaaaaatccatttagtaaagatctaactgacaggtttgccagagcataagaactctgtgaa

SEQ ID NO: 191022 - DNA, 776 bp, Homo sapiens
cctgggggaaagaaaaggatgggtgggagtaggagagggcgtgacgtgggcctactctgggaagggccgttctgctgagtacaatcacgacagcagaagggcagctcccaatcatggcccaagtgcccatctctgccagacacaattctatacaagttacatgcatcgcctcattgcaacttttcaacaacctgtaaggtatgtgctacgccactgcctatgatagagatgagactgaggacacgtgcttcctgaggggaaaggtgggatgagaacccaggctgacttcagatgtctcctggggcagcctgtgggcctccatgcccacccatcctctacatttctgccccctgctctctaggaatagactggtgactgggggcagggctgcttctgtgtgcctgctggaggcttgtctctgcttccttgagccctttcccactgtcaggcttctgagagcccagcctgctggaggcactgtgaccttggtctgtgtccgatgggtgcccctttgcctttgtactcaatgttccacaccgacaagccccctggggctatagacagaagctcccctcaccccaccaaggcccagcaacttcaaaaccctcagacccagctaggcatggtggcacacgcttgtaattccagcactctgggaggctgaggcaggagaatcacttgaacccgggaagaggaggttgcagtgagctgagattgtgccactgcactctagactgggcaactagagtaaaactccatctcaaaaaaaaaaaaaa

SEQ ID NO: 191023 - DNA, 466 bp, Homo sapiens
cagggtcttttcccctcaaaccttgagagcacagcagcctcagagaagatctcagctgtaaccttgtgagaccctgagcctgaggcacccagctaagctacactcaaattgctgtgagataacatttactgtcttaagctaagtttaggataacttgttccacagtatagacaactaatacgatcccaaatctcacaacctgcatcactagcaccctagtccaacctcatcaacagcctaggccatgacttacaacagcttaagtgagtagcctgcttccacacttgccttgcctccttcctttattcttcacagcaacccaccagagatgctttaaaaatgtaaatcagagtgcaaaagtcattaagtgggcccgaggaatgtagacatctgcacttgtatgtgagggagaatgttgcggtagcccagcaagatgtgtcagagcctttgaggggagaagagcctg

SEQ ID NO: 191024 - DNA, 263 bp, Homo sapiens
agagagacctcccttccacctgggaggatcagacaagcagttttggaggagataacatctgatctaggccttccaggaccatgaggattcagaagacagagatgagacagggtacgggtgggctctggaaagaccaaggtaacagttttaaggcaggcagcctctacagaaaagggaaggttagtgtggcagaagctgaggtcatctgaagggaaaagaggttgaaaatacagtctggaacaagtggcacagcattgacagag

SEQ ID NO: 191025 - DNA, 433 bp, Homo sapiens
ccaagggcttcctggagaccaagtaccttgccctacctctggagctgttcttcaataatgcctattctttctgggcaggaattgtagcagggcatgtgtagcctatgtgacccccacagaaaagctggggagacaaggaaaaggcctcttttctagaacatctgccaggaattgaagggacaaagaagctgacttgtgcagtcagcaatgcggtatatgttgtagtgtctagatactctctcaggatcaagtattaatcagacaaatatccatgttgtgggcacaaatcccagcagctgtaattctgttagcagccactcagaagtccaggggcaaagacctcttttgggagttctttctacgtaatgtaagattgtatcccatggacagaggtgcaggagaaacattgatcaccaggaatgtgactggtgat

SEQ ID NO: 191026 - DNA, 264 bp, Homo sapiens
caagtgaggggagacaagtgagtaagatgacagtttgggggacaggaatgcttccatttctctcttcttttttctgtgttacctgctaggtactaccataggccttgggaaggcacatcccaggcacacctagaaacaccttatgtgaaaatggatagtgtcaggcactttatctttaacttaatagaagttgacaatgtaactgacccatggtggagtgaagtgaaaccacatgtgggctggattgaccctcccttgatctag

SEQ ID NO: 191027 - DNA, 346 bp, Homo sapiens
agaatggaatcaaaatggagaatttcctaccttgctcacttcaaccaattaagaacataattggtagcaaaagatgaagagggagatttcaggtaaaagagaacagaaattaaaaaaaaaggaaggggggagaaaggcaacagagacgagatggggaaaagagcaaaggggattaacacatcttgagagggtgagatgaaagtgtgaggaaaaagtaaaaaattatatttgcagataataaagactatgtagaaaagtcctgcagaatctaaaaagagctactaaaactaatcaatgagtttagcaagactgcaaaatacaagttaaaaatggattccattggggg

SEQ ID NO: 191028 - DNA, 184 bp, Homo sapiens
cagttcggttaattgttaaaaataaataaatccaggttttaggtaataaaacctaagaccaataattcatctaagaccaatgctacaacatgttgtcctttgccaactctaaacgggaaatacaagctggcacaagatgggcactaatcaaagtccttacgtatctctaaacacaggttcaata

SEQ ID NO: 191029 - DNA, 127 bp, Homo sapiens
acatgggattgtgctttttggcctccttcacttggcaatttgccctggaaaccagcagacctgtcttgtcaccaggagggcctcagtcatcaaggcactctgcagatgtctgtctaatcttgtggag

SEQ ID NO: 191030 - DNA, 371 bp, Homo sapiens
attccctctatgagaaatgatgtaatgtaaaagccatggtctttatcactgagacctggggaagctttataaagatgccccggcagctgtgaaaacacctgtagagaagaatgcacatttccttctttcagcaagcatccactgatttccaactctgtccacttttatagggtgtaataaagtagaaaaagtagttactgcttttaggtaaattaaaatgtctgcttaaagagctattacctatataagttaactaaggaacagaaaagtagcatgtgtagtgggaatgttagaaggcaaaagatccagccacgattggtgtgactgaactaatcaggactcctaattttcctgactgaaaaaaataggga

SEQ ID NO: 191031 - DNA, 332 bp, Homo sapiens
catggacctctgtttcagttgagctccccaagaagcggaccttgggccaaggattcaaacacacaccctgctcagcatatctaggtctattccattcattgtaatggttgcacagcatttcaccatgtgtctgtatcattatttatttaatccccccaatgtacacacattaccctacctccactccacttcccactcactgacacttaggattgttgggagtgtgctgatgttattgactattgtaaggggggacatatgcgacaaagggaaactccattttccaaaggccatggctgcaagacagggttctgagggctggagaaatgaca

SEQ ID NO: 191032 - DNA, 370 bp, Homo sapiens
gcacattgaattcagactggtgtcatttcaagtgagcaatagtggcccgtggttagtggctactgtgttgcacagtacaggtctggagctcccaaagttagtcaaaaatagtttagatttacacttgctggaggaattctttttcaaaacaagttaatcaacattcctattctagtacatgcacatgggaaacagaatttagtgtacatactcaaattgcctatttcactccatgtatatttttcacgcactcactgtatggtcatggagcatcaactatgttagcatgagtgatggttcacacactggagctctaatcatgagctgaccacgcacagtgtctgttcttcagcttacacctttatgaagg

SEQ ID NO: 191033 - DNA, 417 bp, Homo sapiens
tgggcacaaagagggacaaatcaaacaagagagcacacaagttagaaaaaactaatccatatacagtcacttgatttacaataagcctcctactgcaattcactgggcaaaggatagccctttcaatgcggaagtagatgaaagtttacccctacctcacaccatacacagaatgaattcaaatggatcatagagctaaatatgaagagcaaaagtagcaaaacttctagaacaaaacatagatgatcttcatcgatgttggattaacaacaatctcttgaacaggatgcagaaaactctaaccagagttcccacaaattgataagaaaagcaaacaccctagtgaaaaaaaaaaaagagcagaatatctgaacaggaacttccccagagaggatattcaaatgggcaataagcctg

SEQ ID NO: 191034 - DNA, 167 bp, Homo sapiens
tacttgtcctttcaaagagtggctatttaaggtgtattagagaagaaaaattaactatttctatagtctttgttggttaatttctccaaagcaaatgcagcacccttagactctaggagacagcaactagaggaatctgtataacccctgagtctattgtgtttata

SEQ ID NO: 191035 - DNA, 425 bp, Homo sapiens
ctgtgagcccaacgtatgagaataaccatctccataggtattggtaacatccaggatgtgggatttagaatggagagaaaacagtactgctgaagtcctagagatgggagacacaaaaggattaggagatgaaaacaaccatatgaggaagaggacaatatgttatagaaaataaattccctgcataaaatcccaaagaaggcataattcatacaggatggagggctacagagtcaaatccagcggccacttcttaggaaggtaactgccctttcttgttttgaaattcagggcaaaatgtttgattaatagagttatctttccttctcttttgaagatctaaaaaaaggtatcttctcttatttaatgtagagaaatactctttttttttttaaacggtgtaacagtttcatccttacagggag

SEQ ID NO: 191036 - DNA, 257 bp, Homo sapiens
ctaggatccccggtcaattactacacaaaaggagctcttaatgccttcaaaactgaggtttggggacattctaatgtgtttactttgcaagggacccctaaaaaagaagaatgaagaaatgttgtagaaaggtcatctcatttcatgaaataaactgatatgacacattctggcagcatgatgctataatcttcagcacagcactatgagctctgaaagaaaatgatttgtgggccaggaaaattactgtgatcaag

SEQ ID NO: 191037 - DNA, 192 bp, Homo sapiens
gccaataacattacttttaatggcttctcagtattccattatatagttgtactatgatatactaattaatgcctcattgttggacactgacatttttgccttttaaaattatcattatagaccattctggattttctcaagacaaaacccttagaagtgaaacttctctggcaagggggatatagaatttca

SEQ ID NO: 191038 - DNA, 265 bp, Homo sapiens
ggctttcccttttcagttaggaagggacctgaccctaggccagaactgtcacatggccacacctatttcaaaattcaccttgagatgaaatggcacctcaccttgttaccctaatgcaatcttggtgttcttagtaaggcttaagagggaaatgggtattggtggaacaacagcagtatttgttgtattctgtcacaggtcacctgggttgtcaaaagtgaatttgtgagctgtgtgtggtggtatgtgcctgtaatcccagctg

SEQ ID NO: 191039 - DNA, 474 bp, Homo sapiens
tcctctggctatcctcatatctgacattgagtaaatgtatttcaggttacattttaaccttttttattattttaagttgactgagggctggcctggcaacattctccttggtataaatactccaactataagctacctgctcagtagaggaaactaatcaacagcagggcctagcataggtcaaagacacaagcagtgggaagctttttggggcctggctcctaattgcaaggacagttgcacaggtgtctctgaatgcttagacagcctggcctttcctgacccaatgccccccatcagctttttcaagcacatcttgatcttttgtcattctgttctctggggtgaaaactcatcgtcagggctgtctacaacaaaacagaagtatcaggttactaaaacctcaggaacagagattacggattgggttaagagtgtgccctttcttaaggatggtacgcatggaaaagcagc

SEQ ID NO: 191040 - DNA, 267 bp, Homo sapiens
atccaaacaattggggaatcctgtcaattttacctccaaaaatacaacctaaattcatttgttcttcctaacctgtactcctacctctctaagccctcaccaccttcacttcttatctgagctactgtaatagtttccttactggtcttcttccttctattcttgtatctttagaatccatattgtacacaggattcagaatgacattttaaatgttatacatatcatttaaatcatttaatgatttttcgttgtacttagaataaa

SEQ ID NO: 191041 - DNA, 348 bp, Homo sapiens
tctgctttatatttttcttcccctttttcctttgcctgttaccatatagatggggatgccgaactttgttatgggtgaaatgtcaggcactgtagcatttttttctaaaatggtgatttctcatgtagacactatcataatcttcatgtatggtgctttatcttaaaaatatttcatggctctttttttttctgttgagttaaaagtaattatgcttgtgtattccacagaaagtattaatatttaagcaaatttgaatatcacatgggataataacaaatcttagtgtttagaggctggcacttcctagtctagttctgccattaaaagactgagtatctttggcca

SEQ ID NO: 191042 - DNA, 600 bp, Homo sapiens
tggaaccacttttcccaaacctggcccctaggtctcctgtgacacaacagccacacctcttccttgtgcggtatataactattttgagaaaaagccttatgcactgttataaaccaggtcttctggaaggacagagaaatggaatcttcttccactgggatcaaacctaatggacctatgaagccactgaaccactgtggtagtttccagagggtggtagtttccattttattcagaaatctgtggggataaagacagtattaaccactaggtaatttaaactcattacaaattaagacagggtcgggtacagtggctcatgccagtaatcccagcactttgggaggccaagacaggaggactgcatgtgcctggaagttgaagactagcctgggcaacacagtgagactggctctaccatatatatataaattagctaggtgtggtggcacatgccttagtcctaactactcgggaagctgagctgggaggattgcttaagcccaagagttcaaggctgcagtgagctatgattgtgccactgcactccagcctgggcaacagccagacactgtctctaaaaaaaattaggtggctcgg

SEQ ID NO: 191043 - DNA, 596 bp, Homo sapiens
ccaaaatgctaggattacaggcatgagccactgagcccagcccacaattcaattttcttaaaaacccatgattaatatgtcaccccctacttgaaaatcttcaacaattccctatcttccataaaacaccttgcatctacagtacaatttagctccacctcacctctcagacctcatcttctactgtttcctcacacacactatattccaagaaatctctagtaaactttcatttccaaaggcagcttgttctaactcctcccacatacttgtcaggctgctcctgccacccatctatttggacccagcaaaaaggtcacctccatgactgtttctttcctgatcccagtggaagaggatcccaccttgctgcccttccagaagacctggtgtgtaatggcacatgaggccctttctcaaaatagagatatataacacaaaatgaaatggtagacttactctattatgggaaacctgggggcctgggacaacaggacgttctgcagtagtacaagaccccagagatcaactagcacacatgctttattgggtgcctatagtactttttttttaaatgagccaacatataaaaatct

SEQ ID NO: 191044 - DNA, 569 bp, Homo sapiens
ccaaaatgctaggattacaggcatgagccactgagcccagcccacaattcaattttcttaaaaacccatgattaatatgtcaccccctacttgaaaatcttcaacaattccctatcttccataaaacaccttgcatctacagtacaatttagctccacctcacctctcagacctcatcttctactgtttcctcacacacactatattccaagaaatctctagtaaactttcatttccaaaggcagcttgttctaactcctcccacatacttgtcaggctgctcctgccacccatctatttggacccagcaaaaaggccaagacaggaggactgcatgtgcctggaagttgaagactagcctgggcaacacagtgagactggctctaccatatatatataaattagctaggtgtggtggcacatgccttagtcctaactactcgggaagctgagctgggaggattgcttaagcccaagagttcaaggctgcagtgagctatgattgtgccactgcactccagcctgggcaacagccagacactgtctctaaaaaaaattaggtggctcgg

SEQ ID NO: 191045 - DNA, 648 bp, Homo sapiens
agagataaaaacaacatggtccttactctccagggtgctttcctgtctcctgtgatcattgacactcataatgctaagttacagcaataggatggaagtggctcattctggattgtttcttcagagtaacaagaagccctaattgtcaagagacacagattctatagtccaagagcagagttttcctgtaggtacttttcagcctgcaagttagctcagactcgcctgagaaagttctctgcagataagagggtgcttgaatcttcagtaagtcctattgtcaatttctggatcttttcttacttcaaaataacctcagcccctgctttaataaaaaggactttaagccaacagagtaaacttgatagttggtgtgggggaagaaaatagccctttctttatgagtgttgtgatccgggagctttatataccctaacttaatcttcaaggcattggttgaaagaaggaagtgacttgctatgttacacatttatttaggggtggagttagggattggaactcacgtctggctccgttataccacattccttctctggccttcttatcttaagcccacaaccatctgtatcctgttcagaatggatagttgtgtactaaaggctgatcctgtggtagtgcggtgctttt

SEQ ID NO: 191046 - DNA, 867 bp, Homo sapiens
ggtcagaagtctggtttttaagttcacagtctgagacacatgaagtatgcaactcacagctaaccattaggaaaggaggtgaagtaatctgctggagaagggccaggaatgtaagatgagagatttaaggagagtggaagagtggcttaacaacaacaacagtaacaaagaagcattgttgaggctccattggaaactggtcatgaatgtggtagaaccaagctaccatgtcatgtgacacagaagtaaatagttgggctcaccaaacttcatgctttgtgcaggggtgttggaaccctttgaagaagtgtgtagctaatagcccatacataattcagaagaagtcttcaatggaagacccccgggggataaatggacagtctgtcaagtgggatcatggattcaaatgttctttgaaaatgaaaagtgcaacataactctaattcactttttattggaaacatctccagaaaaatgaataaacgaccatgaataaaaaattatctggccacctgcaagtctacaatacaattttaaaaatgtgaccatcacacctgcatcaggtattataaacactaaccctgcatatgtttgatcatgatgttgtcagctcatgcattggggggtggaattcggtctcctaagactctaaaaggagcatttgttataaatggtagatacttaacttacttttctttcaaaaaatttagatgatgatattctagatcttgtggactaatttaactttagggctccattgtactctcataactgtacctcttgtgtctcccttaagttatgataaatttgaagtgctaacagcagttttgctgaatgctggttttgccagaaactctattaaataaa

SEQ ID NO: 191047 - DNA, 914 bp, Homo sapiens
  misc_feature (478)..(478): n is a, c, g, or t
  misc_feature (480)..(481): n is a, c, g, or t
  misc_feature (516)..(516): n is a, c, g, or t
  misc_feature (614)..(614): n is a, c, g, or t
agcgggatgatgcccctgggccccaccccggggcaggagggcggcgatcggcgcccgggaagcggctgaggggcgccgcgactctcagcgagcgccgcccgagccccagccagcccgggcagcctccgaggcctagggcgccgccgccaggtgcaggggtgttggaaccctttgaagaagtgtgtagctaatagcccatacataattcagaagaagtcttcaatggaagacccccgggggataaatggacagtctcccattggcactgctgttcaatatgttacgacatttggagcaaccacagcagcagctctcaccagaaattaaaggtggagtctcgctctgtcgcccaggctggagtgcactggcgcaatctcggctcactgcaagctccgcctcccgggttcgcgccgttctcctgcctcagcctcctgagtaactgggactacaggcgcccgccaccacatctggctaattntnngtattactagtagagacggggtttcaccgtgttangcaggatggtctcgatctcctgacgtcgtgatccacccgccttggcctcccaaagtgctgggattacaggcatgagccacgccccaggcctatatatntctgaatcttaacatcatttgattatcgcttcctgtacttcacaatcttatcagatgatgtgtgctgtcagtttttacctctaagcttttaaacattttaaactgcaaacccacacttgggaaacatttttcatccacaattcagtaaaaatatttttgccatatttgcatatgttgaatatctatatggttaaaaattcatggactaacactcttattgaagtgtggtgaccactgatatttaatatcctatttcatttttcaaaatcttagtagcagcattcagtcttcccagaccat

SEQ ID NO: 191048 - DNA, 1011 bp, Homo sapiens
ggtcagaagtctggtttttaagttcacagtctgagacacatgaagtatgcaactcacagctaaccattaggaaaggaggtgaagtaatctgctggagaagggccaggaatgtaagatgagagatttaaggagagtggaagagtggcttaacaacaacaacagtaacaaagaagcattgttgaggctccattggaaactggtcatgaatgtggtagaaccaagctaccatgtcatgtgacacagaagtaaatagttgggctcaccaaacttcatgctttgtgcaggggtgttggaaccctttgaagaagtgtgtagctaatagcccatacataattcagaagaagtcttcaatggaagacccccgggggataaatggacagtctgtcaagtgggatcatggattcaaatgttctttgaaaatgaaaagtgcaacataactctaattcactttttattggaaacatctccagaaaaatgaataaacgaccatgaataaaaaattatctggccacctgcaagtctacaatacaattttaaaaatgtgaccatcacacctgcatcagcaccttgaataactctagtttatgtggttgcaagtaatggaacttaccatgagctggcataagaaaacaaaaggaaagtcttaagaaagagggcatctggggaattcagtgctggctaacccaccatggtttatacattactgggtcatccaccatgtaggaagaaaacctctgaccggtcctggatgcatcatgatcctgtgcctgatagagcaggtcgctgcagcagaaacaccacagttcccagaggagaggctgggctgaccacccaatagttggctattgggatggaccttcaaaaactcccattttgagatcattgaagcaccagtttgaaagcacatatctgatcctacctcatcattttgcagatggggagatttaacccttgatatgccatcacctataatctatttgatggaagtatctaataatgaatatataatta

SEQ ID NO: 191049 - DNA, 480 bp, Homo sapiens
ccacccgcttcagcctcctgaagtgttgggattacaggcgtgagccaccacgccctgctctatctcctttttttaagaaagagacagggtcttgctctgttgcccaggttggggtgcagtggcacaatcatagctcactgtaacctcaactcctgggctcaagcagcagtctagctaatttttatttgtattttttgtagacatggggtctcactgtattgcccaggctggtctcagactcccggactcatgctgtccttctgccttggcctcctaaagtgctgggattacaggtgtgagccgctaactggcctcagagtacattcgggagctgtcctcctttctccgtctcattgctgcccacctgaaccaacacccatggtcatcttggtcctggaccgtcatatcagttctctgcaggtgctcttgccacttccagcccatttatttctcacacagcagcaacttcctttcttctaa

SEQ ID NO: 191050 - DNA, 429 bp, Homo sapiens
tggaagaagagaaacaggaaacagaaagtgtagacagatctactgtgaagaaaagcacaaatgtggggaagagttgtttccaaagagtcttgcttaacatgaaaaaaataaacatgcttgattgctgaaggagatctagtagatgaggaaagactgaagaagccaaatagagtggggacactttctggagcaacttcctgaataggtgagagggatgcaagggctactgcaagtggagaggttgacctcactaggcatgtgggcagaacatgcagagaacagaaactaacatatgatgtagtaacagaagaaaagtgaagacgcaggttgatgggtagatgtggtttcaggagtttggagaagctctctttggattccttcaattctgccggtttaaatgggaaacaaggtgaccgtggtgaggaggtg

SEQ ID NO: 191051 - DNA, 1473 bp, Homo sapiens
aagcagtggtatcaacgcagagtgcccattacggccggggactgacttccttcgcactcagcccactcgcacccgggtgaataaacagcctttgttgctcacacttagcctgttcaagttgtctcttcaattagatgctcgcataacatttggtgccgaaagcccgggataggggaactcctccggcagacctctcctctatcctcccggtacccacgttctcccatgcaagagacttccctcgccctcaggacctcagaccagctccgcgagcactccggcctctgtctatggatatgaaatccaacaccggtcacggactcttcttggggagacagccttccttcagtgttcggtcaatgcccgggacgcccgccttggccatttgccagccacacaacccaggacctccaatggggacgcccactgaggatcctagtggttgctcttttccttgtctctttctttccccccagtctttccttgttctatcatgggcaatttcccgccttccatccctctttcttctgtctggcttgtgtcctcagaaacctcaaacctcttcaccttgcacccaatctaaaggctaaacgtctaatttttttctgtaacacgtcctggccccagtataaattagaaaatggcgctcagtggccagaaaacagcacttccaatttctctatttgtgggacttagacaacttctatggaaaaatgggcaaatgggtctgaggtaccctacttccaggcattttttacatacgatctctccctagcctatgcttccaatgtaatccatccccaattttccttatttcccttctgtctacccctccttcttccactggcgatgctgactcctcttgtctgttgacccctccgatctttctccccgaccacctatcgaacctgcttctaattctcccccagaacctatttctacccacaatccaccctcttatgcccctcccattaccacccttcctcacatcctctatggcttacagtttgggcctgcgaccaacccccaggcccctgcctagcaatttcccctcggagaggtggcaggaaccaaaggaatagttcgggttcaggtccctttctccctgttcgacctttcccaaattagtgaacatctaggctctttcccatctggacccaccaaatatatacgagaattccaatacttaacccagtcctataatcttacctggaatgacttaaatgtcatccttacctctaccctcgctcctgaggagtgagagtgggtttggatcctagctcaatcttaggctgataaccgccggtgccgtaagcctggcctccagtaaggtgctagggcagtaccctgtgaagaccccggatggacttaccaggccctgggacccaggcatagtcaggcgggactacatgatctcttgcctagttaaagggcttcagaaggctgcatataaagccgtcaattatgacaaat

SEQ ID NO: 191052 - DNA, 1714 bp, Homo sapiens
aagcagtggtatcaacgcagagtgcccattacggccggggactgacttccttcgcactcagcccactcgcacccgggtgaataaacagcctttgttgctcacacttagcctgttcaagttgtctcttcaattagatgctcgcataacatttggtgccgaaagcccgggataggggaactcctccggcagacctctcctctatcctcccggtacccacgttctcccatgcaagagacttccctcgccctcaggacctcagaccagctccgcgagcactccggcctctgtctatggatatgaaatccaacaccggtcacggactcttcttggggagacagccttccttcagtgttcggtcaatgcccgggacgcccgccttggccatttgccagccacacaacccaggacctccaatggggacgcccactgaggatcctagtggttgctcttttccttgtctctttctttccccccagtctttccttgttctatcatgggcaatttcccgccttccatccctctttcttctgtctggcttgtgtcctcagaaacctcaaacctcttcaccttgcacccaatctaaaggctaaacgtctaatttttttctgtaacacgtcctggccccagtataaattagaaaatggcgctcagtggccagaaaacagcacttccaatttctctatttgtgggacttagacaacttctatggaaaaatgggcaaatgggtctgaggtaccctacttccaggcattttttacatacgatctctccctagcctatgcttccaatgtaatccatccccaattttccttatttcccttctgtctacccctccttcttccactggcgatgctgactcctcttgtctgttgacccctccgatctttctccccgaccacctatcgaacctgcttctaattctcccccagaacctatttctacccacaatccaccctcttatgcccctcccattaccacccttcctcacatcctctatggcttacagtttgggcctgcgaccaacccccaggcccctgcctagcaatttcccctcggagaggtggcaggaaccaaaggaatagttcgggttcaggtccctttctccctgttcgacctttcccaaattagtgaacatctaggctctttcccatctggacccaccaaatatatacgagaattccaatacttaacccagtcctataatcttacctggaatgacttaaatgtcatccttacctctaccctcgctcctgaggagtgagagtgggtttggatcctagctcaatcttaggctgataaccgccggtgccgtaagcctggcctccagtaaggtgctagggcagtaccctgtgaagaccccggatggacttaccaggccctgggacccaggcatagtcaggcgggactacatgatctcttgcctagttaaagggcttcagaaggctgcatataaagccgtcaattatgacaaataaaaaacaaaaacaaaaacaaaaaaaaccactcagaacaaagataaaaatccagctcagtttatggcctgtctacctgccaccctcaggcgatatacagcactagaccctgaagggatagaaggccgccttattcttaacatgcattttattacccagtcagtttctgacagtagaaagaaacttcaaaaattagagtctggctctcagatcccacaacaggaattaatcaacctcgcctt

SEQ ID NO: 191053 - DNA, 1803 bp, Homo sapiens
  misc_feature (374)..(374): n is a, c, g, or t
aagcagtggtatcaacgcagagtgcccattacggccggggactgacttccttcgcactcagcccactcgcacccgggtgaataaacagcctttgttgctcacacttagcctgttcaagttgtctcttcaattagatgctcgcataacatttggtgccgaaagcccgggataggggaactcctccggcagacctctcctctatcctcccggtacccacgttctcccatgcaagagacttccctcgccctcaggacctcagaccagctccgcgagcactccggcctctgtctatggatatggtaagctgcctcggtctctcctcatctctccctctctttttctcttttcaaaattgagacaaagaaccttcctcntatccgtgtttcagaaatccaacaccggtcacggactcttcttggggagacagccttccttcagtgttcggtcaatgcccgggacgcccgccttggccatttgccagccacacaacccaggacctccaatggggacgcccactgaggatcctagtggttgctcttttccttgtctctttctttccccccagtctttccttgttctatcatgggcaatttcccgccttccatccctctttcttctgtctggcttgtgtcctcagaaacctcaaacctcttcaccttgcacccaatctaaaggctaaacgtctaatttttttctgtaacacgtcctggccccagtataaattagaaaatggcgctcagtggccagaaaacagcacttccaatttctctatttgtgggacttagacaacttctatggaaaaatgggcaaatgggtctgaggtaccctacttccaggcattttttacatacgatctctccctagcctatgcttccaatgtaatccatccccaattttccttatttcccttctgtctacccctccttcttccactggcgatgctgactcctcttgtctgttgacccctccgatctttctccccgaccacctatcgaacctgcttctaattctcccccagaacctatttctacccacaatccaccctcttatgcccctcccattaccacccttcctcacatcctctatggcttacagtttgggcctgcgaccaacccccaggcccctgcctagcaatttcccctcggagaggtggcaggaaccaaaggaatagttcgggttcaggtccctttctccctgttcgacctttcccaaattagtgaacatctaggctctttcccatctggacccaccaaatatatacgagaattccaatacttaacccagtcctataatcttacctggaatgacttaaatgtcatccttacctctaccctcgctcctgaggagtgagagtgggtttggatcctagctcaatcttaggctgataaccgccggtgccgtaagcctggcctccagtaaggtgctagggcagtaccctgtgaagaccccggatggacttaccaggccctgggacccaggcatagtcaggcgggactacatgatctcttgcctagttaaagggcttcagaaggctgcatataaagccgtcaattatgacaaataaaaaacaaaaacaaaaacaaaaaaaaccactcagaacaaagataaaaatccagctcagtttatggcctgtctacctgccaccctcaggcgatatacagcactagaccctgaagggatagaaggccgccttattcttaacatgcattttattacccagtcagtttctgacagtagaaagaaacttcaaaaattagagtctggctctcagatcccacaacaggaattaatcaacctcgcctt

SEQ ID NO: 191054 - DNA, 1238 bp, Homo sapiens
aagcagtggtatcaacgcagagtgcccattacggccggggactgacttccttcgcactcagcccactcgcacccgggtgaataaacagcctttgttgctcacacttagcctgttcaagttgtctcttcaattagatgctcgcataacatttggtgccgaaagcccgggataggggaactcctccggcagacctctcctctatcctcccggtacccacgttctcccatgcaagagacttccctcgccctcaggacctcagaccagctccgcgagcactccggcctctgtctatggatatggtgttcaataatagggaagagactgcccggcgacagcgcatttcagaactacagatgcttgcctccgccataagacaaaccccagctgcactgcctacctgcaagaacttcaaggcatctaaacgcaacatccaacagcccctctgggactttgcttcaagcgatgaaaacctggccactgggccaaggaatgcctgcagcctgggattcctcctaagccatgccccgcctgtgcgggccctcactggaagtctgactgcccgactctcatcgccacttccggagctcctggagctcaaacccaaagctccccaccgactccttcccagatctcctcggcttggcggctgaagactgacgctgcccgaacgtctcggaggccccttagacaatcgcggatgccgagcttcgggtaactcttagggtggaggcataaaaagacaggaatgttaggtcctctgagcaggcggcgccatggtcaagccatcgtgacccctgtgactcacacgtacacatccagaaggtctcctggagccagaaagtctgggacgacaggaaaaccacaaaagaagaaaaacggctagttcctgtcttagctgatcagccaaccttgtgacattctatcattgtaacaggctgtaccctaactgatcaatcaacctcatgacactgtgctctgtaaccttatgataatgtaccttatgacattcttcccctgccctcaataaacagctccgaactataaaaaagaaaaaaaaataaaaaaaaactttttgggggcgccgggcccagaaaaattttaaaacctctgtttgggcgcgcggcccgagtatggactcggcaaggcgggccaggaaaccgggcgactgggggggtcccccaaaaaagccggggacggctttgaaaccaggggccgggctcgggtcccaggcccggcga

SEQ ID NO: 191055 - DNA, 802 bp, Homo sapiens
gaactgataaaactagctccaacccaccaccctccactgacttccttcgcactcagcccactcgcacccgggtgaataaacagcctttgttgctcacacttagcctgttcaagttgtctcttcaattagatgctcgcataacatttggtgccgaaagcccgggataggggaactcctccggcagacctctcctctatcctcccggtacccacgttctcccatgcaagagacttccctcgccctcaggacctcagaccagctccgcgagcactccggcctctgtctatggatatgcataaaaagacaggaatgttaggtcctctgagcaggcggcgccatggtcaagccatcgtgacccctgtgactcacacgtacacatccagaaggtctcctggagccagaaagtctgggacgacaggaaaaccacaaaagaagaaaaacggctagttcctgtcttagctgatcagccaaccttgtgacattctatcattgtaacaggctgtaccctaactgatcaatcaacctcatgacactgtgctctgtaaccttatgataatgtaccttatgacattcttcccctgccctcaataaacagctccgaactataaaaaagaaaaaaaaataaaaaaaaactttttgggggcgccgggcccagaaaaattttaaaacctctgtttgggcgcgcggcccgagtatggactcggcaaggcgggccaggaaaccgggcgactgggggggtcccccaaaaaagccggggacggctttgaaaccaggggccgggctcgggtcccaggcccggcga

SEQ ID NO: 191056 - DNA, 1240 bp, Homo sapiens
  misc_feature (878)..(878): n is a, c, g, or t
  misc_feature (906)..(907): n is a, c, g, or t
  misc_feature (964)..(964): n is a, c, g, or t
  misc_feature (1011)..(1011): n is a, c, g, or t
  misc_feature (1025)..(1025): n is a, c, g, or t
aagcagtggtatcaacgcagagtgcccattacggccggggactgacttccttcgcactcagcccactcgcacccgggtgaataaacagcctttgttgctcacacttagcctgttcaagttgtctcttcaattagatgctcgcataacatttggtgccgaaagcccgggataggggaactcctccggcagacctctcctctatcctcccggtacccacgttctcccatgcaagagacttccctcgccctcaggacctcagaccagctccgcgagcactccggcctctgtctatggatatggtgttcaataatagggaagagactgcccggcgacagcgcatttcagaactacagatgcttgcctccgccataagacaaaccccagctgcactgcctacctgcaagaacttcaaggcatctaaacgcaacatccaacagcccctctgggactttgcttcaagcgatgaaaacctggccactgggccaaggaatgcctgcagcctgggattcctcctaagccatgccccgcctgtgcgggccctcactggaagtctgactgcccgactctcatcgccacttccggagctcctggagctcaaacccaaagctccccaccgactccttcccagatctcctcggcttggcggctgaagactgacgctgcccgaacgtctcggaggccccttagacaatcgcggatgccgagcttcgggctagacataaaatctgccaagctgccaatttcctgttacctactccagagacccagtgatatgaagacaccctagctggactgtcagttctcgttaagaacctaacccctcaaactctacaacctctgtggacaggatcctacctggtcatctatagtaccccaanagtggtcagtctacagaatcctccccannggattcatcgctccaggataaaatatgcccatctgacgaccagcctagctcctccanctcctcctggaagtcacaagtactctctcctacttcccttaaattanccgattcctgaaanagaacaataaccctgtataccttttatttacagtagacctttacacagttcaccccactatgtaaagctctgttctactttatgcccctgatcaccattctcaactaggtctaaatggccctgcgtttggtctaatacggcagtcaaggtttcttcagaccatgggagtgaactcatggggtccctccagtgtggacttaatctttctaagtggg

SEQ ID NO: 191057 - DNA, 1258 bp, Homo sapiens
  misc_feature (896)..(896): n is a, c, g, or t
  misc_feature (924)..(925): n is a, c, g, or t
  misc_feature (982)..(982): n is a, c, g, or t
  misc_feature (1029)..(1029): n is a, c, g, or t
  misc_feature (1043)..(1043): n is a, c, g, or t
aagcagtggtatcaacgcagagtgcccattacggccggggactgacttccttcgcactcagcccactcgcacccgggtgaataaacagcctttgttgctcacacttagcctgttcaagttgtctcttcaattagatgctcgcataacatttggtgccgaaagcccgggataggggaactcctccggcagacctctcctctatcctcccggtacccacgttctcccatgcaagagacttccctcgccctcaggacctcagaccagctccgcgagcactccggcctctgtctatggatatggtgttcaataatagggaagagactgcccggcgacagcgcatttcagaactacagatgcttgcctccgccataagacaaaccccagctgcactgcctacctgcaagaacttcaaggcatctaaacgcaacatccaacagcccctctgggactttgcttcaagcgatgaaaacctggccactgggccaaggaatgcctgcagcctgggattcctcctaagccatgccccgcctgtgcgggccctcactggaagtctgactgcccgactctcatcgccacttccggagctcctggagctcaaacccaaagctccccaccgactccttcccagatctcctcggcttggcggctgaagactgacgctgcccgaacgtctcggaggccccttagacaatcgcggatgccgagcttcgggtaactcttagggtggaggctagacataaaatctgccaagctgccaatttcctgttacctactccagagacccagtgatatgaagacaccctagctggactgtcagttctcgttaagaacctaacccctcaaactctacaacctctgtggacaggatcctacctggtcatctatagtaccccaanagtggtcagtctacagaatcctccccannggattcatcgctccaggataaaatatgcccatctgacgaccagcctagctcctccanctcctcctggaagtcacaagtactctctcctacttcccttaaattanccgattcctgaaanagaacaataaccctgtataccttttatttacagtagacctttacacagttcaccccactatgtaaagctctgttctactttatgcccctgatcaccattctcaactaggtctaaatggccctgcgtttggtctaatacggcagtcaaggtttcttcagaccatgggagtgaactcatggggtccctccagtgtggacttaatctttctaagtggg

SEQ ID NO: 191058 - DNA, 118 bp, Homo sapiens
tcattttatgggcatgattttaaacaacattatgtgtagggtgcaccagagatttaacagaacagagaaagaacatgctactttaaaaaggaaggatgaatattttaaggttcaacaa

SEQ ID NO: 191059 - DNA, 547 bp, Homo sapiens
ttgaacttctgggctcaagcaatcctcccaccttggcctcccaaagtgctgagattacaggcatgagctactgcacccagccaaatttccctaaaactttaatgttttattcaaaattttaggtcagaagttccttctttcaaggaatttacagataagtcacggaagacatatgaatcaaactatagttagtgaaatacacttccagcagtctggcaaacactatctgaataacccttccagggttgagaaatgggaacaattacacactgttggtgggaatgcaaattagttcagcctatgtggaaagctgtttggagatttctcaaagagctaaaaatggaattattatttacccagcaatcccatactgggtatatactcagaggaaaataaatcgttctaccaaaaagacacctgcactcatgtttaccacaacaccattcacaatagcaaaggcatggaatcaacccaggtacccatcaatggtggactagataaagaaaatgtggtacatatacaccacggaatactatacagccattaa

SEQ ID NO: 191060 - DNA, 877 bp, Homo sapiens
aaaacctacaaaatacagtttattctataaaataagcagaagcaccaacttaaaaaattagcaaagaaaaaaatacagatttatcacagtgccttgcaaacagcagatgttccagaaacatctgcagatttaaaaatcagattttttggtaaaaagctgaatctttattaagattcttatcaaaatgatctcctttagcagtactttaaacatacacttctacacatagaaatataacaaagtataatcaacaaacacttttactacattcttctaaacccaggatgtttttcttccatgtttgtatggtgccaccaaaatttcagaactctgatcaatcaaaagattttaggcaaaaagctgaaatctttactgtttcttaatacttgaaatagtctccaacagcagtaaggcatacttcaaatatatatttttatacacaaaaatacaacaaagtataataaacattttttactatattcatataagccccattttttattttccccttccctgttcgtctgcatactgtggccaaatgtcagtacgctaaatgatttttttttttttttttttgagacagagtctcactcgatcccccaagctggcctacagtggtacgatctcagctcactgcaacctctgcctccagggttcaagagattctcctgcctcaccctcctgagtagctgggattatgggcacatgtcaccacgcctgacttctttgtatttttagaagagacagggtttcggtatgttggccaggctggtcttgaaatcccgacatcaagtgatctgcccgccccggtctcccaaaagtgctgggattacaggcgtgaaccaccgcacctggcctgctaaatgatttttttttt

SEQ ID NO: 191061 - DNA, 352 bp, Homo sapiens
ggcaaccccagactagctaacgtttgatggctaagtcaagcaacaatggaaagtttccatttgccatgtattggctgtgtgactttggacaagtcatttctcctctcagtgactcatttctttgtcttaaagtaagggtaatattacccatagggttactgtgagttctaagtaaatgaatggaatccaagtacttagagcggcagctggtgacagctgctacagagtaagtaatacataggctgcaattattactatcatttttttattttcctaaagaattgttctgaagattactattgttgttatgtgttgctgttttttctcaatctctgaatgattttataagaaa

SEQ ID NO: 191062 - DNA, 308 bp, Homo sapiens
tcttcacagtagcaataatgatttactcattcaaaacatattttatcagcacttaaatatgcaccaagcatcaacctaggtattgaaggtatagcagtaaacacattagacaaataaaaacaaaaaatccatccctattggagcctacattctagcgaaagagagacaaataagtaaatacttaatgtgctacaaaactaaaaatcctacagagaaaaaaaaataaagcagagaagggagacagggccaatttgtgtgggtgggttaaatgaaaaaggatttcactgaggtgcattaaagcaaaaacc

SEQ ID NO: 191063 - DNA, 593 bp, Homo sapiens
tgcaagtattgaggaatgctctcacccttgagaatgggagactttggtgagagcttaggcccagagaaggcagcaaaggcccgagacagaagcccagggaccactcaaatgtggaggtggggagtgaagccagagagtgggacaccagcaggtgagcctgagaattctcataaaggctgtgcagcctgtgagccagaggtcaccctgaggccaaggggaattttaaaaaaacctaggagtaggtactgtgggggcctctctggaagtgtgaggagagaggtggttagaacacaggtgggcactcaagaatggaatggagggtcttggaaatgggaattctttccctcttagctacactgctcctgcccctggctctgcctggacaccttcccttccacagctctctctagctcacccatgctgctctcaacccgaaattctcgttgcctgtccactgactcatgacttgtgtgccacgaaaagagtctcagaggagggccgggcatggtggctcatgcctgtaatcctagcactttgggaggccgaggcgggccgatcaccttaggtcaggggttcgagaccagcctggctaa

SEQ ID NO: 191064 - DNA, 307 bp, Homo sapiens
catgttaacagtgattgtaactgaattgtgagaccacaggtgattttgttttctcctgtaggcttttctatattctctaaacttttttcagtcaatatatactactataaccagataaattaacagtaattgtgaaaaatatggcatccaaaactgtaaagaaatatgtttattgcaaggcaattaaaaacaagatcccaagtttaaactttcatatgctgtctcattgagctgcacatggaaaacacaactacaacaacagaaaatcttctgtgttaaaagtaagaaaatcttgtctcactgataa

SEQ ID NO: 191065 - DNA, 302 bp, Homo sapiens
tgctgggattataggcatgagccacagcacccagcttattgcgaagtttattgcttacctatgtggcaggaaaataattgacctcccaaagatgtccacacactcatctctggaatatgtgaacatgtgaacttacatgaaaaatggaaattaagaccacatttggaattaaagttgttaactcactttgaaatagggagattatcctggattatccagatggggctaatcacaagatcttaaaagtggaagaggggggcagaagagaaagaaccaaagagatggcagcgtgagaaggcctc

SEQ ID NO: 191066 - DNA, 181 bp, Homo sapiens
tccaaggtagatcatatcataggctacaaaacaagcctcaataaatttaataaaattgaaattatatcaagcactctctcagaccatagtggaaaaaaactggaaatcaactccaaaaggaaacttcaaaaccatgcaaacacatagaaattaaataacctgctcctgaatgatcactggg

SEQ ID NO: 191067 - DNA, 337 bp, Homo sapiens
ttataagataatgtcgaagctattaaaaattaagtgaagaaaagatagtgaaaattcatggttaataaactatctgttatttgtggttgtttggttttaacttctgctaaccacagtcttatactttagaagtcagatcttaaaaattatacagcctaaagatgacacttacatggcatgtacaccaatggccccacactgtaggccaagctatgcattactaaccaatgaaaacaatctctcttgagcctggtaggtagccaacatcaaccaactggagtaaatactcatttcccatccctaaaaaggctgaatattgaatttccaaatcaaagaa

SEQ ID NO: 191068 - DNA, 180 bp, Homo sapiens
tataactttttgcagtagtgccctcaaatacataaattatatgcatacatatggatgtgttaactactgttataaatatgagccacttattacagaaaatatgtcaatttgccttcattgtttctggtcacaatctgtatcttgggataatacaggatatgaaccaaatgtttcaaagtc

SEQ ID NO: 191069 - DNA, 340 bp, Homo sapiens
tggaagccgggcacgctggctcatgcctataatcccagcaccttgggtttgggaatggggtaatcgtgacgaggtatctgtcaccccactgggatcatgtctaagtcccatggagtacagaagtgccacaaataaaactaatctaagaggtgcccagattttgttttcttaacaccatctctactgaaagaaaccagagctccctggagaaatggttgattccatggctggggcaggaaacgtgcaaagtgatcctggaaacccgtgtgccagaaagttagtaagtgttttaaacagtgatggaagccgggcacggtggctcatgcctataatcccagca

SEQ ID NO: 191070 - DNA, 392 bp, Homo sapiens
aagccaagaacaaggaggttgtctattctccaaaccggctgacctttggggctcattttctaggtagaaatcattttcaaatggagatacactctggggattctttcccccagcaaaactcttccccttatttcactgaagctttttacagaggatgtctttttgatacttaaataacaagccagaaaatctaattgagcaatgcctcatttatccagcaccatcaggaaaagaatgagatattttatataaaaaggacattttgagaagaagctgaatcctctaaattatactttttgatggaaagctttctaaaagtatgccctttgctgccttcatggaatactgaatatacattcaaccttttttttctctctctcaggatattagta

SEQ ID NO: 191071 - DNA, 459 bp, Homo sapiens
gagagcatattatgaatctaggaataaagctaccaacttcaggcaagacagttaagacaaatggagagcaataaaataagctatgcagcacagtcaacagggacacagtctttagacattattatcagaatacacatgtaaaagggaaaattctccaaatgtatttgaccatgactgtaaaagaagagagaagaaaagggggagcagagagagaactaagctcttggaggagaatgataaatgcaatggctctatgaaactactggaaatcagaagagctaaaaaaacaaacaaacaaaaaaaagaggacttaaagtgtgaacaattcaaatataaattattagttatagcaatgttaatagtaacactagtattaacagcagtggttgtgccttacatgactcttttctatacacttgcaaccatgatgggtgcataggcaccattatcatccccagt

SEQ ID NO: 191072 - DNA, 450 bp, Homo sapiens
ctatgtacggatttggtccaatgcctcagcctgacctcagggaccttcgggggtctgctccgcgcccacccttacacatctgtgaccccacacacttccaccccagcgccactgccaacagctacacccatccccgtggaccagctcggccccggtgctcggcgggaggtgacgctacccctggggcctggtgagaacggcgggctcgacctgcccgtgaccgtgtcctgcacgctgttctacagtctcagggaggtggtgggcggggcccttgccccctcagactctgaggacccctttctggatgagtgcccctccgacgtcctgcccgagcaagagggtgtttgcctgcccctgagcaggcacacagtggacatgctgcagtgtctgcgcttccctggcctggccccgcacacacacgggccccctcacactcggccccacccgaga

SEQ ID NO: 191073 - DNA, 287 bp, Homo sapiens
ctatgtacggatttggtccaatgcctcagcctgacctcagggaccttcgggggtctgctccgcgcccacccttacacatctgtgaccccacacacttccaccccagcgccactgccaacagctacacccatccccctccaaccgcgtcagcttccagcctcggtccatctgaactcgccgtgccccctcccctgcgcccttccagattcatttgctagggaagcccgctcttccgggtggagctgttcctcatcccctttctttatcattctctccccagggcttcc

SEQ ID NO: 191074 - DNA, 304 bp, Homo sapiens
ggggaggataggacagagaaaaggtatgaatgagtgtcatatatcaaggagaatttggggaaacagagcattagggaaggaatagatggaagagaggcatgcttgtaataaattataggaaagagaagagtttgaaaaagagataagagttcacacaattgtggaaagaatggagtggagtatatgtaaacagaaaagaagctgtatggaatgaggtggatggagggacagaataatgaggaggagatgtggatgggcagaagacagtaagcaaatggaagagaagcaagaggaaggagagagt

SEQ ID NO: 191075 - DNA, 453 bp, Homo sapiens
gcagttcttgcattgctataaagaaatacctgaggctgggtaatttataaagaaaagatgcttaattggctcacggttctgcaggctgtacaggaagcatggtgctggcatcagcttctggtgaggcctcaggaagcttataatcttagcagaaggtgaagtgggagcaagaggaaggggaggtgccacacacctttaaacaaccaggtcttaggagagcttctatctctaggacagcaccaagaggatggtgtaaaaccattcatgagaaatgcaccccatgattcaatcacctcctagcaggccccacctccaccaggcctcactcccagtaggccccacctccaacattgggaattacatttcaacataagatttgggggacaaatatccaaaccatattgcttgcctaatgctgttgaaaaatctcatgttgaaatagtgccacaaatg

SEQ ID NO: 191076 - DNA, 233 bp, Homo sapiens
gcccctggttagcacaatgagtggcatatacatttttataaacatttgctattattttgtgctgaagtctaaaaaaaaacatggaagaaaaagtagaattattatgtaatcatcttttcttggttgttttgtgtgtgtgtgtgtgtgtgtgtgtgtgtgtgtgtgtgtgtgtgtgtgtagaaattgaacgggtcagcgcagctcgcaatgcgtacatctatggaccatcagct

SEQ ID NO: 191077 - DNA, 526 bp, Homo sapiens
ccaccatggcacatgtatacctatgtaacaaacctgcacgttctgcacatgtaccccagaacttaaacaaacctaaaacttaaaaagacatacaactttaaaaatacttaaaacaaaaaaacataaaaagaatgactgcctatggagagggcagaggaacagaagtggagaatagggatgaaaatgaatgaatgaataagagagggtcttgcatacaattgatagtggagtgccatgaatttaagattaagcaatgctctgcacctgaagtagaaaacaaagttgccagaaaaatagttacttggtggcaatgagatacaattcaaagaatgctttgtgggttatgaaatactaaaataatacctgccccaaatccaagttagtttgcagtaataggaacaaaatcatgggagagatggtgaaacaagacccagagctagtatcaggtactagataaagcaggaggtgttgtcaaaattccatggcaattttatgtgaatcttgctgatttatttgccagctatat

SEQ ID NO: 191078 - DNA, 197 bp, Homo sapiens
tgtctctatttagaaaataaaataaaagatggtatgtgtttatccacgcatgtgtgattgtatgaaaaagcgggcgtgtgcagtttctttcaagaagaccatgtgaaaacaagaatctaaaagtagtgaggggaataggacctcttaactttcaaagataccatcaaagtattcttttttttttttttttttttttg

SEQ ID NO: 191079 - DNA, 246 bp, Homo sapiens
cctgccccgcctatgtgttattctgagttttatagttttaattcttatatttaggactttgatccattttgagtcaatttttgtatatgatgtaaagtagggggtccagctttattcttttgctgttggtccagttgtcctagcagcttattgaaaaaactgttcttttctcctctgtaatttttttttaaccatattgaaataggaaaaacaatcaggcaaaatcagtgggagaaaggaaaaagg

SEQ ID NO: 191080 - DNA, 413 bp, Homo sapiens
ttgtgcatccttgtgattaagatggcctacatttgaaagatttggccctttgtctgggtctaaatctgtgcatacctctgttttcctgtggcctgagaaacttctcttctggtgcttctgattctgtcttcctcatgtgccccagagagaaattgtttgctagaggtgagtgtgtgacgctagtagtcgctcactctcagggcgccagtattgcctgggctgtgtgatctggggatgaaaagcagaagatgcttccatttgggagagtcctgtgactatcagtagcagaaggagctattggttgtcttgagaagaggccacattagcctcagcccaaattatctcagtttcgtggttgaagaaattgaagcacagagaggctaagtcatttgcccagcatcacacagttggaa

SEQ ID NO: 191081 - DNA, 292 bp, Homo sapiens
attcaacatcaatgtcttacctaataataaatcaaaatggccacactgtgcctcttttgtacatgatcttactctaatgcttcattgagcatcactctctggttttcttcttccttcctttttttttttttttttttttgggaaaatttttttggtgggccccccaggttgaaaggggggggggggatttttgtctatgggggtttttttttaaagggggtgaaaaagggggtttttttaagggggccctgggggattgaaattttggaatgggccggttttttaaaggggg

SEQ ID NO: 191082 - DNA, 159 bp, Homo sapiens
tacatctggggacatcatagtaaaaaaaaaatgaaaaggcaagagtagttagagaaaaaagattactttcaaagaagcagcaattgattgagaaccgattccaaacagaaatgaagaaaaccaggagacaatgagacgacagctcacccatgctgaaag

SEQ ID NO: 191083 - DNA, 382 bp, Homo sapiens
tcagtactgtggtgcagtattagcccaaatctgtgtaatgggtaatattagcattacagaagacacacacatcacatagaccctcagaagacgtaaacatcacatagaccctatttgtgcatcattttcaagtttaaaacaaatatttgtaatgaacagaaaacaatttgtaattaattatattacctatataatacttgtaaatgttttcttaaccatttatatttggcttatgacatttaacccctaaggagttgtttttctcacttgttattatcaaacctaatggtttttaattttggtacaactccttaaagggttgaaggttgtgacaataactgagggaactgatgttctgaataaatgatgtgaagtaaacaca

SEQ ID NO: 191084 - DNA, 290 bp, Homo sapiens
gggtgaagggagatttgaacttggcgcctgacacaattatcctaaagtaggaaagcctcagttggaagaggatgagtttctttaaatagcccaaaggctgtgatgcgtaaaaaaggacttgacttattctggatagctccagagggcaaaactagcaagtggccagcaggaacacacatactcagagtagagcagagcttgctaataattaggactgcctcatccatagcaaggaacactcagaggctcatctcctctgaactacttccagctgggactcccgacgccca

SEQ ID NO: 191085 - DNA, 279 bp, Homo sapiens
ccttggcttcccaaattgttccgattacatgtgtgagccaccatgcctgaccaaaagtgcatatttattgtatacaacatgttgttttgaaatatggatatgttgtggaatggctaatttgagctaattcacatatgcattacctcacatacttactaattttattgtgagaacacttaaattctcctctcagcagttttcaagaatactatacgtcgttattaggatgtaaactgtgacaccaaatttagaattgggggtggaatgggcagagcagaa

SEQ ID NO: 191086 - DNA, 284 bp, Homo sapiens
cttaagtgatccacctaccttggcctcccagagtgctgggattacaagcatgagccactgtgcctggctaagaataattctgtgaacattcttgtacacatcttttgatagacatatgtactcatttcttgggtatataacctaggaatggaattgctaagtcattgcgtagacatgtgaccaatcagcttcagtaaatcatgccaattttccaatctacactttcccagagttgactccccatcattcggcatttcccatctttttcactgcagccattctgg

SEQ ID NO: 191087 - DNA, 523 bp, Homo sapiens
tcatgctgtagactcctggaagtggtctcagagattcagagatgcccgggggttagtgggtcacactttgagaaccattggaacagattatagttcacataaaactgatcgaatctaaaatgagttctttttgagacagtagctctgtaattctgtagtatgtggtagctgagcagatggcctacaaggaggaagactcttgactaaggatcaaatgttatgtgttgaaatgccattttcacttgaaaaattgtattgttcctcctgtatgtcatcacatggtagatgatactaaccatcagtgtgaggagaggggagctgcagcaggagctcaggcagatataattggaaggacccaggaagtttccatgacagacctgacttagttgattcggagccagtgcccaatccctacacctggcaggcattagaaatgccaggagccactgggaggaaagaagggcctgatatctggcattttaggtggcctgaggcaagagggagcttgagcagaggttgttgg

SEQ ID NO: 191088 - DNA, 284 bp, Homo sapiens
cctgtgagcatatagactggttctgggtattgcaaaatgtatcgtggcccggaagtggagtggcttgtcaagtttttctttattagctaaaggacaggaattgacagggaaataatacaattaatggagaagagtgaagcatgtaagtagggaaagacagaaatgtggtctcagcttcttgaaacacagtcttctctgtagaaatctagattactgtaggttgagacttttaagtttactacagggtctctaagagtcagttattagaagttaacattgactgg

SEQ ID NO: 191089 - DNA, 177 bp, Homo sapiens
agcactgggacagaggccatctgcttgtgaaagcagcttctaagaaaacatacctgttcccctatcccttcctgctccttcccacaggtcacttgccttaatggtgtttgccaagagagccatacctttgccttttctcattgcatttgtttatctgtttcaaattctgtatgcaag

SEQ ID NO: 191090 - DNA, 777 bp, Homo sapiens
agacctacgctttttccatcctgtgtttctgccatctgcagatgtgacttccaggggctctgcaggatgggaacatcaatttgctttgttttattttttttccaggccagaaataagtcacttggcccagcctgaatatcaggggaggctgggaaacggagtttagctatgtgtctagaggaaaaattaaactagttgggtaagaggtagcattgtttttgccacagagaaatgggtgctgctgcctcctccttaggcagagagctccttggttccatttgaaaaccttccttccccttttgctggaattgagagactgaggacacaaagtggtgtgctggagaataaactagagcctatggtgccagactggcaacttggggattgtgtgagtgagggagagattgtgcagagctaatcctaacattgctgatgagtggacagaaaccataggcctcatgaatagtgatttctgaagtcaaagcccagtatgcttaaatatcaacccaagtggtttgggagaggggagcacagcttactgttctgctaaaattctttgaggaattaagtaagaatacgtgtaaggtacgtagcaatggttatttacaaaatggactctgcctgcagattattagtatgtctcagatgtaaaaccagctcaaaagtactaggacgatttgtagtagtatttaattatttgtaaacttacacgtttttcttcacgtttgcagaatacaaatctttgtcagtagtgaaatgtgaatctagtaggattaa

SEQ ID NO: 191091 - DNA, 439 bp, Homo sapiens
tgggcataaaatggaaaacatgtactggaaaattaagtgttatactgaacagatcccttctaataaatttagaagtactgaacagatcctgacactttagacttaggtggcaaagaaaattatatctagatactatcactaaaccttaaaacttaacaacagttttaatatattccatgttatacatgatggatattagaatattcttgttgcagatggttacccagctatggcagaggaactatctctaatacttatatatactctggaaaagaaaataaaagtagagcttcagtttcctgaagaacatccagtaaaacctaatggagaaaccagcccctcttaagttttaacaagggtaatctaggtatttatttttttaattatcaaaacaaacaaaaaatataacccaatgtagaacttactcaacctgataaaa

SEQ ID NO: 191092 - DNA, 514 bp, Homo sapiens
atactcacactctctatcatcctccccatctcttagctctatacctgaccctctagccctaggcaaacactaatctaagttctgtctctacagatttgcttattctggacaattcacataaatggaatgatacaatattccattttgtaatatagagtattgtatgattccatattacaaatatggaaactgtacttctttgatataatgagaaccaggcatggtggctcgcacctgtaatcccagacactcggggggaggctgagcagcgaggatcacttaaggccaggagttcaagaccagcctgggtaatacagcaagacccacctccaaaaacaaatttaaaaaaagaaaaggccaggcatggtggcatgtgcctgtagttccagtgtcttgagatgctgaagcaggaagataacatgagcccaggagtttgaggctacagtgaactgtgatagcaccactgcattccaacacatgcaacacagcgaaacccggctcttaaaaaaaaaaa

SEQ ID NO: 191093 - DNA, 411 bp, Homo sapiens
acaaatatgaatgataaaggctgttctttatcatccataaagaggtttagatgggaatgagaaacatgttccaagaaatcgaatgaaaggtgacccttattataaagtggcaaagaatttcactgaattgtgttcatgtcctagcgttttgtagcaggacggacttacaagcaatgaaatagggtatttggtggaagaactatctaagcaaagcatcgagggtgcagcatggcttctcttgactgcttatagtacgatgcaagtcaggaaaaatgaattaaagacagaattcgtcatccaaatggaggcagaacttaacgatttggaaacttcagcctgcgagcaagaaaaaaaaaacaacgggaaaatatgttcaggagagaacaataagggtgtattcaagtgaatgtt

SEQ ID NO: 191094 - DNA, 134 bp, Homo sapiens
aagtgggttaagagccttggaaagagaaaagaaggccggtgaagtggctcttgagtgctctcagccgggctgacagccctcaggccttgtcaccatccccacagctgcatggaaacagtgccacggcagctggg

SEQ ID NO: 191095 - DNA, 589 bp, Homo sapiens
aatggttagaggccaggaatgctgctaaacaaactgcaatgcacgaaacagactcctgtaacaaagaattttctggcccaaatatcaatagtgctcaagttgagaaactctgacctagaacagctattctcaatcttgagcaatgagcaccacctagaaaacattaaatcacagattgctgagttccatccccagtatttctgactcagtatgtcttgggtggagcctagaatttgcacttctaagaagcttcctgatgatgttaatgctacttgtctgagaaccacattttgtgaatcataatcttgacctaaattactttgatataaacattcagaaaattcaacacttctccttacctacagtatatcctatctataatcataaatgtaatgtctgtcttctcttccagattcttaattccattagagtaaaatctgtccaattcagcactgcatattcacgttaacaggcactcaaatatcgaatgaataaaaaacttccaaatctaaatgtttggaattctgctacagtgtttcacagtccatgagttgtttatctctgaagcatttcccttaccaagtgacaa

SEQ ID NO: 191096 - DNA, 816 bp, Homo sapiens
tgtgtgaatgttttgtttcccttgaaatacttctatggaaaagaaaatcttaaaagcatttcagttgtctacatccaagggggaaggacaaatcaaaagcaaatgtccttcagggatgctcagagatcttaacacatttaactccacttagaaggacataaatgttctgtgcaaagactgttgaggggttcgtgtaaatgtgattttaatgggatatacgtagtcagcatagttgtatgaactgtatatatctccttatatatgttgggcgtttagtgaatatttggtactgtagtttcattatgataatacttgggtatcaaagcagttttcagcatatgttagtactctgaacactaaaatagacatacttctggtataatttagaaagcttttctttaagaagggctgaaacttctcttttcaaccagattaaaaaaaaatatgtaagtgtaatatcccattccatgatcattccacttaatatgcttttcactcttgagagtgcaccttggtaagaggcccataatcttccctccagagtggagattttccactagataagacatggagaaaaagagcggatatttacaaatctgtttattgcagcagaatgtctgggctaccagttccccccagtagcattattaagctttcaccacataagcttattgattgattaaacaaatttagcctttctttacatctcgttggctggatttgaaacctgggtgcttttgtttttacttcagtagtggtttaaagaagggcgacattttctttggtgcttctgagtcctctgatagctccgcctaa

SEQ ID NO: 191097 - DNA, 382 bp, Homo sapiens
gtggtgagataatgaggcataagacaagaagcggagactaaggaggaccaacatttaaggaacaggtggaggaacagggatgggccagtgaaggaaaccaaaagggagtagtcagagtgtcgggaaaaacaaaaccaaacagaagagctgagggactggtcaatagggccagatgcagcacaaaaatcaagctgcatcagaaccgaaaactgcccgttaggttttcttgcaacatggtggcctaaggacttgggctaaacttcctcctgaaaacaactttaaatactagactctatctatctttaaaattaaatgcatccataagctagcaaaaatgtaagaaacacactgaggccaaaaaagtaaatgaaagcaagaagct

SEQ ID NO: 191098 - DNA, 383 bp, Homo sapiens
  misc_feature (357)..(359): n is a, c, g, or t
caccagtatgcgcatcctgccagaggccacacgggattggaggcagtggggggaaggtcacatgaacaagcaagcaggtgaacaggtgaatgagtgagcaggtaggtgtgcaggtgagcaggtgaatgcgtgagcaagtgagtatgcagatgagcaggtgaatgagcaggtgggtgtgcaggtgagcaggtgaatgagtgagcaggtaagtgagcaagtgggtgtagaaggcagtgtgcaggtgggtgtgcaggtgagtacgtgagtgtgcaggtgggtgggcaggtgagtgtgcaggtgggtgtgcaggtgagtgagcaggtaactaggatttttcttgtcttcagccagctccannncccttatcctcgtccacccatatt

SEQ ID NO: 191099 - DNA, 519 bp, Homo sapiens
  misc_feature (493)..(495): n is a, c, g, or t
caccagtatgcgcatcctgccagaggccacacgggattggaggcagtggggggaaggtcacatgaacaagcaagcaggtgaacaggtgaatgagtgagcaggtaggtgtgcaggtgagcaggtgaatgcgtgagcaagtgagtatgcagatgagcaggtgaatgagcaggtgggtgtgcaggtgagcaggtgaatgagtgagcaggtaagtgagcaagtgggtgtagaaggcagtgtgcaggtgggtgtgcaggtgagtacgtgagtgtgcaggtgggtgggcaggtgagtgtgcaggtgggtgtgcaggtgagtgagcagggtgggtgagaggtgagtgtgcaggtgggtgagaggtgggtgtgcaggtgggtgagaggtgagtgtgcaggtgggtgagcaggtgggtgggcagatgggtgagcaggtgagtgagcaagtgagtaagcatgcagcagtaactaggatttttcttgtcttcagccagctccannncccttatcctcgtccacccatatt

SEQ ID NO: 191100 - DNA, 404 bp, Homo sapiens
atttctagttctcagtaagtgaaagagtcaggggactttgagaacatccaaacctagcccagctgtggcagttggtttattgctttcagctggtacttgaacccaggtcctggtcttggaggctttcccaggtttaatccccagagctttctctgcagctgtatgacactgcgctgaccccgaatgaggataggaaaatagaaccagtgccaagccagagtctctttttcatttggagtctggctgtctgcccatgaccagggttacataatgggaaacatagctggggctctggagagcccgcgtttcaccaggctgcccagaccttcgcattctgatgctatatatcttcctaattgtagctcggatgcatttatcacactgttggattggagtactgttta

SEQ ID NO: 191101 - DNA, 202 bp, Homo sapiens
tgaaggaggccctgttcacaggatgatgtatggagtatgacagagtaggtgagtcatggctccttggctagaccccaagggtgggatgatctggaaccacctgagttaatgacactcctgaagccttgcaggtatccctgcatagacaagctggatagcctacttccaacatcaaaagcataacagaatgggagactcctta

SEQ ID NO: 191102 - DNA, 219 bp, Homo sapiens
gacaccttgtggtttctgattattgaccatttttaagcccagtagggttggctcaactcttcttcctgcaaggcccagtccccatgcctgtatcatcctcataaatggaccctggccctctctccacttccaagtgctacctcaggttcaacaccacactatgccaggaactcagaaagtgagctgaccagcaggtggtcacactccaccttgcactta

SEQ ID NO: 191103 - DNA, 920 bp, Homo sapiens
tgaacaggctgctcttggaattgcaaatcttatagttatgtctatggtagaaaatggcctgtcagaacaagaggcacaaaagaaaatctggatgtttgacaagtatggtttattagttaagggacggaaagcaaaaatagatagttatcaggaaccatttactcactcagccccagagagcatacctgatacttttgaagatgcagtgaatatactgaagccttcaactataattggagttgcaggtgctggccgtcttttcactcctgatgtaatcagagccatggcctctatcaatgaaaggcctgtaatattgcattaagtaatcctacagcacaggcagagtgcacggctgaagaagcatatacacttacagagggcaggtgttgttgccagtggcagtccattgggccagtgaaacttacagatgggcgagtctttacaccaggtcaaggaaacaatgtttatatttttccaggtgtggctttagctgttattctctgtaacacccggcatattagtgacagtgttttcctagaagctgcaaggccctgacaagccaatgacagatgaagagctagcccaagggagactttacccacggttgctaatattcaggaagtttctatgagcatggctattaaagttacagaatactatatgctaataaaatggtttcgataccagaactgaggacagggcaaatatgtgaagaaagacatggggggtgatatagatcctgtgcagatgtgttgaatggcagaattggttaaggctcgggtaagaataaaatcccggaaaatttggggcaggaaccttttgaaagaaaaaaagttcggttaggggggtgggggccgaactgggggtttcccggccttcgggagtggttgcgcgccttatggttagccggaaaggggtca

SEQ ID NO: 191104 - DNA, 428 bp, Homo sapiens
tagaatcgagctccgtaccagatccacctttccatcccccctaataacatttttaaatttcacgtagtaaaattgatttgttcttttgttttgttcatggaacattcaattccatggatgttcacacctgtgcagatgtgggtaagcaccatacctgggagacaggcgagccctgccatctcagaagactgttccactttccccatagtcaccaccccgacccgtggcagccacacacctgtcctccaccactgtagttatgtctttccaagaaggtcccataatggagtcctacaatgcgtggctgggagcagcgagatctgcagaacgccgctgagactgatcaggatgcgtgcatcagcatttgttttctctcttttttttttgttttttttggagtagtgctctatggatggatcagtttgtct

SEQ ID NO: 191105 - DNA, 312 bp, Homo sapiens
gatccttgatcctttgtaggtgacctgttttttcatatccagatgcttataggagcgtccctctgtccccagaactctatgatttcacagtgatgagctcaagtatgtgtctgcttccaccaatgaggctgcacatctctcaggccctctcaatctggaaacttccatcctgggaatttgtcttcaaatacttccttgatgggctgaacatggtggcttacgcctgtgatcccagcacttttggaagctgaagtgggaagatcacttaaggtcaggagttagagaccagcttggccaacatggtgaaacccc

SEQ ID NO: 191106 - DNA, 888 bp, Homo sapiens
ctgtatctcctccacaataaacaacttgtcctcaaatcctcacctcaaggtcagcttctaggggagccccaccccaaatgccatgtcgcctaggctcttctacacatggagaccacaactgcatctggacgtggaggtttgcatggctgtgatgctgtacgtgaagtgctggcctgtagtacttggtaagtgctaactgttttcactgtggttactcattcattcacccagaagttgggcagctttcttaaacaatgggcaaagacccgcatgcaggagttagcaagacacatgcaggcaaaaaacgcacaagctagtggggaagagagtatgagaccctccccaccacatacccagcacctggcccctgccagaggggcgatgcaaagtgggggtgaccacaggggagggggagaagcaattgggttccaacctacaggtttagttaagaaggcattagttcaggatttcacaacagattcactgtgcttggatcaatcaacacattgagagatgtcaggttcctagaggactcagcctccacacccttcatctctctctgcgggaaactttcaacacaattgatctaaatggcacagtttttgttgatgccagtttgctagttcataatcacgaacccttagatgactcagatgaaacaagaggttttttttcttcttcttctttgtagatgcacaaggaaccgcatgggcaagtatagattttctaaactatcctttccctttggggccctgggaaagcccaaaaatcagggaacaacagacactgactccctgcgtaagctgattgtaaaagccagtcctgcttctttcctgcaggactggggattttacaaacatacggacatgagagactcaaacctcgatc

SEQ ID NO: 191107 - DNA, 329 bp, Homo sapiens
ttgctgttgtccacatctccggtggctcagacagggagaggctcatgtatgacagtgatgagttggcatctggaaataatgcctcattaaagagccttctttctaaaaatggacgcgtttatcatgaaagggcttcaggaggaggaaccctcggggctgcctgagtgttgtaaatgtgcagatgggaagcggagcccccaagcccatggcatgtcacatgcaccctatccatgcccccactctagcatattctagtgggttccctagtgtggtgctcagacaagtgcccctcaccacgtgcctccgtttcccgcctggggaggtggagg

SEQ ID NO: 191108 - DNA, 183 bp, Homo sapiens
cttgggggcagggtgtggggaaagccccacagagagagctggctttggagaagatggcctggaggtgaggccatgggcggaggagggcaggcgtctcaggctgtggatgcaaaaacaattctgagaactgtagcgaaaggaagatttcattttaaatgtgttgaaaaaatcaccatttggcta

SEQ ID NO: 191109 - DNA, 372 bp, Homo sapiens
catggaataaacaaatgtgaaccattggaggtgaaaggcgacctgatagtactttgggagtgcagttcccagtaggattttgggtggcctggagcacagcagcagctggaggctggggaccatccagttttaggactctggtgaccaagacctgagagaaagtggaaaggtcaggaagggtcagacttgtctcccaagagtttgtattatcatgggattctcttgaaactctggttcatgtggaaaatgtgcttatcctagaagttgactagggttcttggggaatgatggtgaagccagatgcctctgtttgatccaggttctctgcatggtgaatcaccccagaaggagggtgtgaaaggtgcctggcca

SEQ ID NO: 191110 - DNA, 325 bp, Homo sapiens
gctgactgtatttcaggtagaaactgtactattgctgactttcatggggtttaggtgaacttctatgattaagcaatagtatttccctaattctgtccatttttcccccctggatgaatccttcttggaaatcatatcagtttgcttcctcctggaagccttccctgattccctcaaggcttgatgaggagccctttttctgtaatcctgccatagcctgtgctctgtccctttgcgtttaagtcatcagttcagttggctgtgtcttcctaactcgagtgcagggtctctgcctcattcacacttggagctgtggtgcaacatg

SEQ ID NO: 191111 - DNA, 169 bp, Homo sapiens
ggtaggttagacacagatctgtcctgtccccacatatgtgccctaacctaccaccaacccgtttattagcagagactgagctatgggctcagcccactccagctaaaaatgtgaagaaaacgtaagtggccaagacaagaatgatcaaataagtgtttaaagggatgca

SEQ ID NO: 191112 - DNA, 345 bp, Homo sapiens
aattattctttgaaatattactgcttaggaacctgtaaaggctatatatctcctcaccaggcccaaagattttttgggggtttggggtgggggcagcgggagtgtggagtggttggaaatatagtgtgagccaaacatttattggatgtgaataatataagcaatactgagattcttcataatacaaccaatatatttatgttttatcaactttagggcataattactgggctctgtaccttggctaagtagtattttgtatatatatttagttttctttagggctaaattcgaccgagaaaccctagtgctaattacccaatgtagatggcagtcactgttaga

SEQ ID NO: 191113 - DNA, 247 bp, Homo sapiens
tctttcaagattggaaaattaaaaaccagggttcaatggaatctggctaaaaaaatcaatttgtatttcaaaccttgtaagccgaacctcttattacttgtaataagttgcaacttgtaagttgagcctaaattactatgttgtcctgccttagtaaatacagtatcatgaccttgatttaacaggtggtgattcagattcacccctgggtaactgctgggcactgcagcttctctgtaagaacaca

SEQ ID NO: 191114 - DNA, 686 bp, Homo sapiens
aaagatggccactgagcagatatttggtttattgttgtattgtggaaatacataaaataaaggcattattcaaataatgaggacagactatgaaacagataagtcaactgattaactatttggaaatacaagattaagttcctattcccctcaatgaacccatataaatttgaaataaatgaataaaatgtaaaagttaagaggcacactagccaagagatggaagcaacccaaacggtccattaactaatgaatggataaataaaatgtgatctatacatacaatggaatatttaaaaggaaatccagtcacatgctacaacataaatgaacctcgagaatagtatattaactaactagtaagttattatttttaaaaagaggtatgtactaaattacttaaagccactttttaaaaaattactaaactataaaaagatcaaataaaccacttactctaacttctttctaacatttcagtggccaataaggttaaaaacacaacatataagactaaaaggaaaaaggatgcacataaactgaatctgtaaaatgagtatctttacaaaactgatgtaaggaaaaaatatttacagtttcttcaaataaatttgaaaaactaacatgaataatcttcatagaaaatataaattaaaatattaatgaaactaaaccaacagtgcatt

SEQ ID NO: 191115 - DNA, 169 bp, Homo sapiens
aggggaagggagcccaggaaattggcctgtgattcttctccagccatttatgcagtaaacacaggacatctgctgtgtatgagacaccgtgattgtcatccatacttaggaattcaccagaccatttgtttcccagcttttcttttgaattaaaatcttccacaagcca

SEQ ID NO: 191116 - DNA, 593 bp, Homo sapiens
catggtcttttcccctcaaataattctctctctgttgctaatttcctgctagcttgagaaagcagacacccattgttttgtatttgttatacacttaacttcgattcatgctttgattaaatgtttctatttctgccctccctgtttcctacacatacctgtggcaagtcagaatttacttcagcaaactgaaggggaagagtctgtatctgagattttccctccagatattaaaaaatatggctgtttacaagttaagtgctcactgataaccattacaatggtacttaggcatggatatgcctgatactcacattagttactatttactgagcacttgctctgtgctaggtaggtccttcatatacaatctctaattcttctacaaccctgaaagaccagggctcagaacctgcacaggttacaccagtaatgagtggctgagatctgagatttgcaacaagctctaactgcaaagctcatgctccttctactttaacacactgcttccttcccatatggaactacttattccccagttgtcccttttcatgtcaaaggcagcacctcttcccactttgaggaaaaagatc

SEQ ID NO: 191117 - DNA, 106 bp, Homo sapiens
ctgcccagccggtggaggagggggaggaggagcctaaattagctcctgggggagtcagggagggctgcctggaggaggcagcactcagcttgaaagacaagtgctg

SEQ ID NO: 191118 - DNA, 401 bp, Homo sapiens
tcccaggttcaagtggttcttctgcctcagcctcccaagtagctggggttacaggcatgcaccaccacgcctggccaatttttgtatttttagtagagatggggtttcaccatgttggtcaggctggtctcgaacttctgatctcaggtgattcgctcaccttggcctcccaaagtgctgggcttataggcgtgagccactgtgcccagcccccctgtctactttaaatcactactagattacttcttatgtctactagcatgtaaatgctatatagttagactgtattatttgtattttttttttttactgttgcgttattatttttatttatttacttatttatttattttttgagacggagtttcactcttgttgcctaggctggagtgcaatggcgc

SEQ ID NO: 191119 - DNA, 338 bp, Homo sapiens
cagatagtcaccaaataccttgcagcaatataaaataaatgcagattttggttatcatttgtatcattcatatatccaatttgactggcaattcttccttttctgaacaaatttcaaccccttaattttctccagtttcatggtgtgtctatgccttgctacaacctgctgaatctcatacatatttgactggttaggtcttccagagccctgcagttccaaaaaagatttaatgaggcacttgtttgtgaattcactagccagtcatttgattaaattaaaatgaaatttctgtgtttcgcttttctatattttaaatatccccctattttctatat

SEQ ID NO: 191120 - DNA, 257 bp, Homo sapiens
ttttttcccagtaaaagcaataaagcagtaaaatgtttaaagataagaaaagaatgcattcaagtctaaattaatttacaaagttgaaataaaatacaagataatgcttatgttaaactgctatttagaaaatcaggtctgggcacggtggcttacgcctgtaatcccagcactttggaaggccacagaaggtggatcacttaaggccaggagttcgagaccaacctggccaacacagtgaaacccccatctctacc

SEQ ID NO: 191121 - DNA, 240 bp, Homo sapiens
aaatcactgtaggaaagtgatctatacacttaaaaaaaaaaactaaatattgctaaacatttcaaacctattttttaaatattctaactttgtagctcttaagcagttttattggatttttgagaaaggtacaaccatacttacatattataaatgatagcagaaggtatttagctactagcattagaaggccgggcatggtggctcatgcctgtaatatcagcactttgggaggctgag

SEQ ID NO: 191122 - DNA, 496 bp, Homo sapiens
atcccagctacttggaaggttgaggcacaagaatcccttgaacctgggaagtggaggttgcagtgagctgagatcgcaccattgcactccagcctgggtgacagagtgagacttcgtctccaaaaaccaaaccaaaaacactcaagaatcacctggcaagttatttttttccctgagtctcaatcattccctcctcttttttggtctagatttaggcacaaaggttaggatattcaatcatgatttacagacatagtataatagggtggttctaagcctgggttaaaatcatgctctaccactcactagctggtgactttgagcaagtgactaaacccctctgaacttccgcccttccttctgtaagacgggaataatgaaacctacctcatggtgtcaatgtcacggttgaaggagatgcaccgtgtaaagcaatgattatggtgctcaacacagcgtaagagctttataaatgttagcttttattattatttaa

SEQ ID NO: 191123 - DNA, 444 bp, Homo sapiens
tgaatcgagctcggcccagtctgttctaccatatcaacagtcatttggccactctcggttttctccccaacacattttttaaatctttatatgcccaggctgtgaattttccaaatctttacattctgcttctcttttaattataaattttatctttaagtcatttctctcctcttgcattttaatagaagcagttaagagaagcactacaactctttcaatattttgctgcttagtgttctctgagccaggtggatgcctctcttcctccatgcatcctttctccacctcccaggaatggccaggtgtccccactggctcctgggccaggaggcatccaaggttctgtgaagctgctgaaggagcctgtctttgtttgtgctgctatgatataaaatttattttctctcagttctggaggctgggaagttcaagatcaaggtg

SEQ ID NO: 191124 - DNA, 552 bp, Homo sapiens
tctgcagagcttcatttgacatctagatgactgggaaagtgggaggtgaagaggagagaagcagcaccttcatgttctcagcattggagacactgtcagaggcccctgctaggaaatgcttccaatatgtaatcaaactagaaacacccaccatcaccaacaagagacccagtgttccaattttatgagaaagcatggctttcttttgcatttactaagaagcggttacctgtgtatagcaactttgggagatgtttttggaaataatcccgtgattggattcagatggcagattttgtgcagcccagacttctatgtcaatagcactctgcacagggtttccaccaccccctcccacacgactgttttgtcgcatctcggggtgtatttaatagaaccagtgtctgaggagttatgccctgaggctgggaggccttcatggcaacttgcacatttttacaaaacaactctggtggattgagggtgccctggagagcaaggacaaggagctcaggctgtgttcagctggactccagcattccctgtggttgc

SEQ ID NO: 191125 - DNA, 304 bp, Homo sapiens
accagtcgtgtctaccatatccagccaaaaaacatttttaatacaaaaacaatcttttaggtattcatcttttctcaccacttcttctccaaataaatggccaagtgtgccaagaatgcagaaaagaaactgttggagaaaacaaagtagctataggaaagttggaaatagtcatctttctccctgctaaaaaataaaaacaaagtaaaaaacaaagtagctataggaaagtaaaacgaagttaaaaaaaaaaaacaggtaaaaaaacaaagtagccataggaacggttgaaaattagtcatct

SEQ ID NO: 191126 - DNA, 140 bp, Homo sapiens
gggtcagaagacctagatttatttttggctgtgcatttgggagctgtgagatcctgggaaagttatttcacttctctgagcctatcttgtctaatttgtacagtgggcatagtactaatacttacttggtatgatatttg

SEQ ID NO: 191127 - DNA, 217 bp, Homo sapiens
tattggctaccatactgaattcttatttcattttaattttttctaaattaacaaccacaaaaacctaaataaatcattagttttaatttttatgccacttttcataccatctttcttttgaccatctttgtaactccaaaacataagacaatagcccataatggttttggttttttgttttttaatagagattgagtctccctgtattgcccagggt

SEQ ID NO: 191128 - DNA, 257 bp, Homo sapiens
cccagtgacctcctgaggcagcagactccacaggcttactgcagggctatacaaaaaggtattttatgtccttagccttataaatcaattttaattgtaacaacagaaacatcagcagcaaaatggagccaaatgggcgggggcctttttctgcgctttttaaccatctcagattaaatgctgaattgtattttggggtctgagttttgtcatgcaaacgaagaaaaacaacttgctttccaatttccacatgcata

SEQ ID NO: 191129 - DNA, 178 bp, Homo sapiens
taaattaagatatacacagaacacatctgtagttttaaaagattattctcactacagtttcaacaattctctgaagtagagaagttcctacttgcaaaagaaaaaactaagactctgcaaagctaagtaacttacttcaagttatttatttaacaaacatttgagtgtctacgatatg

SEQ ID NO: 191130 - DNA, 477 bp, Homo sapiens
  misc_feature (461)..(461): n is a, c, g, or t
ctcccttgagctctgatccagaattcaaaagcaacaagcttcctacgtgtttggaaaaattgctcttctgactggtagtccaactcttgaatttttgaaaattggaatgtaggtaagttctgattaatagaatttgagtcctgatttgtgggagtgggggagcggcatgatgcttaggcctctactcttaagtcctttggcttttttacttacgttgtacaggtatcagagatctgtgatttctgtgtgagaatcctgcacaaaaggcatatactcactctataaacccagttctttgggaggctaaggagggaggattgcttgaattcctggcctgaagcaatcctcccatctcaacctcccaagtagctaggactacagacacgtgccactgcgcctggccttccaaatacttttatatttaaaagggaattctagggccgggcacggtgacagaggtngactctgtctcaaaaa

SEQ ID NO: 191131 - DNA, 666 bp, Homo sapiens
ctcccttgagctctgatccagaattcaaaagcaacaagcttcctacgtgtttggaaaaattgctcttctgactggtagtccaactcttgaatttttgaaaattggaatgtaggtaagttctgattaatagaatttgagtcctgatttgtgggagtgggggagcggcatgatgcttaggcctctactcttaagtcctttggcttttttacttacgttgtacaggtatcagagatctgtgatttctgtgtgagaatcctgcacaaaaggcatatactcactctataaacccagttctttgggaggctaaggagggaggattgcttgagcccaggaattcaagactagcctgggcaacacaatgagaccccatttcctcaaaaataaaaataaaggcagagtacggtgggtaatcctagcattttgggaggtcaagctggggtggatcatgaggtcaggagttcaagaccagcctggccaacatggtgaaaccccatctctactaaaaatacaaaaattaggcaggtgtcttgacgcacacctgtaatcccaactacttgggaggctgaggcaggagaattgcttgaacccgggaggcggaggtttcaatgagctgagatcacatcacagcgttccagcttgggtaacagaacaagactccatcttgga

SEQ ID NO: 191132 - DNA, 1848 bp, Homo sapiens
gtggagacgcgagcacttccggtgtgtgagcctgcggttgctacataaccgcgtagtttgagccatttctgcgtctggcgggtccttctgaacttgtcaccttcgcttggggtcgcaacgacccgatgatcgatgatccaagcaagggaaaagaagccttggcggagagcggaggcacaattccaccttcctttgtgctccattactcaagacactgaagactccaaaaagtaggaggaaaaatgaccacattcaaggaggcagtgaccttcaaggatgtggctgtgttcttcactgaggaggaactggggctactggaccctgcccagaggaagctgtaccaagacgtgatgcttgagaacttcacgaacctgctgtcagtggggcatcaaccattccaccctttccacttcctaagggaagaaaagttttggatgatggagacagcaacccaaagagaaggaaattcaggcggcaagactattgcggaagcaggaccacatgaagactgcccttgccagcaaatctgggaacaaactgcaagtgacttaacccagtctcaagactccatcataaataattctcacttctttgaacaaggtgatgtcccctcccaggttgaggcaggactatctataattcatacaggacagaaaccttcacagaatgggaagtgtaaacagtccttcagtgatgttgccatctttgatcctcctcagcagttccactcaggagagaagtctcatacatgcaatgagtgtggaaaaagcttctgttacatctcagctcttcgtattcaccagagagttcacttgagagagaaactctctaagtgtgacatgcgtggtaaggaattcagtcagagctcatgtctgcaaactcgtgagagagtccacactggagagaaaccattcaaatgtgagcaatgtgggaaaggcttcagatgtagagcgatacttcaagttcactgcaaattacacacaggagagaaaccttatatttgtgagaaatgtgggagggccttcattcacgatttccagcttcagaaacatcagataattcatactggggagaagccgttcaaatgtgaaatatgtggtaagagcttctgccttaggtcaagtcttaataggcattgcatggtccacacagcagagaaactgtacaaatctgaggagtgtggaaaaggcttcactgatagcctagatttgcataagcatcagataattcacacaggacagaaaccgtacaattgtaaagaatgtgggaagagcttcagatggtcctcatatcttttgatccatcagcgaatccacagtggagaaaaaccatacagatgtgaggagtgtgggaagggctacattagtaagtcaggtcttaacttgcaccagagggtccatactggagagagaccttataattgtaaggaatgtgggaagagctttagccgggcttcaagtattttgaatcataagaaactccactgccggaaaaaacccttcaaatgtgaggattgtggaaagaggcttgtacaccggtctttctgtaaagaccaacaaggagaccacaatggagaaaactcatccaaatgtgaggactgtgggaagcgctacaagaggcgcttgaatctggatataattttatcattatttttaaatgatatgtaagttgtacatatatatgggatatggtatgaaattttaatatgtgtatataatacgtaatgatcaaattgatgtaattagtgtattaccttaaacaattaacatttctttgttttgggaaaattcaaaatccattgttctagcgatttgaaaagaaacaataaattattgttgattatagtca

SEQ ID NO: 191133 - DNA, 759 bp, Homo sapiens
gtgtgagcctgcggttgctacataaccgcgtagtttgagccatttctgcgtctggcgggtccttctgaacttgtcaccttcgcttggggtcgcaacgacccgatgatcgatgatccaagcaagggaaaagaagccttggcggagagcggaggtttggtgggggcggggaatggggtttttttcccgtccacggaagctttctgggatgggggtgctgtgctcgcatcccgggggttggaattggcggggtcctctgtgccctgctgtgagcgtttccaggactttgacctcgctcagcctgcctctctccaccctacctgtgcgaccgctttctcgcagtgtgacgtggagtgttactcaatgtccttatactttccattgctgtttttggtaatggggacattagaaccatcctagtagaatcgtttttgggaactgaaagagataacgcaaatgagaaccttaaagcagtccctgtcacttggtgactggtggtctcttgttaacttcccgaagaggtcaggtccccgggtggagtcatagcttcagctgcaggggccctggtccttctccctaatccctgcaggacgctggatgatcccgggaggccttctgacctctttttaggaaagcgagttgcgtccgcttccacgaagggcggggagcatttaacttttatgggggaccgcgatgcagtcagggtatttcacaactttcgccttccccagcctgacctttctaaaagagctgcagggaggg

SEQ ID NO: 191134 - DNA, 2027 bp, Homo sapiens
gacgcgttctcctgcctcagcctcccgagtagctggaactatgggtgcccaccaccacgcccggctaatttttttgtatttttagtagagacggggtttcaccgtgttagccaggatggtctcgatctcctgacctcgtgatctgcccacctcagcctcctgagtagctgggactacaggcatgcgcaaccactcccggccaattttggtattttttgtagagataggatctcactgtgtcacccagggtagtctcgaactcctgggctcaaacaatccacccacctcggcctcccaaagtgctgggattacaggcgtcagccactgcacccagcctatattaatgtaactatacataacattatattaatataataaaatatgtattgaatcctgtgaggcacatgggaagagtgtggctgagaaaagtgaaaccagtgcaacaaaaatataaaaatatatccttagtctccaggagcttagagttataaggcagatccacactatttcctgtatgttttatagcaaggagtaacagataaatcctatgagtttagaagtaacaagaaggattcagatgggcagaattgggagagcattctggactttctggattgatgggacagtgtgacttcagtcattctgtttgggggttggaattgtttttagcaccagtgctgtgtgaccttggacaacaaagacacaggtacagttcagaggtatggaaatacagagatgaataaagagctgtacctaacagtacttgatgtttagagcttttatatcaaagatgggaccaactttctcatcatccaagcatttattgagcattactgtttgctcagcatatgttaggcattacctgggggataacaaagaagtttaaagcatgttttctcccttgaagcatttataatgtcattgagaagatgactaatacatgtgaaaaaattagtgagaagtatggtacaaaatagatattttgatagttgtgtggtccagactcagtgccgtctaggagttcaggaggaataagagaggaagattaagtacagtggaacttaagccagaccctgctggagccggatcagggtcttaaactggggtccatagatgtgcttcagggagtctaaaattccctctaaaatggtatgctgctttgtgtgaaagcacagttttaaggcagagaggtcttaatacctttcatcatatttgcaaaaccttttctgctcccctaaaatgttaataccagtatctatgtgaataaggagacagcgcttgggaatttagtatggcatttgtagggcacaatgagtaacctgccaggagaagcctcccctcccataggaaacacctagcacacaattacagagagatttgggtgaaatgatggccctagcgatagagaagaaagattgactttacctcctctaatgcccttcactgtgctgtagcctttcaaaaatttatgtttggtttcctaggaaaacattaatgtgctcaagaagggataatgtatcattctaaatattgtatgagtttgccggcttgctttttaactgagtcagaaaattataaatagacttcaaatgtagaactactttattttgtaacattcaaactgagcctttatgtaatggccggatggtaccttagattcatcttttctcctctaagtaattgatggtgtgtaagaggtgccatattgtgggacagggtcttgaattcatgtctcagcaagactgagggggaaacatgcaccttttatgagatagaggctgatagaggcaatgttttatatcaagaaaggtactgatattttacttctcgttcattggcctaatctttcctcctccagctccagctttgcctttcttcaccccctgtcctatgctttggcatacagaagagccagtagtctgcatatatgatgatacttttcagcaccatgtttttgtttatgcttttccttctgcctggaatatcttgctcatctttgatctgctggttttctctttcattcttta

SEQ ID NO: 191135 - DNA, 309 bp, Homo sapiens
aaggcttaaaaaacatttaaatggaatgcaaaatttgcaggtttggatagtatttagatcctgattcaaacaaaccagtataacaacaaaagaagaagaggaggaggcagaggaaaaagaaaaaataaaacgtggagaaatgcaaatgctgacttgatcatttgagactatcacaaatgtatttttttgtgtgttttttttagtcatggttaaacccacactttgtagcaaatctgagagagatatcctttcatttgtaaacaatttaatatgtatctccaaaataactttttttcaaaactggggtac

SEQ ID NO: 191136 - DNA, 446 bp, Homo sapiens
tgcccagatgtaaggcacctccaaagttcccaatgatctagtgcaggtgtgtttttgatggccctggctgtatcatgctggcaattcagtggtaagccttgttctctagtcacaaataagggttgcagccattgtaaggaacagtaaaaaccagttatgaccacaccactgcattagtggaagctaccaacatggcggtttgaaaggtgacattttaccctttgggatattttctgctcaatggtgagacatagggcatgtcctgggccctaggtatgtgcaatatggggtctcctttttgcctgactgcactgcattgcaggagtcagtggtaaaccctgctaaaggactcagtcagtgcacggattgaaaacaaaccaaaagacagctcagtttctccccaaaaagatgccacacactgccattttggattggaatcaaggttc

SEQ ID NO: 191137 - DNA, 417 bp, Homo sapiens
gcttaatagcgccttagcgtattctggtcggcttggcttcccatcaagtgtttttccgtgtgtgaataatggtttcacctcctaatagttttctgtaaaccctgactctcaaacgcgtgctccatttgtccagcgctgtgtgttagtcgccctttccttctgttgaaggagaaccctaactcgttttgcttttgtttttttcccatttccactgctaggatttctgtagggaccgtgaaggttactggacaacagaaacttccctttgctggcttgcctccagcatttcatcagaacagcctcttacagatgacccagattctgtaggctcatccttgaaacctcagtggctttttgaagacactgttgttttttcttcaggagacttgattgcaaatgtggattttcagtatcgcg

SEQ ID NO: 191138 - DNA, 440 bp, Homo sapiens
ctcgactctttaggatcccctgaccttccgcccctataacaaccatttcataaatgaagaatctaagattctgagtttaattataaagtacaaaatttcacaaactagaagactgtcaagtcacgagcagagttcatgtctgttttactctaaatctcaagctcatattctccactccacaagtactaaaaatgcaagttaaaatcatgttaagattttgggcgtgtgtgtgttatttttccagtagttaaaaaaacaatgaaaaatacaggcaaggagccaggcgcactgcagacaaggaggtgagcacagtgtcccagctactgggaaggctgaggtggaaagatggtttgaacccaggagttcgcagctgcagtgaactatgatcacatcattgtactccagcctgggtggcagaccaagaccccatctcctgggca

SEQ ID NO: 191139 - DNA, 527 bp, Homo sapiens
atgaaacataggtgaatcccaaaaacataatgctgagggaagagtacatacaccaggcgggtggctcacgcctgttatcccagttacttgggaggctgaggcaggagaattgcttgaatccaggaggcagaggttgcagtgagctgagattatgccactgcactcctgggcaacagagtgagactctgtctcaaaaaagaaaacaacaacaaccttgtcacaaagaaaactccaggcccacaatctaagacagtaaactgtgcccagcacagggtgggaggagagtgctagcagcacagcttggaaggcaggcagctcctctggctatgaagtcgagttcacttccaggctaacttggacatattgcaaagagatgtttgataaatttgaaactacagttaaatggcagctaacagcctctcacccatctttccctaaggaagtacttcaagatgtccaacaatccagtagggctttcattttattttcttgactcaaatgtgagcctggtgggtagacgcatctga

SEQ ID NO: 191140 - DNA, 410 bp, Homo sapiens
ctgcttgtcccgctttgcaaagcaaaacctctccagctaaatctcacttgggggtgacagctttcagcgaggggccatgaagacaggctggggcagaggcttctggtgggcacttttcttcctttttcctccggcctcagctcggatgtgcttggtgtgcaggccatggatcaatacggcctccagggcgctgcacattgtgttggcatctccgtcttcactagtgaccaccatgtccagggacacgtactgcttcagctcaggtacagaggggtgtgactgctctggatggttaatgcactgttttcccaggatgcctggcattgcttcagctctggcctagaggggcaggacaagcagagcctgaccaatatggtgaaaccctgtctctactaaagaaaatacaaaaa

SEQ ID NO: 191141 - DNA, 1328 bp, Homo sapiens
atgagctcgcacccccctattgcccaaggcccaaacaaaaactgtgctatgccagaaacccaagttgccaatgagcaatagggagcagcccagtgatgactcagctccccagggagaaagctgtctcagcagcccatacttcagggtgttagtcctgccccctggcagctggttatccagctagctccctaaagtgagtactagagttgtttggcctgtagtgtggggtgtctcatctcatgccctgctttgtttccctggaatgtgaaggcccatgccagctcagcccagtattgcatagctactcagttcaggcaaggcactgcatccccagagggtaatgtgcctcgtcagctcaggtctagggtgtgtgaccttaggttggcccaggcaccattttcctgggatgcaggaagctgcttcagattaggtactggactgtgtgtctgcttgggatggccaagacactgttacctggaaggcagggtggtaggtagggtgctgcttaaacttaggcactggggaggcatgactgctctcgatggccaaagtactgttttcccaggagacaaggtactgcttcagctcaggtacagaggggtgtgactgctctggatggttaatgcactgttttcccaggatgcctggcattgcttcagctctggcctagaggggcaggatgtagcagcatctgggaggggtaggtggaggagcttcgccaaggcatcctttcctcaggaggcaatgtgcagcttcagctcaggtccctggaagcagggcagttttgggagaagtagactgagaggtagacagtgagaggtggatgttgcacatctgccagagcattgttttcccaggagggagtgcacagcttcagctctagtcgaaggtgacaggacacagcctagcatagggacttgaggggtaggtggtgcagctctcccactgcatggccctacatgggaaggtggaaaagctgcttgtagatgttgggccaccaggtgggggtggatggtgatggcttatcctcagggatgaagaggtgccatggaaccagacagaactccagccgttccaaaataacagcacagtagctgtatgggccactgggggcaggacagtgtcagctccttcctcaggagcacagctgtatggactccaggcgggtccgtcagctaagcttagtgcctgtgagggctgtaggggaccccagtggtgagtactgtaggtgtccaaggtggtgatgtacgctgctggtatgctattgctcactttttccacatacggagaaattccttctggttttcagctgatcttggctgggggat

SEQ ID NO: 191142 - DNA, 395 bp, Homo sapiens
tttggtaacctgaaccattcaggctcattggcaacttgggtttctggcatagcacagtttttgtttgggccttgggcaatagggagcagcccagtgatgactcagctccccagggagaaagctgtctcagcagcccatacttcagggtgttagtcctgccccctggcagctggttatccagctagctccctaaagtgagtactagagttgtttggcctgtagtgtggggtgtctcatctcatgccctgctttgtttccctggaatgtgaaggcccatgccagctcagcccagtattgcatagctactcagttcaggcaaggcactgcatccccagagggtaatgtgcctcgtcagctcaggtctagggtgtgtgaccttaggttggcccaggcac

SEQ ID NO: 191143 - DNA, 592 bp, Homo sapiens
tctggcaaaactggtaggctccatataactgtcattacttcctgatgttttatagcttgttaaggagacaaaagccttttttcttctcctagtattttaacatgttagtaccagatattatctatgcttaggtatgaattttggctcagagattttctcagcatcacaccaatgataagtttcatgatcctagaatgtactttccctgtattctttctcctctgctggtgttctgtgagtccacgtgtatgtgtgtgcaggacaacacttaaagtggttattctttcttcaaagactcagttcaacacacccctggtggctgttgtagctcagggttgagtagtgatcctggtattaaagatgagaaatttgttaggtagccgctatgagctgcaaggtttcctgaggcagaggtatccggaacagagtcagggaggccatggggccagaggccttcctgattctggacacacagagtaccttggtttccccaccctaccttaaaaatatattcggattcacttataccgattaattacttagagagagtgaatgtattatagttatgtgaacttgtactccctggctgtct

SEQ ID NO: 191144 - DNA, 374 bp, Homo sapiens
gcccttggcaacatctaacctactttctgactctacagatttgcctaacctgggtatttcatataaacacagtatgtggtcacttgctatcaatctgaagaactttatttaggatttcttataaggcaagactgctaacaacaaattctctcagtttttgttgtccaggaatgtctttattttatatttattttagaaagctcattttgctggttataaaattcttagttgaccttgtggtatttttttttttcctttcagcactctgaatacattagcccactatcttctgacttccattgtttctgatgagaagtcagaggtcagctcttaatcttattagggttccttttgaaggagaaatcgggtcattt

SEQ ID NO: 191145 - DNA, 204 bp, Homo sapiens
actggcttctcctctttccttataaggtcctgcccttctagggggtttcttccccctttctgtagagattttgccctatactctttttcttttttttagaaacagtatctagctctgtcatgccggagtgcagtggtgggatcattagctaactgcagcctccaaactcctgggctcaagtgagcctcccaccttagcctcctg

SEQ ID NO: 191146 - DNA, 412 bp, Homo sapiens
ttcaggggctcaaggagggaaccactgtttcctttactttatgagtcatggttctgttctgtcatttcgggaagggcctcaggcccctcaacagtgtcaccactgtgcaattatcttgagtgaaggcacacagcaaagcgcatttcctttttaatgtagttataaatgtcgcatcacttggagatttaggaatccgatcaggaattccatttcctagtcaaatagggtataattagagtgggactctgggcccatccctcaccaggcactgtaactggggaagaggaagcaaggagctattctgcttcctttggatctgaggggcatctggaaaaggagaggcatcacctaagctcaaagccatagaactggtttgcttccccagagaaatgaggcctgctctccagagaaa

SEQ ID NO: 191147 - DNA, 520 bp, Homo sapiens
tcttctcctacaggaaagctcttcttagcagctgacagaggggagaggccccgtataaggagactgtatgtttcctagagtccaaaggcagtgaccacactttaaagaggctgtggtttatgtcacgtgctgcccacctccatgcttttgtaaagctttattccagcttcaggaatagcattggtcttcccaggagaaccagcacacacaggccatagcacaggacagttgtcaacctttgacagtaaagaatgtgggtgtaaatggcagagccagtaagactgagaaaacttctggaccagcttcctaaactctatggaaaaactcagtgggggtctttcagggacctggtgggagagagacctaagctgagattccttctcggccttttattagcagctgttaatttactttgagctttaatttctttatctgtaaaatggagatattactgcttactggggttattatgaggattaagagataatatgcaaagtgcttaatgcctgcctggcatggg

SEQ ID NO: 191148 - DNA, 655 bp, Homo sapiens
ggctctaaaagtcgaaggtagaatggatgcctctttcgcaggctaaatacacaaagagaagagctgttggcattggattgttcaccacagtgccatttcagtggccctctgctcatcaggaaagttttccagaaactgtccctggagcttaatttgaaatcagaagaccatttctaagtgactcttccatttattttactgcgattcttcttcttttttggctcaggtctctgaaagagcaagcatcacttccccactctggatttttactttctctggaaaaatatcccactgaagtaggtagtatagtcacagagtcatcgtcttttaaggctgataatgtcatataattatattttgcaaataaaagtaatatgactttttttcatttaggattcatcttaaattgggtgttgttaagagtaaaaattggttacagaaagagttacttagtgttatagccagaaaatggagatgtttaatttgataaacattttctgaactccttttaatgtgcaagccactgcgttaaatgttgtggaaggttcagcagatcttgtgcttcagcagcttaccagcaggagatgtaacctggtgaggtactacccagccctaggagtctactattggggatgtgaatatgttactcatcatt

SEQ ID NO: 191149 - DNA, 408 bp, Homo sapiens
ccggctcgctgctccatctcagggctgcccttcccttcacctttgtccagactggggcagcacacctgtgcgctggtggtggtttctttttccaaagcaccactccaggtgtatttcttttcctttccagggcctggcacgtgcaaaatacagtgatgacaccaaatacaccgctggcctgcctgcggccgacctgatccccacaacgctgaagaccaggaaagtctgggtcatctactcaggcgaacaacccctctacgtgaacgatgtcctgaaattcgaccagtcccaactacttggctgaggcaggagaatggcgtgaacccgggaggcggagctttcagagagctgagatcgcgccactgcactccagcctgggcgacagagcgaggctccatctcaaaaaaa

SEQ ID NO: 191150 - DNA, 331 bp, Homo sapiens
ctgggacactgggctaggaactgagatccagttttgctcccggctcactgggggcctcgggcaggccacgtgcctcttcatctgcgcagccaaggagacggtctccacatctcccgtcacgcttcaaaggctgcactctcattctctaacttcagaagcagcttatcaaaaaacagagggtagtgcaaaaacgagggagagagaaccatggtggaggaaaccgagaaagccccaaacagcaggtggaggccagggcccccgggactcacagggaacagatgtccattctgttggcaaaccacaggtttcagtcatttccactcccgggcaa

SEQ ID NO: 191151 - DNA, 552 bp, Homo sapiens
tactgtagctgttctatgtttacatatgtttagatacacacaaatacttaccactgtgttacaattgcctacaacattcatgtacagaaacatgctgtacaggtttgtagtcttgaagctataggctgtaccatatatcctaggtgtgtagtaggctataccacctaaatttgtgtaagtacactctattatgtttgtacaatgacaaaaatcacatttctcagaatgtctccttgttgttaagatgtataactgtatttgccttgtgaacatggaaccagcagaaagcattacaagttactgattgacatagttgattttcttattttgggttttacacaatccctaaaaccctgattgaagaaaagatttttaaaagagaaatctgccaaaaaaaaattaaaagagttttgataaagcacctgtaacttaaattctcaataagacatgatttgcccctaaatatcctgtggaaagtaagtcattttttaaacatctattcttgtttttaaaatataaaatcttaatggtcatgccataaaattatctgaa

SEQ ID NO: 191152 - DNA, 468 bp, Homo sapiens
cacttcggtttacaaagcacgtccacgtgcatcacctctttctgattttaattttcctagctgctctgaaaaggctgtaggatgatgtatcaataggcttgttttggagatgaagaagctcgggttcagagaggttaagcagccaattaaaggtcactcactgatatgcagcaaagcctgactttttgactgtgagcacagggcatatgcactacatcgtacgttatataatcatccgttccgtagaactcaccagtaacatgtaacaacatcctgaaaaaagttaccacgtgagtccacctagcgatttaactactcttggcaaatttgaggtgaagcacaccgaaaggtcttcccaagtgatcagctttttacctaaggtttctgattgtcaaaacatgaactcctgacatctctcccttggatgagtaaggttccagggtctctgccatggccactaccaagaaa

SEQ ID NO: 191153 - DNA, 223 bp, Homo sapiens
ttgactgctcctaacaaccccaacaagataaatcataacaattagcagtggtgtttacagcattccaattccttaggtgcttttctcacatggtctaggctttcaaagtcctttgcatactggttgttaggcagggttttgagaaattatcagaattatatccatgtgataagtaattgtttttacagcaagggtacgaccttttctatgttcaatgcattat

SEQ ID NO: 191154 - DNA, 525 bp, Homo sapiens
agactagaaccctcaggtactgcaggtgggattgtaaagtggtgcagtcacttggaaaacagcatggcagtttctgaaaactggaagcatagagttgccacttgacccagaaattccactctcaggtttatacacaagataactgaaaatgtacgtccaagaaaaaacctgtacgtaactgttcatagtggcattattcatggtagccaaaaatacaaaacaactcaaatgtctgccaactgataaaaggataaataaaacgtgacatatccatgcaatggaattctatttagcattaaagaagactgaactatggataaacacaatgatatagatgaacttcaaaaacattatgctaaaaagccacatgcaaaaaccacagtgtattattctatttacatgaaatatccagaaaaggtaagactatagaaacagaaagtagagtaatagtgcctgaggctagtaaagagcagtgactgtaaactggcatgaaaaatccttttgggatttttctaaaattggatt

SEQ ID NO: 191155 - DNA, 359 bp, Homo sapiens
aggccctcaactcaaagtggcaggacagggctggggggtggtcaggctcaagcccagccagtcggaaagggagaagcttgtggtgctcagagaaggggacagggcagcgagctcccaaggcacctgcctttctgtgccatcccacgggtgggaggagggaacctgggcccacttctgctgccaactacaggcatcccagtggctcctgagccaagacattctgtgccacgcactgggtcaaccgctttattcaacctgcagacagccctgggtcaggaggtggacactgttgtgaatttctcagaggagaaatggaagcccatacatccccctgaactcccaccgggcgttagaaccct

SEQ ID NO: 191156 - DNA, 230 bp, Homo sapiens
acacttgtatctcattcttacaggcatgtgtactacccctcagggtccatagctgttcagtatggcaaagggcagacttgctttctcttccactttgctgccttgatgaggttaacatactggaatgaaagaggagggcaggacatctgccaaagtgcaaggaataagagttattgaaacaattgggaaaaggattgacacttcaggaagctgacctcgaagttgacctc

SEQ ID NO: 191157 - DNA, 538 bp, Homo sapiens
cccccccaggaaggccatagctccagtacagcacacgaaggctgaggccagggctcggggccagaggcagtcactggagtagcgggaggagctggtgctcagaagcacttccccaacttgaggggtgggtagaagagcccttcatgggtgaatccagggagcagagcacagacagacccaggagcccctgtccaaatgagccatgtgcagacagtggagatggagggagagagggaaggttattagaggggactctgcaagccagtagtaatcctgaaattccagggcaattaaataactccaaatttgttttgttctcaagattcaatagtaattttttattcttaacagtatagaagagctatcatttgtctaagcgcttactatgtgctcaaggcttttcatgctttatgtctttgaatccacatagcagctctgtgagataaggagtattagtcaggattctgggattgcatgtgacagaaacagacctggctaacttaagccaaacagaatgtattggaaaggtggggctgtc

SEQ ID NO: 191158 - DNA, 204 bp, Homo sapiens
gctaattacacagacagtgacatcatcaatggcatcaacgaacttctcccccaaaaaggaaacaaatgagactttaagagaaataacaattttaataacaacattggctgaaggaatatccaacatttttagagcatgtcagaattgacagcgcgcttccagatgcaggatcacatttgattccctctttacagataaggaaac

SEQ ID NO: 191159 - DNA, 600 bp, Homo sapiens
tatcccagctactcaggaggctgaggcaggaggattgcttgaacccagtagtttgagtatagtctgggcaacatagcgagaccccatctcttaaaaaaaaaagttaaagacagtggttacaggggtaggaacttggcagatggggtcatgaatgagatgaagacttcagtacattttttttcctactatgaacattctgctaaacatgtgactgtattaagtattcaaaaaattaaacacattgagtaaggaaaaaaacaagttatctacaaattggtacaattctcaattacacaaataatttaagtatttagtttactttaaaaagctttttaatatttcatgaaagaaactttccaacatagaattctacaccaaactaaatggtcaattaagtgtaggtataaaatgaagccacatactcaaaaatgttttactcacatgaagttcttaggaagccaatgaaagaaaggcatacgtcatcagaatgaggaataataaactaggagagcaatacatgcggtccaggaaatgggatgcattagaagagaagaaaaaccatgtagagtacaattcgaggattccgaggttggtgaagat

SEQ ID NO: 191160 - DNA, 153 bp, Homo sapiens
tgactcagaaatagaaagaaatagaaagtcaaaaaccacatgttctcactaaccacatgtttagcagaagctaaacagtgggtacacatagacacacagagttgaataatagacattggaggctccaaaaggtgggatggagttaaggagttg

SEQ ID NO: 191161 - DNA, 409 bp, Homo sapiens
gtagaaggatgtgctaatttggtacagtttgtcacctggttgtttgcttgtttcagagaatgagagtagatggatttgctttccctgacctgctgctacttaaattccagtaagccaatcagggactaaggcagcaggggcaggtaggtgtagcttagcagcaactaagtcaaatgagactgaatttagaaactgtcatgtgagctgactgtgtgaaaacagtctgcctaattttctggtcttagtttccccatcgtaaagtgggagaaattcctgtaaagcggtcttgttttgatgaaaagaagggagtcaaaataaatgatccatacgtttactttcttcttttttaggctctgcctctacagctgtgggaaggtagagtaaaaagcactagttccataaaggaaaa

SEQ ID NO: 191162 - DNA, 228 bp, Homo sapiens
ttctcaaaatgctgggattacaagtgtgagccaccacgtccagtcagtgttttagatgaaaaatattaagaccaagacactaagtgatttttttcaactttgtacagttagcaagtactgaaccattatttaaactgaggcttattaagtccattgcctttttttggaatggtggtataatttataaataataagccttgcatatttaaagtgtgcagtatcgttttt

SEQ ID NO: 191163 - DNA, 432 bp, Homo sapiens
tttctcccagcccagcccagtcatgagtcatttgacctctagtttcccctcacactctgtctctgaatctcctttcttcctgaatgaaacgggtagcaatacttccttttaggtactcataacatgctcagaaattaaaacgaaaagtaactgcatggtaatataaaatacagtatactgtgttataattttaagtgcgtgtaatcctactgattcattattttaagcattcattcccttgaatgattacaaaatagtttagtacaatgatagttgtatcatcttccttaacgtggcctcatcagttattagtcactgaaaaattaacagtgtattccttgttcttagggtaaatcaaattttatatttagggtatatgctgggattacaggtgtgagccactggtgccccgccaataacactttttaaaat

SEQ ID NO: 191164 - DNA, 122 bp, Homo sapiens
ctggttttttaaaagcagatttaatttacaaaaagcaaagattttcacagaatttatctgcagtcctgttcccaacatgtaaagctgagaatattctgaaaaaaggtttctgcaaaaatgtg

SEQ ID NO: 191165 - DNA, 464 bp, Homo sapiens
agatgctacaataatctcctaaagcaccactttgtcacgtcaccactccaccctgcaccatttcataagctcccactgcctgtgaagtccaagctggccccagcctgtttttaggttcatccctaccactcctgaagtataaaactttgaacttctttcaaggcattacacacttccttgggtttagttagttgtagaaaactggactgtaagcatcttgaaaactcaagtggtatcctaagtatctttttatctgctgcagcacgtgatgacacttccttgcacataattagcagccaatagataagcatggaataaactaatggttacattttaagaaggaaatgaatgagtctttaactccctgacactgccctggcgttaacttggattggttatatttactgtttctatctcataagaatgtggtgaggtcactgtataacaattcctcaaggaaccct

SEQ ID NO: 191166 - DNA, 355 bp, Homo sapiens
agatccggaggcaggttgtctgaactcatgtgttggatgaagtcggcatacacctcatccagcggtggttgatattatcctccccaatggatatgaggctgtgaggtctcaaaatagcaacctgggcgtatttacctctgtatcaccagctcaaaagaataatcacctttaataatggcaatcataaaaagtcgattctcaggtgcctggttcatgcccagcaacgagtgtgcttgaagtgccaagattcaattaatcctcacaatcatgccaggtggtgggtactattattatacccactttacagattaggaactgaggcatgatatctattaataagtgacttgctcacctg

SEQ ID NO: 191167 - DNA, 534 bp, Homo sapiens
cggcacgaggctgaggtgcaaaatcaaaagtttcataacagagtggttctgtaaataccaaagactgtaaaacagccctgctagattaccacttgtcatcaggtaagcagtgccagaggatgacatgccatccacaggccaggccactgctggcaacccagagcaagcagagggaggggtgctggttatgcacttgctggccattcgagaacagcttttagttgagagttgttatgtggccttccttctacacccaggtttagggaggacctgccttctgactcttggaacacctgtaaaagcatgaatcctaaagtaggtaaagtgaaacttgctggtgatgaagaaaaagtccttcctccatcaggagtgaccagcaggacctggagaggcacttgggggctcacggcctgcacctgccccactgggttgtgtgagccactccctgaagaggacaatgatctctggctgtctttatgaatggtcagctctccccctggaaataggagaaccactggctacaaaacagggaga

SEQ ID NO: 191168 - DNA, 1790 bp, Homo sapiens
tctcaggaagaagcatatttgccatgaagctaaaaaagcttcagtttcactccccttccaaggctctggggggtggggtgggggcgggagctagcaacgtgctcacatggtcatatatttttgtaaaacttatagaagatatttttgtattctttttcttaaagaagatatccaagattgtataagcttcagatcccagaaatcctagatttaaaaaaaataatcaaccaccaccccaacaaaattaggcacatgcctgaaaattctgctgctactgccagaattctgcgggtaggggcttcatccaaggtgttcctaataataggcagagtccccagattagttccggtgaggcttttgggaggggttatttggcgcggtgttggtgttggtaggatcctggctgtgaggctgaggcaggcctgaggagggctggggctgacaggtaggcagagttggctgggatgtgaggtgcaaggggtggtacttcggaaacaaactttgaagaggagaaggggcagcaagactgtgagtctggactttgtgatacactgtcacccctagtttagtgtgcctggttagggagaatcaagcagcatggaacccctcttcctttttcactaacatttttctgtatagtggttgaaacccagtgttaagagactgcatgacattggaaaagaaggggaggagaaaaagagtccatatgaggcaagaacagaacgcagccagaattagggcaggcagggaaaggaagggagtgagatgtgggagtcgggggggagttgaggtaacctgcattttatatgctagagctacgtattttagatgcaggggcaactgtttcggtccaggagtggaaaggactgtagaagcaatctagcacagctgtttctcacttgggaaaactgaagccctcagaggcagagggaggaatggggagcggccaggccaggacaggactcagcccccagttcctcttctcaggcgtccgattccttctgatctttctctcctgccctctctgttactgcttcctcctgttcttacccttatatacacttgaagttttatccccattttttatgcttatgggattgtacactttctggttctctctcaagtccaaccagtatgtggtaacctgtctcttcccacttcatttgtggcactggtttgcagtggacaaaaggtccgtgctcctcttctaacctaatctggactgggttgcccaaaggttgccctgccacactgccaagtgcctaattagctgttttctctccaacccctccaaacacttatcatgagtaatttctcttgtctttagagttgccaaatctaatctctgtaaatacaaatgtggtgagacttcttctcaggagtttcagcaaatgaaacaataaactcttttttaccctgctaagattctaaagataaccatgagaatactcctaattatccttataaatttgaataagtgtggttgttgggttctctcaccctttttatatcccttcaaaagaaaatacaagtttgaattctataaaatatttttctggccgggcgcagtggctaacgcctgtaatcccagcactttgggaggctgaggtgggtggatcacaaggtcaggagttcaagaccagcctggccaacatggtgaaaccccatctctactaaaaatacaaaagttagctgggcgtggtggcgggcgcctgtaatcccagctgctcaggaggctgaggcaggagaatcacttgaaactggaaggcagaggttgcagtgagctgaga

SEQ ID NO: 191169 - DNA, 576 bp, Homo sapiens
cagccaggtgtgcatgaagtctctgtggagaagggatgggtggagggagaggaggagagcctgggccagagccctgaagccaccagcatggaggctcaccaagagtgcaggagagcaggaaagaggtaggtgggtcccgggacaggagagggtgcagggccacacgggttggcatctgggacagtgacaaggacttcagcctgctggattcatcaactgcctgagctttcctatgacagaggtgggcatgtggatgagagaaaccaaaggcttggcccttacagtcagctgaggggcaaccaggtgttcagagcttccagtgtcttgcaagctgaggtggtggctttgaacttgagttgtttcatattgaaagagatgaacagaaagaggagtgctaaaggtatattaatcttaaaagaacattaatgagtttttaaaaaggggagagcagtttgcccaggctggagtgcaatggtgtgataatggctcactgcaacctacacctcccagctaatcctcccatgttagcctcttgagtagctgggactacaggcggaagccaccacacccagctaa

SEQ ID NO: 191170 - DNA, 312 bp, Homo sapiens
tagctaggattacaggtgcatgccaccacgcctggctactttatgtatatttagtagagatgggatttcaccacattggtcaggctggtcttcaactcctgaccttgtgatctgcccgcctcggcctcccaaaatgctgggattataggcgtgagccactgtgcccagccatctgtgtctttttaaaacataagccttggaggcaaacagacctagcttgaatcttggcttatccacttaatagctggatggctttgggcaaatttcttaatccaaaaatctgcttttgaaaactggtaataagaatagtgc

SEQ ID NO: 191171 - DNA, 345 bp, Homo sapiens
attgctttttacaaatttgagtggagttgaaaagaccagtcaatgactggtatactactacttagtctagtaacaatttacaatggcttgtctcaaagaaataaagcatgtaaaatctatttctatttattttctttgtaagtagaaaaggaaacatcccatctcagtttgctgttggaatgtttgcttcaacccctcatctagtcttgtgcatgaccacagatctaagccctgtaaaaattaattactgagtctgtaggaaagctgatgggaatgtgtatcaatacagtggcaccagacttcgagcaacgtagttttcacctttttttttttttttaaggaaat

SEQ ID NO: 191172 - DNA, 828 bp, Homo sapiens
taagaaaatggcagagattcgaatttgtctgcctcctgagccaaagtcttaactactcttttgggctgtctctagcaaatgtcatgaaattgtggctgaaagagcaaaattaatgaataaatgggcaaagctgttacggatatagtaaaggtgatgagagaagggaagaagaaggaaggcatgtcctgtaaatggagagaaaagaagagaagatgttagtggaataaacagagtaagctcgtatctaaagaaatggctagtagcagagtagttctgtattcctcatttgagaattagcaaaggcacacagagaaggcaaatagagagccaagaaaaagaaaaagaaccaaacaggttgtaagagaaaagccgccatctcaacaagtcagcattatgatcaaattggtgaaagaggaaaaacatttctaggccagacagatttgctgctgatctttgaagactataatgcagagatgccaattcaaggctggataatgtaaagtgtgttacttgagtataggataatatggagtggtggggattgtggcagactgaagaatacatgcttaatctaagagactgtttaacagtttctgttgatgaggaaatgctgggctagagttgctcgaccttctgaatttcttttagaggctagaaatgtgtttccaaactattaaatgttggccactaaattgcaataaaaatatgtgtttggactaatgaaaacatttgtgggtgaactttggcccgtcagttgccatctgctccctatgctttaaagcatgcctttgcatgtcctggtctacctgtctagaattttatgccctc

SEQ ID NO: 191173 - DNA, 889 bp, Homo sapiens
taagaaaatggcagagattcgaatttgtctgcctcctgagccaaagtcttaactactcttttgggctgtctctagcaaatgtcatgaaattgtggctgaaagagcaaaattaatgaataaatgggcaaagctgttacggatatagtaaaggtgatgagagaagggaagaagaaggaaggcatgtcctgtaaatggagagaaaagaagagaagatgttagtggaataaacagagtaagctcgtatctaaagaaatggctagtagcagagtagttctgtattcctcatttgagaattagcaaaggcacacagagaaggcaaatagagagccaagaaaaagaaaaagaaccaaacaggttgtaagagaaaagccgccatctcaacaagtcagcattatgatcaaattggtgaaagaggaaaaacatttctaggccagacagatttgctgctgatctttgaagactataatgcagagatgccaattcaaggctggataatgtaaagtgtgttacttgagtataggataatatggagtggtggggattgtggcagactgaagaatacatgcttaatctaagagactgtttaacagtttctgttgatgaggaaatgctgggctagagttgctcgaccttctgaatttcttttagaggctagaaatgtgtttccaaactattaaatgttggccactaaattgcaataaaaatatgtgtttggactaatgaaaacatttgtgggtgaactaatacaaagaggttgatattcaaagtgatctggtttagctgacccactcaatatctgaagaacatataagaggtgatatgaatagatctgtgattttcccctgtatgaactgtcactgtctatatttgccttttaaaatagacgcat

SEQ ID NO: 191174 - DNA, 414 bp, Homo sapiens
aacgacatagggaatgatgctactgttggtattggtggagttaaagtgtcaatgagaaagtgacattagagcaaatacttgaaggaaagaggtgaaccagccaggtgaatatttgaggagagagtgttcttgatctgggtttctcaaactttaatgtgtatatgaattgtttgggattcatattaaaatgcagagtcttgggtctcatttccagagtgttttgattcagaaagcctaggataaggcctgataaattggatttctaataagctcccaagtgatgctgatgctgctggtcaagataatgctttcaagcagcctgcaccaactcatcttactttcacttacatcacccttcattgatttagtcatgatggttgattaacgtagtcaacttcctcttacggatataag

SEQ ID NO: 191175 - DNA, 392 bp, Homo sapiens
aagaaaaattttgaaaatcaccggaaacgcattattccaagaacagttttaaataacttttcacaatagtacttgttatggatcacattcctaagaatgattagtgattaatcaaagtttcacacagttttaagatcctgaatttgggaaatgggctacctgtttaaatttcatttttagaagagcactgtgattaaaagcatggtcttcagttagttctgagttcacttatgactactgtgtaatttgaacaagttacttacctatctctatgcctgcttcctcacttgtaaaatgaagctattaatagccatttcacagttattgtgaagactacatgaaataaagtttttgaagcatctagttaagtacctggcatgaagtaagtggtc

SEQ ID NO: 191176 - DNA, 337 bp, Homo sapiens
agctggtttgttcctcttctctcaggaatcgctgtgctgattgaagcctgttgtccatggcttcatagattttatccgggttttttattgctaaggcagggggtgaattccgtctctgttattccatcatggctgtaagtggaagttgaatccaaggtcatgatggccactgcctcaacctttaagacagtctgcagcattcctgtgagcagccctgatgcgtcacttacagccttccagctggcccggagggtagtgagacgctgctggcctgttcaccccagagggagctgtgggtctggtgggatgggacttgggttggtgggaggacgaggag

SEQ ID NO: 191177 - DNA, 109 bp, Homo sapiens
ttgataatgttttgacttttaagaaatattttttctttgctgttttaattttgttatgcaattaacatctatttttatatcatgtatatattaataattacatatttac

SEQ ID NO: 191178 - DNA, 410 bp, Homo sapiens
aggcttcagaatcgcttgaactcgggaggcagagattgtagtgacccaagacttcatcattgcgctacagtctgggcaacagagggagactgtctcaaaaataaataaatacaaaaataagtgggagggagtaggataactgaaatattaatgtgagttttgagcttcctgttttttcttcccaagtgtgaagcagataaccagacctttatattcccttgcctcagtagagatctgtaatacagaagaaaagcagaattttcccaaagacttctctcttccaggttttcgttcctcaaaaatctgagctcctaaactgttgatgctcagggtgagctctgagagaaaaggcaggcaagatagagcctattattatatatttggatttaaagaaaataaaataatgctct

SEQ ID NO: 191179 - DNA, 502 bp, Homo sapiens
tcatttgattaatgtttctctcttcctctgcacagcaagggaatggggccgtattggtgtgcatccctaatgcctagcacagagcccagcatccaagagctactcatgtatttgtggaataaatcaatgaatgaaagaactccccatccaataccttttactgtgggactacacccctatggactggagcacagaatggcttaaaggtggggaaaagaatggtttacaggtggcaaagcagaggaccagggcttaaagaaaacaaacagaaaatggctacgagggagttgggagtgtttcagaaccaaatctctgcctctttcagtttctgcctatcaagccccaaacatggaacagctcgtagttcaaagtgtcaacatatgactattgaatctggaaactcaaacacatactttcgtttctggtaaggctacactcctatttgaggcttatcttgtaatgcttgagccaccacaatgtaattgaagtaggaaagcgtctc

SEQ ID NO: 191180 - DNA, 261 bp, Homo sapiens
tcccagaccacctcaacaggagtctctcagcctcacttcttccaagaacctcatcctctagacagagctttagctggtgtttgaaaatgtgcccgggatttgttttactcagggatggaaagtcacaaagacgtggaaatgactgtcatgaaggaagaagtctagaagtaggagagtcacatgctttgtagggccacatggggaagcaccaggccagtcaggaggctgacggagagtgggaaacgtgggcagtggccttca

SEQ ID NO: 191181 - DNA, 763 bp, Homo sapiens
cacatatgggtagtggctattgtattgaacagcacagatacaaaatatttctgtcatcacaacatgttctacttgacaagagctgtgatagaacattataattaaatgaatctgcattctctagtttgagatgatagtttcatttcaaccaagtttcttgtgctttttctattaaaattctcttttagattcgaaagttgtatttcttaaaattttaagcagattttattgtaatatatttcaaataaagtagcattattatttttttcaggtctttgacctgtaatagcatttaaattaagcaatcttcgaatttgattttcaatttaagcattgatattatctgatattttatgctaataagttgtgagatggtattgaagcataatggttaagtgcaatgccattgggagctaggggcagtggcacacacctgtcatgtcacctcccaaagtgctgggattacaggtgtgagccactgcacccagcctattatgtatattgtaacacaacaaaaactagagttgtaaggggagaaaaaggttatgtatgaggaactcttctagattaagagagactgtttagagaaaaccaaagatagtcttatttgtagggatcctggtttgaaaaatcagctgtaaattttgggggagtttgtatgtgttctagtattagaagatattaggtaattattaatttgaataaatttgataatgtagttatgtaggagaaaatattgtagttgtgtaggagaatattaaaa

SEQ ID NO: 191182 - DNA, 212 bp, Homo sapiens
ttaaaatactaaaagcaaagatgttgtgtgtgtactgacccactgtgtcccatagttctatattggaggaaaatgtgcaaagctagttggagggatggaattgacatataactcattataatgctctgatttcacataatgggaggccgtgtgtagtggctcacgcctgtaatccctcctttgggaggccattgcttgaggccaggaattca

SEQ ID NO: 191183 - DNA, 623 bp, Homo sapiens
aaaaactctgagaccgtgagtgggggaagtggctggacaggtggatgctcacataagccctaggacacattgatgtactggaggcagacaggcagagtgtggcccatataaaacacccgaacttgcccttactctgcaggaagtacatggaatgggagacaaaagtcatccaggacttaggaaaactaggttctcttctggctgtcattaaccatcaatgtgaccttagaaaagtcatttaatctttctgtgccttaatttcttcctctgcaaaatgaggaatagtattggccttgctcacctcatggacttattttacaaatcaaatgagaccatggaaatgaaagcgctttggaaaatccttggagttttatgaatgtggggcattaggatgagaaaaaagtgtctggagttctcagattcatgaaagccctgaggctgccagggcccctttttggtaacccccttctctgaagatccatctgcagaaaggacaggggcttgccaggcttagggtgagacgtccttcccaaaacaggcctgggagagctgttttctggcagaggtccaggttactcagtgtggctcgattgactcagagatgacagctccctatccacatg

SEQ ID NO: 191184 - DNA, 389 bp, Homo sapiens
acttcttccaggctttgctcacctcttcatctaacagaccattgacacctgcttggagattgatgacagctacaaattttacttactcctaagattataagttccctgtgatactaaggcctggcccaaattgcaaaattgttaaagcagaaactccagcttgcatgttgaaggaatacgtgaagtaaaagaaagctgtgaaataggctaactcagttaccatagcttatggttaagaaagctgcactggctgattgggaagcagttgcacactctctaggaccattaaggtcaaacttgggtgaaattttgcagcctccattcaaatttatcctgttttgtacaaaaacaaattggcgttcatttttctaacttgggttaggttttgt

SEQ ID NO: 191185 - DNA, 520 bp, Homo sapiens
tgttatctacttaaatactttcagggtattctactcaatcaaattaaatataaattcctgaagaagaaattaatatcttgttgctgatcccataagagaataaaacatataggaaaatgaaggtactgtaaaaaaagacactaaattagaacacagtattagtactagtattcattaagtgcctataaactacaagagaacaaagaccatacatatttcactcaccactgtgaatatataaacccatcaaggcctgacatataggggggtgctcaatatatatttgttgaatgaatcaagtttgtaagcagactgtgttaggttctaggcaatccgtttcttattttcaaggcacgtgtagctcaactgcccatccaagaagtttgcaccaccatcttttgtttttgtactggtggacttagcagcctttactggtggctggtagattcaaagaagtgaaggcctttagaccagagagataaaatgagctcatttttccacaagatttctaatgtttccc

SEQ ID NO: 191186 - DNA, 391 bp, Homo sapiens
ataaggacctgaactaaagttgatgtagtggggatggagtggaaaaaatatttcaggaaggacagagtcattgatttgtttgctgtgcccaggggacggataggtgccaaggatggtttcacatccaaagttcagcacacaggtgggtaccaatgctggtcattatcaaggattagaaacacaggagcaagctgaagagtgactgcatgatccttgacctttgggagaccttagtttgaatactgactcttgtttaccagctacacacatggcttaacctccctgaacttttctcatatgtacctgctgcaacagggttgttataaagaataggtgattctaggctgggcgcggtggctcatgcctgtaatcccagcactttgggaggccg

SEQ ID NO: 191187 - DNA, 417 bp, Homo sapiens
ttatccaagtcccacatttctgtttctgagaggtgttggactattgtctcactttgttactgtgcttatgttagagcagagctaattaaaatccttttgtaactttaattgagtgaccataattctcattgctctagggtttgacatttcaacaccttcaaatgggcctatatatttcctgagactaacctataggctgattttttaaaattgaacttcgtaaaaatttatctagctttggaaaagcaatattcaatagttttttcactcattcatttagtaaatggtctttcactgcctcctatgtcctgagcactgttctaggagcttgatacaggcagatacaaggtttgcttccagtccagtgaggggaattcagacaagcatacagtgtaatggtagaaccgactggtccgg

SEQ ID NO: 191188 - DNA, 424 bp, Homo sapiens
gttgctttgccaaacaaaagttgccagactagactagtgagctgaacaggcaaggaacacagaggtgagatcaaggaaggcagaacaagaatggagcgggatttaggaattaaagcaaatctgcaattaaatataactgaagtaatggtaaatttcaagagaactagactgtaagaactaacctcacattgtgggaaaataaaaattttaaccttttccccctttatttgaaatgttctatgactacttgaaagaatttaaaaatgaaagtatttgtcagttttgtccttgaatatctttcatttgtcatagaatacatattttgtccatagtattttgttttataagtgtgagggtagatttttttattgagagcctactaatatgcctggcactgttgaggtgcaggagatcgacagtgaaa

SEQ ID NO: 191189 - DNA, 417 bp, Homo sapiens
agtgaaaacacccttaaatcgtaaatggtataattcataagggttctgtggctttttgtaaagggcagagtaatttaacaggttaaaagaagtacagtggcgttaaacccattatgttagaatcacagaattttgggtatagaaacccattagaaatgttgcccagtgccttcattatacaggcaaagaaaactgaggcccaagataaggagttccaaactgtgctttcttatttgttattttaaaaaaacaagtttttatttgctaattctctatggccctgcaaatcctttattggaaataaccttggtctcactgctgtctttctgtcctttgtactgcgtaatggggcttgaggattagtgtgctgatatttgtgcatgtaaatgcttctgtatatgcatgtgccttctgaaa

SEQ ID NO: 191190 - DNA, 525 bp, Homo sapiens
cgaaatcatggccactgcactccagtctgagtgactaagactcttgtctcaaaaaaaaagaaaagaaaaaatgtctacaattaaaaagacgaaaagaagtgctagggaggatgtggagaaaagggaacacttacacattgttggtgggattgtaaactagtacagccactatagaaaactgtatggaggttcttcaaaaaattaaaaatagaactaccacatgatccagcaatctcagtactggatccatatccaaaggaaataaaatcattatgttgaagaaatatctgcactcccacgcttactgcatgactatttacaatggccaagatgtggaatcagcttaagtatccaacagcggatgaatggataaagaaaatgtggtatgtaacacagtggaatacataaaactgaatgaaatcctgcactttgtgacaacatagatgaacatggaggacatcatgttacatgaaataagccagacacagaaagacaaatacgatctcactcatgtggaatccttaa

SEQ ID NO: 191191 - DNA, 373 bp, Homo sapiens
gtggcaggaagagtgactgccctctagaaagggaatggaagtggtaaagaaccctggtacaagaggaaaaggaattcagctttggggttgttgtgtttggctgacagtgaagcatggagggggaaaggtttagtactcattgggaaaaaaggagctagaaatcatgtgagacgatggaactggaaataagcgagagtcatcagctcaagggagataattaacgttcctgagaaaacaagcatgaaagcctttataatgcattagcaaatgtgtttttcagttttatagctaaagaaacagaaggcgaggagaccttaatgaaatgacctcacctcttattttagatggaatggaagctagtcatatatttgaa

SEQ ID NO: 191192 - DNA, 268 bp, Homo sapiens
aacagaaaacagaaaagcaggccatctgcccactcacagaggacaagaggaggagatggagacctgaggtgaccagagtagaaaactaggatggaatggactcaggcaggtctcctgggaggctacatattagttatctattgctgtgtaacaaactgtcacaaagttgatggctcaaaacagcacacattcattatttcacagttcctatagctcagtgtgagcctgggcatggcttagctgtgtctatggttcatgaatctcataa

SEQ ID NO: 191193 - DNA, 464 bp, Homo sapiens
tcacatggagtctcgctctgtcacccaggctggagtgtagtggtggatgtcggctcactgcaagctccctctcctgggttcatgccattctcctgcctcagcctcccgagtagctgggactacaggcacccaccaccacgcccagctaagtttttgtatttttactagagacggggtttcaccatgttagccaggatggtctcgatctccagacctcgtgatccacctgcctcagcctctcaaagtgctgggattacaggcgtgagccaccttgcctggccaaaagattcttaaaaaaacaatctactgattctcaaagcctagtctgaaaggtaatttcatttggactatctaatattattaaggcaaaaaaaacacaacattaaacaaaagtttaaatttaaaagtttccatgcctctggctggccattttcactgcctttaagcctttgtgactcttcctc

SEQ ID NO: 191194 - DNA, 332 bp, Homo sapiens
cagtccaccttgctccacctgcattagtcttggcctgttctgttactcacaacccaatccacactctctccaattcaggacctctgggacacgggaaaggtgaaggaataggtaaataacaagactctcatatagttcccaatttaatcctcacaactatgctttgatagcagtactatacatatttgatagatgtgaagatgagactgaggcacagagaagtaccttgtccaggaacttacaactagaaagtggtaaagcctgaattcaaacgcagctgcatgtcaagggccatgctcataaacactatgcatactatctctcctaacaat

SEQ ID NO: 191195 - DNA, 439 bp, Homo sapiens
catgttattatagaggttttcagagatcctcagaaatctccaactgaaatcttacttgaggttaatttgggggagaattgagattttatgataataaaccacccttcccaaaagtatagactgtctccccaattattcttctcatcttatatgttctttagactaatttaaaactttttctttatttttttattaaataaggttatcaatactttatagatttttatgctattgtgaattagatcttatttttgaattctgtttttctagtgagttttccttgtctagagaaatgttcttgattttaatttattcgctatgctgtgtttctcaagagcagaggctgcatctttcgtctctgtattcccagtgtttaaaacattgcatggtaagtgatcaatgaatgtttgtttgttgaatgaatgaatgaatgagcagg

SEQ ID NO: 191196 - DNA, 464 bp, Homo sapiens
aggcacaggtgagcgcaaagtcccagtgcatgtcccctcttctctcccgatgcagtgtcattcccaggtgaacctgccgggctgaacggcctggcccctctattcagtcggagttttactactccagtggattttggtaacttcatttggaaataatttcagacttacaaaaatgttgcaagaatgacacaaagaaccacccttttatatctgccccacttgttttcatgttttccctctttgcacacatgtacaatttatttcagaaaaaactacagacatgatactgcttttcctacactaaaaatacttcagtgtatatttcccaaaaataggagtaatcccttatgtaaccacagtgtaattatcaaaattcacaaatagtgttacaaaactattatctgatctatggaccttattcagattttaccacttgtcccaacaatgcccttctcagaaaaaaa

SEQ ID NO: 191197 - DNA, 594 bp, Homo sapiens
gctatgatcaacgcgttgggagctctcatattgtcgacctgcaggcggcgcgaattcactagtgattatccccggctcctgggtaggataggagagcattcctgattttgaggaggaaggatagagggttttactggtgaatgacgtgagtaagtgtcatgaccgctcgtattctcaggattcttcagtattgggagatgtgactgcagtggacagggcagtgtcagagagactagattttataatagaagcttttaaattacctacccatcaccaacttatcaggagactgacactgtccatctcctccaaaaaaaaaaactgacctgcccggcactttgatgtccaccagttgagctttatgtttatcaagaatagttgtgtaaacttccaaaactgtttatggcaggcacagtggctcacgcctgtaatcccagcactttgggagggtgatgtgggtagatgacttgaggtcaggagtttgagaccagcctggccaacgtggtgaaaccccatctctactaaaaatacaaaaaagaaattagccaggcgtggtagcgggcgcctgtaatcccagctactcaggaggctgag

SEQ ID NO: 191198 - DNA, 394 bp, Homo sapiens
ccccttcctcctcaacagccctccagtgccctggtagccgccagtccccgcctggcgttttgaggttccacaatcaactttggcatgttttgactggcagggccttcaccaacacctatctcttctacggtgcgtaccgagtggggccggagagcagctccgtgtacagcatccgcctggcctacctcctcagcccgctggcctgcctgctcctctgcttctgtgggactctgcggcggatggtgaaggggctgccgcagaagactctgctgggtcagggctatcaggcgcctctcagcgccaaggtcttctcctcatgggacttctgcatccgggtgcaggaagcagccaccatcaagaagcatgagatcagcaacgagttcaaggtgtgtgc

SEQ ID NO: 191199 - DNA, 340 bp, Homo sapiens
tgctgtcgctactttgtgtagtacaactttcaggttataaaagcaaaatgggaagaaagtattaaatgcttttacagtggactaatgaaaacaatcccagagcattatttactttcatggtaaatcatagtgtgaaaaaaaaaaaacagtatacattcctgttactgaccactgtcactaaacaccatggaacactggctctttttatcctcttcctataattacacaagcgtctagatcaccagaggtagtaaatgacagagccagggttaaaatccacctctgtctgacagattctagagtcttagttttcactccctatgctattctatctctctag

SEQ ID NO: 191200 - DNA, 746 bp, Homo sapiens
aaatacatcaacgcagaaaaaaaagattttctttttaggtctcgaagatctgtatacaagatgctggaaccaagtcacactgaaaaagttgacagcctggaaatttctatatgtggctggccagagatgtataaagaatacagtggggcttactggagataacagcacttcccagatgaggggtgctgcagtgtagaccaaggggccacgacactttagaggtggtactggcctctgagaaggcagaggtctctaagaattaaagaactcctatgacttaaggtcagcagagataggctatcttgaaagaaatgatctacctcccttccctgagggagatagaacctcaggaaacctcccttcaaaattagaaccaagatgagaatgaagttgaaggatgaagatgttttatataatatctttacttacaaaaattaaaagaccaaagatgtgctgtaattctgaacttcactggatctacaaacatcaatagtggtcggcagggcgtgggggctcatgccagtgatcccagcactttgggaggccaaggtgggtggatcagttggggtcaggatttcgagaccagtctggccaacatggtgaaacctcgtctttactaaaaatgcaaaaattagccaggcgtgttggcggaccctggggagccagaggttgcagtgagcggagatcgtgccgctacactccagcctgggcgacagagactccaactcaaaaaaaaaaaaaaaaaa

SEQ ID NO: 191201 - DNA, 709 bp, Homo sapiens
gcacaactgcatgcactctgttggtgaaattacttcagtcaatgttcaggactgtaaatactcagggaaaaggtcatttttgtttctatcctgctcagaagaaaataaatctcttctttccctttaatctaataaatcaaaggagcactggaaagcatcttttcagttgtaattttatttcgatgttttgctcaccatgtcacactgtttaagaaactgttatgtctgccaaaaagaacagttattggccttattttgcaggtgatagagccattaccattcaccagaccagtatttaggacatgcatactgaattatttaacactaataatgcacatgggacacattaaagtaaaaaatgggataagtaacttcattgcaataacatttatttcctcctggcttgcccaactgttctcttttgttcaagggcacaccaagaacttcaaagatgataatcctgggtacctaactgctttgcttctttcaaccacaacccacttactctctgctttgcctggtcaaaaacatagttgtggaattgacttccagcatgacagtttaaggagctctgctgtcctgttccacggtgaaactgataaaaattataaaaaccaaacaaaaactattcagagtttcttgaaatggtcctaagggcaaaagagtaaataagaacacatttattcaagaacatttattaaaactcagt

SEQ ID NO: 191202 - DNA, 547 bp, Homo sapiens
attggaacagcagtgcaaggtgaggcacgggcccagtgagtgccagtgcatgctgctcagctatttagctgggtgtaacacagaaactagtaaaagtcaagatcttttgtgcattcacggatcaaggacctactacgcactcagtcttgtgtcggtgctgatactgctgaggtaaataagattgtttttgccctgaagggtcttgtaatctggtagtcatcaaaaatgaaaaattacaacaatatagatgtgtccagggaactgtggggtctcagtggaagatgcacccttcattccaccagagacagatgggaaggcttccaggaaaagaccctaaagtgcacctcggaggacggcatagaaacacccagtccagggagggaggggctcagtgagccctgacgggacccctaggatgaagcacatctcaggggagagtggcaggtgagaggtttcttccacagctgtgagacccgggaacaaccagcagtcgttgagagacagaagatggaggaggccgaggcagctcacatgggccctgcacgtg

SEQ ID NO: 191203 - DNA, 576 bp, Homo sapiens
tctcttatgcagaagagtgatccacaaatgaaattcaccatctctttcctactttaagttggtctgatcaaaggaatttttttgtttgttttccttccgtgtcagaacgacagctgctctgactgtaaattaagtatcaatacttttgaccaggagttacagaaaggaggagggggttactatattgacaactgactcgagggagttttctttctacttccaaaggaaactaacctggctttggacggtgattgttcctcaaggaagggactgtcttgggtttctttctggttctgtaacagtgtcccacatccaggggtgctaatcaacgtgtggtgctggtggacagagcagatggcacgtgggaggggaaagagcacccaaacaggatgcaaaaagaggcacttgaaattaccactttagaaaataaagtgatgtttatgcacagaataacacaatttcttgttcacacatcccacctatgacattaatcagagccttcacctatgggctgaatgtcatgttttccactcctagtagtttacagattttttactttgaagtggaagacacaaa

SEQ ID NO: 191204 - DNA, 264 bp, Homo sapiens
tggtcgctgttgatgtatagaagagctactgatttgtgtacattaatcttgtattcagaaactttgccaagttcttttatccgttctaggatctttctggaggagtctttagggttttcaaggtaaatgatcatatcttcaacaaacagtgacagtttgacttcctctttaccattttggatgccctttatttctttcttgtgtctgattgctctggctaggactttcagtactatgttgaagaggagtggtgagagtgggcat

SEQ ID NO: 191205 - DNA, 421 bp, Homo sapiens
gcgaagatgtagagaaagcagttatcttgcaaattgctagtgagaacataaagtggtgtagccattttggaaacagtctggtagtttctgagaataaaggtaaatatagagttaccatatgatccatcaatcctacctaattccactcaagagaactcaaaacatccatacaaaaacttgtatacaaatgttcacagcagcattattcatcagagccaaaaagttagaaaaaaacaaatgtcctgtccatcaactgatgaatgggtaaacaaaatatggcataaatcagtacttcattccttttaaggccaaatcttgtgtgtgtgcgtgcgtgcgtgcatgcgtgtgtgtgtgtgagacagagtcctgctccgtcacccaggcttcagtccagtggcatgattatggctcactgcaacct

SEQ ID NO: 191206 - DNA, 412 bp, Homo sapiens
gaggtgggaagatgaaggaatcacagcaaaaccttccaatccaaggacccagtctgtggctctagattttcttgcttccatggtaacaggaaactcgggctgagcaaccacaaaaacttggtagtcccaaaagctaagaaaccaagggccatattaacagaagcctaagtcccagtttaaaggaggagcgatcatgagacctgctctcctctgctccctcaagtcctcacttgcagtctgtactgaacaccaggtgtcactttccaacgactagtggtccaagggagggaaggaggcctgagtggagtggggtctggagccccacatctctgtgcccacccagagatgtggcatcctctgcccagctgtgctgtctcatgaagagtgggtggagaacttctgactccacgcc

SEQ ID NO: 191207 - DNA, 139 bp, Homo sapiens
attgcatcaatggcaaaaaagtgagcagacttctttgaatgagtatctggagagctcgctgggccaacagcaatatgttttaccaccactagcttctatctagcccactgaatgctgaaatgaccatgactggtgagca

SEQ ID NO: 191208 - DNA, 559 bp, Homo sapiens
acttatattaaacattgctatacctgtttgttcaaagtatgcatatagacatttaatatggggactcggcatttctctcataactttaaaaaaaagttgaacacagaattatgagtttataacactgattgtccatattaatctcccataaacatctttttcatgttgattatattaaaacattttatatttgttaggtacaataaaaattggagctaaatatttcatttttctagaaattcattttttatttaacgataaagtattagtctacaataaactaggaaaacaaaatgaaaggtggtcccttcaccacagactgagaggtacctgatccagaagagggaataaatgctaggttaatcaaagtaggaggctgtacattactcactggaatctattaagttaatggtcatagttcatataaattggggccaggaagttaaacttttctgaacacagggctagcaaaataataaagcaacattttgtgaaaggacggttttctatagattcaatttccaattttctgctctcacagagctcaaaacatcctaca

SEQ ID NO: 191209 - DNA, 389 bp, Homo sapiens
ctgcgaatacaaacgtgcaccaccatgcctggctaatttttgtattgttttgtagagatggggtctcactatgttgcccatgctgttaggggagacctactttaaacaggagactttttgtttgtttgtttttgttgttgttgtttgtttgtttttggctgagacctaaagaatgatagtggagggaagtgagaatggcatgtgcctggtgcagcaaagaaaaggacatgttagaggagcttaaagcagacctttgtggatgtagcctaaggagcaggggagagagtggcacagggggagttgagataaagacaggagcaagcttattcacagactaaggtggggactcagaaacctttgagattttaatgagaggaatgtcatcatct

SEQ ID NO: 191210 - DNA, 176 bp, Homo sapiens
ggagggacacagttcaacccataacatcaacctcttctacatgttgatgttagttacttcccttttctttgagctcttttcatgatcatctgtttcatcctccccaccccacctctcacaccctttcttctgtttgtatttccttgccggcttttatcctcagcctgaaaataagt

SEQ ID NO: 191211 - DNA, 606 bp, Homo sapiens
ccccataagaccaggagggtagagtctctgctatcagactaggagagtcatgtctccctcgttagactgggaaggtggtgtctcactcattagactaggagggtggtgtctctgccattcgactgggaagacagcgtctcctctatcagactgggagggccacattcccccaacaatgaaccgggaagatgatgtctcctccattaaactaggcaggtggtgtctcctccatcagcctgggagggtggtgccccccccatcagactggaagggtggcatctcccatatcaaactgggaaagtcacatttcccccatcagactggggaggcagcatctcctccatcagactaggagggccacatccccgccacaatgaactgggaaggtgtctcctccatcagcctgggagggtggcatctcctccatcagactgggagggcggcatctcctccatcagactgggagggccaaataccccaccccattgaactgggaaggtgccgtctcctctatcaaactggaaggctggtgtccctccacatccaatcggaaggtggcatctgccacatcagactgggagagaggtgttccctctattatactga

SEQ ID NO: 191212 - DNA, 185 bp, Homo sapiens
cctgttgtggaactgagccctcaatttgtggggtctgtggaaatgttaagtggtgtcagcattgaattattgaacaccagtttttcttggagaattggctcgtgttcagcaaatgctacatatttgctgtcagaagtaatgttagataaaatacaccatgggtcagaaccataactctgaatttg

SEQ ID NO: 191213 - DNA, 289 bp, Homo sapiens
atgtctgataatacacaggaggacgtagaaatccataaaccactggtaggagtataaactagtacaatcatgttggaaaacaatttgacactagtttacaatgatgaaaaggcacatagaaactccactcctagctatatactagtgattatgaaccttggttgcccattaaaatctcctgaaaggcttttctaaaaatcagactgcccagactacactccggacaaatgaagtaactatctctgaaggagggacttagttgtcaattgtttaaacctcccagggtgat

SEQ ID NO: 191214 - DNA, 317 bp, Homo sapiens
atcaacaagctaaagaagaaaaatctcatattaatagatggagaaaaagtatttgacaagatccaatacccattcacagtaaaacttcttggtaaactaggaatagatgggaatggcctcagtttgatgaatatctacaaaaacctatagccatatatttgaatttagagaagctacttctacgctaactacacataagggctatgtttctagtacagaatattgattaaaacctttcctgttttgattaaatctagccacatgattctcctagtgaagggatttaatcttgaaattggtggaatattttagatggt

SEQ ID NO: 191215 - DNA, 529 bp, Homo sapiens
ttggtgatcaactttaggcacgctggcaatttcccaggacaaccccgtcttaggttctgaacatcagaggcaatggctaaggtcccccaaagcactttggaatgagcccaggaagttgacctttgaagcactctcctgctcttggggccatgtcatcaggaagaaactccaggctgaaaacacaactgcaaggccaacaggcaggggagcagctttctcaggacacctgaggtcctgccccaccaggctctggtctttacacaccatctctcactgtcctctagccccaactgcacattgccttcctccttcctgagctcatgcttgcccctccctcggcatctccctagccccagcctgaaggctgacctcctccagaaagcctctccctcaccacgaggccagaaagagtctgtcctgtctctagcttctgagtttcttagtcccaacgactgtccctgctccactgacaccttccatacacagctttgtgagctgtgcgcatctgtgggtaccagagggtaagttc

SEQ ID NO: 191216 - DNA, 399 bp, Homo sapiens
atcgctggtgatctagaggatccctagggtttagggaggcatgacagcaccactcactgcactccagactgggcaacacagcaagaccctgtctccagaaacaaaaggagtccagccatgactcttctacccaccaaaaacataaatccaactgtctcctgaatatgcctgcctggatatcatagtcatctcaagcttgaacaaaactcaattcaatctttcaagcccctcttccatatcctcctcctatactccctaactcatttgtaaataccaccatcagtcaccaaaaccaaaaattcaaatgttatctctaactcctttaccctcttcattaaatcaatcaagtcttaccttgataacacgaaagtattactgcactctctcccaaccattcta

SEQ ID NO: 191217 - DNA, 390 bp, Homo sapiens
aaaaaattagctgggctatggtggtgcatgtctatagtcccaggtactagggaggctgaggtgggaggatcgcctgggcctgggggattgaggctgcagtgagccgtgagagacacagtgagaccccgactaaaaggaaaaaaaggaatgtaggtaaaacaaattcaattttactatatgtgttgttgaagtgagcacataaaacaaattcaaaatgatacagttatgtttgacagtggagcaatagtaaattggacttaaaaaactttattatgaaaaatttcaaatatattcaaaagcagagataatagtaaaatgtactattgcataacgattacccagaatgaatattattaaatcctgtcaatctggttttacccaggtcctcac

SEQ ID NO: 191218 - DNA, 182 bp, Homo sapiens
atggcataactagtatatgtagtagagaatggagaggtggtaaatgaaaaggctactgaaagattctaactaagcaaagtaagacagcttggtagagagaaagatgaaagactggggaaagaataggacaggacagtgagaaaggaagatgagaaactgggaaaaggttttgaggttgatct

SEQ ID NO: 191219 - DNA, 286 bp, Homo sapiens
tcaaaaatatcagaaccaaatcactgttattaatttgttaatcttacttaaaggcctttgtaaaatggtgatacagtcaagtgctgcataatgacatttcggtcagtgacagactgcatgtacaatggtgatcccataagattattatacggtctttaagtaagattaacaaattaatgttctcattagtactatgaaccccccaaatttgagacaagcctcaattaatttagaaagtttattttgccgaggttgaggacacacatccgtgacacagccatttagg

SEQ ID NO: 191220 - DNA, 621 bp, Homo sapiens
ggtatatatacacatatatacatatatacacataggtatatatacacatatatacatatatacacataggtatatatacacatatatacatatatacacataggtatatatacacatatatacatatatacacataggtatatatacacatatatacatatatacacataggtatatatacacatatatacatatatacacataggtatatatacacatatatacatatatacacataggtatatatacacatatatacatatatacacataggtatatatacacatatatatttatacacataggtatatatacacatatatacatatatacacataggtatatatacacatatatacatatatacatatatatacatatatacatatatatatggatttttttttgagacacggtctctgtcgctcagactaattatagctcactgcagtctcgacctcctgggctcaagtgatcctctcacctcagcctcccaagtagctgggacttcaggcgccccaccacgccctgctaattttggtgttttttgtagagacggggtctcgccgtgttgtccaagctggtcccgaacccctgggctcaaacaatcctcccgcctca

SEQ ID NO: 191221 - DNA, 386 bp, Homo sapiens
ctagtggtcctgcaaatatctgcctaccatctggggcttatcttttaagattgtttttggtgttcatgtgtcctggatatagttttattcctaactataattcatgaaatacttgcaatcaaccccatttgatagatgagaaaactgatcctgtgtgctacgttaacccagctgtaatggaaaagaggcacaactcgagcccaggtctctataacccttgcttcctccaagttctcttctaggccatcctctctcttaggtgagaggtaggaaagcatgtctgtaccagcaggtggcaccaggaatggcatgaaaggaaccaagcaagggctattgctagagaaaaagcaagacaaaggcctggagtggtggttcatacctgtaat

SEQ ID NO: 191222 - DNA, 319 bp, Homo sapiens
atctctgtcccatgtttcttgtccctgctccatctctctgtactcctgtccccctacccctctgcatccctgtacctgtctctccacggccctgtccttgtctgtctctcattctgtttttctctatatctcttgcacacgtgtgcacacagatggccagggccctgcacatttctggcttctgagtcacaaccccacgtcaactcaccactaaggatgtgtcccaggcagcttctgcctggcccctctggtcacctcctcccagattccaagttctcaacatctgcagggagggagggaagctaaggaattggccaag

SEQ ID NO: 191223 - DNA, 343 bp, Homo sapiens
ataaggatccccgttcgaccgagcagcgattagggtggtgtagtcagaaaccaaagcataatgccaacagtcaccagaagctcaaggaattattctccccaagagcctctgagggggtgtgccctgctgacaccctgattttggatttctgtcctccaaaactgtgagaaaataaattattgttgttttaagccacccagtttgtggtaatttgttgccacagccacagtaaactaatataggctgggtgcagtggctcaggcctgtaatcccagcactttgggaggccgaggtgggtggatcacttgaggtcaggagttcgagaccagcctggccaacatgg

SEQ ID NO: 191224 - DNA, 451 bp, Homo sapiens
agtcaaaaatattgagatgagatcatcctggagtagttgagtgtacccaaaataccatgataggtatccctaaaataatagacacagaggaaaagatacacatgaaggtgaaggcaatgagaagacagaagcagcgattagggtggtgtagtcagaaaccaaagcataatgccaacagtcaccagaagctcaaggaattattctccccaagagcctctgagggggtgtgccctgctgacaccctgattttggatttctgtcctccaaaactgtgagaaaataaattattgttgttttaagccacccagtttgtggtaatttgttgccacagccacagtaaactaatataggctgggtgcagtggctcaggcctgtaatcccagcactttgggaggccgaggtgggtggatcacttgaggtcaggagttcgagaccagcctggccaacatgg

SEQ ID NO: 191225 - DNA, 149 bp, Homo sapiens
ctcacgtctgcccagctcctgtggtagtcccattcatgcagggaggcctttttacaagttgaggatcatgaggagtactgccctcacctcttaggagaatgggaggaaacagtttacacagacttagatcaaatacaaaaaagcacttt

SEQ ID NO: 191226 - DNA, 535 bp, Homo sapiens
tgtgtgttctgcctttgttctctgttttggttaatggcatcaccaaccatccactcacccaacctaaatacttcaaagtatctgtgtgtcttccctctttgtgtctaatcaggtgctaaaacctgttggctcttctccagagtaccccttaaatgtggtttttctctccctcttatattttgactttagatccaaatggtctctggatctagcctcctacctgacactctgctactcatcttatatcctagatttgtaacctaaccatcattagtatcaagttgatcttgtttttctctttaaaaacttcttgtgactccttgctgcctaaaaaattaagcttaaagacattacattcaagacatttacagactggctggaacccagtctcatttcctgccagtctactagctataaatctgacctctgtagccaaattacgcatttccattcttccataaccttgcttgaactgttcccttgtttggaatactgttttcctttccttcttcttcacacatagaacccttcacat

SEQ ID NO: 191227 - DNA, 117 bp, Homo sapiens
gaaataaatccagatgttcaagatgcatatatccagtgacctacttgacatattcatacaaggaatttgcagatacctcaaacagcacgtccaaaactgaactctcactgcacactt

SEQ ID NO: 191228 - DNA, 207 bp, Homo sapiens
tgctgaaatattataggcaagaattagtgagggcctgcatcattacaatgctggaagggatggagaggagggcccaagttggagaaacacaggccacctgaaaccctgaagaagttgtgacttaccaaagtcacagtcaacagacacgtggtcagaaacccagcctgctagccccttgtgatttccaaatgtcctgggtttgatgca

SEQ ID NO: 191229 - DNA, 546 bp, Homo sapiens
atgagcatcgtaataataccaactcatagggttgctcttagtgcccatatatataaaagcactgagaacactgcctggcccattataagttccttatatactagacaatatttgcactgttctcatcagaacccaagtgtacactgtcagaggagtagacaaacctgtaaattcacacaatcaaaagcgatccagcaatgaaagtgaatgaactaagcttaagctgcagaagactacctataatattgtactatatcaaattcaaaaccaagcaaaaataaacgattaattgtgcagggaaatacatatagagtaaaactttaaaaaagaagatgaaacctaaataaagtgaggctgggatatttgaaggaaacaaggcaaggatgtctagtgcatggcaaatgacgacagctgtaagatgtgacatcaggctgtgcatggtggctcacgcctgtgatcccagcaccttgggaggccaaggcaggtggatcacctgaggtcaggagttcgagagagcctggccaacatggtgaaaccccatctcta

SEQ ID NO: 191230 - DNA, 420 bp, Homo sapiens
aagaagacttggcatctaaaagggactcgataaatagttttggataattaaatactgaaagtttagaaattactccactgatcattgtgaaacaatactgaaacagtagaaaccttcgaagctttggagcagagaagagacagatttataaaactgcttttataatgctagtttgatatagtggaaatgatgcatccgaagagtggaaagagaaggaggacagggaatccaaataggagactactgaaattaatacaggcataatgccaaatctcctgtcacttagaccaactccagaaaaagtggaaagaaaggagagtgttgattgtttgcttttctctaaattctacactccccccaccccaccaatcctgtacttatctgtataagagccaggagatatttcattgtatcaggtgg

SEQ ID NO: 191231 - DNA, 233 bp, Homo sapiens
gctgtatgggttagtagtatcacatatactatcactttcatgttttcagaactgggaagggaaagttgcactacctgctttggtttgcatggcgatagttcagctgattgtcgggcatctttcgaaaacctgtactgaaatcaggacaacttctgaggctccctggagagaactcccctgcctattgttgtccacagaatatgtatttatataatctcaatacttactgcgtg

SEQ ID NO: 191232 - DNA, 973 bp, Homo sapiens
tgaatgatttactttttaaaaaataaagtaaagcaaataaaagaatatccctccaacacacaccattatcattcacacactgttatattttcaagacagatggaagttcagaggaactgtatacataatgctggattcatccatctgagtccattaaacaagtcaacttccttcatatacgttcttgtggaaatagaaaagtgagaattactgatgtgtcttcctatgtactaatctgccctgtaatagagctatttcagagagaaattgtacgagttccataagtctcctggattgcctaagttataatagaaatgaaaaatgtggggaaaaatggccaagtgtaaatgaattggccagggttcatagaagatttccataacttgattcaggtctgaaataaaaagaacaatattttcctctgaaaagtgtatcgaaaacctgcctgagattttaatataaaatcatgtctagggcagagaagaagctgcccaatatattgacataaagactatatctggtacgatgaatggaaattgaatagcatcagaccaaattcgctgtgcttatgccttttctgatttgtactttgtatccaagaaaatattactttatcttatatgagatgttttgcacatttgagggtaatgtgcacaaatgttttgcacatttgagggtaatgggtgtgtgatagtgtatgtgtgttaagagagatacagaaagcatagaatgtaattagctaaaacaaagtacatttccagtttgcatgagaataaaatatttgtgaaagattttgataaaatcaaacgttggatataataaggaaaattgttttttaactttctggagtagaatatttctaaagtgtattctaaaatgacaagttttccaggaaatgctgatgtgtaaatgttaggtgtttgtaaatgttaggtattcattttccaggaaatgctaagatttgtaaatgtta

SEQ ID NO: 191233 - DNA, 290 bp, Homo sapiens
tgatttatttaaaagagaactcttctgtatgtggaatcctgaagattctatatagaaggatcaaaatatcatgctttgagttactattaagtgttttatagacccgtggggccagattaatcaaaagaataatcagtggattataaagaaaatcttacagatttcataaaatcttcactatcaatctttccctctaggttactagttaaatgaataatgtctaatgaagtccctatatcaaattagactgcttagcactgtggcagtgtagagatatttaactaaaggtt

SEQ ID NO: 191234 - DNA, 119 bp, Homo sapiens
gtaccttttgggatcttcagtaaccctgtcttgggatagtctccccaccagcaccaggtcttgccatctgaccatttgccagttcccacctccccttctctaagagacttcagcacaca

SEQ ID NO: 191235 - DNA, 159 bp, Homo sapiens
gagacaggaaagggctcctccacaatagggcctgcatttctttataattcaccccaaaaagaacagcaccccatgaggggctgcttctgacagattctagccatgcctctcggcggagagctacactttggcctttcattctaaggctaatcctccgaa

SEQ ID NO: 191236 - DNA, 264 bp, Homo sapiens
atgcaggtgatctagaggactccccggaatggtggtgttgtgcttaataattgtctttgacgagttaatgggtgcagcacaccaacatggcgcatgtatacatatgtaacaaacctgcacattgtacacatgtaccctagaactgaaattataatgaaacaacaacaacaacaacaacaaaataataataataattgtctttgaatggctgactgaaagcacattcatattatctagtcaaatgaatgtccaccctccactata

SEQ ID NO: 191237 - DNA, 298 bp, Homo sapiens
  misc_feature (1)..(1): n is a, c, g, or t
  misc_feature (12)..(12): n is a, c, g, or t
nagatcccccanccatctaaagtatgttttccttcttaactcttggaaatgggtaacttaacatagtctgataaaattttagaaaacgatttaaaaatgctaaacttctaggtcataaactaatattttcctggtatggaaactattctgtacgttatactttttaggcacagcattgctcatcaaagggtaattcaatctacagacaaattacagtgtaagccatatacaatgttttaagtggtacatgccagagtgcaatagccatgattctgacaagaacctttgtgcctgtttg

SEQ ID NO: 191238 - DNA, 180 bp, Homo sapiens
ctgaaaaagagggagtggtgagggaaggtggaaacacagggccagattctgtaagcccttgtaagctatgttaagaattttagatcttatcttaaatacaaagagaagccattgaaagtctcagggaagagactgatcggatttgcatttcagaaagcccatcacatgtgaatgtgatgg

SEQ ID NO: 191239 - DNA, 711 bp, Homo sapiens
ctcagcttcaactctagggatcaggtcagcctcacttctggaaaacatgtttcactgtgatgtttatcaaatgcaacttaaactagggattcaactacaattacacagtcacattcctgtagtgaggacacatcatctcactaggtagggttctctgcctcttaaagaatgaaaagataaggaaacgatcaccaaatgggttacaccaccatatcctgcaacttgagctctgacggaagcgggagtccgagggcactgaccggactggggcagagggccaactgcaaggtttggggaaagccttttctgggctcctattggaaaggggcactgggtggatcatagccaaacttctttgacacacaggggcagcagttgagagatgatcacacagagctttcagtaactcccaaatggactagagcgtatgagagatgataaaggcccagagagagaggatttgcccttgccttagtccccacccaaactcactcactgatgaagtatccactgagacttaatgtctttgatagtgtaacactccacttaaaagcaaacaagtgctattttcttgaaacctacaattttagttaaaaaaaaaaattgttaaaaaaaataggagtggggatggaggacagatcactctcaaaccagaccctcatctgccctggaatcactactgcattcccactggtaaacatttctgtctct

SEQ ID NO: 191240 - DNA, 425 bp, Homo sapiens
gttaaaaaaataaaaatatgaggcaagaggatggtttgagcccaagagtttgaggctgcagtgatagtactacagtactctaacctcggggacaaagtgaaactctgtctttaaaaatttcaagaaaagaaaaagaaaaacattgggctggctccaaaaaactgactttgagctacatatgacctatgggctgtatactggtggatctttaatagcttctaaaaaagaagttcaagatctaagtagggccttggctaaattttaatttcttccttagaatactttaaacagcacttttcattattaatttctgggtatgtttcagggggcagaaataaggacatttctcgttaactactgtttacactgtctttgggtgaaggaagattagtatgatgaacttagaggaaacacactgtttacac

SEQ ID NO: 191241 - DNA, 484 bp, Homo sapiens
aaccaagtgaggcgaggttccacatcgccggccaagtggctttatgggcctccagtgggatgtggcaggaagtacccagcggctctgccatgcattcttgaccagaaatgttgaacccgagttaattgtgaggaaacggacaaatccagggtgtggggcacgccgcagagagctgccttagccgcttcaacaccatcaggccagagtaggcggggagcgtctcggggaaaggggacagagagacgtgccatccaaatgcatgtgtgtcctccacggggccctgcatccccgcagctaggaaggtcatctggggacagttggtgaaatggaaacagggacgggatgttcggcagtattctgtcggtattcatttcttgggtgtgctcatggtgtcctagtgagcaggctgtcctgattcgtaggagatgtggacggacatggagggagtgccgtgacgtagcccaggagacctttttagcttaaa

SEQ ID NO: 191242 - DNA, 450 bp, Homo sapiens
ggcgcgaattcactagtgattagagactgcgagaaggagctaccaggcttcctgcagctctctggcccagggctgggtcatcagcacaccctgctgctgctgttcagatctgcatcctggtcccgcttggtcccacagtgagaacgctttgctatcacatgggcaggctctgagagccctgccggcctggccttctcaaagaagacctgagagcttgggacccaagcagagaggaagaacagggctcagggtgcttgctccatgctcgctccacacctggggctcaaccctggctttccccggctccctgtgtgacttcagggcaggtcccttgggccctctgggccttatcatcttcatctgtaacagggcgatgcctctgccgtgtctggtggtgttgaggagttcctgtttgtgtaagcagctagttcagtgccagcacgagatggg

SEQ ID NO: 191243 - DNA, 472 bp, Homo sapiens
ctcttcaaggccacatgattccagtacaaccgcttgcggggttccaagccacttcttggctatgtaaatgcagcacatagactagccatgtgagggcagcagagggccactacataggtgcaacctttggcttcaaaattcttggaccattctgacgtgattaaactaaaaacgaatgagtttatgcatatcgagataccctgaggtgtacaaaggatgagtcaaggtagcggagagagagttgaagagtgacagctgagaaacagagataggacatgtccaagaagtgccaggataacccaacaacacaggctgattgaggaaactgccagagattagacaaagtagactgaagagggaaagcaatgtttgttggagattttgctttagtttttgataaatatttcttagtcataccaattgttttaaatataattacgcccccaaaccaaatttctactcttattctggc

SEQ ID NO: 191244 - DNA, 482 bp, Homo sapiens
acgcgacgagctccgaatggagtccttctcctattaaaagggagtgaaaagaactgtttcaagatgaggcccaggatgattctacaagggaatacacttattactttgcatttcaattgctattctaacctattatatatgaaactttttgctagcaaagtaaaaaaagtctgcagtatttactttcatggctaggccaatgagtatgaggttaatgattcattaaagcagcaataaacttgaaaactagcctcagttgaaccctttagggtttatacaaatgctactccaaaagtcgggccccattccattaacacgtgctatggttagtaagtatggattatagggtatgttaacattaatttgcgctatggttagtaagtatggattatagcgtatgtttaataaagtattcttattttaggtcctcttaaatgatgctagttagcaaaggcagcatactggcaaaatactactcctgg

SEQ ID NO: 191245 - DNA, 494 bp, Homo sapiens
aaagactgaaaaaaaaaatctcaggtaagcaatctaatcttggcagtatttttgaggtcttggagactgatcccaggggctgtccaccctgtggtgtccttgtgcttcatcctaagctgtcccagatgcactgggtagctctggcttctgttgactccaaggccccaaatactgatttgtagctataagacttctaccttgcaaaagttgtgagtgaaggttttagcaggcactagacatacagtggtcactccgtacacggccctgtgcttctgacagctggcgtgcatatccaaacagactccagagtttggccatgcagaaaccagtccttatatttatcagaacaagctttatgggaatgaattccaggcttgtaaaatttggcagcacagatggccactcactctctctgcatagaatatttagccagttctgaaggtaattatctgccttggttttgtaactaaagactaccagcaaaggaatcaggg

SEQ ID NO: 191246 - DNA, 358 bp, Homo sapiens
actggcttgctcacggctccgtgtgaccgctgaggtctgctctacctctgccatgcctggtaggatggagttccgactggccacgttggcaaaatggcttgataatccccgtctaaataagccccttcccttccctgcctcactgttgttgctctttgtgatcactgatggggctcggacaccccaggataagcaccttgacatagtgagtatttgacgatgcaggaaactgagaaaaccacagaagcaagaaggtcactttctgacctcattcccgtctaccctgaagtaggtcgtcttcattaacgttcttatctcagaagacacagagaggccaagaagaacccgaacaaacagg

SEQ ID NO: 191247 - DNA, 232 bp, Homo sapiens
tcctggcgtctggaaggagcagggggtgactgacgaagagcaggaggtcagaggggcaaggtcagagtgagcataaaggacagaggtaggagctgatgttagcagggaggcagggccaggtcgcacaggaaaactgggcatctaagtctggggtgaggcaggggaatgacctgatctcttgggttgttgggaggagaatggactggatgggaggggccagagtgtaagctgt

SEQ ID NO: 191248 - DNA, 334 bp, Homo sapiens
atccctgccagtcttggtttcttcagcaagccattttgctgaagtagatgtcaaagtattttgcctagactatcaagcctttctggaaatgctaatgcatgctcaagtttgagaagcactcatttaggctaatgacttagatatatttgcccaaataatactcattttttctttcctcctaagacattttcatgtacgaacagaaaagtaactacaaaaagctaagtattttcttcttagcaatgtatctcacttaaagatttgaaactggggcatgcaaatcaaactcagaaattatcttaatatctgattgttaaaagctattccttatatt

SEQ ID NO: 191249 - DNA, 183 bp, Homo sapiens
aagtgattcaaatagtaatgatgctataataggacacattgctaggtcttaacctatcaggatgaaggacacataatagtatttctgaagacaggggacctcagagaggtacataagctgtacctggttccctggttccttgttcttaaagaattaactacaccatgctttaagactggtcag

SEQ ID NO: 191250 - DNA, 505 bp, Homo sapiens
caacagagcgagactccatctcaaaaacaaacaaaaaaacaaaaacaaaacaaaaaaaaaacacacctccattcctacccaagaagttcagccgagtggatgagacaggaattctgatgcaagaggatgaaaagggctctgttcacagttaacacagggatctctggcagcctattctaaagattggaagtcagggagaacttcctgggggaggtggcatgagttgcatctttaggaagcaaagaagattaaaaggttacaagttgttgtgtgggttgtagaggaatgggtggagacaagctgagtttctaaggcctcatgggcaagggacagaaggacaacaaactgtgtgaaacatacccacccaagagcacggatgcacaaataaaggtggtcttggctctgcccactgcttcacacttgtcatttcagacccattatgaggctgcaatcaggactgggcggcttttctcattcacgagagggcactacattctgctaactc

SEQ ID NO: 191251 - DNA, 164 bp, Homo sapiens
ttcccctacacgtaacagctacatacaaaagagttataaaaccgtccttggtttaacaaggataaatgaaaaacattaaaattctccaattgaacaaggtatacaaggatttttatgttgttgttttgttaaaacagtaaaagcaaaataacttactagaatag

SEQ ID NO: 191252 - DNA, 474 bp, Homo sapiens
ggattttagtgttgatactaagcagcagcagataagggaataatggctttgttttaaaagaaagtgataaatatgtggagggttatagtgaagccaagaaaatatgaacacctgcatggtcgataaaaaaatagtattttaagtagaatcaataggattgaggggacctggtagattcagttactcaacaagtatttagtgtgaagtttctagaatggatgttgaaatctttgcctcctcagtcgggaagagtcctgctaaaaatcaggctaaaaatcaggccaaaaatcaggccaaatgacttgacaaataattgacaaagtggttttcacgtgtgtctatctttgctagcagcttgtatacctcaggccaggtgagctccccatatttcttttttcatttactccagtgagtttctgctgtctttttcaagtatgtaccatatgacttaaaggtgatttggatgcgttgtaa

SEQ ID NO: 191253 - DNA, 416 bp, Homo sapiens
gtactgacaagagtagattcaaatataaaatattggaacaatgctaaaagacgctgaaataatccagactagaaggaagggtctgaatgaaaaggaaagactggaaaccttagggggaagaattagtaggcttttcaaatttttagatatgcaggatgaagaaaatggaggaggcaaaagtgcctgaaaagcttgagttcggtgacggaagacatggtgataccattaagcaaaaggaggaagttggtgattatgttggtttgcagcaatggttttggatatttgagtcaagatgaagttgagtgttcagaaggtgactggaagtatgtgtatgaaggaaaagcaaaaggtaggggctaaaagtgaagatttgggattcatcttcattcaaagagttattgaaatcatagaagaca

SEQ ID NO: 191254 - DNA, 283 bp, Homo sapiens
agcctccctccacagccttccaaaatgctgggattataggtgtgggccactgtgccactctgtgctgcagatttgatatttgacttcagagaagtgacttaacctctctatgcctcagttaccaatataaaagggatagtaacagtttctatttcctagggtggtataaagtagtgtgaggattaatgcaaagagtacaatgccaagcatttcaagcagcacttggaatacagtagcagtcagtaaatgtgggctaatctcattacaaagaatggaggcaaag

SEQ ID NO: 191255 - DNA, 177 bp, Homo sapiens
tatttaagcacatttagtcttgaggtggtggtacacaggagtgtggcagggagcgtggctgttgcagttgcttggtcctacactaggaagtcattactgaatttgtatttaagataaattcctgaaggtggaattgcgtcattaaagggcttgccactagggtttttgaaacatatt

SEQ ID NO: 191256 - DNA, 761 bp, Homo sapiens
gggtgtattttggggagcagcagaggaggtgagcccaaaaatgtacattaggaccagattagaaaagactgttttactaacaagtctgcagtttatttgggggaagaatgggaactttttagttcaaacttttaggaagatcgaagaccctttttgtttttttgttgtgttttgttttgttttgtttttgaggagtctcactctgtcaccaggctagagtgtaatggcacgttctcggctcactgcaacctctgcctcctgggttcaggtgattctcctgcctcagactcccgagtagctgggattataggcgcgcaccaccacacccagctaatttttgtatttttagtagagacgggatttcactatgttggccaggatggtcctgatctctttaactcgtgatccgcccacctctgcctcccaaagtgctaggattacaggcgtgagccaccacacctggctgaagagcttttaattaaaaaacaaacaattaaacaaataaacagtttcattgaggtataattgtcatgtaaattgtacatattttgcatgtataatttgatcattttccacacacacatacctgtgaaatcatcaccacaatcaagatactccatccttctccctgctctaggcaaccactgagctgctttctgttactgcaggttagtttgcattttctaaaatgtcatagacatgtaatcacatagtatagatttttttgtcccgttctggcttccttcactcagtgtagtgat

SEQ ID NO: 191257 - DNA, 567 bp, Homo sapiens
tagagcaacccaccaaatagttaacacttgcctggagagatttaggaacaccagtattccactgagattgctgagagtctcaggaaagaaaggtctaacttaaattgtattttaccatttctgagtaatgaatggattaattctatggagatatattctacagtctagaaagggaaagccaaagataaagactgttgtatttattcattagttgccaaagggaaagggaagaccgattaacaacagaagtgtttctgttattgtgtatattatcctgtttattttaaagatgcttgcttatttacattttcttttatcgctacataataatttacctatttatgggggacgtttgagtgtttgttacatgcatagaatgtatactgagcaagtcagggtatgtggggtatccatcacctcgaatgtttatcatttctgtgtgttggcaacatttcaagtcttctcttctaccttcattgaaatattcaatgtattgttgctaatgatagtcaccctagccttctgtcgaacattaaaacttacttattctatctaactgtatgtttg

SEQ ID NO: 191258 - DNA, 147 bp, Homo sapiens
gaaaccaggaatataaaatttgccttgaaagttcaagattatagaagaagcagtagccatattatgccaaataagtgaatcataacttgttctataacagaaaggcagaaaatatattaacctctgcttagcagaaaggaagaatgg

SEQ ID NO: 191259 - DNA, 258 bp, Homo sapiens
ccatctgctgtctttccagatttccggaagcaccagtgcattttatgctcttaaaaagtataaagagctctataaatgcaagttaataatacaagcagtaatgattatctgaaaacttaattcttacctgaggacccgattgcccgtgaactaccaatcatatatgcacttaagacgttgtacgagctctataaactgcaagttaattatacaagccgtggtggttatctgtagccttgtttcttgccttggtacttt

SEQ ID NO: 191260 - DNA, 516 bp, Homo sapiens
ctgaggatccccgggagtagtccaaatcactgatgctttacatgtgttggtggccttctgtctccagccctttaacttttcattctaggaggagttttaggcttcctaggttatcttatctttctcccctgggttctttcttcactttctgtgattcttgtataattgaatatggccatgctaattttacaagtcaacaggagctcagaaatggtgcataaaaatgaaggtcatgtagctaacgatgtcacaggtgaaggtaggagtgagtcctatatgttttagacttctataagcccagggagaaaactctcttttctaggcctttgacatcctcagtcatttttatacaccatccccacctatctgtattttgcacgccccattatgcttagctggactgatgacagtcttcctagaagctgtaaccctttccacatcgattgcactctttctgtgtcatttctcccaggtagagtcaagttggacttactcccggggatcctctgagtcagt

SEQ ID NO: 191261 - DNA, 389 bp, Homo sapiens
gaaagggaatggctagttgtattcgtcagagctgtagcaggaaaaagatgccatactcaaactgggtaatttgaagagcgtgtaataacagagtagaatggtgcttcctggggctggggggaggaagaaatgtggaggtattattcaaagggtacaatattacagttacacaagatgagtaagtcctacagagctactgcaaaacacagagcctatagttaacaatactgtatcgtagacttcgaagtttgctgggagggtagatttatgttaagccctatcactaataataaataaagagggcagcaggaaacagaggtgatggattatagactgtggtaatgggttcaccagtgtacatttatctgcaaactcatcaagttgtacac

SEQ ID NO: 191262 - DNA, 151 bp, Homo sapiens
cttaactttggactggattcacttataagagtaaattttccaacttgcaactgtctctggatatgagattcagaacatccagtggattgtattcatgtgaaaagaggacaatctttactgtcgtgcaacacgaataagggatcctctgggc

SEQ ID NO: 191263 - DNA, 541 bp, Homo sapiens
cttaactttggactggattcacttataagagtaaattttccaacttgcaactgtctctggatatgagattcagaacatccagtggattgtattcatgtgaaaagaggacaatctttactgtcggctgggtgtgcctgagtgtcaaaacctcaactgtacaatgagcctagttagaacattccctgtaccaaccgaggaatttataaggttcccatgagagtcgcaatcttttgtgactgggagacaattgtaatggtatcgacccataatcgtacctgtggctctatgcccagatatgagagttaacacctctataatgactgggtccagatatgagagttgttacctccctataagctaggcttactaatgagtcaccacctcagctgttgcctgatgttcacatatgacagtcacaatttcaactctgcactgcatccacatgtaagatttaagacctctccagtaggctttgtccatggatgagggtgacaatcttaacaattggcaaagtgtgcatacataaatcacaatcccatct

SEQ ID NO: 191264 - DNA, 542 bp, Homo sapiens
tagtcttttgaaggttttacatgatgttattaaatacgcagaatttgattctcagctttaagctcttaggacctttttttttttaactgattctgtttgttttatagtaaattctacattctgtattgccttactattttttaaatatattttatttgttaatatagtttcttttttaaccattgctgctattttgaatttactatctagttacctctttccttatctaaaatgaaaaaagtggccgggcccagtggccaactcctgtaatctcagtactatgggaggctgaggcagacagatcacctgaggtcaggagttccagaccagcctggccaacatggcagaaccctgtctttactaaaaatacaaaaatcagccaggcgtggtggcatgtgcctataaacccagctcctcaggaggctgaggcagggagaattgcttgaacccaggaggtggaggttgcagtgagccaagatcaagctactgcactccatccagcctgggcgacagagtgtgagactccatttcaaaaataaata

SEQ ID NO: 191265 - DNA, 2721 bp, Homo sapiens
ggcacgaggaagctgctgatgagagctgctgctgaataaaatcaacttttacctgcctacggctccctgagtgttctttctgctcattcacccactcccctcggacttcagcatgggctggaccttgaccacaggatctgacaattggccatgaggatgggatgaggtgagtgggtcttcagcccctgagggctcctgggtcggctatgtggccgcagcaagagctgtggtacctggtggcagtggtgctgcttggatgggtcccagtggaaacgtgggagacggtgcactggtctcccatgagtgtggagaaggagctgaagcacctggaagtgcacagcaccgagaagtatgcctttgccgcagagtcagatgggcgtttgtgactgtgctggtgggaggtgcatgcccagtccctgcgggacacagcacagggagaaggaagaaaccccgttgcaggctcgcccagggatgcaccggaaaatagagcatgagcagctgttgggccccaagggtgggcccagagcccctctactgtggtggagcacacttcctctggtccctgtgcccccgctgagttgtgggagtgaagtaagtaatgtcggcagtcatgtacaaacttactgcaagtcattcgggagaaggacattgctgcgcaacccggtcctgcccaagagttccagttcaaaaagtacccgctgcagctggcggaagtgtaaagccttttctgtttgataagagaactggccgagatgcctggcttgtgcggggcaccagacaaccagagccacatgtggacttggcaatctgctggtccctgaatctgcgtaagttttcaggcagagctgcatttattaatggctataaaggctggtcagtgaaagtgaaacctctgtctctgcatcttagcattggccgcttggctctccgcttatgccctgtgtatgtctctcccatacctgaggacactccgggggcggatgttttgcatggctcggcagctgtgctgtctgtcacggacttaatggaccatttgacaacggaactgagacaatccaccgagagcctggaacagtttgccttcatgggagggcgacaatggacttttacagtgttgctgcggggctatgtgcatagccccatcgtgtgtcatgattttgttaatgacgttatgttaacttccaattatcttgcaggtttagaagcggtaacacccccttttgcctgagattgggatgataaggctgagacagcctttctaaccaaggatgcccatttacactagatgtacatgtaatcacagatagttttggctagggcctatagcagtgcatggaacgcttggaagctccagtgggctgttagtcccaactatggaagggagctgagctctggtattccttaataaagaagcagtttaatagcaggattggtgtgttcatggataaccactacctcggactgggaaagcagttggtaactgtatatactgcccttcaggctcataagagtgtggcgggatgggctacagtcgtcgtgcagatgacttacctgacagcagggtgggtgtgttcatgggttacaagccctcaaactgggacggtacagacatccactttagcgaagtggagcgctatttagagcagtaaagtaccctgagtacaagttccttaccagcagagttacaagagattttagggtctgtagccctaatgcaagataaagccatggggcctgaggcacccctagaccctgagcctttaccataaggaagggcatacccccattcctgatgaggcatggtatacagatagatccagccagagtactgctgctgctgcagtattgacaacagcctagtactgacaccatatggtttaaaaccaggtgtgggtgaagtagctaataagctaaactcagggcagtatgagtggtaatcaccaaggaggagacatctgtggtaatctgcatcaatcaccagtttatcaaagcctatgtgtatgtatcgggcctgtgtgcccaaacctgtgtatcaagcttgcatgcccatagcttgtgtgtgaggcttatgtgtcaagcctatgtgtatgtatcgggcctgcatgcccaaagttgatatgtcaggcctatgtgccaaacctgtgtatcaaacctgtgtgtcctaggcctatgtctccctcggcctagagggtggagtgtaaggtacatgaatgtgctttggtcaaggaataggccaaggcagatgtccaggcctgcatgactcagtgagtttggggcacaggtgcacacctccatttgttatataacctgtttgtgtaagttcatacttggctctgagccactatcgtctgtaaaaggtataattgccttgctaacaccgtacaggggctcttgaggctcggcttggctcaacatggcttaacacagcgggtgcactggcacccagagaaagagagaaagagaaccagagctgtccttcttgtaggtggacagaggggagccacagcacggctcgcactggtgcccagagacagaaagagtgaagctgttgaccctgaaggcaagggagagctggccatgcagctgcaggtgtgggggcggcgggagccacagagccccagcaaacagccgagataaaggtgagcagtgtagagagctagtgtgaggaagctgctgatgagagctgctgctgaataaaataatcttttacctgcaaaaaaa

SEQ ID NO: 191266 - DNA, 2618 bp, Homo sapiens
ggcacgaggaagctgctgatgagagctgctgctgaataaaatcaacttttacctgcctacggctccctgagtgttctttctgctcattcacccactcccctcggacttcagcatgggctggaccttgaccacaggatctgacaattggccatgaggatgggatgaggtgagtgggtcttcagcccctgagggctcctgggtcggctatgtggccgcagcaagagctgtggtacctggtggcagtggtgctgcttggatgggtcccagtggaaacgtgggagacggtgcactggtctcccatgagtgtggagaaggagctgaagcacctggaagtgcacagcaccgagaagtatgcctttgccgcagagtcagatgggcgtttgtgactgtgctggtgggaggtgcatgcccagtccctgcgggacacagcacagggagaaggaagaaaccccgttgcaggctcgcccagggatgcaccggaaaatagagcatgagcagctgttgggccccaagggtgggcccagagcccctctactgtggtggagcacacttcctctggtccctgtgcccccgctgagttgtgggagtgaagtaagtaatgtcggcagtcatgtacaaacttactgcaagtcattcgggagaaggacattgctgcgcaacccggtcctgcccaagagttccagttcaaaaagtacccgctgcagctggcggaagtgtaaagccttttctgtttgataagagaactggccgagatgcctggcttgtgcggggcaccagacaaccagagccacatgtggacttggcaatctgctggtccctgaatctgcgtaagttttcaggcagagctgcatttattaatggctataaaggctggtcagtgaaagtgaaacctctgtctctgcatcttagcattggccgcttggctctccgcttatgccctgtgtatgtctctcccatacctgaggacactccgggggcggatgttttgcatggctcggcagctgtgctgtctgtcacggacttaatggaccatttgacaacggaactgagacaatccaccgagagcctggaacagtttgccttcatgggagggcgacaatggacttttacagtgttgctgcggggctatgtgcatagccccatcgtgtgtcatgattttgttaatgacgttatgttaacttccaattatcttgcaggtttagaagcggtaacacccccttttgcctgagattgggatgataaggctgagacagcctttctaaccaaggatgcccatttacactagatgtacatgtaatcacagatagttttggctagggcctatagcagtgcatggaacgcttggaagctccagtgggctgttagtcccaactatggaagggagctgagctctggtattccttaataaagaagcagtttaatagcaggattggtgtgttcatggataaccactacctcggactgggaaagcagttggtaactgtatatactgcccttcaggctcataagagtgtggcgggatgggctacagtcgtcgtgcagatgacttacctgacagcagggtgggtgtgttcatgggttacaagccctcaaactgggacggtacagacatccactttagcgaagtggagcgctatttagagcagtaaagtaccctgagtacaagttccttaccagcagagttacaagagattttagggtctgtagccctaatgcaagataaagccatggggcctgaggcacccctagaccctgagcctttaccataaggaagggcatacccccattcctgatgaggcatggtatacagatagatccagccagagtactgctgctgctgcagtattgacaacagcctagtactgacaccatatggtttaaaaccaggtgtgggtgaagtagctaataagctaaactcagggcagtatgagtggtaatcaccaaggaggagacatctgtggtaatctgcatcaatcaccagtttatcaaagcctatgtgtatgtatcgggcctgtgtgcccaaacctgtgtatcaagcttgcatgcccatagcttgtgtgtgaggcttatgtgtcaagcctatgtgtatgtatcgggcctgcatgcccaaagttgatatgtcaggcctatgtgccaaacctgtgtatcaaacctgtgtgtcctaggcctatgtctccctcggcctagagggtggagtgtaaggtacatgaatgtgctttggtcaaggaataggccaaggcagatgtccaggcctgcatgactcagtgagtttggggcacaggtgcacacctccatttgttatataacctgtttgtgtaagttcatacttggctctgagccactatcgtctgtaaaaggtataattgccttgctaacaccgtacaggggctcttgaggctcggcttggctcaacatggcttaacacagcgggtgcactggcacccagagaaagagagaaagagaaccagagctgtccttcttgtaggtggacagaggggagccacagcacggctcgcactggtgcccagagacagaagtgagcagtgtagagagctagtgtgaggaagctgctgatgagagctgctgctgaataaaataatcttttacctgcaaaaaaa

SEQ ID NO: 191267 - DNA, 329 bp, Homo sapiens
gttgatcttccatctcattctcttatgagggaagcatttgagtagtggttctcaaactgtggtcccagaaccaggtaccatcagtattacttgggaacttgtaagaagtgcaagttcttagccctgtcccaacctactacatcagaagttttggatctggagccagcaatctggcttaacatggtctccaggtgattcgtattcatgctaaagtttgggaaatcaaaccatgttagaaatctttgggaatcagaagcagctgctgcaattctaggctgcaaatctggtcactgacttgtttccaggtctcttagtttgggcccttccta

SEQ ID NO: 191268 - DNA, 387 bp, Homo sapiens
caaacatcacaatttccatcaacacatttccttgaaggacctcctgctttcctctgggtcttctgggtattctcttcctgatttactcagagatcacagcttttctgtagaggcaacagttcttgagtcaagaatatcgatcagtggttgtctcttttcagacgggataatctacctcagcattattcttatgtatgttctgcaaaaaactagtgagataatcagcaacaacaaaaaggctccatggacaatactcactgcagatatgactctcagtgcacaaacttaattatacagggaaatatcacattcttctattttcatgaatcaacctgattttagctctgatctgccatccctccggattgatgggaaatttcaagtcgg

SEQ ID NO: 191269 - DNA, 507 bp, Homo sapiens
gtcctttagaggaaaagtttgccatcccctgtattatatgcttatctttacccatccataagtgcaaaaggtattctccccaccaagaagagcagcacgtagaaatgctaatgagacatgtaaatcactctccaaaccatgtctctttcctgggtggtccaacagaaacagcataggattccagaaggacaaagggaagccacagcttcgataaaggactcaaaggtaccaggggtaggaagagatgcaatatctcaacacaaaagccctgcaaggccagtgaaaaaaggctagtaagagcaggaagctaacagtgaattagcgccaagtgagtttagttattgctcttatagccccagctgttacagactaaatccactacacactgatggtacttggtaggttgttctggacatttctaatgcctctttgccataacactcatacctaaggatcaagatcagtttacatccatgtgtcaaagccctccaatatgtctgaagtgct

SEQ ID NO: 191270 - DNA, 231 bp, Homo sapiens
ttgagattacaggcgtgagccactgcgcctggccaagaaaaccctttcaatactgttttaaaagagttgggggaagaggtagaaatgaatcttttggtttagttttttaattctctaaggacaacattggggaagtgagctttagagttatatttgcagtatttatttttatcatgaaatattcaagtctaggcccttggtgaattgaggcctggtgagtatttctgcttt

SEQ ID NO: 191271 - DNA, 288 bp, Homo sapiens
ggggattgtgtagggaacgtgagcactgtgcgaggagccttcccacacccaggcagtgacagaagagtgtggtcatggtggccggtggcgctgggggatttattccagggaaggcaagcttcccagcttaacagcctgggcaatcccaccagggggtgctgcccccaggctaggcagccccccagcctcaggcagggtccagggatgagagcgcctttctttaaatatcaccaggcagtgactaaagcatcccccttattccccagagacagagcccgcaatgcacct

SEQ ID NO: 191272 - DNA, 552 bp, Homo sapiens
gtattcctgagctatatattatgcatagtaatttcctttgagatcctaagcttgagtatagcttaggattctccacattttgagtatagttaagaagccacaaacatcaaaacttataagcatgattgtgttttctttttctggaattatttatgtaggaatgaattcaatcaacaaacatttaaagaacagcttctagtaataaggtactttttaggcaacgagggaaatataggagtaaaggtaatacggctttgccgtacaccaactagaactttcttttaacttcattttctatatggaattttctatacagaattgggcactaatttatctccttatgacaatagttgccctcaaacctcgattctaacatgattgtgcatcctgtgttgaatgtcagaatattacttttctaaattttaaaacgttcatagtctatatttttgggggttattatgttacagcctttgaagatgggaaacctcactggacagaaataagttatgctgttctttgccaatgcttgtttcaggcatgtccctctcgtga

SEQ ID NO: 191273 - DNA, 297 bp, Homo sapiens
gttcagccaagctctttcatccaacactgtgaccctgatctaataatcggtgctctttgcttcaattctccagctctaacatacttggaaaagttaaaacggtgaatatctactgattactagttgctggaagacgtaatatgtacgcattttgagttcgttggaagaaagatgctagagaaatgcaaacaatgaaatattaaagcatggcatgacaggtctgcagatatgagactcttttttttttttttttttgacacggagtttcactcttattccccaggctggagtacagtg

SEQ ID NO: 191274 - DNA, 985 bp, Homo sapiens
gatctagaggatcaccggaatgtgtggtgttatgcacagataagtggagccatcatcacaatgaattttagagcattttcatcacttcaaaaagaaaccccaccttctctagctgttaacatcctatagactcatcccctactcaatcctaagcaaccacaaatctgttttctgtctctataaactttcctattctgttttcatctaaatagaatcatacaataggtggccttttgtgcctggcttctttcagttggcataatgctatcaaggttcatgtacgtattggtactttatttctttttataaccgtataacattcaatttcatggatataacattttgtttatccaataatatttttattgacatttgagttgtgttcagcctttggctattttaaatactgctgctaaaaataattgtgtacaatttgtgtttgaacacctctttccaataatctgggtgtatacctaggaataaatttctgggtcatatgacaattctatgtttaatatatttagaagccatcaaattattttacagagtggccataacaccacacaattccggaattgtgtggtgttatgcatgaaaatttaaagtatatcaagttcagccaacactctaagctctagtcacctgctctattcaatagtcctgtcccctagagattatcttgtgtttcaagtatttgcttacttttcatgggctttatacttttggctgaaaatgttgctgcaaagatgtgggcaggattaaatgaccacatgaggtttcaaagggctcccagtaattctccactcccaaagaggctgacacctgatctttgaaaggcttctgcccaagcattggatttgaggactggaaagggtatccgccttcaacctatcattttacagatcaggaaatatttacaaatcaggagcagagagagattctgtaacatattcataacaccaccagtccatgccatggtgaagac

SEQ ID NO: 191275 - DNA, 623 bp, Homo sapiens
tctttaatcatcttgaatagattttgtataaggtgtaaggaagggattgagtttcagctttctacatatggctagccagttttcccggcaccatttattaaatagggaatcctttccccattgcttgtttttctcaggtttgtcaaagatcagatagttgtagatctgcggcgttatttctgagggccctgttttgttccattgatctatatctctgttttggtaccagtaccatgctgctttggttactgtagccttgtagtatagtttgaagtcaggtagtgtgatgcctccagctttgttcttttggctcaggattgacttggcaatgcgggctctttttttggttccaaatgaaatttaaagtagttttttccaattctgtgaagaaagtcattggtagcttgattgggatggcactgaatacttacaaagtaccagacaagttttaaatgttttatatgcattaatttatgtaatcctcataacaaccctatgaggtaggtagtattatcatccctgttttacaaataaaattgagggagttaagtgctgtatgttggctgaggtcacttggaaaaggtgtggtctttaaacacttatatgtacttggcctggtaata

SEQ ID NO: 191276 - DNA, 204 bp, Homo sapiens
agctgttctttcggaatggtcaaggactgaggtcagtttatataatgaggcacactgttggttaagctgatacaccgcttcaacactgcattcagattaatggtttctattgagccacttcttttctctttgcctaaccttgcatcaatagcacaattaccttcgttactttagttttataatatcctaatattacaagcccac

SEQ ID NO: 191277 - DNA, 345 bp, Homo sapiens
aaagctagaacaatctgagcaagaaaataaagtagtactggattataaaccaaagcatgaaacaaatatccatgagtccaattacataaatatatgactgaatacacagacaaatcttaaatgaagaaaaacttatttatgtaggtattttatcttcaaggaagtggaacacaaccttcactctttaagtgtgcactgtgcaatgacttccttccaaagagtacagtatgaaaagcgtgaataaagtagtaacttaacaatgaagaaatttgacaagccctatcttagccaggtaatcaagtttacagtcaacagaaataagtcatgcagaacagcatgtaccct

SEQ ID NO: 191278 - DNA, 161 bp, Homo sapiens
gatcacaaactggtatctgctgtgaaagttaagaagcacctgctatgagggagtataaaaaaggggagaccaaattttagagtggagagaaggggcctaggaaagacttttctgtataaataagatttaagctgagatttgaagagtgcgtaggtgttagt

SEQ ID NO: 191279 - DNA, 552 bp, Homo sapiens [sequence omitted]

SEQ ID NO: 191280 - DNA, 669 bp, Homo sapiens
gtatattcctagtattaataaaatatagcattattttattacatatttattaaccactaacacaccctgttttcccccaactctcaatgatgactctgctttataatgaaatccaagtcaccaaactggaactctctcatttatccaagcaaaggaacaaactttctttaatgtgtactctttcctgagacagtagaggaagtttttctctttctatccaaagcaaatccatctgtttgtgccctcgagttcatgccctttactttataaaagactgagttacttctgataatttctctttctcttgactttttgatgctttagtctctactggatcattccagacagagaaacagtatgctttattagctatcatactttaaaaaatttcctgtggtctgggcacagtggttcatgcctgtaatcctagcactttgggaggctgtggaggcaggtggatcacctgaggtcaggagttcaagaccagcctggccaacatggtgaaacctcatatctcctaaaaattaaaaaattagccaggcgtggtggcaggtgcctgtaatcccagctactcagcaggctgatgcaggagaatctcttgaacccgggaggcagaagttgcagtgaacggagatcatgccactacactccagcctgggtgacagagca

SEQ ID NO: 191281 - DNA, 455 bp, Homo sapiens
actttttttttttttgagatggagtctcactctgttgcccaggctggagtgcaaaggcacactctcagctcactgcaacctccgcccccccgggttcaagcaattctcctgcctcagcctcctgagtagctgggattatgtcacacaccaccacacctgtctaatttttatatgtttagtaaagacagggttttaccacgttggctaggctggtcttgaactcctgacctcaagtgatccacccaccttggcctcccaaagtactgggattacaggtgcacgccgccaccctcggctaattcacattcactttttaattttcgagtatcaatcattaaaaaaaattcctttcatacataaatacatgttgatttccaggatttcaaaccatctacttaagttttatgccttaataggagttgctattcaggactttaaaaagattttcgaacctt

SEQ ID NO: 191282 - DNA, 326 bp, Homo sapiens
gttgctatagtaactgaaacattggaatttcctgagatttgaaggcttttatatccttaaccttaaaatgatgataatgtagattttgactgtggacttggtctttgcttgtgaggaacttacgtatatcgagtattctatgaatgctaaggtgtgactgcacgttccataaatacagttttgaaattcaggtttctaatatcccaactgattttctcgtctatgtgtacaaatctcggtggctaagatgttattaaaacggacagcctttctgtaaagagaaagggagaatttgaaggggaaagcgagagaagtggaactctcct

SEQ ID NO: 191283 - DNA, 236 bp, Homo sapiens
ttaacattcatgggtccacaaagctgaaagtactcttgaaaaataacctttccatttcagaatttagcaagttgtataacaaataatgaagaattgccaaatagaagaaaaagatgaaaattagaaagtctacctgggatgctaaggaagaaaaataatgttcatctttctttcttctttttttttttttgagacggaatttcgctcgttatccaggctggagtgcagtggtgcga

SEQ ID NO: 191284 - DNA, 795 bp, Homo sapiens
gtcatttgtaacctgatgcgtccaccctactgctgtgtccggtttccattggctggaacgggacctcatattctgtatttgtcctgattgggaagcaacttaaaactttttaaaagaggcgaaggcagaagagaacaaaggaaggagaaagtaacttgtggaatggtgagaaaggcatgaggcgaattctcagccatgacaaggctgaaggccagcaggaacaggctctagcgaaatgggtgctgtgtccccttcctgcatgtggcagaaagttgcaaagtttcatggatttgaatgtgaacatctgttccctggacgcactgccaacaacgtggtccaactggtactcatcgttggaactaccaagtcaactaattttttttttttttttgagacagagtcccactctgtcgcccaggctggactgcagtggcgcgatcacagctcactgcagccttgacttccccagggtcaggcgattctgtcacctcaggctccctagtaggtgaagactacaggcagacaccaccacatctgagtaattactttttgtagagatggggtttcgccatattgcccaggctggtcttgaactccctaaggtcaagtgatccacctgcttcagcctcccaaagttctgggattacaggcgtgagccactgcatccagccagtcaacttttaataaggtccttgttaggtacagtaagggacatgagatgaaaaagagctggactgtcttcttggagcttacaggttagttagagaagatattaaaagacagatgagatgggcc

SEQ ID NO: 191285 - DNA, 513 bp, Homo sapiens
ccattggattgttttacacacactgtgtatgactcatgtcagagaccacagaggtggggcctgtctatggcagtcctctgagattggcttggcatgcgtgggtcttagggaacccaggccaagtgtcagggatgagcttcctctatgctcgcatcattccagagtcccacagtcactgacatcacattggattcctctttccctcctttaaaatgtttgtcaatagatggcttctcctctgtgagtcttcatgtggcaggccaggtctcactaatgcaggcctccatgacaaccgtttcagtactgactgagtggcgaagttaaatattaaaagctgatagagccagtgccctatacaaatgctggaatgtaacaaaagcccaccaagagttctgccctggcctttcctgggccttgaagcatgacaagataatgaggaattttccacaggacccgtttgggattatacaggttttattgggggtctgaagaaactccccaggcctccacagg

SEQ ID NO: 191286 - DNA, 465 bp, Homo sapiens
acataaacccagacagtaagcaattgtcatggaaagataaatccatgtgactatatctctgaagcttaagcaaaactagtttacatgaagcaaaacagtttattaaataaccatatctaaagcagccctttgttttgacaataagtaatttaatcatttttccatcactgtggatctaaaaggtatgttaaaatgttatactccgccaggtggattaatatggatttattaaattatgcttagactaacactgcttcctggtcattgtagttccaaattaaagataatgataggtttagagaaataattgtgctcaattattactcaccaaaaattctgagttctcactgcttgatgacttacactagagtaggaaggcagacgatacacacagcacattcataaactgggatttaaccgagtgaaaattgaactgaaagaacattaaggtgtcaggcgagaaga

SEQ ID NO: 191287 - DNA, 842 bp, Homo sapiens
gaaagcatttgaggatgtcatacatattaagaaggtgttgttctgtgaaatgtttgattttatcacggtttcaaatctctataatatacataggatgtgcacacgggatcaagatgtaaaatctatttctcaccgtggagcagggttaaaacctgacagccaccatcctatttccatgtagaaagaaggtgacccccccacctctgagcaagaggatctggaggtaacaagacccattcgaggaatgaaaaagtaaaccaagaatccccggggtaccaggttggaacgaggccttttcttcagctgaaccctgaggtgctaagaggtcatgcccaacaaagggaacccaggaggtcctgacgttgttccctattttacttttgcctgaattacttcaggacaccctgtgcttcctttcccaacttactcatcaactgtgcaaaaatggccaaattgtgtaccctttccagcttctgtccaacatctgcagaatgaggctagtaacacccactttatacagttgtgaggaacagggacaatgtggcaccagccctgtgcagagacgctctcactcacttctttcttcctttatttcttcactctattattgatcaaatgtttacatataatgtaccttgtgtgagatattaaccacacagtggtgcgacatgatctctatccttttgtaaagacaaaaattgaccaaaataaatgcaaatgtgtgactgtgacaaaacctaattttgaaaattaaaattggagtactgaaaatttaaagtgcaattgaggaagtcaaaggtaaattttagaaaaccttccagaacatggagaagaaagagata

SEQ ID NO: 191288 - DNA, 657 bp, Homo sapiens
accctctccaatttgttcctcacagtgcagccaaagtaatctctatcctatggacatttttaaattatggaaaatgtgaaatatataaaagtagtaagttatataatggactttcatgtgcccgtcactcagcgttagtacaattttgtttcttcagtaacttcatctacctctgcttcctgccgcctagattatttcaaacagatcctggatttaaaagagtgatcttttaaaaacttaaatcttgaaactttcctgcattcctcctgtggggtctcattacccttagaataaaatctaaactctttacatagctctaagacttggcctttgctcccttctgtagcagcatcttgtatcattttctagccacattggaggaagctgttggcctcctcaggactttcatacatgcatttccttttgcctggcatgctcccttcttccttggcttagttggctgtttcttatctttacggtgtcatctttattaaagaggcatttcctgatggttttaaccgtgtgtcacatgtttccctttcaatgacaaaaatgttgacaagtggtgcatctaggtgaagagtgtactagtctttgaacttttcactagatttgaaattactgggcagagaaattagtttgaggggaaaagacccg

SEQ ID NO: 191289 - DNA, 433 bp, Homo sapiens
aaaaaaaacacccttgctttgcatatgttggtgacaggaatgttaattttaattaatccttataattaagcattaaaagtgtttcttgctttcttataagtccctaggaaataaatcagtatatctttgactttataatttaccagagaggagttactcaattatatggaatctatacatatgttgattttaggaatttattgaaagaaaaaaaactttctaggtatagtgtgattttatttaattttctggttaagtgaagatcttacgcagatcatactgaaaatgtgctcattcattcatttattcaaaaagaatttattgaaagcctaccataaggcaggaattgttccatgtgtgtaagacacaccagtagacaaaacaggaaaaaattcttaccctcatggagcttacattccagtgggggagagaa

SEQ ID NO: 191290 - DNA, 348 bp, Homo sapiens
tcttttctcaggaacttctgggagccaaatcaccaccagctcctccagaaaagatacctgtgcacacccaaaaccaccccactgagccctgcctggggtctgtaccacatccagcatgtgcactgtgagcatagaatccggccctgaattcatgaccacccaccaacatgcccccaactgaaaccagcaaattcccacacatggcaagcactgaggcttggaggtgctttctcacgaggtggttctgcttccaccatggggtggttgtcactgacactggaagttgctcagcacctgatagtggtgcaggactcagggaccctcaacatcaatctggtgaaggcagat

SEQ ID NO: 191291 - DNA, 210 bp, Homo sapiens
ggaggcaaagcggaagaacacggagagctgatgcacaggggcccaggcttagatgtctttccacactggcccacatgtcaggagtaaatggaataatctgcagaaggttctactgacttaatatgaggtatattaagattaaaaaattatttttttgcttctcactaaaatagagtggagtaaaccatcctttggccgaacggtcaggat

SEQ ID NO: 191292 - DNA, 509 bp, Homo sapiens
aacagtttggtaattaaaactgggttacacaaagccttctgtgtgtgtgtgtgcacatgtatatatgtgtatatttttcttatctatgtatatagcttttcttatataatagaaatgctcccttgaaaaatatttgaaaagtatgaatggacagcctactatgtgcaattgctatgtaatatggtcatttacacaccacacaccctatccttaataggaagtcaatttcttaaggatgggatccacacatgacacttaatattttgtcttgtgtacgtggtagcagaaaaaaatattttctgagaaaactaaatgagatttgggttctaattcgccttccatcacttcttagccatgtgaccatgaaaagacagttaaaactttgggtcacaagtctatcatctgtaatccaggaaaactgtgctgggatttctgggcctatgattaaagggagggccagccatgtcctagagtttctggtgaccctcttccaaagtagcaagacactt

SEQ ID NO: 191293 - DNA, 603 bp, Homo sapiens
atttaatccttagaatctataaaagatctctagtcttgcattggcagtagctttgactgtccattctaattctaccccaatagtttatcttatttacagtttttatttatagtttcttttacttagtagttattacaataaataacattgactcaatacaactatctaagatagggcccttattcaaaatgcctttttaccagctaaaactgtttaaatattgctaacacctgaaactatagttcgaacacaggtatttatgggagcagggaaaaaagaacaaaaaacagttaacaagcatattctgtaaaaattgttaggattttgtttgttttgcttaatacatttttaaaaaatgttcttcctcaattttttactttgaacaatttcaaacctacagaaaagttgaatgaattagtacattgaaaccccatatacccttcacctagattcaccagttgttaacgccttggtgatattttccatatctatgtatatgtgtgggatgtgaatatatttctttttctttccgtttgcttcttggctaaactgtttgagacctcatgatacttcacccccatatatatcagcatgtatctccca

SEQ ID NO: 191294 - DNA, 216 bp, Homo sapiens
atgtcattcatccatccatgtttccaccaactatgttttaggcattggttccagacatctggcgatgccgacttgaattagacatatgtggaccttccccataaagaagccactgtaacaaaacccgccagaatcttcctaatgccagggctcctctttcctgcccccgtgtcaaagttgtggtccaattctcagttatccaacatgaggaagctg

SEQ ID NO: 191295 - DNA, 270 bp, Homo sapiens
ggtgtcagtagccgtgtctcatacgcagttaggttcagttgcttgtttaactactgtgttgtggccacatgttatagctatgtgtgtgtatgtagctgtgaccgtaggcacttggttgcatgtttgaagttgcttctgttagtgcatgctcagaggatgtgacaaagccttaagtggctgagacttcagcaaccggcagtaaaccccgggcctgagctgcaacgtggaggatccgtcttattacaggaagtatgtcctcctctgcctaac

SEQ ID NO: 191296 - DNA, 372 bp, Homo sapiens
ttagcagataaaactcagcaatgtagaaagaatgatacaccacaactacgtggtatttatcacaggtatgcaaggctggttcaacatttgtaagttactcaaccctatcaacacctaatagcctaaaaaagaaaaaccatataattgtatcaactgacacagaaaaagggcatggagaacatcagtcttattcgtcatcactcccccaacacctaaaagcagacacacagaaatattagtgaataaatgaatgctttccatatgtcgtataaaccctatataatagatggtcaaaacccaccctatataatagatggtcaaaacccaaagaaagataaatgaaaagttattaaatgttacagaaaaatgaac

SEQ ID NO: 191297 - DNA, 494 bp, Homo sapiens
tatttgtaatacaaaaagtaaacccaaatcatgaatttctgctgtgctttccattttattcaacagggcatgaaattacatgtcttttttctcacaaccccttacattttgtctagcacagagtagatatgtaaataaatatttgttaaatgaagaaataaattcaattagacaagagaatatgtatttatagattctagtgggggttaggacaaaaaaaggggtcaggtacttcctttacatcatgtgctggaataatgatgttcattaaataaatcacagttaatcatctctgtccttggcagtatatgagctactgacaaattttctgacctaatgaatttaacagactgcaagaagataaagaatgaagtaagctcccaaagctttgtccatttctccaaatatttaattatcagtagttgtaacaagaaaaagggtgcagtctgtaggaacatgaaatcatatgcctcatgactgtcaaagattctgtg

SEQ ID NO: 191298 - DNA, 543 bp, Homo sapiens
ccggttgactctagacgatacaccttatgttctgaaccaactgaaaattatgataaagggttagagcagatagagattaaaacattcacaagctcaccattattactgatggagctgacattagataaggtggttgccttcttttccctagaactgaaaagattgactgctgtaggcatttgtcattaagcttaatgcatagctgagaacagtagaaaatgcaagatttctaagagtaaatttactccaaaaagtatcaagaagaaggggattaacacagaatgtccaggctctacttccaaatacatcaaccaaataaaccaccgcacttcagtagaacaaatgagaaaatgaagatgggcagcaatataaaggcaatggagatttcagcccttgatctagagcaaggacctagagagggaagaagtgttctccaccaacagtagctgttacttacagagagcctaatgttacttacagagagcctaatgtgtcttctgatacgctattctgagtgcttttccctcattagcttatgcagtc

SEQ ID NO: 191299 - DNA, 381 bp, Homo sapiens
caggtcggccctgcacacagttgctgagggaggggccacgtctcttgtcctcgtctgtgtctctggggtcccgcatggtgcctccatgttgagtagatgcttggcgaacatttgttggaggaaggaattcatgattcctttcaaagcagagatctgcctgtaccctctctaggagccctggccatttggtggttctcacctgcccaggtatatagtgaaactcctcagcatgacatataggccccgtgcagtctagaatgttgtccttgttcttccaggcttcttctggtctgaaattctctgctctccttcctgtagttgtaaagcttcatttttggcctggtatagtggctcatgcctgtaatctcagtgctttggcag

SEQ ID NO: 191300 - DNA, 417 bp, Homo sapiens
gcagtgggatcaggaggaagatgaggaagaggggacaggacagtggagggaaggagaagcagagcctggttgcagggtagttgacatttttctcggccgtttgtgggctgccgggaaggagcaagaagacaggaaagggttggcgctccagaggcgagagaggagaaagggacacaaaaacccatggaagcaatagggcgggactcaaagcccacgaggagggccggcccagttgttctctgtctcgttttctaagcgctgcggcagggctggtggtgaattcagataaacaggcacaaagggccagtggggtcgctagcaagatctgggacacgctgaaagttaataggaattggctgccctttgccggcgcaacccaacgtacaaagatgatcttttctgaggctccaccgccgc

SEQ ID NO: 191301 - DNA, 431 bp, Homo sapiens
tagagatagacagagagagacaaaacagtgcacacatgaagagtgagaactccaaagaatttcaaacctctcagtggagtccactggaaattccttcaaacttttttttaaaaaaataaaactattgagatataattcacatgtcatacaatttacccatttaaagtctacaatccggccgggcacggtgcttcatgcctgtaatcccagcaatttgggaggccaaggtgggaggatcactcgaggtcaggagttcaagaccagcctggtcaacaaagcaagaccccatttctatagacagataaaattacccacccaggcatggtggcatgcccctgtggtttcagctactcagaggctgaggcaggaggatcactcgagcccaggggttcaaggctgaagtgagctatgattgaaccagtcagcattaa

SEQ ID NO: 191302 - DNA, 343 bp, Homo sapiens
taggctttggtggatttctgtggatttctactgctgtttgttttcgttttcaggtgttaacagaatggggaaaggcagcaatggagcagtaagatcaaaaatgatttttatgaagatgagggttctattgatacatgatgggggaaaatgatagcaggaaggcacttccccatccccctcctcttagcaagctactgcatttgtacagtatttctgttcttcatgtcattgtgacaaaggacttgagatggccactcagcttactattgaccttcccctgtactgactactttgatgacgggctggcccatcaatgaccaactaattggaactgaaatgagat

SEQ ID NO: 191303 - DNA, 723 bp, Homo sapiens
cctgagaaatctttggcggcagcaatagcacttgtcccattgtgagtggcatttttttcaaagtgtcattggactgtgaaagctacttaataacttgatctcatctgaataatctgagttaatactagcttcacagttgtgaggattaaataaaaaaaaattgtaaagtgtctgcctcaaggcctggcacagagtaaatctcaacaaatgctcgttgaatgaatgaatccatgaatctgagcattaaggcccccctcaccgtttccaaggatcagtgcataacagccccggtaactgagacttgtagactgtcccaactgagcctgcagcctgaggcatgatctaaacctgctgttcctttgacaaatatttgatgagttatggtgtggagggtggacccttccatgaaggccttgttggcctagctgttggaagcactatgcagacagtcttccagggtgggaattgcctcagagagcaccttgcccaaggtcaaggatagcccacattcaatggcaacaggtgtgtaacggcctggccttcttagcttattttgggtcaactctgaagggccattctagcttcagagctccctgtggggttggctgaggctgtcactggcttgtcttgtagatcagcctcttcctctggccactcctgctcattctcattcttccacagctgttgatcccaaaggaggttcttaataaacatccagcacat

SEQ ID NO: 191304 - DNA, 202 bp, Homo sapiens
tcggatggtgcgtgatactggcagtgactcttcttcctccctagattccctgccctcattctggtctctttatagcaacactgtaactcctgtcttctgcctggaaggcctgggatggcttgagcgctacactgggaggtagctaaaggcctcctgcgttctattttcagctcccctgccttgtgcgtgacctttggccgaa

SEQ ID NO: 191305 - DNA, 594 bp, Homo sapiens
ttcaggttctgtcttgtgagcttgaacaagctatttgcttttatataccaccacttccacaaaatgggaaaatggggttaatacaacagtgaccctgctacaggcagcgttcgaggattaaaggagttaaaatatgtaaagtgatcagaatcatacctggaacaaagtaagtgctatgtaagtactggctgttattattattattgttttgtttttgagacagtcttgctatgtcgcccaggctggagtgcagtctcagctgactgaaacctccatctcctgggttcaagtgattctcctgcctcagcctcccaactagctgggattacaagcgcctgccaccacgcctggttaatttttgtatttttagtagagacagggtttcaccatgttggtcaggctggtcttgaactcctgacctcaagtgatccgcctgcctcggcctcataaagtgctgggattacaggcgtgagccactgtgcccagcctagatgacaattttacaactttgtcctcagatcttcaataacctacttccctatccttattcttagttgatgactgtacttcttatttcatttagaacacttaaca

SEQ ID NO: 191306 - DNA, 600 bp, Homo sapiens
tgcacatactccaatgaaaagatacaagaaacaagaagaatcagagaaaagttacacaatcaaatgaacgaactaaatctccagtaaattaccttaaggaaatgaaaatctatgaattgcttaacaacaaacttaaaataatctcaaagcagatgaatgggtttcaaaagaaaacagatagacaactgaattaaactgggaaaataatgcgtgaaaaaaataagtatatttgcaagaaaatataaatgagaaagaaccaaacagaaattctgaaactgtggtatgtattaggggggtacaaaagtaactgtggtctttgccattacttttaacggtgaaaatggcaattacttttgcaccaacccaatagtaagagaactaaaaatttcactattgggatttggcaacagatttgatcaggcagaaaaaaaggatcaacaaacttaaaggcacttgaagttatgcaatcaaaggttcaaaaacaaaaaaaatagtaaaaagagtccagtaagcttgaaaggtagtctaggtcataaagactgcaactcttaggcatgttttagggcaaaactaagctaagacacaatggacccttggtgg

SEQ ID NO: 191307 - DNA, 137 bp, Homo sapiens
gagaagatggtgatacactttctggaaagtcaacctttctggaaacgttgaccgcagggactctgggatcaggagtaccaggcaaagctggaagaggggatggggaattccaggccaaaaacaggggttaagtgaaa

SEQ ID NO: 191308 - DNA, 465 bp, Homo sapiens
ctttgtttctaccaagaaccaagttcaccaccaaaataatattagtctcttaacaacaatcctgctgacatctagtattcattcatatgaaatgtaattattggggtccttaaaatttgagaatctttgtcaattccccaggaccttaggcaaaaaatcaaggaaatgaagtgactcagtccgccaaaagtgggtattctgaaatatcactttccaacttcaagaaacacacttccctacttgtgaaggaaatgaatcttcctctctttttctcaaattacacaattggaaatttagatactctggagctcctccagctggtgggccaactaagagaaaacaggaagtgggagattctagcttggctggaccatatccaggtcttcataaggaactctctttggctgacatgtaaaaaaattctttcagcaggagcattaatcttaaacgtgtgtaaacaccaaa

SEQ ID NO: 191309 - DNA, 220 bp, Homo sapiens
gagtgagttcttcctttgttattgagtattcctgattaacgtgtagtaaaggaagtcaagaagaaaagcaagcttcagtggttttctttggaaagaaggggattgtgagagagtgatggagagatgactagtttagacatattaagttataggttaactacacccacctttatgttgcagtgaacatatatcaacaatgaataaaatgaagcattttaag

SEQ ID NO: 191310 - DNA, 692 bp, Homo sapiens
ggtcccaggctgagggagcttccatttcttttcttactccctcccccactggggaacaaacgtggcgagtcataaactggctcttaaggctcctacccgaaagtgacacttctgctcccagttaattggccaaagcaaggccaggtgtggtggctcacacctataatcccagcactttggagaccaagatgggaggattgcatgaggccaggagttcaagaccagcctgggcaacatagcaagatgccataaagtagctgggcatggtggcacacgcctgtagtcctgactactcaggaggctgggatgggagcatcgcttgagtccaggagttggaggttgcagtgagctatgatggtgccattgtactgcagtctggctgacggagtgagacccggtctctaaaacaaaacaaaacaaacaaaaaacaacaatccccagttcaggagggcagggacatccctgaactaatagctggagctatgtggtgaacagctgtcatgactgccacggtctctgtcgctgtctctgtctctctgtcatcactatgtcatctgcctctctgtttctgtctctctctgtggtccatctccatccatcaactcctgcctctataattttccccaaaaggtctgacctggtttagggacagagatggggcttccaatatttgacactggtccctacataat

SEQ ID NO: 191311 - DNA, 130 bp, Homo sapiens
taacagactccaatgcttacaggacttctgagagatgttaagaaatcaatccccattaggcaaattaaatctaaataaataacacccactctgcatcttcctggaaaaacccatcccaggcccatatggc

SEQ ID NO: 191312 - DNA, 548 bp, Homo sapiens
atcacgaaaccctgtctctacaaaaaaaaaaaaaaaaaaaaaatacaggcatggtggtgtgcgattgtaatctcagctacttgggaggctgaggcccgagaattgcaggttgcagtgagctgagatcatgccactgcattccagcctaggtgacagagcgagactccttctcaaacacaacaaaattatgtggaaacaacaaagagtgtctctaagatctctggtcaccagaaaggtactccacatgggggaaccacaaaaccaagaaactacagaatacctaagggtgttggtgaggaaatgcccaggcggtttccacataatttttcccgttgggagtggctttgaggctagttgtcacgccctgaccagcagaaatctgagcttggtccagcatcaaggttgacctagcactcttttaaatttcattttagcttttacatagaacaataaccaagggattttatatttaacttttttctgttggtttgcatttccttatatatccagtgaatcccactccctgggaggtggattcatctctaaat

SEQ ID NO: 191313 - DNA, 236 bp, Homo sapiens
tccttagaacaggcacatggccattcaaagttctccatgtctgctcttgctttcctgccttccttatctcatcaacgatttcccctttatatttttatttccagttctcacacatctctatccctttctaaatgatggttttattgctaggaaacacttttctttttctctcagcaagtttctatttgtccttcaagtgttagcttaaagatctctttgatacagccatccctgat

SEQ ID NO: 191314 - DNA, 412 bp, Homo sapiens
atgagaagtgaaaggctggagggtaaaaataccagaaggaaacccaaatctgcacagagaactgagaacactcaaaatatcagttaccaacgatatggaatgaaccaagaaaaagggaaggagcaagagagaccttttccagcaggaattggcaaactgtggcccacaggccaaatccagcccactacctgtttttgtatggcctgtcaggcaagaatggattttacagataaacatttgcaattgatgtgatgatacagaacactaattttggatcccatttaagtgaaatgttattccctcaaccaaaggaaaaaaaaaaaactacacttcttattaatagatctgtattacccaaaaatgtatttgatgattaaattttgaattttgtcaataaaaaatgtgaaatttt

SEQ ID NO: 191315 - DNA, 405 bp, Homo sapiens
ttttatttgtttatttatttattatttatttttgagatggagtttcgctctgtcacccaggttggagtgcagtggcagggtctctactcactgcagcctccgcctctcgggttcaagcaattctcctgcctcagcctcccaagtagctgggattacaggcgcccgccaccaagcccggctaatttttgtatttttagtagagaaggtttcactccattgaccaggctggtcttgaactcccgacctcaggtgatgcacccgcctcggcctcccaaagcgctgggatcacaggtgtgagcactgcacccagccccttcattcctgtgcagttttttcaactccttatgttagaacattgacaaactgaacctgaattcccatagcaggtgggagccggagagagct

SEQ ID NO: 191316 - DNA, 342 bp, Homo sapiens
gtctgtactaaaaatacaaaaattagctgggtgtggtggcacatgcctgtaatcccactacttgggaggctgaggcagaggaatcacttgaacccgggaagtggaggttgcagtgagctgagattgtgccactgcgctccagcctggcgacagaaggagactcagtctcaaaaaaaaaaaaaaattgctccagttatgtaacgaatcagcccaaacctaatgagatcaaacacatttttttgtggtaaataaaaactatcttagaggccaggctctgtggctcatgcctgtaatgctaacactttgggaggttgaggagggtggattgcttgaatccaggag

SEQ ID NO: 191317 - DNA, 410 bp, Homo sapiens
  misc_feature (15)..(15): n is a, c, g, or t
ggaccactctagagnatcccctcgtcttttgatagggtttggtgacaggagtcaagagatggagaaatcaaaggtgggaactagaatgacttggagaattgctgtttcactgaccaaaatacagagatgacaacgttgtggtttattaacaattacaccagagagccaaaaggtgcaaaagaggagctagtaaacaaatttgtttattttacagttaaaatccactcttagagtataaaatagaattttttctgaacacaagattttgaggacatgccatttttatcccctaaggatcaggaaatagaaactacagtactatatctatttcagaggcagaaattgaactcctccaatgggtaagaaacaccactcgcctatcaaaagacgagggctccctctagggtcgc

SEQ ID NO: 191318 - DNA, 792 bp, Homo sapiens
aaagaaagaagaaaaaaagaaaaagaaagaagaaaaagaaagagaaagaaagaaaaaaaagaaagagaaattctgggaattctagctttctcttggtgcatgctctcattcgattgaaatcaagcagtttctacatgaggcagacaagttcctagggtatgcagaaaggggcaatatcttggttcttgcttcaaaagagctaactgctgctgggacctacggttgagcaatgactcagggacctggctggtaaagaggaaggaagtggctatggaaagttgctgttaagtaactggagccccaaaataacataatattgaccaagtcatcccacccccaacacctaccattactgagagtaacaatgtggagatagccatgcaggctcctgggtccatttgtcacttatttgagttcccttcgttacaactcttaatgctactgaactctaattacatgacatggaaatgcatgggatgaaggagctggaggggatttgccctcaactccacagtcccatgagagagtgatttgtctttatataaatagctatcaactaaattgagatcataagagttatatctttgaagataacatataattgcattcataagaagtattcaaaatcaccatttcataaatttttccaatatccctatgagtagggattgttattctcattttaccaacgaggagtctcattactaaatgtaggaaaagtacttgatctgagtagcatgataaaaagtacacattaaaacaagaagacatattttgaccatcaaactagca

SEQ ID NO: 191319 - DNA, 432 bp, Homo sapiens
ggccacccagcgtgcggttctgttacagcagccctagcaaactcaggcacccagcaacaacagtcatgaaacacccctagcggggctccttctcttgcacatacagccctgtgcagcagggcagagatgggttttaaacaagtgagtcagacaaggatatcttattcatcactccgacgaacccatgggctgaacccttgaatcactactttatttatcatcgggctcgggctcagaaagtctcgctgaggaaatgagtagaacccaaactcgtcagctgcatttctgaaacatgcctaatctctgaggctctttcccagccacgatagaaattgaaagggaacggggctctgggctgcggcggtgggctggtgtggagacagagccctttgttctgccactccagggaccacgagggcagaagagaagggc

SEQ ID NO: 191320 - DNA, 207 bp, Homo sapiens
ttaaaatttttgtagagatggggtcttgctgtgttgcccaggctggtcacaaactcctggcgtcaatgtatcctcccacgttggtctcccaagagttgggattacaggtgtgagcctgtaatctcagtgtgagcacatactgggcttcttcacatattttatttgaagaaaggcctcctctgctgaatcaatttaaaattttgctga

SEQ ID NO: 191321 - DNA, 537 bp, Homo sapiens
tctgctgcagcaataggcacgttttgatgtggaggaaaccattactgagctgttctgttaagagcatatttgaatgttacctcgctcatcattttacagtttgtaaaagtcttagaacgtatcccgtccaactctttgttggaaaaaacggaaattctaattaaatccgagagagagagagagagagacagagagagagatgcgtgctcaaaactattgcacacccacttgcttgcacaatgttggagccatttccaggagagaaccaggaaccgggtaggggccaaccagcttcccgacttccttgtggggctgccagttccactccttcgcctttctctttgacaaacggctcccaggactatcttttcacccattatacattaaaaagctattacccagcgatttaaattcactctgcagggtcagacagtcccaccgtgccataaaagcactactttgaaaagtgtaaagcgtgatacaagtgtaaggtattgtaaatggcattcttaataaatactgtccatagtttaacct

SEQ ID NO: 191322 - DNA, 205 bp, Homo sapiens
tactctaaattcatcagagaaacactggcaagctggcgtgggagaaatcttacaagaccattcaggttgatgccccatgttcctcaaaacccaggttatctctggggtcagacaaatacaatccttcctagccctgaagattttcctccaactggggcaaaagtcaaattagatccaaaagacagtcactctccccgggatacag

SEQ ID NO: 191323 - DNA, 601 bp, Homo sapiens
ccctctcagggcgaccctgggcctcggggtgagaggtttcctacactaaaagggctgcggcccctcagtgctagaccccgagattcctttcactcgggaaatctcgtaatcgcatccattgtctttttggtaagtaaacggtgacgtgagaaattttgatggggttagctcagtcattggtgattatgtctcagtttagggtagatggtttgagacctaacttagaagtaacactgttttattcggatggcccatcctcttccgaatgttaatttactctgttcttcatattcagatttccatgcctaatttctagctcctacgtctctattgcgggacctaaaagtcgctgtttcactaagctttggaacccgactccaggaaatctcattctttcgtcccaaaatttcaaccgtaaagagaaatccgcgcggcggcctcttcaagcgcccgggccgggagcgcgggttctgaccttcggtcgccgggccggtctcccgcagcaccacgggtaagaggagcctgagcagctcggagggatgagtgcgggacggtgggggctccccctcttcctgccagtaccttgccccaaggagaagat

SEQ ID NO: 191324 - DNA, 215 bp, Homo sapiens
atggaatttttaaaagtaccagcggaaaaaacacctagaaggagtggaaagtgcttgcctctgaagaatgcaagctgcaagccagagataaagaaaagagggtcattgctcttttctttgctttttttttttttttttgggaaaaagttctcctttgtcccccaaggtaagagggcaaggcgcgacccagatgccggggggaaacctcaacctcc

SEQ ID NO: 191325 - DNA, 202 bp, Homo sapiens
aggaagtgcctgccaacctgagtcctccttccagggtgctggttctgaccttcagctcctgactcatccaaccccgggggcctggctgtgagttggtgctcagctcacaccacagctttccaaagccacgctgtcttggagggtgatcacacagcttgcctcggagggctgctgtcaggatgggttgcatgagataagtgcc

SEQ ID NO: 191326 - DNA, 510 bp, Homo sapiens
acaccaccacacccagatagtttttgtatttttagtagagatgaggtttatcatgttggccaggttggtctcaaactcctgacctcaagtgatcctctcaccttggcctcccaacgtgctaggattacaggcatgagtcactgcacccagcctcacatttttctacagtgccaaatctgttctttgttgcttccaacgaatatttgaattccatcaaaatctgtctctgaatttctttatctcgccatattcactttcaccctgagctcatatttttatcttattttattgtcttttaatctcagcttgttctctccttataatcctcccacttctgtttcataagagccatgtcttttgcatgttccctatgctcgtgcagagcatccaaggtgcccggctatccttttctgcatcaattcattatgcagaaggtataggggttagtccttgctatattatgcttggttataatttttcatctttcccttgcggtactatatctatagg

SEQ ID NO: 191327 - DNA, 340 bp, Homo sapiens
tcctaagattcttggtgtacacgttgtataatcccaactagatatgagagctatcagattaagactttgcatctttacatcccccagtacctttcagagtgtgagtgcacacacaccatttgctaaggaatgattgcagtgacaataccaagtttaggatcccttaaaatacctatatcttgggcagaggttgcattgagctgagatcatgccgctacactcagcctgggtgacagagcgagactccatcttcaaaaaaaaaaacagtccgggtgtggtggctcacgtctgtaatcccagcacattggtaggccaaggtgggtggatcacaaggtcagga

SEQ ID NO: 191328 - DNA, 260 bp, Homo sapiens
ggcccatattcacgtggagaaccatctctactaaaatatcaaaattagctgggcgtggtggtgcacgcctgtaccagctactcgggaggctgggaccacagacatatgctgccatgctcaaataattttaaaatttttgtagatggagtctcaaattcctgggctcaggaaatccaccccgcttgcctcccaaaagcactgggattacaagcatgagccactgcactcagctgagaagttctatttattgattcattgtt

SEQ ID NO: 191329 - DNA, 213 bp, Homo sapiens
gtctgaggaggctgtgaaaaagagagacaggaagaacctctcaatattgaataggaaatttatattgttctaaaaacttcatatctcccaaatttgtaagaacaccctggtttaaaataaacaggctccccctcttgagaatagagaaacagtgacaggtgtttccctaaatttccaaacctaacaacccatttagacagcctatatcaggtg

SEQ ID NO: 191330 - DNA, 320 bp, Homo sapiens
aagtgtgtggtgttatgatacagatatgaagagcttaggaagggagacaaaagaacctgaaggtgggcttgaagaatatcttggagtgggagcttagagttggggagaagagagactttaggtgagcctaggcatatcgggggaaaggaaggaaagaaatgggagaagagaggttttaggaagtttttctatgttctcgctttgggtatgtttatgaaagactgcagtaaagattaaattatttgtatgtctatttgggtcagggttgatatacctatgacacacactgaatcaagatggtgccataacaccacacatta

SEQ ID NO: 191331 - DNA, 498 bp, Homo sapiens
cataggtcacaccgtcctacatagtgtttaacaacatactcctgggccaggagtaacaagtccaggcccttgaagaaacaaaagggctgaagccaggtacacaaataaaaagaagactgagaggttgaggtgacagaatcacttgaggtcgggagttcaagaccattctgggcaacatagcaagactcatctctacaaaaacatttttttttttaattagctgggcatggtggttcatgcctatagtcccagctactcaggaggctgaagtgggaagattgctgagcccaggaacttgaggctgcagtgagctacgagtgtggcactgcactctagcctagccggtagccagtagagtgagactttgtctataaaaaacaactgaaaatgaaaataaaaagaaatgatcacttgtaaattacattatcaaatcactctatcaaacttctaaagaagttgttttattcaatcacacgttgccaagatgacaggtagtat

SEQ ID NO: 191332 - DNA, 105 bp, Homo sapiens
tgatgaaactgaggtccagaggaaggttatgcagaagagcatgagtgggaatgagtatggggaagtagacagggcctgaattggtaggaatgtgtattctgcaga

SEQ ID NO: 191333 - DNA, 206 bp, Homo sapiens
ccttgttacaatttcacaccccatattaagtaataaatgaatttactgtttcacagctatttttgcaaagtggctgtaagatcataaataaattttaatctgaatttccattctttggtggtactttataattgttcttatattgtttcacatatccatatttcctcacccttactactaccctatgttttattttcttttttctt

SEQ ID NO: 191334 - DNA, 269 bp, Homo sapiens
ttaggtagaatagtaaaaatcgtagtagcagtcttaaagggagatactacccctttccccatttgtaaagtgagtttgaatctgctttcatggcaccagaactcagctatcatctagagaacataaatgcacagcaatcccagcacctaccactgtgcctggcacctaggaggtcctcaaacacttgctgagagtaaatggatcctgggaaaagcacgcatcagtcaccttattaactgcaacaccaattaattacctggaaactgtga

SEQ ID NO: 191335 - DNA, 445 bp, Homo sapiens
attcagtcttcccaatgaaagacttctataaataaagcattttaatgtaatttctcacatgcaaagataaagatggtacaagatataatggaaagcataatgaactccaggaaaagggaatcagggaggctccaaaggttaataatagtccattcagcagatgggagtgagaacatattccagcttaacacacagcatgtgcaaagcaacaaaggcatgaaacatcacagtgggttcaggagtcacataatattgaagcataaggtatgggatggggaagtgcctgggtaatgagtctccaaagatagctctgtctataaatgggcctaaagtgccatcttaagaaactttgattctagagaaaacagggagtcattgctaggcgggtcctccagcccatcttagcttgtaaggcactgaatcaacaaggatacagaataacaag

SEQ ID NO: 191336 - DNA, 272 bp, Homo sapiens
catctgatataatctgaatttcttctctgatttatttgaatttttttgcattttgaggtgcatatataatttagtaatatcctcttgctgaattgaatccgaatgatgcaccatatcctcctattctcagggtgaatacgatgacctgggagttgtttcagtactcagctcaggaagataataccagattagtagaaagatggattattttccgagaccaaaatttacatatcctagaaactgaggaaactgagtctagctaacagtaggaa

SEQ ID NO: 191337 - DNA, 337 bp, Homo sapiens
ctggtaataccccggtgaagggtcttcaagagcactgatttggcattaacgtaatcattgtatctttgaagcagaaaagttttcaccttatatgcctttgagtgcaaatactctctttgttctattcttttcttcagtaatttctgctgtcctgatacattagatctccattctttgtcctatatgtcactttttctgtcatcactttaatctgtttttgcttttcttctgcattctaggaaggtttctcaagtttgtcatcttgaagaacactcgagtaccgatcgtcgtaccgcgctctcatgcgtcaataacggtcttcctgggttgacattgt

SEQ ID NO: 191338 - DNA, 387 bp, Homo sapiens
ttcagtctcataatgatggtctaaaggagtaacagtagtaactgttggaatgatggctcaagtagtaacagtagtaactgctgtaatgatgatctcaagtagtagttgtggcagtcagccacataaaacatatttttttaaaaattccagaatttttagttactcacagaatgcatacatagaagcataggaatgaactagcaaatatagtcaatagggttataaatttggaagaaaaaaataaaagatgactttctggcttaggatgggaaaccatatacacaagtcagtatccaaacgaatgtttctatctagtggcccattaacctataagcttttcccccccttttcctttcactctaacatataggatctttttaaagcaca

SEQ ID NO: 191339 - DNA, 226 bp, Homo sapiens
tacgtaccatctgaaactttgcaccctttggtccgctctctccttgttctcctttaatcattttaaaatgcaacagtgggcaggcgtggtggctcatgcctgtaatcccaatactttgggattacaggggtgagccaccgcacctggccaggagatgtctttttgagtcataaatagaatcatatcacttcctgctgccccttgctaatgtaagataatgtcgaga

SEQ ID NO: 191340 - DNA, 281 bp, Homo sapiens
gtgatccgcctgcttcagcctcccaaagtgctgggattacaggtgtgagccaccatacccggctgcaaaacaaatattttttaatagtatttttacatttcattttgaacaaattaggaaggaggtggggaaaaggaaataaacaacaacaaaacaaaagaagtgaagaggtaagaggcaaatagtcgaaaccttgacactgaccagaaaatcacctttcagaggtaaacctatatcacaaacttgctatgaaatatttttgttgttgttgttgttgttgt

SEQ ID NO: 191341 - DNA, 174 bp, Homo sapiens
cagcaatgtcagtgtcacctgggagggtgaatctccacccaagacctaccaggtcagaatctgcattttaacagattcccgggtgattcctttgacattaaaaggtgacatgcatgacttagagcttctgaatcacaggcctccagggcctatgcatcatctcccttaaccttc

SEQ ID NO: 191342 - DNA, 623 bp, Homo sapiens
gcagtgtgagatcagactaataaacacccccatgatttaattacctcccaccaggtccctcccatgacacatggggattatgagaactacaattcaagatgagatttgggtgggacacagccaaaacatgttattccattcatggtccctttaaaatatgtcctcacatttcaaaacacaattatgtacttccaacagtcccccaaagtcttaattcattccatcattatccccaaagtccaaatctaaagtctcatctgagacaaggcaaattccttcgcctatgagcctgtaaaatcaaaagtgagttaattacttccaagatacaatggagatacaggcattggacaaatacacccattccaaatgagagaaattggccaaaacaaagaggctccaggccccacccaagtccaaaatccaacagggcagtaaccaaaccttaaagttccagaataatctccttcaactccatgtctcacatcaggtcacgctgatgcaagaggtgggctcccatggccttggactgcttcacccctgtggctttgctttcacaagatggcattgagtgtctgaggcatttccaggtgcacagtgcaagctgtcagcggatctaccattct

SEQ ID NO: 191343 - DNA, 452 bp, Homo sapiens
aggctgtgcaatattgcaggtgggagacggcagtggtctgcacaaggatggagacatcaggatgtgttttgaagacagagtccttaggacttactgataatctacatgtgggaagtctggagaaaatgggatcaaggatgattcctagccaaaatggcagcaggtgacatttatcgagcactttgcacagattctctcatcactccttcattaccaatatccttaccatcttctttatcatcatatgaggcaaatactattattaaccctattctacacagagaaaatcaagaagccaaggtttgggaaggtcaaataacctctctatggttatataagttggtaattggaaccaagatttgaattcaaggagtctggagtcccaagtttgtcctgtgaactgcactcctataccaaacctggattatacacatatgcatagattgaagggt

SEQ ID NO: 191344 - DNA, 392 bp, Homo sapiens
taccaactggaactggagctcttagaatttccagccacagggcagcaaagccattttcctagcagaaccagacctgggatttaggccagtgggaggggattttctgctctctctgccttctgtccctaccctcttctcttactccccagcctcgggccaatttgcagcttcagcagccctgaagcctgacagttccagccatctccctgtgtacctccctcacccgcacccccatgcaggccaagctagaagaacagctccttccagatttatcttcctgggccttggcaccctcatcctgtttggtggcagactggccttactcacattcaatccttgttcattccgattctgccaccaatttccacagcatggtacattctttccacagc

SEQ ID NO: 191345 - DNA, 285 bp, Homo sapiens
tacagcaaattccatcagtttacacaattttgaatctgagtgttagtgcaatgggttataacatcaatcttttcttggttgcaacagtgaagggagagataggacatgacaaaaccttacagctatatttaaaacacataaataggctgggtgcagtggttcatgcctgtaatcctagcacattgggaggccgaggtgggaggactgcttgagaccagtttagacaagcctgggcaacatagtgggagtctgtctccaaaacactttttttgtgtaaactgagct

SEQ ID NO: 191346 - DNA, 248 bp, Homo sapiens
tggagcatgggttgaaccgcagtttattttctctggcagagcacctgtagatgctgtttaatcctgatcatatttttttctagagcctcctctccctcccgtgagagctcactttttgtaaaggaaaagtatggcattttatacttagttgctgcactgtgttcatctgtatgtatcacattatgttgaccatctttcttcaaattgaattgagtgttaaactttctttatagaaacaagggaagcca

SEQ ID NO: 191347 - DNA, 448 bp, Homo sapiens
agtgttgagctcctgaacttgttcctctaataaacattaagtaagcaaggcttcctctgtcaatcattttccctgttccttatgcactaaattgctatttttgcataagttttgcactattttccagcagtaaataagatgaagcccatcaaattttttaataagtgtattcatattctggcagccatttagttgaaatagcaagcagattgatatacactttttttaataagtgtattcatattctggcagccatttagttgaaatagcaagcagattgatatacacatacagatattttggcagctctatttaaaaggcactttgggaagttattcacttctggctcaaattccctctaaatgaccccagactgacctatcctgtttttgtatatctttaagtaggaactttccaaaaactgtggcagatacttaaggctttttac

SEQ ID NO: 191348 - DNA, 461 bp, Homo sapiens
ggtggcacacacctgtagtcccagctgttcaggaggctggggtgggagaattacttgagcccaggaggtcaaggctgcagtgaactgtgatcgcaccactgcactccagcctgggtaacagagcgagaccttgtctccaaaaaaaaaaaaggccaccagcaagcctctgaggccacatggctgtgagggatcagagacatggattcctccaggccctgagccaaaccacgactgcctggcagcgtgacgcccttggccttaatgtggaacagggtgaggacgcagcgggagatggaggctcaggccttaccactcacagcaaacctgaattcaaacccactggggaagggacggcttaatcacggaaagcgaattccagaatacttgaagtcacacttaggtttcggttttttaacttgagcagttcctcgatacgctccagaaggagcacccccaattgc

SEQ ID NO: 191349 - DNA, 830 bp, Homo sapiens
gtctgtcactttcccaaagggtgggatttggcaaatccgtcagccgtacgagaaagcgtaagcattaagagcctctcttaagttgccactttggaccaatagacccattgtgaaagcgggagaccagtgtgagcgccttcctgaattctgtgggccgctggtcccatctaattcagttacttgttttcacccgtcccccaggcgcggagaccaagctcattgctgagctccagctagcccacaatacatagtatttattaagctaagagttaattgtcttaagcgactagataagatggatctgcagttagcataaagttaactaccctgcgaaagaggagttggtctttaaatggtgtttttcacttgaagagaaaagaaggtactgggcaggaacatagcttagcaggcctagggaatgggtggaaggaaaattgcactgaggacttacatagaatgtggtgtttgttcagcaatgattgagtagaaaggtgattgtttcgttttgcttgtttggttggttgggaaataaataggagtgaaagatttcgcctcgatctttatttagagcccaagagttgttgtgactcagttttagctggtagtggcttgtacacgccaggggagttttagaactgttctgaagagagatggcagcagttcttccaccttttcgatgactgttgaaatcctgaagattagctgtccgactggttaggttacacaagatgattcaaacacagctttcatgtttgagaaaataggtaacttgtgattcttagtccttgcactaataaagcaacaggaatgagtaagtcttggagaaaaag

SEQ ID NO: 191350 - DNA, 544 bp, Homo sapiens
ggcgccctctctgaacctcctgcctctcccctgtctagtggggccccagtgcacttgtaaagtggagagacctgacgaccccccacccccaagcgctccactcacgctgttgtgattcctaaaccatcgtgcccggaactcagtgaagctcccagaacgtattacattgtattaaaatggcttgtttatctccacgttgcatcaatgccctcggggccaggatcctccgttgccagacttcccgggaacacttggaatgcctcctccacctcggactagcagtggcctttggcctcagtctccccagttgacaaaggggggtaatctgcacctccaggatcactttgtgaattacttaaggagcgggcttgaggccagcactcccctgcactgctacatctccatccccatagcaaaggctacattttatttactagcatttatatttgccttgtgtttttcccagatctaggtgcaaacagcacctgaaaagcgtttgtttatttcatgagagaaaaggggttccttactctctcctcctctc

SEQ ID NO: 191351 - DNA, 748 bp, Homo sapiens
ggcctggcttctacttggtccatctgtttccttggttctttatacataaatcattgggaaatcctattgttaacaagatttcctcttaaaagcaacctttaaatggaaagaggaaaggaaaaatttgggaggcttctgcccaggtgtgactacagaatgtagtttgactcattacccttaagagtctaacaaacacgcagaggcccccttccttctcttcaagcagcagagctgctacctcagtttgcacttagagcaaatctatgatgttgaatgaataattagatacttaaaatctgtaggcaaaaccagctattattttggaaatctgaaaattaatccttcttaattttttttcttaagcttccagaataaaggtttgcattccgagccaagagtttaatatgactgctctccattccatccctcaactccttctggaaatacaaagtcccatgtggcttttcctggaaatagctagaaaaataaacacttgaacacctgtagagtcaaggtaaaggagagagtaaaaagatagaagcacaggtggaaaaggaagtattctaaacatctgcaaatcccttacatttctatttacatggacaagcccagctaacatcacatccaatcttaatataagtttttctaatttttttattgacaaataaaaagctttgccaagaaactaatcatttcttccttaaatattacattttgaagcatcaatacatatttttccctttgaaac

SEQ ID NO: 191352 - DNA, 140 bp, Homo sapiens
catggaacatactggacacagagaatctggatttcccaaggcatcagtgtgctttggggccatacctagaagctacgcacctcaaattctgtggtttataaagttcaataaattgtctctacctatctgagatagaggaa

SEQ ID NO: 191353 - DNA, 729 bp, Homo sapiens
gtattcaaataatatttgtcatgtgagttaatattaaacattcttattttatattctatgtcttgtcattctacatttgaagactgcatgtatgatttttaccatctcctccttctagtttttacccattgtgccgtttacttttatgttttgtggattttgactctgggtttatattccttggattttatccgtagaaattacttgaggcatagattgacgttaccttcattcagagattatttgtgtttacttttactagttgcctggggttaactacttactcaggaccaaattaatctctctccttgattttttgtttgtttttgtttttaactatgtaagtgggtgacttgacctgcaaacccatgtgtatgacagtatcaactgtggatataaattattgaaagaggaaatatacatatttcctctaccaaatgccaaggtacagatgggcaagtttccttgctcctttctgtgcagcaggtttctttcctgttcatcattgcactggaagtgcagcccctttggggtttgcagctttgttagattttcctgtcttaggcgagcttcagcttgagctgatgtctaaaaatccggtgttcttcagatttctcaagtgtagcctgatttttatgtgaattcagcaatttttaagtgttggcaaacagtttaaaaaatgttttaatgtgctgggaaaaaatcaccgcaggtcatatttgatctgta

SEQ ID NO: 191354 - DNA, 716 bp, Homo sapiens
gttctcagaggtcccggggtgtccgtttagtactgttacaagtgtgagttaagcctttatcaaccatctccaggttctcgtgtatgtaagccttgggaagaggcagtccagcagtgaccgtgcggccgccccgtgcatcttgagagccctgacagtggcaccaagcaccaacacgtgaggccagaggccggaataccggcatcagatgttaaaaaacttttccattaccaatgtctgctccaaatcctgcttccgtctctactaaaaatacaaaaaattagctgggcttggtggcaggcccctgtaatcccagctacttggaaggctgaggcaggagaatcacttgaacccaggaggcagaggttgcagtgaatcacttgaaggaggcagaggctgcagtgaaccgagatcacgccactgcactccagcccgggcgacagagcgagactctgtctcaaaaaaaaaaaagaaaaaaagaaaaaagaagcaaaacagatgcagaacagattcttcctatcttcagtgacctgaaattagaccactgtgtaaccaaatatgttatagctcaatttgaaacttcaagtgaagtcagtaatatcctaacattcaagattagaagagaatttttttaaaattctgagccatctaaatcaaaagcagtaaagcctaatcacagtattacatcaagtgctaaactatgtgcttaatcttttcca

SEQ ID NO: 191355 - DNA, 644 bp, Homo sapiens
gtctaattctggctccaccagctatgttatagcatcaggcaagcttaactgctttgactcagtttcttcatccagtaaaatgccagcttcatgatgtgcctgtgaagattaaaggcaatcatgtatgtaaggagctttgcatactgcctgatatgagataggcattcaagaaatcattacattgaagaaattttcaattttccttctcctataaatccttgtatgaaatcgaaatgagtgttgagatgaacaaaagacagctagttcaaggtgaaaggttggtaatttgcttacaagatgagtctcttcttcatttggcagctgactaaattgttaaaagctcagcctaattgtacctttgccaggacattttaatgacaccatttgtctcttcagttcttaagcactttggggaaccagtagaatacaaagtagaatgtctgtgctttttaccttactcctacatcatctttctaaaatttaaatgtactatcactaaccctgttttgatttagttgaggggagaaaaaaagcttaaactttactttcagggtctaattggctaaagccacttttccttttctgtttccaatacttttttaaaaaaattataagttagtaatatctttctctctgtctacata

SEQ ID NO: 191356 - DNA, 259 bp, Homo sapiens
gtgggttcattatcatgggagtggattccttataaaaggacaaattcagcctccttttgtctctctcttaccttctcactttctcaccttctgccgtgggatcacacagcaagaaggccctcgccagatgctggtgtcttgatcttggactttccaggctctagaactctgagaaacaaatttctattcatcataaattaccctgtctcaggtattctgttgcagcagcacagaagggacttggattccaatcagtagg

SEQ ID NO: 191357 - DNA, 324 bp, Homo sapiens
tatttatcagattaaccaggatattaagaattaaaaagtttaatttgttattccttgaaattatagtactttgagaatgaagacaaacagtgtatcctagtacacaggaatacagtctttgggttcaatggacctgggttcaaatctcagctctgccacttaactgagtctttttggacaagttgcctcggtttccttatgtgcactttgagaataaccatgttcccttcatctggttcttacagagataaatgtgtgaaaaacatttagcacagtccctggtaaccagtaagggcttaataaatggtggttttcctctcattc

SEQ ID NO: 191358 - DNA, 450 bp, Homo sapiens
gccctctgagtgcacctacagcagatttcctcgaggggataaagtggctttgtcagttccatagagtgttacactcaggagagagcctctcataggagctggctcagaacagtgaggaactttctttcctagaaatgcccttccccccaacacacacacacaaacttgccctagagtctgaagatgccacattccactggcacaggcaaaggggatgggggatcacccagatgggcttagcctactcaggcccacccaaccaacttctcgcaataactgtgtgcccttgttagtgttcctgaaactcctggggcacaaattattttgcactgtagcctgtcacatgaggtaatatgagccaatccccagcaggccctcagcatggggtgcagtgcactagtgttgaattacttccccttcccacctcttgacaacttggttccccactcc

SEQ ID NO: 191359 - DNA, 444 bp, Homo sapiens
cactttcctggagatggacccaaatgctcacaatcagctggtttaacatctcttctccataaaccagatgttattgctaaagaaatgtgtaaacatgagtcaaggaagctaaaaagacactttttcaagcctcagctttgaagtctggggcttagatcatctcattggtgagttagcttttaagatgtttaaagtagaaacttaattggaaatggtattcagctgcttatacttcacagagggtcagataaatcttaattaagcaaggataatcactaaataacactaactacagcaatctaaaaggtttactctccaagattcccatccagatcaccaagagaaaatgagaaggcaaaggaaaaagaagaagaaaggtgatgcggcttcatgttttcaggtaaaggaaggcacatgatcacacagcaatattaaataataaac

SEQ ID NO: 191360 - DNA, 641 bp, Homo sapiens
tggagaatccagacaggaacagggatatgtctcttaacactaacctctttccaacaggctgatatcatcagcgtatatttatatctgcacatagcccaattatctgattatatacactgatgctatacgttattcaaacggcaggtgttagggattattctgttttgcaatcctaaattgcggtatgctgattaagatactgaatttcacagagcagacaacataacaaaaagccattggaaagttctgaagataagcagtggttttcattatctaatgcagcgccttgctttatccacaacaggaacaatggataccaaaaagctacacataaaatcatgaaggtaaaagaagataaagatgactattggtaacagaataaataaagctaatgagtagtaagtgtaagcaaacaaaaatgctacaaaagtacttcacaaaaacatatttttccttatataactaggagactgccagtaagaaagaatattagttgggccggatgcagtggctcacgcctgtaatcccagcactttgggcggccaaggtaggcaggtcacctaaggtcaggagttcaagaccagcctgaccaacaagtgaaaccctgtctccactaaaaatacaaaaattagctgggcatg

SEQ ID NO: 191361 - DNA, 179 bp, Homo sapiens
tggagaatccagacaggaacagggatatgtctcttaacactaacctctttccaacaggctgatatcatcagcgtatatttatatctgcacatagcccaattatctgattatatacactgatgctatacgttattcaaacggcaggggctgtcgggctagtcgggggggtaccgagctcg

SEQ ID NO: 191362 - DNA, 329 bp, Homo sapiens
aagagggggtgtaacagccttagtgagatttctgtactgtccacagggaaatttaagatcaacatggccaaattctatttcaataaaaattatgcatctaaattttcaatgaaatttttgacatctgaaaactcatttataaaaataaaaatgcaaaatgcccaaacaaaaaaaaatgtgtaatggccacttgtatacacttgtatacacctctggactctggactgcataccctgtgcctgtcttcatcctctaacataacataatctacttgcacctttgttcaggaaaattttgtgaattttgttggaaatgttcgttccatttgt

SEQ ID NO: 191363 - DNA, 150 bp, Homo sapiens
ttttttaaaaatgcagaatagctggaattcatccttaatctactttatgttgaggatagggtagtagtatttttttgcagccttatttccttgggttgttcaaggcaaggtattggaaaagttaaaaaactcaaataactagatttgaga

SEQ ID NO: 191364 - DNA, 420 bp, Homo sapiens
ttcagcttgctctctagaaccaaggccaacatggaacttagaagttggagtaggggctacttaggcaccccaccccccacagactcctccatggtggctggaacccgatctaacctgccctgggcatgctgttcatcagctttccctgtcccagtggtctgggccatctagaagactctcctgggcttagtcaggtacagggggcttctccctgcttcactccctgggcagcaggctggctggcctctgggaagacaggttcacttaaaccaaaggggattgaggcttaaattacaggccatacacacacaggtgtgtgctaatttctggtatacaggcagtcccccaacaaagaggaagggtctgaggtcctaaggatgaggaggatgaggcctgattctcctttaggcagcctctggt

SEQ ID NO: 191365 - DNA, 829 bp, Homo sapiens
ttttccccccccaaaaggggttttttgcccttttttttttttttttttttttttgagatggagtcttgatccatcacccaggctggagtgcagtggcacagtcttggctcactgcagcctctgcctcctgtgttcaagcaattctcctgcctcagtctcccgagtatctgggattacaggcgtgagccaccgtgcctggccggctttttgtttttaaataaatttagtgtccatataagagtgatttggggtaaatcctttattttcctagactataaaacagggatgataataataggatggaaaagtacttgcacagtgccagcgcagaaggtttgtaaggatagttttcattcctgctgctctcaaattttgtgattaagcaagttcacttagatgctgtttagttgagaatttgtggttttggtgttttagtccaaagcagtcctcattcttaaatgttatttttatattatgttacacttgcattctctttattggtgttatcagagtcagcagtactgaaaagaagagaaatcttttgacagggttaggttgtgtgacagggttaggttgtgtgacagggttaggttgtgtgacagggttaggttgtatgactgttgagaaaaatgcagtgtattgaaggaatgattggctgcaaataaaagtatactattttcttttcctgtcttgatttcttttttggagagagggctttggattcatttcctctaagagaatagtctaatgctgtcaactactgaaccacatctgatattattgatgattaaaaccatagtcttcctcgttagcttccatgatgctgtgc

SEQ ID NO: 191366 - DNA, 779 bp, Homo sapiens
gtgaagcaacaagaaaatttagagttaatttaccccacctctcttatttttatttttgagacagggtgtcactcctatcacccaggttggagtgctatggcacaatcttggctcattgaaacatccgccgcgtgagccaccgtgcctggccggctttttgtttttaaataaatttagtgtccatataagagtgatttggggtaaatcctttattttcctagactataaaacagggatgataataataggatggaaaagtacttgcacagtgccagcgcagaaggtttgtaaggatagttttcattcctgctgctctcaaattttgtgattaagcaagttcacttagatgctgtttagttgagaatttgtggttttggtgttttagtccaaagcagtcctcattcttaaatgttatttttatattatgttacacttgcattctctttattggtgttatcagagtcagcagtactgaaaagaagagaaatcttttgacagggttaggttgtgtgacagggttaggttgtgtgacagggttaggttgtgtgacagggttaggttgtatgactgttgagaaaaatgcagtgtattgaaggaatgattggctgcaaataaaagtatactattttcttttcctgtcttgatttcttttttggagagagggctttggattcatttcctctaagagaatagtctaatgctgtcaactactgaaccacatctgatattattgatgattaaaaccatagtcttcctcgttagcttccatgatgctgtgc

SEQ ID NO: 191367 - DNA, 437 bp, Homo sapiens
aatagtgaaaaatcagaaataagcagaccctcaataaggaactggcaaaaataacaatatggtataacctattgaaataaatgccgctattaagtcatgcatcttaaaatcataatgcaaataaaatgacataaaaactgttcataacatcatgagaaatgaaaaatgagggtacaaaattatatgttttttaaaccttggaaataaaaaacattggtagaaaatataccaaaatttttaccattggttatgtttgaacaattgaaatggcttttcccctacttttttctctgtgttccagtgtaacaagaatatagtagggccgggcgcagtagttcacacctgtaatcccaacactttgggaggctgaaatggatggatcatgaggtcaggagtttgagaccagtctggccaatatggtgaaaccccgtctctag

SEQ ID NO: 191368 - DNA, 581 bp, Homo sapiens
cagcccttttccccaaacacttgtctcccatcaagagagtttcagaaggagcatatggcaagataggatcatttttcagatgttggtctgggcctcagtccttaccaagcagggtttttggtgtcaaggagactcatctcactggctgagggcaccacttccccacatttattccactccatcccttcaccacagcagtaaatatccctttgcctagaacacctgctgctgctggtggtggatgaaagggtgttgcacttccgtcactgagggtagagaaggcactgacgtcagacatcagagctgttggagttacataatcccagaagctgcttgagcatggaataaggccatatttaacctcgggggagctaaaaataggcaaatagaattttatttccccataaactttttagacttaaaatttttttttttttggtgattctaggctaggattgtgtgtggcctcaggcaatttttcaatgttgaattatgatccctgggaaataagtatggtctatatgcagggtatagtcatgatgtgtgtgtgtgtgtgtgtgtgtgtgtgtgcttgtgtatgt

SEQ ID NO: 191369 - DNA, 224 bp, Homo sapiens
aggagcactaggtctagcaagaaataggaagagatgagtcactattattaattctattaagaattaaacatctaaccctaccagggtgaacatctttttttccccccctagaaatataaggttaagggtattgacaccccctccttctttggtgactaaagcagcatttttgtatgtttctttaggataagaattgacccctcccccccgttagctttccttcc

SEQ ID NO: 191370 - DNA, 109 bp, Homo sapiens
gctcctcctggagtcctgcctcaggctggtcagaattcccatgctccaagagtcagaagggacacattagaaagtctgtgtggtctcctcaaaagccacatgcctcatg

SEQ ID NO: 191371 - DNA, 271 bp, Homo sapiens
aagggtgctgcatgagctccttaaaggacaaaggtaacagagccagcgagagagctcgaggggagactttgacttcaagccacagaattggtggaagtgtgcgcgccgccgccgccgtcgctcctgcagcgctgtcgacctagccgctagcatcttcccgagcaccgggatcccggggtaggaggcgacgcgggcgagcaccagcgccagccggctgcgtgaggaccagcagcacggccggcaccgcggacagcgcccgttctagatcgcg

SEQ ID NO: 191372 - DNA, 151 bp, Homo sapiens
agccccccaaccctcataaagtcaatgtaattctaattaatagacatctgaagataagaagaaagaaccggcttagagttcgggaggaattaagtaataaacactcgttatctttttttttctgagacagagtctcgctgtgttgcccagg

SEQ ID NO: 191373 - DNA, 333 bp, Homo sapiens
cagtcagcaaaacctgaagacttcactccctagatattttaaagtcctaccctcgtcaatagcacctccttgctcctttgcatgagcagctagcccttaggtgacctagcctgtgcctaactctccagccttggctctctcatgtcctcctactctgcaccccatggggttctgcactggatcagcaaacataaccaggaggcaaatgacaagctggggacaatatctctaacacatatgaaattccaacagttaacatataacaagctactacagatcaataagaaaaacataagcagtccaaaaaggatgaaagctataaataggcattta

SEQ ID NO: 191374 - DNA, 335 bp, Homo sapiens
gtgagaataataaaacagttattatctgccacaaactttgaggtggcttgtaataaaacaatagataactggaagtaaatgctaaatttttacatggaaaggagcattggatattcatgatggctactgtgactgggcagtgttgacttgaatagagtttagggatgaagaccgagagcccggtaggacagaccatgttgggctttctaagccataaaaagtttagttagtttgcttttctgttttctaagcttgatggggccccactgacctattcctaaaggactgaaacataaaagtgtggtacagaaaggcactttaacactggagcaaaa

SEQ ID NO: 191375 - DNA, 510 bp, Homo sapiens
ctgaatttggaacggttcgctgctgtgatgggcttacaaagttgtgctctcctagcttttaatcagaactgaagaatcacgcagcttccctgctaatgccagagcaactgaaagcactcacaggaacacacttgattaaatgagtagaaagccttcttgagacacctaggtgtgtgtatgctgagctgttacatttgtcatggaattaacaacaataacaaacttgcttaccaaaggagcgcgttaacttctgcaagtgtataagtgtataggctctgctgcttaaacacattcgtaccaatcagaagtttactttctggtctctctggcttctgtgttgtcaccatccctggtttctgtgaaatggaaatattgtgtattcgcccagacggttggaagccgttcatgtaaatatgggccgttgtgatttaactgtcagcctgaaaggccctacttccaagggctccttttaaaccaagcacaatgaggtgtctgttttagatgcggccg

SEQ ID NO: 191376 - DNA, 406 bp, Homo sapiens
tggatggctggacagttagagtagtgagtgagtagatggatgggtggacagttagagtagtgagtgagtagatggatggctggacagtgacatgcagaggcaggggggtagaaagatggataggtggctgggtgaggatcgtcacgcctgtaatcccaggacttagggaggccgaggtgggcggatcacgaggtcaggagatcaagaccatcctggctaacacggtgaaacccgtctctactgaaaatacaaaaaattagctgggcgtggtagcgggcgcctgtagtcccagctactcgggaggctgaggcaggagaatggcgtgaacctgggaggcggagcttgcagtgagccgagatagcgccactgcactccagcctgggcgacagagtgagactctgtctta

SEQ ID NO: 191377 - DNA, 555 bp, Homo sapiens
catctccctatcctttcccttcattttgtcattttgggtattgccaagtctctacagaggctcatttccattttctgctaattcgttacttgagaactaagatatttactgataatggttctagacattgcccttccaagatttgtattttaatgagagggaggagtctctttatgagccaaaagaataaaactgtagtgataagatatggtgataaacttcattgataaaaggaaagtgaaacttaaaacattaacctcacaaggctgggtgcagtggctcatgcctataatcccagcactttgaggggctgaggctggaggatctcttgaggtcaggagtttgagaccagcctgggcaacatggtgagaccctgtttctacaaaaaatacacaaattagccaggtgtggtggtgcacgcctgtggtccccgctgtcttagctacttgggaagctgatgtgggaggattgcttgggcctgggaggcagaagttgtagtgagccgagattgagccactgcactcaagcctgggcgacagagtgagaccttgttaa

SEQ ID NO: 191378 - DNA, 315 bp, Homo sapiens
gtgatagtgagtgagtaagttatcatcatatcttgttgcagcaccctgccacacttcctcctgctccagcaatgtaaaacgtgcctgcttccccttcaccttccacgtgactgcaagttacctgatgcctctttcgccagctttctgtacagcctgcagaaccatgaggaatcacaccccttttctttacaaattacccagtctcagacatttctttatagcaatgcaagaatggactaatacagtatctgtgtaaaatggagatgtttcctaagaaagaataaactccttttggtataagttatgtgactacaa

SEQ ID NO: 191379 - DNA, 141 bp, Homo sapiens
atgaaactgcctttaaaattcatttgagtgcagattagtccccaggatcttagcatagggaatataactgggtgcagattggtggatatgcgcttgtttgagcttgggggtcaatgccagtagccccctttaccccaaatg

SEQ ID NO: 191380 - DNA, 620 bp, Homo sapiens
aaaagggctggagtccccaacatacagagattacagctaaaattacgaccagagctgttaatcaaatcccatcttcccttcctattcacacagtagagatgttataagtcatacaggtttgagacagaaaattgagagcagaggagcatgtgtttaaaccagcatagaaacattcatttaccagaattgctttatttcagccgtatctcaactcgttgcttacacagtaacgcatgctgtctcgtcactcagccaagtgggagacaagttcaggtttctgctccatgggatccaggagcctgcagtcaccgatgagcctggaggaccacaaggtggccagggcccttggagagctgtgctgcggaatcgtaaagctaccatccggagctggccgtcccagagggaaggcttggtcatctcttcccctccacctggtcctcagccctggtcccgcagtttgtcatcccgcagtttgtcagcatcgatgtgggactgggagaggaaggatattgccagttatggttgaatgtcattgtcaggggagtaagaagtagtttgtgattgttttacgtggctctgtgttggtatataattatgctgtcatcttaaaacgccctgat

SEQ ID NO: 191381 - DNA, 537 bp, Homo sapiens
tacatagcatcctgacacataaattcacaacatttaggagacaatcccaaattactcaaattataacatgctaggaaagtatgagccattctcgtgaagaaagacaaacattagatgtcaacccaaaatgacccagatttggagattatcaggcaatgactttaaagaagctattaaaactatgcccacaagttgaagaaaaatatgtttaaatgaaacaaaagagtaggaatcttggcagagaaatagaaaattaaaagtaaattggaattttagaactaaaatatacaaaatctgaaatgaaattagctaaatgggcttaaaaacacaaatgaacataatggaggaaatattcaataagcttgaaaataaatcaataaaaattattccatctgaaaaagagagaaaagattgaaaaataatatgcagaacctcaggagcatgtggggagatctcaaaactacagaatatgtgtaatttttgtccaaaagaagaaaagagagaacaaagaaagaaagattatttgaagaaagaata

SEQ ID NO: 191382 - DNA, 456 bp, Homo sapiens
acatgcacagggggacaatcctgtaaggacaaagggagaagacagccatctccaagccaaggagagaggcctcaggagaaaccaaccccgcccacaccttcatcttggacttctagcttccagaactggggaaatgaatttctgttgttgaagccccagtctgcaatacttagttatagcagcccttgcgaaccagcacatccaagttctccgtctctgtctctaacccctctctcaactgtcggccataagtgagcctctgcccccaacttctggcctcctctatgttctcttccttggtgacctctggcagtgacgctcagtcctcatggccagctctggcctctcccaggctctggcgccgcaatcatctcttccacttgtctctgcttggatagtctgtcagcatctcaaaggcaacatgaataaaaccaaatgcattttttcctcccacaa

SEQ ID NO: 191383 - DNA, 153 bp, Homo sapiens
cctgggtagtgatttgggatttagagtaggtttgcacagtggaggagagcagttagggtggcgacttttcatctaccagttgctatgaaagcttagggggctgttgatatcactcgggtgtaaagagaattatttcattgttcagttggttga

SEQ ID NO: 191384 - DNA, 548 bp, Homo sapiens
gggagtgagccgagatcgcgccattgtactccagccctggtgacaagagcgaaactctgtctcagaaaaaaaaaaatagcttaaagagaagaattgtaatgttcccaacacatagaaaaaataaatgtttgaggtgatagatatcccatttaccctgatttgatcattacacatgtatacacatatccaaatatcacatgtacccccaaaataagtacagctatgaaaaccccaaatattaaagtatctgattaaaacctcaaaaataaagagaactttctatactctgtaaattccctctgctagcagtcctgttcgcctgttaacccatttatgccagaggttgcaattttttaaatttttgcatgagtgaaaaatccgaccttagcaataaccttgagcaataggatataaataactcccacatgcttagcgttccaataatggaacactaggcataagtgggttaaatatattcaacttatgtatttaaaattttgtcagtcagggtacctgtacctttcatgagagttccttcacttccgtag

SEQ ID NO: 191385 - DNA, 429 bp, Homo sapiens
cgcacgtgtgtacatgttttgtagagacagggtttccctgtcttggccaggctgatttcaaactcctgacctcaagtgatctgccagcctcagcctctcaaagtgctggaattacaggcgtgagccactgcgcccagcccgtggagtgcctatttctaagtgcagctaaaggaatgttcatgaaactttatagctggacagctggaaattaacaattcctggggtcactcacccagggagaacaagatttctctagtttgctggtagagattacctacaggctacagaagaaaacagtgttatcttgtttttcctccctttcttttttcctttcattatagcttgacatgatttattgaatgcccatgatcccagttacatttactcttatcctttatcccaaactcctattcccttagtgtagatgtc

SEQ ID NO: 191386 - DNA, 406 bp, Homo sapiens
tggatatggggctcagaataggtaggcaaacaaattgccagaaggagtaggaagtagaaaatgatgctgcttgttgattaattctgtcgccttaactagggtcttatcacttactgtttttgcaggtactgttggactatcataataaagtcactctgctgagtgggagaggaagaggcagtggtcacctgggtcttttctggcagataaatttcaagctgggtgttcagattttcagcaggatgttcaattgaggacacacctctttctttattttgtcttatatactgctgtttaaaactgcataataagttctctgaatgtgttctagtatacgaatcctcctttgtttccagctctgtatgaatttaaggactgggcaagtgttaataatatgcccttatcc

SEQ ID NO: 191387 - DNA, 221 bp, Homo sapiens
tattattttcaacaaattactcaagctctcttattaccaattagcaggaagtccagtgtctccttcagggtgacttttcttgaccaagaattgtcctgtagaactccaagggttgatcttgttcaaaggggttagccctgccacgcggtgggagagctggagggccctagagctacagctctcccagtttgcactcgtgcacccagttcttactccctaag

SEQ ID NO: 191388 - DNA, 178 bp, Homo sapiens
accctaaaacaccctaccactggacctcactcctattagtatacctctcactcactctaaatgaagccataagatctccttgagttctcggagcaggccaggtgagtggtccactttgcacttgatgttactgcttccctagatatctgcaccacccaccctcgccctccatgcaaat

SEQ ID NO: 191389 - DNA, 418 bp, Homo sapiens
ttccatagtgagcagtcaatgtaagcagaaagtgtacgtaattgctgctgtggctcagtaatctagggtgttcagggaaggtgtcatctccttgatggcttaaggctgaaatgaggattccaaggggaataagaaattacagactcttgcctagccaggcctcacagtgtgttgctcaggatgcagggacactcaggaaccttgctgcccctttgcaggctggtgtgccaccattatgacagctcagcagctcttatttctacttatttggcccttcctgacactcactctgccacttgtgactttttctgcattgtgtcctctgctactgccttctcactcctgtaccctctactaacagacattctctatcttccattcaaagcctctgatgatatctgattggttaatagtcact

SEQ ID NO: 191390 - DNA, 464 bp, Homo sapiens
atgatagacttcctgtgtgactggactgaggcacccatttgatgtgagggagaacaaaaggaaaggaggaaaaatgatatggtgtgttgggcctgggtggccagtggagcattgctctcagttgtgaggggagttgaggaggaagctgtcatataaaatgatcggacgtggcacatggagagctcaagtgcacatgaacggacattccgtgaaatgtgtccagcagcagttggatgtgtgaccatcaggctgaccagagccgggagctgcagagtggattgagactgacctgcagaggccaggcgggctgccctaagcccggggaggggtgaggtcatcaggccaaaatcaccagcaaggcaaggcggggaccaggtgcagaaagccttggggtctgtgcttgtggaacagagggaccaggggatggaaagggagctttctgggtagcacagtgtcaggggagc

SEQ ID NO: 191391 - DNA, 248 bp, Homo sapiens
aaaagaagtttttatatctgcatatatggagcagaggtccctgggggtggcgggtcttgagacccatgaacagaagggacaggccagagtgaggggcacaagacccattacgccatgtgttcctgttgtattctgagcttgggtacacctccctccatgaaagcctgtccacaaaggcatagagaaatccactcatggaaagaggtgtaaccaagctcagaatacaacaggaacacatggcgtaatgg

SEQ ID NO: 191392 - DNA, 176 bp, Homo sapiens
tcctgggattaaaggcatgaaccaccgcacctggccctggatgttattttataacctcacgagcttaacttacattccctactttttttatgatctgatcaaaaaatgctccactctgctttaggcctgggccccaggcaggactttctagtcaacagcaaaaacgcagcttggta

SEQ ID NO: 191393 - DNA, 683 bp, Homo sapiens
acggtccatacctgtatcacccaggatagcgtggtggtcaagggtgtcctctcgagttaaacagatacacctggattttggtctggctctttgtcaagtacacaactggtctgagtttcaaagtagtcacttgcaaagtgtaggtacaataatagttctgtcataaagatttgttgggaaagtcatgaagatcgtgtatcataaattgctttaattaattttagatttctgctatgtcgttttgtccttcttctcattcttaatgttctttgtgctgtctcttttttctttgattagtctttcccaaggtttgtctagtgcctttttaaaatcagtatttgggcttcttcattcctctaacttatttgggttttattttaataatgcctgctttttcttttcttatttcctttaaaatattatcatatacttagtttattaatttttggcttttaagattctctttgcagtactaatttctaatgtagttgctctgtggtcagataatatggtctgtgtgatacagaccaggggtcagcaaacttctactaatgaccagatagtaagtcttttaggccttgatcagctagtcagttttggtgttgtaggacaaaaacagccataaacaatagtaattgagtgaacatggttgtttttccataaaacgttacttgtaaaaactg

SEQ ID NO: 191394 - DNA, 576 bp, Homo sapiens
ctactgacttgtgtattgctgtcagaagggatgcctttgtgattcgtggcaaggctggacactgggtgacatcccattggtcctgctggctttataatgatctgctctggaagtacagcactagaaatcactcgaaaggagaaaatgggccaatcatcaggcaatcttcagtgactcattatagtgagccctccattctatgcaaagatgagagttctaacaaatgtgttcgttaagtggcctccagatggtacctatgctattagcatctcaggttactgctctgattatagctgctctgatacggtcagaaaattaggtgtgttacttacccacatgtgctatggtgagagtctgtgactcagcctccatatcaggatttaaaaatatgcccctatgctgcagatgaaaacaatattgattaaggagcttatattaggaattgtgagccactgccatccataagggtaacttagaaggctggtggaaactaagataccatagcttattaccaagataatcctttaatgaaatgcatttgaagtagtgaactgttagtgacaaaacagggcaaga

SEQ ID NO: 191395 - DNA, 435 bp, Homo sapiens
ctggattgtgtcagtggcccgtgtgctgtaatttataatgagcccctgcaagtcctgcaaggcgcattctgattgatgacatttaaaggtactgtcaaggtggctgggtaatgaagttgaccttcctccatcgttgtctcagtttcaagtttgtatgtataaactatttcacctgccatgtttgcttggaactttttatgatatctgcaaaaggaatttggtttactagtagttcttttcttcccattagatcagggattaacaaaatttctctgtaaagagccagatagtgaatattttaggttttgtgggccatactgtctctgtggcaactacttactctgttttttgtcatgtaaaagtatccatagacaatatgtaaatgaatgagcatggctgtattccaataaaaattcatttgtggacactgaagta

SEQ ID NO: 191396 - DNA, 641 bp, Homo sapiens
ggaagttggtatgcagttgatatggtgcaatcttggctcactgcaacccaacctcccatttcaaggaattctcctgcctcagcctcctgaggagctaggattacaggcacctgctacaatgctaagctaatttttgtacctgttttgagatcttttaggcaatttatcagaaatgctccctaaacatcctggcttcccgtccccccaccccttacttcgcagggtcttagcacagaaaaccaagtccataagctgcaccactccaaattgattagcttcacagtacatttagtcgaaagcaaataagcagagtttagtaggaagaaaaaggaagaattcaggtcaggagtggtggctcgtgcctgcaattccagctcttagagaggtcgaggttggaggactgcttgagcccaggagtatgagacgagcctgggcaacatagtgagacacgatatctcaaaaaaaaaaaaaaaaaaattagcccagtgtgatggtgcatgcctgtggtaccaactacacagcaggctgaggtgagaggattgcttgagcctgggtggtcaaggctgcggtgagctacgattgtaccactgcactccagcctgggtgacagagtgaggccccgtagcaaaaaaagaaaaaaa

SEQ ID NO: 191397 - DNA, 119 bp, Homo sapiens
tcactgaaataatgagcaggaattccattaaggctccaggccaggtatgtgaaggaggtgtgattgatacgcaggacttggagattaactgtgtgggacttgctgaggccatgcctaca

SEQ ID NO: 191398 - DNA, 609 bp, Homo sapiens
gggaacactctctgaaagccctgagctgccacataagaagtctggctaccttgagactgtgatgctagagaggccatgtgtagatactccagttgaagctcccagctgagcccagccttctccatcaaagtgccagatatgtgattgactagcccagaccagcccagataccatctaaataccacaggataagctttgttactatcacgtggaaaaaatatatctattaccccaattgagccctgtttgagtttctgacctctggaattgtgagatatatttaaaaacctgttgtttaaagccattagaaagttttgaggaagtttattatgcagcagtagataacaagaaatgaatttggcacaaggaagttgagagtgcttttgcagcaaaaatatgtggcattgacattggtactgggtagtaggcagaagctgaaagagccatgaaaagaccgatggtgaaaggttggagaacaatgaggaagatgttattagagctggagaaaatatgacacattatgtggttgtaagaagttttgtgaacctgttgactttatatcaatactttggattttttctctgatattttgaggggatagatccctgg

SEQ ID NO: 191399 - DNA, 457 bp, Homo sapiens
tgatcatagaatagtaatttgttaaccgttacacatactgaggccttgatgacaccaactgaagtcagcttccaccactgcccttggccttggtaaaagaaggcctgtcattttgctaaggcaggctgtagacccacagtcctcttattgtgacgtccccctcaggcaacttcccagcatgtccagatgccgaaccacctgcgagcttccttccaagatgcctctcctaacctcaaactggccttcaccaccgaaacgaagtgtgtatttaaaaaaggaaaagaaagaaagaaaaaagaaatgcatctatttcacttcctgcagtcccctcaatctgtatagctgtaattaagacattattagaactggaatcagtcattactactcaggaggtaagatattaaaactctttatcttgggctttttgcagattaaaagcctgggcaacatagtgaga

SEQ ID NO: 191400 - DNA, 553 bp, Homo sapiens
agtaagccccaccccagctgaaccacaaaggagaccaggtagaagaagcagctgacttggtcaaggaagcaccatccagaaccttccaggagtcgctgaaccctttcctttcagagtgtgggcctctccttcatcttttcctttctttaaccctgggattttttattagaggtttataattccacagagggactttcagggagacctgtaaacctctaaaaaatacaaacaatatgcaatatatgttttggctgagtgtagaagcccatcctagaaaaatgtacttagatatgtattggattttcagcccctgcccgccttcctgtcttgctgcctcttctgtgggttgctccctctccttcctggaagcccctctctcttctgcctgccctgtcactgacctaggctcttggctggctcaggggagaagcaaataaaagaatgatagtggtcggggttggacaagtgacagtggaaaggagggatcatatttggaaactgctctccccctgtggtcgcttcaagacaggagcaggaaaaacccgggcaggag

SEQ ID NO: 191401 - DNA, 605 bp, Homo sapiens
taaaagaaaggaattctaaaatcagtatgtctcaggaacatagatgcaaaatcctcaaaaaaagaaaaacccaaaaataacaaatcaagcgcaacgatatgtaaaaagaattgtataccacaaccaagagggatttatccccagtacacaagactgttataaacatttgaaaatcaattaatgtaatcaccacatcaacaggctaaagaaaaaaatcataaattttatcagtagatacagaaaaagcatttggcagaacccaacaccattcacagtgaagagtctcagcaaactcggaatagagggtactttctcaacttgataaagaacatcagccgggcgcggtggctcacgcctgtaatcccagcactttgggaggctgaggcgggcggatcacgaagtcaggagatcgagaccatcctggctaatatggtgaaaccccatctctactaaaaatacaaaaaattagccgggcgtggtggccagtgcctgtagtcccagctactcgggaggctgaggcaggagaatggcgtgaacccgggaggctgagcttgcagtaagctgagatcgcgccactgcactccagcctgggtgacagagcgaga

SEQ ID NO: 191402 - DNA, 622 bp, Homo sapiens
cctggcgccaggcacactgagaccccacactgctgtctctggcctgcaaagatgcacaatgccacctcatgtaggcctgcttgcctgccccacccacacccccaactcaggtcataacatcactttcccatcaaagctccagtttccctactatggatgatttcctggtgatatttttaaaatcaaactaagcgactctaaaaggtgaataacaaactcattgacttcccactgtctcacacacaacacacccagcctttgcatctggtttagtgacttgttagcttacatccttggtcataacttggcagccagggagccaagtctgatttgcagttgtgttttaacctggtcagtgttttaaaaatcggcaaagtttacacaaaatcatcgctctctctctttctctctcaggagacaggtgatatggcatcctggggccacagttccacagggtagcagacgaggggctgaagagcaagttctctgtgggctctagttcacagggacacctgccactcctgactgtcatatacacacagctctcattttctttcttttgttttttcagatggagtttagctcttgtcacccaggctggagtgccacggtgcaatctcag

SEQ ID NO: 191403 - DNA, 254 bp, Homo sapiens
atctgaactccctgtggtcactctgaggcctctctgtctctctgtgtctttctctttctaccctctccatccctccttccctctgagggcttgaccttcactgacctccagggcaagaacaaccaagagttgctcccaagagggcttccctcctcctcgttctgtgtggcctcagaagtgagggaatctcagtgctctgtgcaggcatgtgcttattctgagctctgtttgaaattaaacatgaggtgtactaa

SEQ ID NO: 191404 - DNA, 621 bp, Homo sapiens
cagccacatccaagttaaaaagtcacaaatttcatagtgatatgtcaagtctatagtgcttgcactacaaggtgatgtttatcagtcccttggatatcctgggtgaagataagctccctgccttcctctagacctacacacagtaccagggctccatacacttaactattcacctcctgtgaaaccagcccttacccactgactcaactctagtcgtcagctcagctgcaagtctcagaaagcacttataccaaaggcaaacaggttaagacccaccaatctcagcattccacagaatactgtatttttagatagtgtacctatctggcattttgaatataggatataatcaatgtgggcgaaaactttaggcagtaaaggtagacctgaattggcatcattttttaaagttttatgttttttcttcaatctcctctaaaatttccagagccatgaaactggcctataagatttcaactcagtagttttgaagtgtgtacgtttccttgaaaattttagttttaaaaaaaaaaaaaaagctgtaattgtttcagaaacagggtagcatgaaggttactttggaagaacccaacacagcctcagagcctgtctacatgacat

SEQ ID NO: 191405 - DNA, 119 bp, Homo sapiens
gaccctggattctagtcttggggtacacgcccacgtgtaagagtaagcaaccacagctctctagacacactcatgccgccaatctcatgaaataagaggtaaggaccttgcaatgattc

SEQ ID NO: 191406 - DNA, 861 bp, Homo sapiens
acagcttgagctcggcagttcaagaccagcctggacaacgtggcaaaaccccatttctaccaaaaataaaaaaattagctgggcatggtggcataagcctgtggttccagctactccggaggctgaggtgggaggattgctggagcctgggaggtcgaagctgcagtgagctgtgattgcacccctgcactccaggctgggtgacagagcaagaccctgtctcaaaaacaaacaaaaaacaatttcattctctaattcatgtttagaaaagaacattggtttacaaaaaatttttaaagagttttttcagaacaaggatgccacttcctcttcacgtggcacctatctatacttctgagaaccatgaagactctctaattatcttcatattttatatcctcaccttgtttctttggtcccaaacatttatagcttccttccccattcttcttaattgctgcttcattgtgctatgcatagaagtggtgcagaattcttgggatttgttttttctacactacccccttcctttgctctccatctcagaagactagaagacaacttggtaagtgttgaatatattgtttctcagacttcttcactcaaaaaccaaaaccttcatatgacccacatctgctgaggatttacttgatggtgaccaagatgacagctgcccactgctaaacaacccaatgtcaacaactctttttcttgtctttctgctctaatgggacatcttctctgttttatttcttgaacagaaatttttcttaaaaccatcaaatgaacagtgaaattggcttggtcattaggaatatgaaacagaccaggcatggtggctcacacctgtaatcccaacac

SEQ ID NO: 191407 - DNA, 189 bp, Homo sapiens
gcggtgaattaaagaagattttttattgttgttatagtaatgataattttccagtatataattattgcctgcttaatggttcattggtaaacaaaccaggttttaaaagtcatttttaaaatgtaattttagactatataaatagaaatcttgtgtcaaaagtatgaaagacataaaaatcagactcta

SEQ ID NO: 191408 - DNA, 642 bp, Homo sapiens
gggccattgtaggccttgcagggaggcagtcatgctgggagaggctgatgcattctgatgaattctctggagtagtatttagaaaggaaaggaggacagccagcctggaaaaggatggagggaagcagggccccatccagggagtggggaatgagggatgcctgaggtattgaccttgctgttgtgggtctgaggtactctgcttcaagctcctgcccccaaggtcaaggcatttgtggtctcagaggcccaggggctgccggccacattgggtttttgagaagaccctcatcccctgcagagtccaagctccctccccatctaggactgaggcgcttctgcctgttgggctccctgcagcgggcgcaagccaggcctttccatgcccccagccagctgcccctttcacccccgcaacctctcaggattactcagccttcacagcgtctgtcactaagatgctgagtgcattcctgacggcctctcttcaggaaaagcccaggctgtgtggccttttaaaaaagactctgtgcccgggttaagcctctgattgtggttctgcatgaagaaaccataaaccaaagggaaagcgatggttcagctttggtcttggagctttgtgtcagcgtctgtcctgagtcc

SEQ ID NO: 191409 - DNA, 1164 bp, Homo sapiens
aacacacttgtcaaggccacagggttctgatgaatcttgttttcttcttctgccctgctttcttccaaaaaggattagaggcagcttacaaaaattcataaaatacaataggataaaaatagatcagagagaaaacaacactggaacacatggtacaatgaaccaagagggtaggacacagaaatgttctttggctggggctccacaatcctcaaaggtggactgcaaacaggattctgagcttcgtatcagtcaaaacaaagagggaaatctgccggttttgagactcacaaagtccacaagattaaaaccaaccctggctgggtgcagtggctcatgcctgtaatcctagcactttgggagaccaaggcgggtggatcacatgaggccaggagttcgagaccagcctggtcaacatggtgaaactccgcttaaaattagctgggcgtggtggcagacgcctgtagtcccagctgctagggagactgaggcaggggactcacctgagcctgggaggtggaggttgcagtgggccgagattgtgccactgcactccagcctgggcaacagagcaggattctgactcaattaaaaagcaaaataaacactcaacctagaagcagcgcagctatttctgacactaaagtctgagaggaattctcgtgggacctttgaagggatgaggggtagtgtcccaagcaacaccgtcaacaacagtccttttttgttttagagacagggtcactcagtcttgctccagcctgggcaacagggtgagaccctgtctcaaaaaaaaaaagtcccctgacattgccgaatgccctattaggggctgaaaaccactgctcataaaggaggagtgagccactttcttaaaaggttggtgcaaaagtaattgagggttgggtacggtggcttacgcctgtaatcccagcactttgggaggccaaggagggcggatcatttgaggtcaagagttcgagaccagcctggccaacatggcaaaaccctgtctctgctaaaaatacaaaaattagctgggcgtggtggcgcaagcctataaccacagctacttgggaggctgatgcaggagagttgcttgaacccgggaggcggaagttgcaatgagccaagatcatgccactgcactccaggatctgtctc

SEQ ID NO: 191410 - DNA, 306 bp, Homo sapiens
tccctttcccctagctgcctctggccacactgactccctgcacttgctgatcgacagtggggaacgagctgacatcacagatgtcatggatgcctatggacagaccccactgatgctggccatcatgaatggccatgtggactgtgtacatctgctgctagagaaaggatccacagctgatgctgctgacctccggggccgcactgccctccaccgcggggcagtgactggctgtgaggactgcctggctgccctgctggaccacgacgcatttgtgctgtgccgagactttaagggccgcacgcc

SEQ ID NO: 191411 - DNA, 609 bp, Homo sapiens
ccacacaaaattgaatttccacatccaatcaaagatgccattgattgtaatatgcaccattattttttgcattgctaagaaagaaaaagcagccatttgaaatatgattgatattttcttatttatctatgacttacttggacatagatttttaaaaattcatatactcatgcatatgtaaaaaggaaaatataagcaaagtatttctaaaatgttttcctttattaggttattaattacattttattcaatgttataaaggcctcacttacacaactagagttagaacattatgcccctaattagtattagttcatcaatttcatcaataaattataggaaacatggattagacaaactagttcaaccattgtggaagtcagtgtggcaattcctcagggatctagaactagaaataccacttgacccagccatcccattactgggtatatacccaaaggattataaatcatgctgctataaagacacatgcacatgtatgtttattgcggcactattcacaatagcaaagacttggaaccaacccaaatgtccaacaatagactggattaagaaaatgtggcacatatacaccacggtatactatgc

SEQ ID NO: 191412 - DNA, 118 bp, Homo sapiens
aaggaatgaagcctaataagatctagaaagataaagaaccatactgacattatttgagcatctgaatccaacaaatgcctgaagccaaatgcagccctgctctgcccagtcatgcgag

SEQ ID NO: 191413 - DNA, 466 bp, Homo sapiens
aggctggtgaagtctgtaaaggcttgttcattgactttgactttgtgtagctcagatactccattgataggctcttctaagacaagagctgtttatgcagcaagcccaccagtgccttaaaatagtagggcacgaaagagcaccgtgggtgtcctactgccggaggaaactgtgagggcctgctctgtgctcgggccctggggtgcagggtgcagtgcctgtggttccggggcctcccagactttcacataagcaactctttctttgtgtgacaagcaggtgatgtagtggaacaaacacagtctttgccgtcagatctgcgtggtcccagcagtgccactgaccaccaagtttctctacctttctgagcctcagttttctcacctgtctgaagggagtggggatccttgcttacagagaactgttgtgaggatggtgtgaataaagtgtcttgcacgttgtgtgg

SEQ ID NO: 191414 - DNA, 843 bp, Homo sapiens
catgtaatagttgttctcactgccttcccaaaactgtctcattgggaagttactcagcccaaatctgaacctaaacagccaaaataaagagatctgattctgaagcaatattttctgagtttgaattcatcgagtacctaatattaaataaatacataagctagtttgaagtacaacttatctagagcatgtctttgtagataagaaaatcttcatgtttttcaccgtatctacttgaggtagaatttattggcaaaataactcaactggatagattctcaagaggaaaatagtcaggcaatatttgtgtataagaaacagagccctgttccttagaagagagctgtctgtatctgtagctgggtgaaaaacaacatgacattggtgaactgtgtatcctaaggtgtaataatctgggggaccaggaggatgagccaagagggtgggagataaggctaaaaaaattggaaaacaccagtgacaaaggcacctggtagctgctcaagggtttagagtaggagagccgtctgaccacatttacatttggggtacatatggtggcagaaaaatggaggattgggggatcagaatggtaagactggaagcagggaaatgccttaggttactattagttgtttttatttttaagtaagaaatgttctgtagtgaacatgtattaattttgtaatagaaaatacatagctattattttgtatgaaatatacttgtggaatggtttattatatagtcccaatttaaaaaaatctacaattaaaatcccaattagagattggttattcatgacacttgatgtctttgctcaacaataggattccatcacag

SEQ ID NO: 191415 - DNA, 545 bp, Homo sapiens
cgagctcgttacccgtcctacatagtgttatcgtgtatgaagcatacataaatacccacatacttagagaaatatcagtgaaaatagatcttagtggtcctagcacagtaaagtgacaaaagactaaaaaaaaacctagagttacggctcctggaatccttctgacttttttgaccatagtacttgcgagaacgcgtcccttgtgaatctaggcaatgacggcaacaggagccatgcagcagtgacagaacgtctcatgggattacacaggggatgcagatcagtgaagaaatattggtgcttataaatagtcatgacaggaatggaaaaaaggacaggctgagtgactttaatattcaataaaacaagtaatctcatgtgaaaggcatgtgtttttgaagatgatggaatgctcttattctgacacctgactctagaggtggtttaagtcagtcctatagacaaggcagtgaacttgatggggatatgtggaactgaatggaagaatggaagtgtgaacactatgtaggacgggtaagagctga

SEQ ID NO: 191416 - DNA, 346 bp, Homo sapiens
tcaaaatttaaagccatctgtcagaatctgtttgagtgctaaaaaaaattaaattgaaaaaggacttgtactcttgaccatatgaagaattcctacaactcagtaacacaaacaatatggtgagagatttgaatgacacattatccaagatgatatacagagatggaaaacaagcacttgaaatgatgctcaacatcatttgccatttggggaaatgcaaattaaagccacaataaaatgccactacacaccttcttaaatggctaaaattaaaaactgaacatcccaagcattagcaaagatatacaggaagtagaattcttaaaaactgctagtgggaatagaa

SEQ ID NO: 191417 - DNA, 237 bp, Homo sapiens
tgatagaagcctctgtagaactctcaagatcccattctcttccctcaccagaggtaaccactctcctgaattaggtgtttatcactcccctgctcatttttattttcatactacatgtataatccgtaagcaatatatggttttgctatacttgttttaaaacttatacaaatggtatcaaacgtatcttcccccgagaaacccaaaaacatatcttctacagcttcctttttgtta

SEQ ID NO: 191418 - DNA, 237 bp, Homo sapiens
tttgtatatgcacatttgaagttcatgtgattctgctactctgaaaaatgttttgcattttttgtttaaaaaaaaaaagtagatttccttttctttacagttaaattagcatattagtttaaaaaagtgttgtattttatggttcattaacagaattttacgattttctaacttgccaaggattatggtgtttattcttgaacattgcaagccccattgaaagtttggatgtaacat

SEQ ID NO: 191419 - DNA, 788 bp, Homo sapiens
attggtatttgtcgagcatcaaataaaacaacattcctacagtgttgttttattaaggaaaaacacagaaacctacaagacattgactgtcctttgctgggtgtagaggaaacaagatcatgcttatatttggtagaagcaaaataaggcatagcctgttttgttcacagtcctgtttttttttttttcaccctttccactagctacagagcaagaaagtgaaacatcaagtttaggaaaagctatgattttcaggcaaaagagagttgagaaagggagagaaaatattttaggagatttaggttctgtaagtgttctaaggaaagaaaagaggaatgaactgatcttttgtcttctccttccagtgtccccttggagacccacatctcagctacctcgggctttaaacattttacaaacaccctccttcacagatggaagtgacctttcattctttacagccccatctacaccctgaacaaacatgtaacagtgtctgggacaacctattgcatctactcattgagtgcctggttctcctatctcttgggttctttgaggactcagtcatatgtgcatccacaagcttagcacagtgcctcacgtagacaacatggaacacaaagccgcaggcaatctgcttagcagcagcaggcaatctgaataaaagggtcagggaaggctagggaagctggattgccagaaaccatttttacttacgctttgtacttatttgggttggctgagaggagctcatagagattagggagctaattctcccaagccac

SEQ ID NO: 191420 - DNA, 277 bp, Homo sapiens
acagaggaggaaaaggatttttgtaagaaatgtttgaggtgaacctcacagacacagaaagagacggaagagggacaagccaaggatgattccaatgtttctggcttgagttatctcaagttgagttatcctggtattgctgatggtaataccattcagcaatcgaggaataagagagggcctaagacttacagagaggccaggcacagcggctcacgcctgcagtcccagctactcagaagggctgaggcaggagaatggcgtgaacctgggaggt

SEQ ID NO: 191421 - DNA, 457 bp, Homo sapiens
cagggacgctaggcaaataggttaggcccagtaagccactctcatcagttagggtggtgggagccctccccaaatccaagctcccaggtgccagccaagggtcaactttgcaagcatgactttctaaagatagcagtctccggcctgcagtgtgaagtctttctgcacagggaattatatatacctttctccatatttctaggggttattttgtttgttttgttttttcttttgttttgtttttggagacggagtctcactctgttgccaggctggagtgcagtggcgcgatctcagctcactgcaacctccgactctctggttcaagtgattctcccgcttcagcctcccaagtagctggcattataggcacccgccaccatgcccagctaatttttgtatttttagtatagacggggtttcaccacgttggccaggatggtcttgatctcctgac

SEQ ID NO: 191422 - DNA, 292 bp, Homo sapiens
cagattaaagtgtggttggttgaatccatcattaagaatttatcttaatgaaacaattttatctctaattgattcgttgactttttaatagacccttaacatttacagttacattcatgtctcaaaacacttgcaaatgtggcctgcagtttctctctgctaaagtttcacatctaatcccttatttagatgtgataacatcagacattcctgggcagttttcaggtggttctgtggttactgattacgaacaggaaaacagcatctctatgtacatatcatgacctgttca

SEQ ID NO: 191423 - DNA, 406 bp, Homo sapiens
atccaagttcatagtagcaggtctcattcatgatcatcttatactttaaaatgtctttccttcttttacactctgctgtgtatggctatgcatttttatatgtgtgttacttttgcatatattatttaaatgataaaattatgagcctgtaatcccagcactttgggaggccgaggtgggcggatcatgaggtcaggagatcgagaccatcctggctaacacagtgaaaccccatctctactaaaaatacaaaaaaattagccgggcgtggtggcgggcgcctgtagtcccagctactcgggaggctgaggcaggagaacggcgtgaacccggaggcggagcttgcagtgagccgagatgatgccgctgcactccagcctgggtgacagagcgagactctgtctca

SEQ ID NO: 191424 - DNA, 315 bp, Homo sapiens
gtccgttcccacactgctataaacaactacttgagactcagtaatttatagagcaaaaagttttaattggctcacagttctgcaggctgtacaggcttctactttgtaagtttttcgggaaacttacaaccatgatggaaggcaaagtggaagtaggcacatttttccatatccagcaggagagagagagcaaagggagaagtgctgcacactttcaaacaaccagatctcaagaaaactctatcacaaggacagcaaggggaagtccacccccacgattccatcacctgccaccaggcccctcctccaaaactg

SEQ ID NO: 191425 - DNA, 431 bp, Homo sapiens
gactgggaaggcagtcatgaacaagttaacaaataatgagtaaactaattatagatctggaagagtgctttcaaacaaataaataggttgatatgacagttagagacagggttcagaagtctagtttctgatagtcattaggaaagcctaaaacttgtaagggagtcagagacagctattcagaggtgggaaacagcatcccagggaacaacaaaggcaaagatcctgacatgggaaagaattttgaaggatggtatacacttagcagatcttcaatatagtaagcacatgatgaataataggtaatatgtttatagacaaggaggcatctatttgattatatgccatggaaaactaacctaataaaattagtcttccattttttacatacagcacatagaataatattttaagtggcccatcttacaaac

SEQ ID NO: 191426 - DNA, 364 bp, Homo sapiens
aagtgaatagaatgtgagtgttgggaggagaacagagcaggactggatattatgtggaaaaagaattgaaaaatgcctgaattgagacctaagagacctacgctccagtcttgatttcaacactagttgtgtgaacttggagaatttacttcatcttcctaaatcttgatttcctttgctttattctgaaaaataaaacccaaacattgagatgacacattggactagatagtatctaaacttcagctctaaaattttgagatttgtaggataattattgctaaagattctgggggagagaggaagggacgacatgttcatgcccattcagattgcactccaaggaccatcacactaataaagt

SEQ ID NO: 191427 - DNA, 334 bp, Homo sapiens
ttctatcttcacccgttctgtggcctttcagttttagtcatgtcttgctttagccagtgtggctagatgtgatgctgggtcaattctgagcctaggacttcagaggctttgcatatttctgtcaagaggtgagctgtttttgaaaaagctgagctgccaggtagttaattaagacaataagacaaaatgaaagtgacagtcaagcacttaatcacttattgtgatagtataagcaagaaactaaacaagagtaagtgctggttcctgcaatgttccatttttgcctgtgaaacagcaccaggtgagggtcaggtgtatcagtgcagatagtagg

SEQ ID NO: 191428 - DNA, 163 bp, Homo sapiens
ctctgtttgagatggtatggtgcaacctgggttttggactcatcctaataggactgcttagagttgggaattccccaaaggaagcagaagaaaagagaaaggaagacctgctgggcagaaagaaaccatagttattcactggccactaggatctagggactag

SEQ ID NO: 191429 - DNA, 613 bp, Homo sapiens
aaggtatcctcaaagattatcagcaaagcctaaagctcaatgatatgtcatattaaagagatggttgttgacatcatgaaaaaattttgaagttagggaatgatccatcaaatcgcaaaactattaccttttaactcgacaagtttaagagaaaaaatctatttcccaaaaaattgaaagttaagtataacttctcaaagcaattaaagaatgaatggattgtaaaacaagcttcatcttagttcttaaggtggtctatgacatgttctagagatagagtctaaaaatctatacccatatataatttaattagaaaaaatgtttctctttatactcatatagtcccttcctctttaggacttgaaaagccaaatgtattccacatcaatttgttactttataatgcttgaatgcagacaccaaaaattacgaataatctcattcgtcaaaaagagttttttgtttgttttttttgtttgttttgttttgtttttgagatgggagtgtcactcttgttgcccaggctggagtacaatgacgtgatctcggctcactgcaacctccacctcccgggttcagacaattctcctgcctcagcctcccgagtagctgg

SEQ ID NO: 191430 - DNA, 446 bp, Homo sapiens
tcaaaggttgagagctggtcccgagtatattagttccccagcattttgaaacttcccatagaccaagcatactcctttggccagaagaatctctcaggtagagagagatgtgcagaaactgggagcgggggttgatttgtatacaggaactgtccaccaaagcttcaggtggtatctcatgtgttctgagggaacagggcactgacagcagctgctacaccccctcggccagaaaactcactccatcccaccccaaggaaaccatcagatccaggtctaccccatccattcagttaagtccaattccacatactttccttgaactcaggtgacattccaggcagagtgatggagttgggggtgagagatacaaacttggatcagacccaggctcagcctgcaaggaacttccagtccaacaaagaggaacatgataaatacacaaa

SEQ ID NO: 191431 - DNA, 160 bp, Homo sapiens
caaagtaatcataaattactaaacagcctaccagaacaaaacccaatagtcatgaaagacacataacatgcacaaaaaaattcagatactaaacaatgtaacattcacaatattcagcaggcaatcaacaactatcagacatgccaagaagcaagacgat

SEQ ID NO: 191432 - DNA, 462 bp, Homo sapiens
tttctgtgctatttgctcaatttttatggaaatctaaaactgttatataaaatctattttttaaaaaaggccattctatggcttctagaaaaaatgaagtagacatacttttccctattccctccactaagtacagctaagaattctgcaccgtatatacaaaacatgaaaagactctgaaaagtggaaagaaaacagaagaaccaggaaccttgggatctgaggaatgatatgacagtgagtttcacagattttctgttttgcctcatttatcctaaacttggcactatagaagcaggtttcaaatttccagatactagacacagcaacaggcccacattttttagaaagttccaaaacagcctgctctttctagccataggatcaggaaagtggcagaactgctcaactcgagtcaaacagcatagagaaaaaacagctctatccccattcccatcacat

SEQ ID NO: 191433 - DNA, 416 bp, Homo sapiens
tgtgggatctggtcttgaaaaagtaactccagagctccttgccattgcagctggtgtgactgcacttgtaatgtgccctatagagaagggcaactgtgaggtagctgggctgatcatggtttccaaagtgagttcctggggagttgtggccccctgaggagctgaggtagtggctgtggctgatgacagagatctcccagtgtcccagtcaagagtggacagagaatcaaacagaaaagtggacaggggcgtatttgggtcagtctttgtactagcatgatctgtagaaaccattgaaacaggcacatcttctgcttctgtactactgggagtccaacttgtacttaaaatgtcaggaactgagatgctcatcctctggacacgagaaaaagttgagatgggagtagatgcagttg

SEQ ID NO: 191434 - DNA, 102 bp, Homo sapiens
ttaggattatgtctttggactaattttgagtaattttgctacttttcactttattattattctcttaatgtagttagtccaattctaaggtttcagttataa

SEQ ID NO: 191435 - DNA, 297 bp, Homo sapiens
acatgttagaactgaattcagatatttttataattaccaaaccagcaatgtatatcaatattgacacccatagtcatgagtctgatcattgctaaccatagtgggctgttgccatcttttttgactacacataatattagcccatctgaaaagggagggagaccagacgagaaacaaatactttaccatgttttattcaatttatttgccaatatgaaatttctgaataatctgggaccagacttacatacactacatatgtaatagggttcttcttcttctcttttgctgttttat

SEQ ID NO: 191436 - DNA, 276 bp, Homo sapiens
tgactgagactgagcatattaagtttatggtcagaagttatgtaggaaactcccattaccattcccaagatacttttgcccaggagggcactccatcccagcttgtaaaattgctgggacaaaaatgattatcgtagaggaagttttgctgctggctttaaaatttttattatgaagtgactaagggtctgtggtttttagcctttacttcctataaggtgtaatccacctggagaagatatttctggtcacatttcttttgctattcttaggaga

SEQ ID NO: 191437 - DNA, 341 bp, Homo sapiens
atgtcactgtctcccatcacccccagataggaccatctagttgcaagaaaacaagctcaggactcccactgattgtacattatgatgagatgtataattatttcattatatgttacattgtaataataatagaaatagagtgcacaataaatgtaatgcacttgaatcatccccagaacatttcctcttcctccctcctggtctgtggaaaaattgtcttccaagaaaccagtccctggtgccaaaaaggttggggactgctgctatatgtgtttcctgaacatcaattgtaatagcaaaaatttgggaacaatatgtcaatcatcaggcaggtgaatgaa

SEQ ID NO: 191438 - DNA, 258 bp, Homo sapiens
gccattacaagggcctttactgcggggctgtgagcacagatgttcagctacaactaaagagcagacccccagggaggggctgttttcagtcatgcatttggtcagggagccatgaaggcttctcaggtgatacactaagcttgactaaaaaagaaaaactgagatttgctagtttcagaggaccttctatttatttgttatttgggaactgaagctgaccctacccttttcaaaagatcatcttttcattgcgtatgg

SEQ ID NO: 191439 - DNA, 235 bp, Homo sapiens
tctgtactgtgttagtttgctgagaatgatggctcagcttcatctatgtcccgcaaggacatgaactcattctcccagcctctctttctatatccaaaatttttgaagttctctctacttatcaccacagtgttcaaggcatagatgattttcccccagatcttgaaaaaaatttttattgatttgcctgttcattaacttaacaattggtgagcatatgtctcaggcaggatgc

SEQ ID NO: 191440 - DNA, 386 bp, Homo sapiens
ctgggtcaggaagtggaattgatgtttgtatgtacataggtatattttaccagaatggatgctctattcagagtttcgggtgatggacagaacttgataggaattgctagcaagcaatataaccttctgcctttgcaagccaacttaataaaaaccaattactagtctatatttcgttgattacaaaatatttttcacactgcataataatatgatagtcattagcatttctttagtatttaccataaatgaggcacagtgctgtgacagttaatcacagtgctttagttaatggatgtcatgagcacccccgaaatgcttgtcctgtttttcttcttttctgcattgcccctctccactgcaccccaccaccccactccactctc

SEQ ID NO: 191441 - DNA, 902 bp, Homo sapiens
ggcgacgcaacgccgccggcagcttttcagtttcatagaggttcccagtgccaccttctgtgatgtcattcccaagaggaagtcagacccagaaaataaagcaccccattggtacacgaaagggaccattggaggtgccacccccaacagagaaggactggcctaaagacgatgaacaggatcatgtcctcgtggatccagatgaggagctggattccttgcctcagccttatcgaatgatcaacaagctggtgaaccttctgtttgaccagtcttgggaaattattgaagagagaaacgcactgagggaagctgagagcagccagatccagcccaccgtctaccctccacttggagaaatccagctcaacaaaatgccaaattgtatggctgtttcccaagactatgtgtttattggaggagccaaaggattctcaatttataatctgtacagtgctaaacaaatatatgcgtgggagaagcttaaggttgatgtcacttccatctgggccacagatttagggaatgaaatactcattgctcctgtggatgaaatgggtatcattagactcttttatttttataaggaaggactttacctagtcaaagccatcaatgaagtggatgataccagcaagcaaactacctgtataaagatggagatctctcaaggaggggactttgcagccttcctcctacaaggagccggagatatttggctggatgtgtataaattgcccaaggagacttggctcaagaaactagagcacccccaactctttgcctcaagcagtcctcttgcctcagccttccaaagtgctggtattatagttgtgagccactgtgccctgccaagtctcttttaatattgaggttctgatcctgtgtgtgtagcaggatga

SEQ ID NO: 191442 - DNA, 758 bp, Homo sapiens
ggcgacgcaacgccgccggcagcttttcagtttcatagaggttcccagtgccaccttctgtgatgtcattcccaagaggaagtcagacccagaaaataaagcaccccattggtacacgaaagggaccattggaggtgccacccccaacagagaaggactggcctaaagacgatgaacaggatcatgtcctcgtggatccagatgaggagctggattccttgcctcagccttatcgaatgatcaacaagctggtgaaccttctgtttgaccagtcttgggaaattattgaagagagaaacgcactgagggaagctgagagcagccagatccagcccaccgtctaccctccacttggagaaatccagctcaacaaaatgccaaattgtatggctgtttcccaagactatgtgtttattggaggagccaaaggattctcaatttataatctgtacagtgctaaacaaatatatgcgtgggagaagcttaaggttgatgtcacttccatctgggccacagatttagggaatgaaatactcattgctcctgtggatgaaatgggtattgttcttcatcttcctttttagcctcatttacaggtacctgtagactgttgtcaatttaatctccttttgaggtattggtggggccaggcatggagacttctccctggtcatgtaatagtaactatatgtacagaacaggtatggtgggtcagatactgttctaccatttcacatgtgctagcccatttaatcctc

SEQ ID NO: 191443 - DNA, 480 bp, Homo sapiens
gcaagtggcctccacttagatacatctaagaagacaagtcagaatagggaacatttgtttgaaaagaaggggggaaaaggaggtgagaagccagaagacccattcattcaacagtgtatctctgtctaacaacagtgtatctctgtccaagaataaaataaaacctaagaacccacataagcccttgggttctatctccatcttttaaaaagaacatcctcttgtctttccctacaaaaatcacagtgcatgccaaatatagatgagttaaataaatctgagtccattttcttttgttttgttttgtttttgagacagagtctcactctgtcgcccaggcaggagtgcaatggcacaatcttggctcactgcaacctccacctcctgggttcaagcaattctcctacctcagcctcccacgtcgctgggattacacacgcatgctgccacgcccggctactttttttgtgttttagtaga

SEQ ID NO: 191444 - DNA, 267 bp, Homo sapiens
ccattttattgtgtactttccttcaacattactatttgttacacaatcaatagaaattcaggaagatacagatttcaaaaccaatcctaaggtgctttacaagctttatacaacatcctcaatagggaaaacttttcagggaggaacaaaatgttaactataagaagggtctccataggaaacatttcattatggcattaattaaaagttgctagtttctatcttataggactgaggaattttcagacagataaccttactatttct

SEQ ID NO: 191445 - DNA, 624 bp, Homo sapiens
ttactgttgagggatagagagataagtaatcacagtaagtcccaggacactatatgtggaagggaaagaaagaatgcaggtgacacaactaactctgtcaggagagtctcccccacagcaaggtacgaataaggaccatttgttctagtctccgtagcatcctagcctatttccacttcctcttgtcatcatctgtcctcttcaaagttcaaatggctcaagaggcagagattgcgtctctcttgtccattcctcagcattcagcaagtgttcaataaacatttgtggaatgaatatatcaggttagggacacaaaaacacattacaattccataatagaaatagaaagtgatgatatgcttacacataggaagaagtggctaactctgccagggggaaaaaaaaacaggaaaaatatcttacatacatttatacactcacacacatgcagctattacaatgataacaacaccattaagcaagacttatttgtggaaccctaactattcaacaggcataatcccaagagttaatgctcacaacagacttataaggaaactagtattattatccccatgttacagaggagatggaaacagaggcacagggaagggggggtggcct

SEQ ID NO: 191446 - DNA, 521 bp, Homo sapiens
ccaagcactcctgctactatttgtaggactggctttcctcagccttctgatttctgcttaaatgtcactcttcagtgaggtcttccccgagtgtcttctctaaagtaacccctcaaacactgactctccatcactctatttccttcagagcatttttcacaaaactagttaatattttcatttatttgtttacaagtttattttctgtctgtccaactagaatagtaaactccacgaaggcagagacctgatatctttctcactgtggtaaccccagttcttagcacagagattatgcacaacaagtatctgtgggaggaataaatgacacagtgctaacaagtccacaaacatcaggtgagggagtgaaaggatcatatggagttttagaaagatgactgtaacctctggtcaatatgctggatggaagttaacaagggaagtgcctcatacaacagcaaacacataaatgttcaataaaatagaacaagaagaatttagtacacagcagagctcgaaag

SEQ ID NO: 191447 - DNA, 143 bp, Homo sapiens
taatccaaaaactattattttccctgaaacatatttttaatagttggatttgaataaatgcatctgctgttataataactcatctgaaaccgaatgatgttcaaccatgaagacatgattctggaagtcttcctatttcccat

SEQ ID NO: 191448 - DNA, 241 bp, Homo sapiens
  misc_feature (28)..(28): n is a, c, g, or t
  misc_feature (31)..(31): n is a, c, g, or t
ccccgcagatggaatccaattaaactanagngcttctgcacagctaaagaaaaagaaaactgtattggttggagtaagaaccctgttatttatcaaccttgttggcttcacaaaaaccctccccacactatcaggctgatgctggtcacttgagctgcctccagcatgtgcccagtgaggaataatagccgatgatgagtacgagtacttcccaaggacagttttcagtgacagaaaagag

SEQ ID NO: 191449 - DNA, 627 bp, Homo sapiens
aaagaaaaagagggaaaggagggagagtagggggatgaggggtacctttccctttgtttctctggtgggggagagagagagagagagatacagcaagccagaacactcattgatggatgaagggtcaccttaccatgacaacttcaatatcagatatcttggacccaagaccttgggactgtcccagggacccacaatcctagagagacatgaaccagtagaagtataataaaagaagactgaaaaggcagaaagggaaaggaagctaggaaaaacaggctcccgtagcagcaaatgtgaattggggaagagaggggttgttgttcagggcgtgtccttggagtccctgagacagtggagaactcacccatcagtggagacaccaaaaaaagtgttcaggcggctgcttttctgccattgcagggagtcgtcattaggtcaggggttcagggcctccagaaaaatgggcttgaacaaggcagctcatttgggaccctcattttgagcagaaagaaagacaggaagagacctgttgcagaaaagaaaatttatgattttaggagggactagaagaagttgctgaagtggatggaatgacagagtaaggaaaaaaatgaaacggcacca

SEQ ID NO: 191450 - DNA, 202 bp, Homo sapiens
tgaggacataagagagcaaaggaaggtcacttattccgaagcaagaaaagggatgaactgatgagaaagactaagaagaaactaaacagcaaaaatgatctgaaactgaactacaacactcaggattccacacaagaatcttggtagctcccttaatgtaagcacagacccgtaagtaactattactaattctctctgtgaa

SEQ ID NO: 191451 - DNA, 207 bp, Homo sapiens
ggccaattaaatataagtaacagtcattcttcacttcaggacagaaatactaagaaccaggatatggttctcccaatctactattccctgccaggcaaatctgaaggcatgttgaaaggatgcttctgtcagcctgagtccctaaatgactatgataagcaaagcttccttgccaacttgtgatggacatgtattatgagcaagaaa

SEQ ID NO: 191452 - DNA, 537 bp, Homo sapiens
gcaccatatggccaacaggggatgccagcgacatccctaatttctctggcttcctgataggtcctggtagggtcggggttccaccgggatttgcctagtatggtctacctctgactgaaattaaactctaagtaggtaactggggaacgcctttctccagagagaaggttttgatgtgatctcatcatcggggactggattggacctggagaaatcagtttttctatagtcttgtttctagagtggcaccctggtcttgggcaggtcagaaggacagatagttggtcaccatcttcaacacaaatcatggctggaaaagggccccagtagggagtgcctttctcactcaccaatcaccaaggctagaagatagtctgcagattctttcagatgccacaaagctgtgattacagctgcccattggcaaatcaggtactagtttttgttaatcacattgcagtcttccttcactgtttcttcccctggtcccggaattaaggctgggctccatttgacaagttatcttctgtgcaggta

SEQ ID NO: 191453 - DNA, 656 bp, Homo sapiens
gcaggctgggctcagccctggtacgggagtggggaggtgggagtagtagggaccagaaaaagtggcagctgttgacaactctgccatctctttctgaatgtaatgggaggtcctgtcttttcagcttgcaaggaaggagggtccgaggcaactccgctgttgcacatttagggacccctgaacttaaatgacagaatgccctgaccactctggaaggcactgtgttcatgtttgtgtgcttgactcttgatccgtaaaagggctgtttgtgcaggtcattaactgtgagattcagagagtaggtgcacacgtccctgcagagattccagcaggactgaaaaccagtagaaatatatcagcacctggatcttgcctcctgagtcagtaaggatatgccacagtcacgaaggcagtgggatttcgagggagggaagggaaggcggcaggcggggcatgccctccggggtgcccgaacacacctgctgcatccacatgtcttcagagccctctccctgtgggaggcctttttcaggacagccttggtgaactggaaacggaatcccagcccttggtggccctgcagtgacttggacctttccgaggtcaccctgccactgcgtgcccttcagtccctcctggcagtgggggcacatccc

SEQ ID NO: 191454 - DNA, 115 bp, Homo sapiens
ttttctttctgatttggatttttaaaatttctttttattgcctaattgctctggctaggacttttagtatgccattaaatggaagtgagagtgagcatccttttcttttttccga

SEQ ID NO: 191455 - DNA, 170 bp, Homo sapiens
aggtgcattgactagtgaaatcttaacccaggaccctgcctagagatggcttcattttctagggaaaaggaaacaacctgtaaatcaaagggcagcctttcctccagaaaactgcatagtggaggtctctgaccaatgtggtggaactaaagtccagccttgattgcttc

SEQ ID NO: 191456 - DNA, 542 bp, Homo sapiens
ccgctctagagtatcccctcgtcttttgataggcacttgatgaacttaggagggagttatagtcttcattttagagatgagaaaagcaaggcttgaagagatcaagtgacttgcccaaggtcactcagcttataaacgaagtggtcagaatttgaatacaggtcttctggatctatgtgaaattctgtatttaggcagtataacatagcggttaagagcatggactatggagttaaactggggtcaaaagccagttttgacatttactagctgtgtggctgactttgggaaagttacttaacctctctaagcctcagttcccttgtctttgaaatttatttaataatactgacttcagaaagtgattgtgaggattcagtgagatcaggcatataaaataattagcattgagcccagcacctctagaaacacctcagtaaatgttgttatgattaatattaatacctttgcgtcactacctattagatacagatttcatgttttaatttgtaatcccagctctttcactattctatacctat

SEQ ID NO: 191457 - DNA, 189 bp, Homo sapiens
actgtagtgatacatatatatatatatataatatttaaaatatatttatatatatttcatatcacagtgaaatatatatataccattatatatatatatcacaatgaatagtatatataccattatatccatatattcatatatctttatatatcattatatagtgatatatattctttaaattatata

SEQ ID NO: 191458 - DNA, 405 bp, Homo sapiens
cagggacacagtggatgaagatggatgctgacatggcaaacaggcaggtaacgtgatggggaggacaaagccaagcagacacaggtgcctttctctctgcgggcagtgcattagataagcttctgattgcttctcttttattttgttttttttgttttgttttggtttggtttggtatttttggaatggagtctcactctgtcgtccagggtggagtgcagtggcaagatgtcaactcacctcagcctcccgggttcaagtgattctcatgcctcagcctcctgagtagctggaattacagacatgtgccaccacacccgtctaatttttgtatttttagtagagatggggttttgccatgttggccaagctggtgttgaactcctggcctcaagtgatccgcct

SEQ ID NO: 191459 - DNA, 423 bp, Homo sapiens
gaagttgaaggttgagttgatcaccagtggttagtgttttaatcaagtatgcccacataatgaaaccagcgtaaaaactcaaaaggactggtgaacttctggggaacttacagattcttgagcatgtggaggtgcctgagggtggtgaactgagtctctaataagcttccgtggagggcatggaagtcccacgccccttgctacaaaccttgctctgtgctatcccttccatctgcctcttcatctgtatccttcgtaatatcctttattccttttcccatttgccctgagaatactcacctttggtgcttgcagctggagcatttaccccgagataactttgccatgaacgatctcacttttattattttcacatcgctctagtaggtcgccttgggaaacaaaagacatcattctacttat

SEQ ID NO: 191460 - DNA, 364 bp, Homo sapiens
tgagttgggggtgatcctcatggcttcatggaaatgctccatagcggcctggagacagacttcccctcccaactgcagctctctgaacagagaattatagctgagacccaggcactaggggtatggatgacacagctgtatatacgggctacctaagaggcaggaaattagtcacacaacaggtgtcaataaatattccttggtaatttgcacccaaggcactagtgggggctcggggggtggttataatatagcttaacaataacccaggattcactcctccaatccccaagttctttacctttatatggatagcaggttgactgcgatagtggggtgaatggtgaccccctaaaagttatga

SEQ ID NO: 191461 - DNA, 229 bp, Homo sapiens
cctggagcatgatgaagcttggacttcttccacttcttaggacttttcaatttcatccatgtcaacagccaagccaacacgctgttgctccaatatgtaaaaggcacttctgtagggctggcatgagtcagtcagttcaaggcaacctgaaggagttgaataacatctatccagtgagtcctgcaagacttcaggccctttctcatccagcagctccctgctgagcctg

SEQ ID NO: 191462 - DNA, 432 bp, Homo sapiens
cagaagggtgaaattttgctcagaaatctctgattttagatgcttcagttttccatttaaagttcataatgaatatttactagaattacttttatcatataagagctctttaaaaatgtagagtcagtacaggtaaatgttattagtgatggagcttgtactgctcaaatagccacttcctccataactttgtctaccttggccaggaactgggtgcatgttttcagtgtatctgggtctatatttgagtctggaacaaatggccctaaggtcataaaaggaatcaggacatgtaccattgtgcaacataaggttacagaaaaacctatttatttttccacattattgctgactgtatgaggaaaaaattaaaatgggcattagattacatatagcttttttggttagtcatatgtaaaggtgagtgtatgt

SEQ ID NO: 191463 - DNA, 245 bp, Homo sapiens
attccaagtggacatacgttgggggagggcttggcctcagggtttgtgcttatataatgtctgggtttcaaaagtcttatctcctctgtgatttgaacttgctgaagtactgctagtgctaaattgaatggaaaaaagtttataatggtagtttaacaagatagtggtctagtcttgcctctccgcaagaagagaggctccatttattttcctgaaaactgtttcctacttggccgggagactta

SEQ ID NO: 191464 - DNA, 340 bp, Homo sapiens
aaaatagagtaaagagggaaacgaaaggaaagagagaaatgaattaggcagtctccaaagcacactggctcaactgggaaactgcgaccaaagcaagctccataatagtataatgacctttaatgagtgtcttgggaaacaatacagccctagcataaaagacaaagggcaaaactcatcatggctctgctgacactaattcaaaatgattttcagaacaactaaagaatgtaagagaagtaatctgatccgcccatctgacctcactttgattcaagggcccttctcctgccatttctaattgtcaaaccctctacatttcacatctgttcatatttaa

SEQ ID NO: 191465 - DNA, 92 bp, Homo sapiens
ctccttctcaacttgtgctggctgccaagggaggcttcattagagtcccacttaagaagatgctaattgtgacatttttacatgattaacga

SEQ ID NO: 191466 - DNA, 646 bp, Homo sapiens
  misc_feature (148)..(148): n is a, c, g, or t
  misc_feature (225)..(225): n is a, c, g, or t
  misc_feature (240)..(240): n is a, c, g, or t
  misc_feature (303)..(303): n is a, c, g, or t
gaatgtaaatataaccaggtgacatggacataccgtgtataactgacggtatttggacaatgtgtcccacactttggatgattctgtgacttcgttattgatgccagtggagtaagatgtatattcgtggggcgacctagaggctctnttcttccatacaatcacccgtggaagggggtaatcctggaacaagaaatgaggtgactttttggctggggtaggaanggaacttcctccccnattcgtggggttcgagaaacctcgtgctcctgaggtttggacaagggctacgggctgctcccnatgagaggatgaagtgtatgacatgaacgaggcaggccagcgttgctggcagctaatattttatgggcagcaacaccaacagcgcagagaagtggccagtgtccccacagcggggttgctgtctctgtggtctctctggatgacagcgatgccccttcccccagctccttggcccacctgcattcatctgcagctacagacagctcctagcacactgatggccatctctggccccaaggctctctcctctgtcaccacaggagcacagcctggaagtttttatttcctgcacaggtcaccctcaaccacagggggaaaggagccataggataaatgcccttgc

SEQ ID NO: 191467 - DNA, 325 bp, Homo sapiens
atttaccatgatgttagctccaacaagagtaaatgaccatattttggtcagtgctttactctcagtgaataaactagtgcctagcatggtgtagtgcttaatggagatttttttgagtattaagacctttgttcatgatatgcccattttttaatggatatatttttatagctatgttgaaaatgtgttttctttgaattgttaaattttatgttaggcttttaatgtttatgaagagtgtgtgatactcttcataaaaataaaaaccaagaataattaaactaagattatgctaaatttagtgataggcttttggtgggaaaga

SEQ ID NO: 191468 - DNA, 739 bp, Homo sapiens
ggccccaagtgtgaaaggccagctccaatccccctgcaaaggaacagccagagccttggatgttggaaagtgaatgtccaaagtcatttaagccagaaatcaaattttgtcctcaccttttgagttaaatcctgaaagcactgaagtcagcccatctctctgacgcctcagcctcctctgtgttagacagaaggttcccagcgcccggccgcagcggcttcttggagtagctgcaggctggctgactccccggcatgggggtggccccttccaggcctgagatcttgcaaggcagcctctagtgggccttactttttcttgtaagtcccacaggaaaaacaggccagtctccaacctgtagaacccatgtgtgctggccaagccccttgagtccctgcggcatcagagcaagggggtggctgagccttgctgaggcagcgtgctgcttgcctggactctgacccggtgtgaccgagactcagcaggccgggggcatgtcctctcctgtggacgctgggcccaggcagggctcccaaagttgtgttggggacctggctggtgaggcctgtcaccatagttttgaggccattcttttctcttgtttgaaacttctgattctccaccgtgcggggggccagactcgtgtctgtgaagagtctctcaggaataggcagggatgctgtgtggacctccgtgtcagggacacagccagcagatctctgtccagcactgcctgaga

SEQ ID NO: 191469 - DNA, 566 bp, Homo sapiens
agattcctgtgggggctgcttttgtgtgtttttgtgttgatattctgtaggatttgtcctcagaaacagcaaacatttattgaaccttatgctgaagataatgggaagccattaaagcaagggtttttaatcagggttccaaagattgatatcaaggaatctgtgaactacctgaaattacattcagacttcaaaacttaatatgttaagtgctttacatgatgctaagtgctttacacacattatctgtttggacccacgttgccatcctatgaagtagattcttctgttgacccccaacttaaagctcaggagactcaggattagagaagatgagaaacttgcccaagattgtagttggtaagtgttggagtaaggatttaagtgtaggcagtctgactccagagcttgtacttcaaactgtaatgccactttgccttagcaatgcatgtcccaagacctcttttttatttcagagcctcaaaaactactaaatacctatcttcagctcggatttctatcccatcaactaaatagcttaggtgcctgtaggcccctccagttca

SEQ ID NO: 191470 - DNA, 457 bp, Homo sapiens
gaattcactagtagataataccccggttcctgaggtagtaaagggagagtaaagaactaccccctgagtctgctaagtggtccacgtggtccacagctgggagagtgttctgagacatcgacctgacagacgctgtatattagagaaggaagggacttagagattgtttagaaacatttcacagatgaagaaacagtggtcttaagatatggaatgtacctaaggttgtacaacagagcctaagaggaccatatcccataaataagacccatgggctctctccactacatcacactgctttcttaaaagtaacccaaatatccctggatgccattcataacttacaggaacccagtttttcatcaggcacacaagcaagaaatgaccaccagcacatcactatcaccacccaaaactctgtctctcatcaagtagaggcttcaggatcaggctctcc

SEQ ID NO: 191471 - DNA, 558 bp, Homo sapiens
aatctcatattttcctactcctgtctccctgcttcttttcccttgaaagaatcttttatagctgctactttggttacgttcttttcaaaccaacttcgattcattttctgggatcaccacactttttctgagttttgtaatcagcagtgactcttgctgccaaattttatggttatttctttgatcttatgctgctagacatcttagtggtgtttttcacaggtcagtactatatccttcttaaaacactttcttcttttggatttcttaataccacgttattttttctatccaacttatagcttattcttgggcttctttgatgagtcttataaatattgtgatttacagagttctgtgctagatacctttctcttttctgtgtatgccttccctctgaggcaatatgtagcccctggctttcactgtcatcattatgctaaaaaccatcaaaactgtttggtcaaaactcaaaggagtatctgttccctagatttatatgctgtttctactgatacgtgtaatagtcatgaacaacttagaattatcctgttggat

SEQ ID NO: 191472 - DNA, 322 bp, Homo sapiens
gtagaaggatgagacgaagatgagtgatgaaaaattacttaatggatacaatgtacattattcaggcgatggatacattaaaagcccagacttgaccactatgcaaatatatccatataacaaaactgcacttgactccttaaatttatgcaaacaaacaaacaaaaaaaacccgagaccgacctactcaatctgatcctcagaccattctctggcccagtccaagccctccatccgtctggtatcgccaacccaatccccttcctcagactccacacctttatgtccacctgtctgtgtgacatatccatcttgagacatt

SEQ ID NO: 191473 - DNA, 176 bp, Homo sapiens
ataccaggctatctttcttgtttcttccccacggcccagcaagagtgccccccctttcctgatcaggtaatgcctccatctctggagacccccgtctacagcctcagtgaggctgtgtcaccattggattgcttcaaagcaaacacggctgtgctggctgctccctctggtgccct

SEQ ID NO: 191474 - DNA, 726 bp, Homo sapiens
aaaataaatgtatttgtcttgtgactataaagaatgatttcttgtagatttagctttggacttctacatacaaaagagggatgtgtgatgtggcacagtaagactaaatcctaatgtgtacaagtcacctggatattgtgttgaaatgcagatgcagacttaggagatctgagggagggccttagatctgcatttccggtaagatccccattgatgctaatgcatttgggcctactggccacactttaagaagcaagagtatagaagaaagaactaaggtatatagtattcaagaagtctggctttagttccagtttcatcactaattagccatgagacctcaccaatatcacttaaatatattcctcatgtataagatgatggggctggacttagtcatctcaaaattcctgacacaagaactgggagtgatgacgtgtgcctgtaattccatctactcaggaggctgaggcaggaggattactttctttctttctttttgagactgagtctcactctttcgcccaggctgaagtgcagtggtgtgatctcggctcactgcaaactccacctccccagttcaaacaattctcctgccccagcatcctgaatagctgggactacaggtgcccaccaccacacctggctaatttttgtgtttttagtagagacagggtttcactatgttgggcaggctggtctcaaactcctggcctcacgtgatcc

SEQ ID NO: 191475 - DNA, 409 bp, Homo sapiens
ttgagcgcacacattggctcgacatctactacctgaactccctcaacatactaagtgctaagtaccatcgttggggagaggggtgattttaacgaaatatgagatgtgttcctgttgccttctttgtacagtcaaacttgctataagagaagtttgtttattttttgcattactttgctaaacactggctcctcaactccaactctgcctcaatagtatttatgttcttcaggagctgccctgttgttttcaggatctactcatttttgtgtattctgtacaaatcttcaacaaatcactagaagtaaatttgaagaaaattgcatttggagtcagaagacctggactctggccgggtgcggtggttcatgcctgtaattccagcactttgggaggtcgaggcaggtgg

SEQ ID NO: 191476 - DNA, 679 bp, Homo sapiens
ggtttctttccttggcttgcagatggcgtccctcttgctgcttcttcacaaggtagtccctctgtgcatatgtaccccaggtgtctctctctatgtcctaatctcttcttataaggacccagtgatgttggattagggcccacactaatggcctcattttaagctcattacctctttaaaggacttacctccaaatacagctacatgctaagacactgggtattggagcttcgaacacatacactttagcatggtggggagaatgttattcagcccaggaaaacagttatataaaatcactggttccctgagcttgtgatttaatagacaaacacagtttgccaaaagcagacccctctcacacacaaataaaaatatgaaggtcacttaatgttgctaacattcttttaaacataatttctgatgaacaaatcatctaataatgccatcattttataacctgcattacagcatcataattatcatggaaagcatgaaataaattgaactttatgaaaacctaactacattgttcttatttttgtcattctgctatagaccagtgagaactttatcataaaccagctctagtcactggttatcatctgggaagcaccaatgcataatagtcatttttaataatcacctatgatacacttatttataatactcctgtatt

SEQ ID NO: 191477 - DNA, 410 bp, Homo sapiens
gattgtgaattcctgggaaagagatctttgactttgatattattgatgttggagagcacacttaaaatactgtatttaaaaaaaaattaaaacttttattttgaaataattatagattcatatgcaattataaaaaataatatagggatcccatgttctctttacccattttcccccaatggtagcatatcgcaaaactataatataatataatatcaaaaccagaatatttaattgatacagtcaggatacagaatatttccatcatagcaacacccacttctctcctgttgtcacccctccttaacccctgttcatggtttttagctgttatgaacaaagctgctgtaaatattcatgtacagattttcatgtttttattggtctgggataaatgcccattagtgcag

SEQ ID NO: 191478 - DNA, 192 bp, Homo sapiens
gagccactggaagtccacaggccccgcaaggacagccaatgcaggagggtctggggcactgaagaaggactagtgtggagaaggcagggaatagataatacctgaggaggagaatgaatgggcacatggatagatggctggctgggtagctggctggctggctggctggatgaatggatgaatggatgactg

SEQ ID NO: 191479 - DNA, 515 bp, Homo sapiens
agaatagaagatgtagatcctttttttcaggtgcttacaatctagtaaaataggacatagaccgaggaagagtaaataatgacagcagttaagttcaaagggaggcaatgctgcaaggaagtgcatgaccagtggccacatgagttagctgtaccaaaaatctatgaaagctttgaagaggaaggctcattttagattgagctttatagagtagatgataattgaatcaagtcatcaagggtaggagggatgtggatatatgaaggtaaagaaggttgggtactccaagtcttgaaatcccttctgttaaaatcttttaaaaggaagctggataattttctctgatgatctgttacccatgacccaacatactgatatcagtttaaaactcctctctgcccttcactatttttgcgtgctccctaaatggccagccaactaacatggattggaggaagggagtggtggtcaagaaacaaagaagatgacagaataaagtcctcctgggagacctg

SEQ ID NO: 191480 - DNA, 486 bp, Homo sapiens
tcttgagttgatttctggcactgttcaatgtcaagggcactgcagtttcctctgaacaaaacatcctggttatctgtaaaaatgcagctgcagatgcaggctttgcagtgttagatcaagaaggccagcatttcacagaatcctgaaagttgacagatggacacacagacacactcatacagatgcacatgcacacataatcttctacataccagtctttgtagctacgttattgtaggtggagtatcttgaagcatgtaaggagagccacagtactgcatgtgtgcatgcacaatgtttttggttgtattgacacacagatgtgtcttcaaataccatgcaatcttttcagacactggtaagtaataagtaagtgacacttctattacactgattgacatttcattatctaaatgctttgccttctttttgctttgggaatattagtcatcagttcctcaaagcaattacactgtctgtgttact

SEQ ID NO: 191481 - DNA, 398 bp, Homo sapiens
aaccaagcagagctcagaggtctcctgaagttgaggaggtatgagtttagactttgggaagagcaaggaaggtgaaacatgcaagggagggaatcagagaagagaatcatgcggagaatgagctgcaattcttcaacggcttcacccaagtgctgatcagcgcatgtgtataaggaaagcacctgaggctggagaaagaaccaagcagaaccattctcagagctcatccagggctacgaacagttcacactcccaatagccaaagtggagaaatttcactttgactgtagactcctggtctacaggcttttctataaagggtcacaaaataaatattttaggttttatggattgttgtggaatggaagcagccacggacagtacacaaaaatgagcat

SEQ ID NO: 191482 - DNA, 248 bp, Homo sapiens
agggcaatgtggaggggatgaacggaggcaaggaaaacaaagtagacaatcaaaagcaatggctacatttcaaagcggcatctaccagaaatgactaagattcattttattttacactaatacaaaatgaataaaatcagaaaataccatagctttattttaacacagaagaaaaatatagtggatgcaggaaaaaagagaaattgaataatctgcttctacttgtgacatggcaaacgtttttaaaa

SEQ ID NO: 191483 - DNA, 177 bp, Homo sapiens
tgtttctttgtcctttgttgaataacaagtcctcatagtgggtctaattattgtaattttaaaataatgatgttatttcaagataatgtgcaaccactgtaaatcagtataagagtatttgcaattttttgtgttgataccaaactcacacagaattacatttttggtgtgtggcgt

SEQ ID NO: 191484 - DNA, 243 bp, Homo sapiens
gtgccttcttccatttagctgacgtgacaatggcaggaaaccagcactccgcagcccatgcctcccaccaggatgctaccttgttggcgtccccatccgctctcaaatgctcacactcatataataaatacacgctacttaaaaaaaagaatggcttctttaaaaaccgcaaaggccagccgactgcagacagcctctgaagagctgctttccttgaccccccaaggctataaaataaatgca

SEQ ID NO: 191485 - DNA, 324 bp, Homo sapiens
aatagtctcagctactcatgaggctgagtagggaggactgcttcaacctgggaagtcaaggttgcagtaagccgtgatcatgccactttattctagtttgagtgacacagtgagaccctgtcaagaaaaaataataataacctgtgttctcatggagagttgtctattaccagatgaatgaatctcaggtttttttaggggtaacaagtctggtaccccagatgagacccagggttgagccctgacttgacctcccttataggctcctggcaggcaaagcagtgggatgtggaagcatgcgtgggccaactcacctcagttgcc

SEQ ID NO: 191486 - DNA, 611 bp, Homo sapiens
ggcaacagagtgagactccgtctccaaaagaaaaaaagaaagaaagaaaagataaaagaaaaaacagaggttatatagcttgtgcaaactcatttggaaatgtcaaagctggccaggcatggtggctcatggctgtaatcccagcattttggtaggctgaggcaggaagatcacttaaagccaggagtttgagaccaccttgggcaacatagccagacccccatttctacacaaaaataaaaaatagaaatgtcagagctatgtccgatttcagagcagtctgatgccaaagcctgtgttattgacagcctggctatgctgctagaccaacacggtgtcgtaacttgtcaaccagttcatggcttccttcaatagccacgaatttataatgtatgtgttacttaaattggtcaaacaatacccctaccactctcctggtggctatagtatatttgtttcaaagataagacaagggtcaaccttagtccagaaatcccaagccacataacattccaggtgggtccagacggagccaatgaatgagacaatcctggggaccctgagactgggattttatgagacactcacctttttcgccttacttactaact

SEQ ID NO: 191487 - DNA, 397 bp, Homo sapiens
tagaatcatcaacaggattttatagcattgactaatcctacctctttccccacaaaaaaatcttccagtgtgctctaatgcaatgattcccaaaacactatgcagtgagatatcatacagtaagaaagttctatgaccaaataggcataagaaatgttacaggccaggctcagtggctcacgcctgcaatcccaacactttgagaggcctaagtgggaggaccacttgagctcagaagttcaggatcacctattatcagtagaaaccttgtatctactaaaaattaaaattaaaaaaataggcatggttgtgtgtgcctccactctcagctactcagaaggctaaggtgagaagatcacctgagcccaggaagtagaggctgcagtgaaatacgata

SEQ ID NO: 191488 - DNA, 271 bp, Homo sapiens
ttttccctgatatttaagtaaatatgaatagtttgtgttcagaagaattctcattcaggaagagtcaaaatcagctaaatatggatcatcactctgtttcaatgcctaattagacttgtcactgtcagtccttccttggttacaaatcatcagtagttcttataattatatctttgtaatgaaagacagagtgcttctccctgatgccagcaattccaagcaatatcaaagcaactaagtactcacatggaacttataaaatatcaagggg

SEQ ID NO: 191489 - DNA, 401 bp, Homo sapiens
taatttacctgctttactttgctggggagaggaaagacgactgcagagtaaaatattaaagatttagaacagtagtatggaggcagtctagtacggtgactaggaaccaagctgttgtttggatttgaattctggttctgcaagttactcctagtatgatcaaaggcaggttaatttaacttctctatgcttcactttctacatctgtataatgatgttaataatctcatatacctcatagggttactgtgaagattaaacgaattaatgtatacgaaaggtttagaacaaggacggtcatataatttactctacaaactgggaaccctttgaaaatgaaagagatgactcgtcatttacattaggtatatctcctaatgctattcctccccgggatacag

SEQ ID NO: 191490 - DNA, 368 bp, Homo sapiens
cgcctgtatttaccagagggacccaggtcgctgtggcaaccacacatctgggccccggaatccagatgtgctgtatccagaagccatagcagaacgatgaggcaaacatcaggctccccagtgctggcccccacagctgggaagaggatggagaactggtgtgggaagtaaagggagtgggggaaggaaggaggaggagaggaccaaagtgggggaaaagagaggacataatggaaaggggcaagaaatgtggacgagggagcagaatgggaaatagaaagggggcggcatgagaaagggaggagacaagcacagggtcagcagcagcagcagatgagaagaccaagaaaaacaaaggaaaaagacag

SEQ ID NO: 191491 - DNA, 614 bp, Homo sapiens
tagtggtgactataaatccaaaataagttaaaaaaaatccctgctcctgactcatgattcttagaagaaccaactaatgattaaaactttaaaaagctcaatatatgcaaattgaccaaggggttaaaaaaacaatataaataatctctatgtattcaagatgtgtaattggcaacaatttaagattgattaacaggtggaccctagagggggaaaggaacctttagtgaatttctggccatgccaggaagaatgtaaagtttaagcaattatttcctattagcccttgctaatttcttactacaaactcaataaacattgttaaatccatctactttgagatacatctagcaccaaatgccacaaagtcaatcacttctgccctcaacaagcttcaccacttcaccaactctctgtcctaacttagattaactttttttttttttttgagacagggtttttgctctgtcgcccagactggagtgcagtggcatgatctcgtgatctcagctcactgcaacctccgcctcctgggttcaagtgattctcctgcgtcagcctccggagcagctgggattacaggtgcctgccacgacacccggctaatttttgta

SEQ ID NO: 191492 - DNA, 624 bp, Homo sapiens
acaccaaatagaatcactaaaattaaaaagacaaatgataccctgtgttggtgcaagaaaggggagcaaacattgctcttgtatatcactggtaagaatgttaaacagtacaaacactatggaaaacagattggcgatttcctaaaaagttaaacctatgtctaccctatgacctagcaatttctcttctaggtatttacccagaagaaataaaagcatatgtccatacaaagacttacataaaaatatttatagcagctctatttgtaatagcaaaagctagaaagaacccagatgtttgttcatctatatgaatgaataaaatcactgcggtatatccacacaatggaatactacacagaaatcaaaaggaaaaatattgcaacaaatagccaacatgaatgaacttcaaaatcattatgacgcaaaaaagaagcaagacaaaaagaatacatatgctatgtttccatttatacaaaattttagaaaattcaaactaacctatagggacagaaagcacataagtggttgcctagagagaaatggtggaaggaatggattccaaagaagtccatggaaacttgggaatgaaagcagtgtccattgtcttgattgtggtgatgg

SEQ ID NO: 191493 - DNA, 165 bp, Homo sapiens
aatgtcagctgaaactagcagcagatagagactttattgttctgagcaagacaatctataccagttcattatcagctgccaggtgccaagctaaagtaatctgtgctcgattttcttttatgcatcatcccaaattagatgtaaaataattgccaagagttcagt

SEQ ID NO: 191494 - DNA, 205 bp, Homo sapiens
agggtcagggaattaaatttcataaactaacaagataaaaatagtaaggcttaggcccattccttagaactgatttaatttggaaaaaaatagataaccaggtttgtacaatagaaatgacaaatgtattttgtttgaaaatgggtagctcagcatttcccaaagcctgttttgaggactattattgctctgtgagatattaata

SEQ ID NO: 191495 - DNA, 541 bp, Homo sapiens
acatgcaatgtaacattcattatttcatttattccttataatatatttaggtggagaaaatgtgtaccagatggtttggtgtgaaattatacctaagtttcctaagagacagatatcatcttgtccacattttagttagggaaaccgaaccttagacagttgagaaacacaggatctactggacttcagagcctctgctctcaaccattaagctaattagtcagaagtcatatccagaagattgcctttgtattccatttttcttgtattgtgaaaactagacattttaggcaaaataaaactaccataaagggacctaaactgtgatatgtctccactttcctgtgaagagtatcccagcacaggattcacagaaacctaatccttttcaaacggtgtttgatggaagtgaataccacttttctgaggtgcaacaaacagctaagcggagaaaaatgatcccattgacaatatcaatcaagatgcagagctagcatctgcttggcaacttgactacgatgttctaaaacactttaagtaa

SEQ ID NO: 191496 - DNA, 396 bp, Homo sapiens
cctctttccacagctccttcccacctgacacgggctccgtggcattagtcagactaattaaggacacagaagatgtcggtggaaagactcagagagaagtggagactcaaggagagacaaagatgggagagacagcaagagatgggggagaaaaagggatggagagatgagagacagcacatgagactgtgactcagagaggtgtgaggatggtggctgcagaaaccagatgtgggaggacagaggcacagagacagggacaggacagacggagctacagaagcaggaagggggtgtcaccgctgagagggagagatggagggaggagaggcagggatggtggggaaaatgagacagttctggaggaagggaaagagaaaaatcaggaaacagggt

SEQ ID NO: 191497 - DNA, 222 bp, Homo sapiens
tagtatacacaagatgaaaaatgcagagattgggacacacaccagttactgaagaaacacagagcagggaggaagtctacccaaggcactatttgtgcttcctacaaacaggtttgtcatatggtttcaaagctgagggaaactgcagagcttagagagaaggcaaagaaacaggccttgaaagatgggtggtgtactttacagtatcacgtggaaaagagg

SEQ ID NO: 191498 - DNA, 446 bp, Homo sapiens
atagcgacaccgtactacttatctacccaactaacctgcaaattatctggttaggaattatgtatttattctccattgtttcttagaatagtgcctagtgtgttcaatgaataggtttctccatcatcagttacaagtacaaaacaaaaatttacactgtaaatctcaagtcatgattttgaattctagtttgttgagattgttagaccatattaagaacagcgagaaagttatagtggatatttggaagcagccaagcttcagtactcaaatcagagttaagatttaagttaagaaggaactgtctatgatagggcaggaggaaaaacgccaagaagtaaggaaaccttgtaaaacctgggtcttagtattacctcgcagaaacatttaactgtaagcactatataaatgtcaactggcaaggagaatctgttaaagacaataaa

SEQ ID NO: 191499 - DNA, 241 bp, Homo sapiens
ataactgtgagatagaaattccttttctttataaattatccagttttggatattatgttaagagtaacagaaaacaaatgaagacaatgaggaatgcattattactcagctcattttatagatggggagaccaaggcagagaaagctaacttgcccaaggttgcagaggcaggaagaggtagtgccaggatttgaacccagatacttggttccagagtccatgcttcgtaacccctaccag

SEQ ID NO: 191500 - DNA, 245 bp, Homo sapiens
ccaagatgtgagtcctttctcctgaatatagtcctttaagaacttatgttcacatgtttggattgttttttcctgcagatgactgagtattgtgaacagttggtctgaaaatgaagttcttccactatgataattcagagaaataaataataacatgtttcttacatgttccttgggccttgggcctggcccttaaaattgaggtccaatgtgtctaatgatttttgcggctactattctctttc

SEQ ID NO: 191501 - DNA, 255 bp, Homo sapiens
tgaagcatttcatggggagctaatgtaatgttgtgaaggtgaggagctttctgttcctggaattggtaatttcccagggtcttaggggcttgcccatgcctcctgagccttttcacactgctgtctctaggtaagcatttatctgctaaggtggctgagctccaaaagtatcccctttgattgccagtctctcaggccacttaaatctgtgacacttcccatgggctgccttgtattgtgcccgacattcttatt

SEQ ID NO: 191502 - DNA, 299 bp, Homo sapiens
aaccctcagcgcaaaaaaactcaggagaaagggctcaaaatttaaactagaggtctggggtctactctaaggtgagctaaaaacaaccctaaaagtataaaaccaaaattttgaaatccccctacacccacagcaaaatagatctgaactcagatctattttgagaaatgaatgagtcatgatatcttacctctttttgtagtctgcactttacaaaaggcagttaataaatatttgtcaaataaatgaatgaatgaataaacaaatggaactctggtctgtggtatccgtgcacaaac

SEQ ID NO: 191503 - DNA, 569 bp, Homo sapiens
tcattggcactgggtcatgctgatgccgtctactttgggcatcatgtccatgggctgggcaggacccccttcctgaggacgcctgtggcactggccacagtaggtaagcctggatcccccgaggtggttctccactctcccatcgaaagccagggcagtgacctgtgggggagtttgggtgagagataagcagttaacccttgatgccctcgataaaccagcgcggaccagccacctgtgagcctccccataaaagacacattctaaaaagtttgcaagaccgaatccaaaaaactctattcccgcctcccgttaaaaggacatagcccttccgaagtctcctgtggctcacagttctgctgaggacttgatctcatgttaaaattgaaaaccaggatttagtccctgcgtatcaacaccaacccctaaaccctacttcggatgattctggaactgattaaccagttggggctttgttcattattttctctatggctcctctgctgtgtgatcttttcactgctcactatactgtcatccagagagcgtcaggaaacctcagcagtgaa

SEQ ID NO: 191504 - DNA, 1272 bp, Homo sapiens
agcggagaagctggagaggtggcacaacagagagggccaccatgggggaccggaggccacaggaccggccaaggtcccaaggcatggactccaagccctggtactgtgacaaaccgccttccaagtacttcgcgaagcgcaagcacaggcgcctgaggttcccgcctgtggacacccagaactgggtatttgtgacggagggcatggacgacttccgctacgcctgtcagtctcctgaagatacgcttgtttgtcgccgtgacgagtttttactccccaaaatatctctcagaggtccccaagctgaccgcaaaagcaggaagaaaaagctgctcaagaaagcggccctattttccgagctctcgccagtacagccagcacggaaggcgttcgtagaggaagtggaagcccagctgatgaccaagcatcccttggccatgtaccccaatctgggaaaagatatgcctccagatctcctactacaggtgctgaaacagctggatcccgagaggaagctggaggacgcttgggctcgttgtgaggcccgggagaagacaaccgaggtacccaccgagtctggtaaatatccctgtggggaatcctgcccgcggcctcccgagactccggtgtcccgtctccgtcctcagcttcccaagactccggtgtccagtcgccgcccagagcctcccaagactcgggtgtccagtctccgcccagagcctcccaagactcgggtgtccagtctccacccggaacctccagagactcgcgcatctcatctccgcgtggatcctcccgagactggagtgtcccatctctgcccagagcctcccaagactctggtgtccagtgtccacccagagcctcctgatactggagcgtcccatctctgcccggagcctcccgagactcgcgtatctcatctccacccggagcctcctgagactggagtgtcccatctccgcccagagccttccaagactcaggtgtccagtctctgcccggacctcccgaggctggagtgtcccatctctgcctggacctcccaacactcatcgggtgtccagtttcctactacaggtgctgaaactggattctgagaagaagctggaagatgcacgggctcgttgtgagggccaggagatgacaaccgaggaactcaccaagcctggtaaataccatttttgggaatcctgtccgcggccttttgagagtcggatgccccatctccgcctggtgcttcccataactcgtcgaatggccagtctctgc

SEQ ID NO: 191505 - DNA, 177 bp, Homo sapiens
ggattataggtgtgagctactgcgcctggcctgattccacagatttaacaatcacacttccagttcctctctccacttctctctaaaacccagaccaacccgcttctcctgcccatcaaagctttccttgtccaggtctccatgaacacatggccatatcccaagtgcaatgcgcgg

SEQ ID NO: 191506 - DNA, 386 bp, Homo sapiens
  misc_feature (251)..(251): n is a, c, g, or t
cttactccaggtcacccaggtcataggtagcagagctgtgatttgcagccaggcagtctggcctgagtcctcgctcttggtcatgatgtccatgatctcttgtttgttatatgcccagcactgtggaaagtaccttgcagctgttgtctattactctggtcctcacaataattctgtgaggtaggcactcttttttctccctgctttatagctaaggaaactgaggcagaattgcttgaaccagagaggcngaggttgcagtgagccaagatcatgccattgcactccagcctggtgacagagcaagactcgtctcaaaaaattacataaataataacaataatggaaacataatagaagtaatagccaacatgtcttgaacactt

SEQ ID NO: 191507 - DNA, 273 bp, Homo sapiens
tgctgggattacaggcatcagccatcatgcccaactctttctaccttttctgatataagtatttgaaagtataaatttccttttaaggatttttagccttattctgcaaattttgatatgttgtatcttcattaccatttaattcaaaacactttatttgacctttgaattatataggaagatattgtttagaaatattggattttcccgggtagcttattgttactaattcctaattataattccattttgatcagagaacacactgtataa

SEQ ID NO: 191508 - DNA, 565 bp, Homo sapiens
gttctgataaagaacagtaaaataagagagtcaaagaaaataatagaagatattgatgaaatagaaaagaaacatacaacagagttcttttaaaatgataaactttacaaagatctggtgaaactgatcaaggagaaaagaataagcagtattaggaatataaagaggagctattatgaacaaattaatgccaataaatttgaagtttgaaaacataaatgaaaaaattcctagaaaatataacttattaaaactgactcaagaagaaatagaaaacctgaatgtcgtaggaccattaaagaaattgatttgtttaacatcttcacacagagaaaatctaggctcagatagctttaaagcaatttctaccaaatagtaaagaaaaaaataattccattatattgaatcctgggatgttgaattggaattggaggtattggtgtgagctcatggttttcaatatataaagagagacatgaatatgtacgtaaaatgtgtgtacactcaccttccccccccaccccctgccccacacacacactgtccactgagagagcctcggaac

SEQ ID NO: 191509 - DNA, 573 bp, Homo sapiens
actggaggcaactcaaatgtccactaacagtaggatgggtaagtaaacagcggtgtgctgacatagtggaatactatgcagcaatgagaatgaactggcaattctgcaagcaaagcacagctgaatctcacaaatacaacgttaagcaaacaaagcaagatgcagaagagtatatactgcatgcgtccatgtacataatgttcaaaatcaggcaaaaccaacctttgatgttaggtgtcaggataatgcttatttcgggagtgaatagacggcagtaccaatggggcttccagggtctggaaaagattgtttctggataatacagattctggtgacacaggtgtgtttcctctaaacattcaccctcaatcagtacacttttttggtgcatgccctcctctgcatgtgtaagagtacacgttcaacagctattaaaattactatccacaagtcacttggttgctgctgcataatgacaattctgtcatttcatccatagtccatgggaagttatacagcataatggaaaaaagcatcaggcttgaagaccacccatcttgaattagaatccct

SEQ ID NO: 191510 - DNA, 672 bp, Homo sapiens
cctgctagtctttagcatctgccagctgccatgcagatgactggtgtcgtcaaacaggaatgacagattggtggcaagtgggcacaagagttaaaaaatggtgacaacttagaccagctgctcatctagctgggtgtagagctcactttaaatggaaatggcaattttacaggtcaagtgtgttgtgtatgaatttctttgcggtcctactgcctcccagacaccagcgtgggctcctttctgagccacatgtttagcagcatgcctgggaccctgggagaaggcggcaaacgggctattccatggaggacagatccttgttaaggggctgttccgagtgcacctctgggaactctttcatttggttactaaattcctttctgcttttcatgtagagaataaagctcattagctgtgtcttttaagaaagccaagtgcttcacatgagatacttattaaaatattctcaaatccattctaattctgttcttgtgaagaatcagtttcattccacaccccatccagcatctggcagaagaggtgccctatcccagtcagggaagagagagttgttgggatggtttcattgccctctctctgctcagaacccaggtattgtcttactggggttcaacactcgtggttcttgtacatggagccctttgtcctaag

SEQ ID NO: 191511 - DNA, 373 bp, Homo sapiens
tggcatgcataggtcccaggactgacacgctgctcgagtgagcttgtcctgccttggcacaaattctgagtctggccagggccacagaaggcgagtcccctggatggtaatcctggctgctttctgcacttgaacatgaagtcctcctcgagacggcctgttgtgtgcctcctggtaaccaagaagcccacagtgtcatacgacccctgaggcatggactggagccccaaaggcagcacacaccctgctgctgagcccgctgctcattccctctctgtggctccatttgtagcagagtagttgcactgaggcttgtgcatgctgggcaaggccaagctggctcaaacagcaaccagtcacatctgcaagggtg

SEQ ID NO: 191512 - DNA, 732 bp, Homo sapiens
tgaaaatggaaatggaaatcaaacacacagccccagtcaggtcccaggttagctgacctgctcctaatgcctgctgggctcaggccaggatatcggtggaggcccctggtccgcggcccattccccttctcttgccatccccacctggtcattgtaacaaggggcctcgcacatgagtgtggacacccggggctgcatgtttgagctccaaccatgtccacgtctcagccacagctggccattctcagccgaggcatgggcacacaagtggccccagggaagatgaactcagtgcaggccctggcagctagcaaaggggcatttgggcagagaattatagaaaaggaaggatctgggggtccaggggacatgtccctttgccctgcagacctctttcccctttagggagccacagccagagtgggtgcctcttggaacatatgaccttatctctttggcccagagatgacatcttctgctatcccaagtgtgagccgttttggtctcagaagaaaagtcccctcgtcttcctttcagggaaaagtgctgaagagggcaggagactggtggtttgagacctgccccttagaaaccatgtgaccctgtgccgtgactgaccttcctagacccagccctgtgtgtacaaaatgaagacaaatacctacctcgccaccttgttggcaggactcaaaggatgacaaagtgccaagcaaatggatgttttcttatgga

SEQ ID NO: 191513 - DNA, 243 bp, Homo sapiens
aatgtccctaactctggcaagtactttaaattaggaaagaatttattaaaactttttgttttgttcagattagttagctccctgtactactcattgaggcaaccgagtggctttctgtaattgagtaataaagcctacacatctcagcattaatgtatctgctatttattgagtacctattatgcgcacagcactgtactgtgtcctgtggagactaaaaagaagtgtaatacgtggtgtctg

SEQ ID NO: 191514 - DNA, 342 bp, Homo sapiens
cctgtcccctgacgcgaagtgaaacaagttaggtacatgacagcacatccactcttctctgagcacctcctgaagggaaggaggaagttgggctatttgaggtggaagaataaagacagggagagttctttccctaaaacagccacgttgatggcacagtggctcttcccagacgttcctcgcctttgcagggcttctgatagtcacctgattgattgcctaaaatctggggactttcctgggagctgctgaatggcatttgtttccatatctttggagaagattatcaggcatgagccttaacatcttagcatttttgtaattagtatttctccactgaaa

SEQ ID NO: 191515 - DNA, 167 bp, Homo sapiens
ttcatttctcatctgtaaaactgggataatattgtcgttttgcagagcgccatgagaattaactacaacagaggaatttggaggtgaagtagcatggtgtgtgaattgctgcaggatctggggaacctcatgtgttctgtatgggcagttgtgtagacagcattgat

SEQ ID NO: 191516 - DNA, 383 bp, Homo sapiens
agagggaaacagaaaatcacccttaggcaaacaccatagtaataactgttataggcaaattcattcacggatgataaaattagacagcaaaattgaggagaaacaggatttgcatagtcttaaaatatcactcccaagaagtttatcaactgaaaatagaatgaaagcatctttacagtggagaaacttggcagatataaccttaagcaagtggccaaagttagcatcaccagtaataagacatccactgagaaggacacaacatctctcttgtgttatttgtgccaaacatgcatggtctcattccaaatataagaaaatatcaagcaaaccccaactgagggaaagtgtacacaataactgaccagtattcattaaaagca

SEQ ID NO: 191517 - DNA, 437 bp, Homo sapiens
attttgaaattttgatgatatatcgcaggtagaaaatggatctcttcaactatgatatccacggcatagttaccgatgctagatatgccacggtttgtttttcttaatgaatgtaactctctatcactgctaaagttactgttttgtaagtaggaaaagcagcatcttgacctgtctttccaggcccttctctggtcttggcttcccatgttggccacagggactggggaaagaagctggggacagcacccctgccatgtaacgcatgctaatttcattatgtgccatcatcagaatgggttggtgatttcagaccatcagcaaagtctaaacctccaccgatttaattaacttgactgaaaatcagatgaacagaaaataaaactatcattagaaacaattagcgactaaaacatactgctgccaaccagtttgta

SEQ ID NO: 191518 - DNA, 498 bp, Homo sapiens
gagaataacagaaaccaagccttgttaggaaagtttctttcaaattagcttagagtttaacattttttttctagagccctaggaaaaaaacgcccaatcagtgcaataaaaataggctcaagtgttcagttgggtattttcctctcatatcttttagttctttgaagtttcttccaaattataatccaaaaataagagtgctacaatttttagaaaagttatgttgatgtaacttttatagcaagctacccaaagaatcaagctatattatagccatgctcagttatgaagaccaaaactattttaaaaataccagaacgagaaagtcctagtttatttagtctggcttccttaacatgaaggtcttgttgttctcaaaatattcagctttggctgaattccaaaactgacataagcccacttcaggtgtttggaagacactaaagagaatcagaattgaaaacaagattggaaaataaagccttttatgtgatcaca

SEQ ID NO: 191519 - DNA, 314 bp, Homo sapiens
ggatgagccacaacactttcaaatttggtgtgttatcttaactatatttggtacaagattatatactatgctattccatgtatatgaattaatatacaggggaaaataatcagtgtttctagaaatcaggatgatgtttatccttggaggggatgggatgggtagtgatggaaagagaccaggtggggcctctgaggtgttgggcgataaatcactatgttatccccaacacctgtgacaattgcttcaattatgtttttttaaaacgattttatttttccattgtagttggtttagtgttgggcgataacata

SEQ ID NO: 191520 - DNA, 1112 bp, Homo sapiens
gccacattgctcccagagtaatgaggcaaaatagtgctctgttatagaattgcttgtttcacgatacatcatgacagataaccatacaacatggaatgacacaaacataatatgccacactccagaatatgtaatgctcgtcttccaggggggttcagtctaaggtaatctctaccaggaagaaacgctagatgacttcagacatgtgcattggtttggaccttctaattagttgaatttttacttattttgacatgagagattacatagaatctctatgttgcccaggttggtctccaaatctgctcaaacaatcctcccgcctcagtttctcaagtagctgggattacagggacacaccactgtgcttagcttaaatagttgaatttattgggcatccactgaaaagaaggaagtaggaataaaatctgcaataatatgaataaacctgtaagtgagcatgagcagtggtgggcaagggtatgcagactctggaatccagaaatagaaagtcagtggaaagccaggcacagtggctcacacttgtaatcccagcactttgggaggccgaggtgggaggatcacttgaggccaggagtttgacactagcctgggcaacatagtgaggccttgtctactagaaataaataattttgcagatatactaaataccattttaaaaataagtggaaaagggattagagagatccttgtaaattatgtactcatattcattgttctctttagtcacataattcagtcatgtacgtgacattccacagtatggtgctccataatacatattttttcttttttcgatctcacttgtatatgatccataatatttttcatcattcccttactgatggacatttagattgtttcctattttttgctgtttaacagtactgcgctgaacatctgtacatttctctcaggcatgtgtgggtcttcagatacctcaaaagtagaactgctgagtcaaaagacatttgcatttaacattttggaagatgttgataaattgcaccccaccaccccccccccccgcccacaaaagctgttatttatgctgtgaaacattttaacaatgattttgcaattaatcaaga

SEQ ID NO: 191521 - DNA, 156 bp, Homo sapiens
ggatggatggatggatgggtgggtaggtgaatacatggatggatgagccactgattgagtgggtggatgggtggatgaatagatgggtggaggatagataggtgggtgtatgggtgggtggatggattgatgcatggatggatgggctgcccattg

SEQ ID NO: 191522 - DNA, 804 bp, Homo sapiens
ccgcctcccgggttcaagcaattctcctacctcagcctcccaagtagttgagattacaggcacctgccaccatgcccggctaatttgttgttgttgttgttgagacggagtctctctctgtcacccaggctggagtgcagtggtgcaatctcggctcactgcaagctccacctcccgggttcacgctattctcctgtctcagcctcctgaatagctgggactacaggcatctgccaccacgcctggctaattttgttttgtattttttttttttttttaagtaaagatgaggtttcaccatgttagccgggatggtctggatctcctgaccgggtttcgccatgtttgccaggttggtctccaactcctgacctcaggtgatccattcgcgttggcctcccaaagtgctgggattacaggtgtgagccaccacacccggccctcagaattatttagagttagaattcttagtctactagtcaagtttcaatcaagagacactgtatcagttatttcaagagagaatttaatataaataattgttatccagctagtagagatttaaaaaaaagtagtgataatgagatatcatgaagattttgactgcaagctcccagcccaaggactcatacaacaaagaaaagaggttgaaaatatcaaaactcggaaatatgaaggtggccctagggctgggggttagtcctctgaggaggaggcactattaatggtacacgtggcccaagggctcagagctcaaggtccaggagctggacgcagaattctggagaggggacatggccagcc

SEQ ID NO: 191523 - DNA, 945 bp, Homo sapiens
cacacacacacacatatctatatgaaaccccaaaatatttggaaattagacaatatatttctaagcaactcatgggtcaaagaaggatgcacaagggcaattttaaaatattttgaaatgaatgaaaatgaaatataaaatatataaaaaaacagctaaagtagcagttagaatgaaatttatgactataaatacctgtatcagaaaagaagaaagctctcaaatcaatatcctaaaatttcaccttaagaaactagataaaaaaaagagcaaactaaatccaaagcaagcagaaggaaggaaagaataaagattagagccgatatcaatgaaatagtaaacagaaaaatcacaagttgagtctttgagagatcaacaaagttaacaaccttttagctaccctgatcaagaaattaaaagagaagatacaaattgccaaaatcaggaatgaaaagaggtacagaaattaaaagaattataaaagagtattataaacaatgttataccaacaaattagacaaatttagatgaaatggacaaatgactagaaagacaaattaccaaaactgactcaacgagaagtagaaatatgaatagacctaaaacaagtaaagaaattgaattagtaattttgaaagcatgtaggggtagaagctaaagatattgagaggtggactcaggcccttttagcctctcctaaaaaccctaaagactatttgtaaactgcgggaattggggtggcccaaaagagaaaaaaagacacataaccctagacatgccaataaccaccggcaacaaaacgaagaaacaaacagaacaaagagaacaaataacccaaccgaaaggtggctaaagattataccacaaaacaccctaaggaaactcacacttatgcaagaaggggacaggcacaggagcaatggaacggaaaaaaagtgcaaaaca

SEQ ID NO: 191524 - DNA, 224 bp, Homo sapiens
ggagtctttccagaattttcctcttcagttgactcagttggcattcccctatataattgtttcaatggtgctgccactgggtggttgtcagcctccaccatactcagagaattgcgtggcttcctcctaaagctttgctacattgtgatcttaaatcccagttaaagaacagcacatcctgaggatagtcttgatagttttctaatattttgagagctcatcag

SEQ ID NO: 191525 - DNA, 404 bp, Homo sapiens
ttgtgtccctcacccattcatattgtgaagccttagcccccagtgtgatggtatttggagaaggggcctttgggaggtgattaggtttagatgaggtgaggagggtggggcccccttggtgagattagtgttcttataagaagtgggacaggctgggtgtggtggttcatgcctgtaatcccagcactttgggagaccaaggtgggtggatcacctgaggtcagaatttcgagaccagcctgaccaacgtggtgaaacccctgcatggtggtgggtgcctgtaatcccagctactcgggaggctgaggtcagagaattgcatgaacctggaaggcagaggttgcagagagctgagatcgtgccattgcacttcagactgggcaacagagtgaggctccatctca

SEQ ID NO: 191526 - DNA, 292 bp, Homo sapiens
tcagggagcccttccactaggaaataatgcaaaggtgctcagccctcctactttctagagaatttaccttgttgctggactgtgtcacaaaacacagttaggagattttgaccaggaaagaaaatagctacatgaaacccaggatggcctatgaatacctctgaggacgagaagatattatcttcaaattttaggaaatgacaagccaatttcttctaggtttttgttgttgtttttgtgtatatataaatacatatatttctgtaatatatatgtatactcttgtttatgt

SEQ ID NO: 191527 - DNA, 352 bp, Homo sapiens
atatgtatatatcagggggggcaatgaacaatctggaaatgaatttattattttcacccatagtagcaataaaaataatacttaggaataaacttaagtccaagaggtatacgacaaaaatcacaaagcagtgctgaagaaatacctacataaatggagatatatcctgtgttaacagactgaaagacttcagattaagaaaacaatactccccaagttgttctacagattctttgcaatccaatccaaatcacaggtggttttgttttgcttttatgtagaaattgacaaaatgatcctaaaattcatatggaaatgcaaattaccccaaatagccaaaatgaacctgaaa

SEQ ID NO: 191528 - DNA, 583 bp, Homo sapiens
cctttctcttttgtctattaaaactccactcctaaacccacctcttgtgtgtatgcctacttgatttccttggtgtgagatgacgaaccttgggtatttaccccagacaatgatgccgtttcacaaccacatgaggaaggacccaagtaggcactgagactgcagcagaaagtgaaccagagaaacttaatctccatcgccctcatacatatactcactccagcctgaaatgatgggtttgacgcacaaacttcaacagtgcaaaagacagaagcctactatcagtttatttacataaaaaagggaaggatgacccaagactagaggacttggaaatacttcggttgcagatttaaatacacaagcagtatgtttatactacatctgtcaatcaatgtatgtatttatgcatataggtacatatgtgtatatgaacatagatatatatcttttaatttttaaaacaaatttgtagttaatttgttaactactaattaatgactactatgttaaaagaaagtgtagtttacacactttgcaaccaaaagtgaaatgctaaatcttcagtaaagataatgaagta

SEQ ID NO: 191529 - DNA, 277 bp, Homo sapiens
gttgtggcagctgcagcaagccacctatcccttttcttttgttgttaacttcccccagttatttgaactatgtcagctctctggtacaataaggcatgacagaaactggcccctcaagcagcacactgaaaggcatgggcagtgcaggatgcccccactcctctccttccttcctgggagagaagcctcaggttcttagccttctctcaatctctcagagccttccagctgcagcaaccacctaccctctttcctttgttaactgcccccaggcatc

SEQ ID NO: 191530 - DNA, 228 bp, Homo sapiens
ttgactttatggtagatccattctaagaacgaattcaaatccctgatgtatcataggtctttgcctccagcacaatttatgtactagtgctgcagaggttttcaaatttagtgtgtctaagaattacttgggaactttttttttttttttttttttttttttttttttttttttttttttttttttgtggagggaaaaaaaaaaaacttctttctttctggggggggg

SEQ ID NO: 191531 - DNA, 598 bp, Homo sapiens
attatcactccccagcttaagaatctgtgcagcttacctgatctaatacacactcctcaggcatgttatcacaaggcatccataagtctggacaattgtgcttcattttctatctccaaactatatcctacagttctctaatgtaaactgaaacctctgttccagtcttgccatccctattatccatatgccacgtctcacctttaagccattctctagtcttcaccccttccaagccctatccatctttccagatttggttcaagttccaccatatccatccatgccactttcaacttgtattatcatcttacttttccgaacacatagcacttattgtaattcactacttgagtatttattctttgtgtttcttgctccaacaagagtttaacttattcaaaagcaaggaatatatacttttgggtatgctctataatagtgcttttcaagcttttctaaccatgacacaagtaaaaaagacactttatattgcaaccttgcacacatacatacacaattgaaactcaagtttgataaaataatacaatactatccatgatgcaatctgatattctatttttcattccatttgatt

SEQ ID NO: 191532 - DNA, 545 bp, Homo sapiens
gatttggaggttttgatcgtgactttattttgagatattgtatctttgttagtattgcattgataattagacttcacctggatttcagttcacttctggacaatatacttagagggtatgtatagacaaattaaaagatgtaggaaatcaggatgataaatggggttctaaaccatgttagaagagtcagaggtggatatttgtcatccagcgaaaattcacaggagacatggtagctcttatgcatttgaaagctggccaggtgcggtggctctcaactgtaatcccagcattttgggaggctgaggtcggtggatcacttgaggtcaggagttcgagaccagcctgggcaacatggtgaaaccctgtctttactaaaagtacaaaaaaaattagctggctgtggtggcgtgtgcctatagttccagctactcaggagcctgaggtgggagaatcgcttgaaccctggaggtggtggttgcagtgagcgaagcttgcaccactgcactccagcctgagggacagagcaacactctgtctcaaaa

SEQ ID NO: 191533 - DNA, 557 bp, Homo sapiens
ccattgtctttaaaagagctgtgccccctccagatgtaagcccctccagttctgagctctatgtcttacacttaggctcttagtacgcatttgaaagaatgaattaggtttccttaagtaaataatttccctttagagtttggtgctgaagtagaagtaattagaagtaattaactctcaaccatttcgttcaattgatattgagctctttctttgtacctggagctaagaatgtacagtagtgaacatgatagccccagcccgaaaggagcttatgatctactggagaaaacacagaaggaaatagattttaggacaaggcagagaaggaccgtgataagctggtgccattggagtatacctagtgggcattagtccagtcttgggaggttggggagccctctggggggagatgtctaagcagagataaggctgaagaaagggtagtatgggagcagcacagcagaggaaacaatgtataaaagcttggaggacagagagggacagtgctttcagggaacctcaggtgagtaaagcacagtggctggagcatttga

SEQ ID NO: 191534 - DNA, 283 bp, Homo sapiens
tacgctagataaggagctaaactcttagcggcctcctcctctccctaccccccaccttggagattagcaaccttcactctcagtctaactcccacctgagatttaggacgtggagtactgcaacccaaaaaagctagtttgagcctccccctccacactcctgcatactgagtccatctacctccaccttctctccccaaaacccagccagctggtcccccagcttctgggaaactcagctccccagatttccaactgtccagtaggaactctggggagagag

SEQ ID NO: 191535 - DNA, 208 bp, Homo sapiens
ccctaaaccctactgataaaagcagtgccaacaacataatgctttatttccagaaaccccttaagacccctgctttcgggaaaatgaaagtctcctggcaaggttcgcagaagtagccacatctgggatcggtacctaaagacagcaccatgaacttcacatgtcagctctccatcagcatcctcccaacctcagcaatggtatttct

SEQ ID NO: 191536 - DNA, 543 bp, Homo sapiens
acacacacacacacagtttgaatctgtgattagtcagagtaagtgcttggtgaatagaatgccttttgtctggggatttccctgcactcagcagaagtgcttgttgccgcttgtcaaggcctgagaaagccagattcttaaattggagtagagggtcaatacctcccagtctgtgagcccctaattcttgccattagacaaatatgtggaaatgttcgaaaaggtagatttgcaatccatttttggtgatttagggaattcttcacagaaacgcaatctctcccttcaggatccttccttctctaccaaatagcagtcacttttcccctgtccccgaccaccagcggtgggctccgacaaggaggtggctgtgcagtggtgtcacgtgtgtgattgtgttttaaagctggttattctctcttccccacacaatgtgttcatctttcccttcttccctctacacagcatgttcatcatcatcttcttccctctgcttccctgcacccttgtccttcctgtctccctctggtgtctctagccgtt

SEQ ID NO: 191537 - DNA, 667 bp, Homo sapiens
gtgtcttatcaaatgttttcttttacagcatggtgattgggaatgcctgccttggaaagtgtgtatccctaaatcattctgactaggctctacatctctgggacctcagtcacccactgatgggtgtgttaaagaggatccatgaccattttctgagagaaatcatggccttcctttgcttaggagtggggtactctccacatgctgctgttttgttttcatgaagtaatgcaaacctggttgttaatctgctaattctctgagttcaatatgcctttaattgacaacagagaatatttatattcctgttttttctcggagaccacaatctcaaactctatgccactttgtccttatcaaaacggtctctatgataatatttgcataatatttctgaggaatatgtaatccgttcattctgctagggagtagaccttttcttttaattcaagccacatcatcgtagagttttggccctttgagaattgcttttactgagtggtagtgtggtgtaatcattgacagattgagggtcattaatacgcaatctcagttaagtcattattgcgttgatcgtggtggaatgcttaaggagatggtccatatattacatagtctttgtcttatgaacaaccataggagaaagttcttaactgtcctgtcccag

SEQ ID NO: 191538 - DNA, 457 bp, Homo sapiens
ggccggacccagttacaagctcactcgggtaagacaaaattgaggacatctggttctgcactggacagggaaaggattacttttcgtctgtgtctgggaactacctgcccagctgtttgctgttgtaactggccagttacaacagctcaaaacggtctctatgataatatttgcataatatttctgaggaatatgtaatccgttcattctgctagggagtagaccttttcttttaattcaagccacatcatcgtagagttttggccctttgagaattgcttttactgagtggtagtgtggtgtaatcattgacagattgagggtcattaatacgcaatctcagttaagtcattattgcgttgatcgtggtggaatgcttaaggagatggtccatatattacatagtctttgtcttatgaacaaccataggagaaagttcttaactgtcctgtcccag

SEQ ID NO: 191539 - DNA, 125 bp, Homo sapiens
tgggcacatgggtccggtggagtgaggggagggggtagatgggtgtgttgtgcctgcccagggtctttacgagggtcccatccacggggcagtgtgtgtcctgtgcctagcgcggcgccagcatg

SEQ ID NO: 191540 - DNA, 269 bp, Homo sapiens
tctgtcccaaaggctcttccccaaaacatcctcctacaagtctgtgctcaaatgtcaccttctccattcagccctacaacctgccctccacctctctccctgcactgcacactggagctgcctttcctgcctctgtgttttttttttcgataacactatcacctccttacatactagataatttacatactaactattttttactgtttagcctgccccaccttgacagccagtgtggatgcaggacaggaaagacaaaagaggaatga

SEQ ID NO: 191541 - DNA, 209 bp, Homo sapiens
ctatctagaggaaacctatcatggtttaggttgttgcagctgtaaaattttttttaaaagactaaaggatggtctaccatttgactccaaaaaccccttttctatgtcttgttctacaataattgacttattctcttccaggaaatgcataacattatttaaaaagaagaatgatactaattatataattgcaatgtaacagcgtacta

SEQ ID NO: 191542 - DNA, 422 bp, Homo sapiens
gctccagccttggccagcccagaaaggggctcccacagtgcagtggtgggctgaagggctcctcaagtgccgccaaagtgggagccctggcagaggaggttccgagagcaagcggggctctgaggactgccagcacgctgtcacctctcaatagtatggggctcccggtggcggtggtatctgcaaaagccaagactttcttgagttatacaggaaggaaacaacagtgctgggatttgaacccaggaatgtctcgatctagaatctgtgctctaaaccagtaggcgtcactgcctgagactggtgggagaattgacatgtgctccacagccttgtaggtccaccaacaaactcccagcccacccacaggctcatcaacatcaccttggatcaaagatttccatgaatattggaaagacata

SEQ ID NO: 191543 - DNA, 724 bp, Homo sapiens
ctatgtaacacatccctatgacaaattagaacatttctatcccaccagaaagttcctttgtattcattcctgatcagcttgtattcactcctgattccagcactgctaagctaactttttcaccttagtttgcctaatcttaccttttattttattatttatggggaaaagaagaatctttttactcatggataaagagggctatttaaaggaagtgtctatttcagaatgttatattactgtactgggagctataagatgtgtgtgtgtgtgtgtgtgtgtgtgtgtattacaaaaatatatgacttgttttctcagggagcttaccttcttgttagggaaaagaaacttaaacactgatagcagaatgaaatgtacagatagacatgtcttagaagttttgagaaagacaagattaatgtgtttgggaagggttggggaaggcttcatgaaggatgtgtgttaagcctagaaagggggtaggagtggataactggaataaagtgactgttacagcatcctttatcagattttgttgcatttatgttagaaagaaactttgtggtgccctttcaatccatcttccactgccaccagagctctttttaagaagctcagatatgatcataatattccttcattaaaatcattaatctactctaaaatacaaactttctgtattcatggtgtggtccttccctacttttcccactcatccaaccat

SEQ ID NO: 191544 - DNA, 481 bp, Homo sapiens
ctgttcctccatctccttgatgcttggcatctgtgtgggtcacatattcagcagattgggtaataaagagcatgcgttgcctttgcagcaaggttgcatcagatggctggacgtgcctggatgtgctctgccactggcatgaaggaccctgtgcagacaaggccaatagtgaaggtcagggattccgagaaagcacccagtttctcctcttctccctctaaaaatggtttcttctgcccacattctattgatttgccttaatccttttagctgttaacctttgcctcagtttagtggacacacatggtatctgcagtgggtctggctctaggagtgaggtgagatgaattgaggtaagcctggcagggtccctgctgcccatctgcccatcttgctggggaagacagaatagccttgcgctagtgtaaggtggtaagtatggggtcaggagaatgaaaagggtgccaaggcagccagaagt

SEQ ID NO: 191545 - DNA, 366 bp, Homo sapiens
aggggacatgagatgggataaaatgaaggaaggctgttggacttctggaattctacaaaatgggccaatagcgctatccagctgtaaacatgtcttatccttcaagaaaagagaagaataacccaaaggtagatcataggtcagcagggctgttacttctcccttgggcccagaggcataggcctagggaatgtggctatatcctccagatttcatctagccaggcatctgcttgtgagtgccagagggtgtgggtctgttttctagggctgaggtgagtagggctgctttccagagctgagaaggcttggccaccacctgggtgggctcagaggacagaacactgagccaaagaaatttattctt

SEQ ID NO: 191546 - DNA, 486 bp, Homo sapiens
aggcaaaggcttaggaaatacaacattccagagtcctccctgaaatcaccagtcatgtgagagatgggtccaaatgaggaatagaaaaattagagcacaaaaaaccggcagtaacattgaaaccaattaaacagagttggcaaaagccaaaaacaaggattgaaaaagaatgttgtggcttaaaaaaaaagtgtaaacaaaagttaggtctgtcgtcctgattaagtggacaaatataagtagtgagggcggcaggtaggaggcagaaaagcacacaaaatttctcatgggggaatataaaaacgaattatttgtcactgactttactaatgtgtgaaatgtaaactattttcatttgataaatctaaaggcagccgcgagaagaattaaaaatactttctgccttgaaaatcacgatagaagataaaagcaaatgtgggaaaattcagaaaacaggaataaataaaaactatagaatacgaagtc

SEQ ID NO: 191547 - DNA, 238 bp, Homo sapiens
ttgcttcaagaggacaaactaaaagacgcttccacccaccccattttgactttctaacctaattcggtgaccacaccctatccacacgaaataattctacacctcactgctcactgagttcaaacacaccaagctctttgacgtctgtttctttgcacacagtgtatcacagcagaaccatcattccattctttctctcctcaacccaggcctggcaaattcctactcatgctttaag

SEQ ID NO: 191548 - DNA, 493 bp, Homo sapiens
ccgctctagagtatcccctcgtctatttgacaggttgtattattattcatctgatgactcttatttctagatatacaatgaagaatgtcaaagaaaaggtagcaagctacccaattcatgcaataaaagcaaatgtaaaccttataactaaacgataaatacagcagtcttgtttcaacattatcattatagtggacaatataaacgttatgtaccaggcacagttctaaacctcttcaataaattgtcttacttaaaccttataatgatcagtaagaaaactatattcccattttacagatatggacactgaggccaagaaaagttcatttgcaaatgacaagaagatgattagaatttgggcagtctggcttcagagcctgtggctgtcatcttaaatactactaggaataaactcagttatgtattttaagggtagcctggttgaccccaagggtagcctagtttatcttggtcttgatagacttttgcc

SEQ ID NO: 191549 - DNA, 480 bp, Homo sapiens
gaagggtcccatctcttgcagtgttttcctattgggacacactacccagttcttggcctaggaatggggatcacaggggctgagggtggtctgggctcccaggtgaggcaccaggctctggaggcaggctctgaggctggagtggcaaggaatttctgcgagcaaagccctccataaggtctccaggggcagcttcatggaaagttggtgcctctgtggcaaaggagccagcagggacactccagccattctggggagatgggaggagaaggtgtgctcggtgaaagaagtgacagcgactaggctctgtcacctccctgctggccagcctcaccagggagaaactaagtgtgaccttccacctgcagtggaaacatgactccaataactggatgccaattttatagcctaacccagaggctacagttgctatgtctgctcctcttgggtatgattggcttgttgctggctgcccattgc

SEQ ID NO: 191550 - DNA, 369 bp, Homo sapiens
ttcattttctacacaaaaatccaaacatacccatctgtagtggctttagtcaaaactgccacaaactgaaaacaactcaatgtccttccactggtaaataaacaaacaaattgccgggtgcggtggctcacacctataatcccagcactttgattaccatccacaggctgactctcagatctaaaattccagtttataggtctcccctgagctccagattcaaaagcagcatactatttctgacacacctaagctgagagcaccccacgtgtcttcgaactcagtgtcttctcactttaccgccacacacgtttttcttcctgtgtgccctatggcagtcaaggccattgtcatctatgcagctgcctg

SEQ ID NO: 191551 - DNA, 191 bp, Homo sapiens
ggaggccgtggcagatttggaggctttggcaatggcttctgttaccttgccatgaggtaactcagttccctcatcacttttctctgagaactataaaaccttggaggggtgccttctgcccttcgcttggcatgtatattatgcagggatcaggtcttactccgttcttgattgttagtacaaattagtta

SEQ ID NO: 191552 - DNA, 472 bp, Homo sapiens
aactatccccataacccagtatttatttccccagtgtggcctttccagcccctgtatgtgatcatcatctcttggagtgcttgctaaaatacagtttgcctcatcccagccgtgtgaactaagggagagtctttgggaatgaagcccagaactcttcattttcaattccccaagtattcttaggctactagagtttgagaactactgtcatatagcctctcttcctcaactaaggaacagatctctgtagtttgtagtaactgctgtaaaatggcagctccataggaacctattttccataggaacctgcagttcacctgttcagacagatttagaaaattagaagtctccattttgcatatagctatttataatagttgggtgatcatgcttccttcttctcaaaatatgccactttataattcaaaactgcaataaaactttagaagaaatttccttcctcaaaaatcaa

SEQ ID NO: 191553 - DNA, 497 bp, Homo sapiens
ggctttgccaggcgaaaacagaatttttttccattcacattgctaagatttaagatgagctcagtgagtcagaataatagaactggaatctgagttgactgcattactgttttaacggtcttgctgttataaaaataatacatgttgattagagaatttggaaactacaggaaaggataaaaacaatttaaatggccacatttctactcttcagagaaccattgtgagcattttgaagtttgacttttttcccttttctgttagcgtctgtatatgtaggagagtattttttagtgaatttgggtgtcacactaaacacaagtgtttcataatctgccctttacatggatgctgaagataaacattttctcatatcattgcctgttttaaaataattgttattgaatcccagcacttaggccaaggtgggaggatcactgaggccaggagttcaagactaactatcctgggcaacataacaagaccccatctctaaa

SEQ ID NO: 191554 - DNA, 301 bp, Homo sapiens
tgcacctgacccaaagacagtcactccatgtgctggccagcaaaaagctctttcccacataggataagatggacccattggattccttctctgtgaataattttcactgaaaaataggaataggaccaggcgtggagtagcaggaacagaaaattaaagagaaatgagagactatgagagaccagagagagactatgtgttaattttcctaagggaaaggaacaatcaggaaaacaaatgttgacgtgctaaggggcgttgggagattacttaatatctcctacagtcttcgtacagatct

SEQ ID NO: 191555 - DNA, 442 bp, Homo sapiens
aaggttggcaatgcagcctgagtgcttgtctttgtaatgagctcttgggtgatgtggattctgtcggtctccagaccactctttgagtaacaaggggttaataggtgcttcttcaattatctgtgctatgttttttgtatttccaattaatcccagcaccttatcaataactttattatgacatactatggaatgatcaagttctggcctacattatggtatttctctatttcctttagtaaactccaagttccttgaggctggagccctctttatcactgtatgctgacaacctagcccagcagtttacaaagtgaagatgctgcttgatgattacatgtacaataaacttgaagctgacagtggtctttaaatactcaagtctttaaatgtgaagtgctctcacatatgattttttctgatgaccttaggtacaacaaag

SEQ ID NO: 191556 - DNA, 343 bp, Homo sapiens
ggttatctttgcgtaggtttaaaccagtatcaatcagcccgaatcaacctgcttgtttcctaaagctggcaacatacacaattttgaaaagggtaaacattcagtaaaaactgttgtcaaactatcaaaatattagaaggaaaagttctgaactatgttcagtctgattagttgttctgttaaactccttgggttttttcttacattcacctttagttgtcttgactcactctgcattcctgaggagactgagatctagtattttaacaaaaattacttttgaaggtgattttaagtatgtgcacatgtatagcctgtttgcatgaagaaccaaaggcatctt

SEQ ID NO: 191557 - DNA, 494 bp, Homo sapiens
agagaccaaaacaaacaggaaaagcaacttagaggaaacagggattatccagaaattaagaaaaacttaaaaaatgaaaattaatatccctagcagaaataagagaagatattgtattcatgaaacaagagtagtatagtatatgaaaggaactttcagaaaacaagaactcttagaaataaaaaataaagtgaaataaaaatctcagaagatagaactgaagaaatatccatgaaggtgggaaaaaaagacaaaaaagaaaaaggaccctaggaagcagcaggatattccataactaaattataggtctacagagaaaaaaaggagagaaaatagagagggccataaaaaaaattaagaaaaattcccaaaatggaaaacaggaattctcaaaatgaaaggacccagtggatgaaaacagacctacatcctcaccaaggcagtcatctcaaaattgcagaaccctcaagttagaaagaaaaccctacaactgt

SEQ ID NO: 191558 - DNA, 304 bp, Homo sapiens
tatttttttattttttattttactttattttatttttttaagaaagggggcacaaatgaagagcaggctgcctgagacttgttcaagaagacatcattttgtgtaactgagtcagtgtttactcattcactcattcagtgatcctatgttgcttacctataaagcatctttatgatgcctacaaaaggtggagtttatttcctggattatcctttgatactctaaattggagctttccaacctgtgtgccatgagtgtctggggcctccagactggttgccttatgttactgttctatatgtgc

SEQ ID NO: 191559 - DNA, 351 bp, Homo sapiens
atgatcttgccttccattctacttgtacttcagtcacacactcccactgtcacaccctggaacttgtccttagtgaaaacttcaccttctccattcaaacagggttgagtatcatgctaacaactacccctatttttccagttcgcttcctttcttattctggctccaagaataatataatctgaccagtgcctgcaattcattgatacttaactcgtcagaatcctaaatacttgctgagttgtcatatatttctttgtacaagttaggttccatgatctattcaaaataaccagccaaacaaaaaaccttacttggatattttttctactccactgcccctttctcttt

SEQ ID NO: 191560 - DNA, 1157 bp, Homo sapiens
ataaagtaacaggaaaattaaaatgcccagcagacccattgcctcctgaacaggtgtttgctgctaatggatacagtttccatttccttgaagggatttgcccagaggattactttcacaacttctattgagataatactgctctaacagaaagagcaatgcatgaatctgtatatcagttccttaataaaagggaagatttttttagttcctaaaataccaatgaggtgaagaaaaacatgccacccaggtaaagttactctgtaatcacccgcattatctttttcaaggaatgtgggggaaatttatgtcagtcatcaggcaggtactagaagatgctaggggcctcacagacagcttgttcccggctgttaacatggagcagagcgttccctggggctgagcatgggagcccagcacttcttataggtaggtctttcctactataatattagatgcctacacttattgactttttcatttgctctttaaaatagatttcttctgctggttctgcttagttctaaggagtaaggtagaattttggtgccatacctaaatatcacgtctaaaatgacattggtagcacttttccaagaataaccagcatattgatcaagccattaataaagcctaattatttgctttaagaatgtttttggttgtttcaaactgagttttttccaaagtcataacaaaactaggagaggctgtagattcttaattattcattagattagggggaaaacgaattgctattacaaagaatatcatgcaaaaaataggttttaaaaaatgcattactactgagttttaaaaatgtatactaacattctccatatcaagaactgtttcatggatggtagattttagttatagcagtactggacttacactcagtcaaataattttaaattttctataattgggaatacatggtagctgaatataagcaaacatattactctatgaaataaatgcataagagtttgttatcacaaaaaacagcataacattatttttttgaaacacaaggctctgttttaacactttaccttgtttaatagtaacaaaacccctgaggaataggttgtattgccattttaaacactggagagcaaaggtccagagaggttaaatagctttctgcaggtcac

SEQ ID NO: 191561 - DNA, 272 bp, Homo sapiens
caaacacagattggagaggaaaacagtctatcaagaggagaatctctatctcctaccattaagtggcaaatgtaatagaaacagagcatagtcaaatgtaatctgacttgaaactgttctatcaacctcattacatagcaaaataaatctgttatttgcttagcttggcgggtcatacaaattactgattgcttggctttttctcagtatgagaaaacaatttatagcacagtagataaataaaataattttaggtccaagtgatttgcttc

SEQ ID NO: 191562 - DNA, 949 bp, Homo sapiens
aaatctgccaaatctgcctggttatgttcagcccatgagctaaaaatggttttcacatgtttaagtggttaaaacaattgagaggaaaataaggcttcgtggcacatgaaaatgatatgaaattcatattcgtgtccacaaataacactttgttggaacatagtcatgccttgttttttaatgcattgtctatgactgtttttgtgctaccatggcagagttgaatggctgtcatgtggcctgcaaagcctatctggctctttgtaggagaagtttgctgacccctgtagccactctgaaggctttatggttctatatttgtgataaaatatcaaatatagttcaggttaaaggtatttccaaagtactcagaagtgcttattttaaaaaatacattgaggatggtaattctggtttgcttatttgcctagtcttctgcatcttatgtttgagcaaatgatgacattttgtgaattatttgccaacttatcacattccctacctgaatgcattgtaaatgaatgatgtcaaaattaatgaagaattactgttttatcactttcagaaaaggaaacattagactcctttacatgatttcagtgaaaatatcctgattgttattttgaatttctactgtacagttttcttatgtgcaatcactgttttaaagaaagttcagtataaaatgaataaaacttggttaaaaatctctttacctccaaatgaaagagaaacagtccattataagtaagattcgtatctcaatgtagatagcacactaacatttaaaaaattgtattgcaaacacactgatgattacttaaacctatatttttggtttaagttggatttaaaattaaaattaaatttatctcttattttagtatgcttagcatttttggtgcatttttttgtttttatagtccataacattagagagtaggaagaa

SEQ ID NO: 191563 - DNA, 363 bp, Homo sapiens
tgtcacacacatgcacacacaatgcacgtgctcacagactcacacccacatgctcacacacatgcttgtgcaatgcacccacacgccagattgcacccacacccacccacttgcacattcacacccacatctgccctcacacactgtcactttctcacacacccacacaatgcaccagctcacactcacacacatgctcacacactcattcactaacatgcccccacacactggcacccacacgacacacccactcacatgcttgcacccacccacatgttcaaacccacactgcatctgcttacacattcacaacccactcacacacacctggtcacacccactcatgctcacacctcattc

SEQ ID NO: 191564 - DNA, 203 bp, Homo sapiens
tgtcacacacatgcacacacaatgcacgtgctcacagactcacacccacatgctcacacacatgcttgtgcaatgcacccacacgccagattgcacaagcaggtgtgtatatatgtaggtgtgtatatgtgtgtgtacatggggtgtgtgtgtatgtatggtgtgaatatgtgtctctataagtaggtgggtatatgtgtgta

SEQ ID NO: 191565 - DNA, 531 bp, Homo sapiens
ggaatttttctttcagtctgttgtcatgctcaggttgccttacaattaattcatagaaggaaaattattaagatatttaaagaattgagcagaaagaaagctgagagattacctattccagtgaacacatcttgcaggtgaggaaattgtgtcctacagaactctgaggtccataagaagagaaaaacaaagtgaaaaggaaaaacccccggaatctagaaatttcatagtaacttagttccaggggtatgttgggctgactctctaggttcatgagagctgactgtgcatatctcttcccaatttcaagattagtgacgtcatattggtagcttgaaatcagtcatggaggcaacacatacaccatggaagtcagcaaaaacaactataaattagagggttggttattaaacatttaccagcacaccagtgctcagttcacagagtcgagtatgatatttaatagacatactgtcagcactatctaagtacacatacaaatagtttaggcatgttttatttgctgctaaa

SEQ ID NO: 191566 - DNA, 380 bp, Homo sapiens
acttgttctctgcccacatgggctactgtgacatactgctgagtttaacaccgatgtgatgtaactcttcagcctcagccatgcctacctgggacatggtgatgcatctctgcacccatcacccaggtgatgtgactctgttttcctgtgtgctctctgctcaaaggggaagattgctacctgttgctgggtccatcacctagctgatgtgacttttctcatctttctaagttctgcctgcaagggagatgttgacattttaccttgcccaacaccgaggtgacattaacctgttggctttgtcgtactttcagaagacattgtgacatattgctgggcccagcagcaaggtgatgtgagtctcctgcctgggccctgtt

SEQ ID NO: 191567 - DNA, 191 bp, Homo sapiens
gggaataacattacactctcacctcaggagagttagaagccttgggcatattaccagtggcagaccctaatttctataaagagctgagactagggcatgatggtgagaagatggaaaaattgctctttctattcctcagggacttaagtctctctttgagaagactggttatttgttctgggaacaaaact

SEQ ID NO: 191568 - DNA, 299 bp, Homo sapiens
atgggatagcaggactgggagaacagaggtagagagccatgtctgcagagacttacatgcagctctcctcatgagagtctcctcatgagagccccataccaatactacctccacttctctgcaggcccctaattctacaagccctgggtatgttgatggggcagctgctcaggccacccagtcagatgcttctgggcctcctacagctaatttctatggggaatgggatcaagctgttattctctggtgaatcagctgtcctgctcagaaaagctgccacacaggtctttaaagcatga

SEQ ID NO: 191569 - DNA, 474 bp, Homo sapiens
  misc_feature (5)..(5): n is a, c, g, or t
  misc_feature (58)..(58): n is a, c, g, or t
ggatnccctttccctgatcgctctcgtcgggaggctgaggcagagaactgcttgaacntgttaggcagaggttgcagtgagccgagatcgcacgccactgtactccagcctgggcaacaggcgagactccgtctcaaaaaaacaaaacaaaacaaaacaagaaacaaaacaaaagcctggcatggtgtcacacgcctgtaatcccagctactcgggaggctgaggcagaagaatcacttgaacccaggaggcagaagttgcagtgatggttgcagatttctgatttgcttagaggtttttttttggtgtgcgaatatatttacagtcatcttcagtgatatgaaaatgaaaggtgtcatctttatctgagttgtctcaccaacttgtgtgccgaatttgaattgtctttttaattgtaatttgtaaaattgaattttacaagtcgataaacttgtcagtgagcgatcagagaaa

SEQ ID NO: 191570 - DNA, 231 bp, Homo sapiens
ggcttgttcaaccagatgactagctcactgggatacgggaccatagaaaccaagttaggagtatcagtgagtgtggggagtggggagagcatgaactcatgttaagtttggatggctttgagaatcccaggaggacaaggcaagttgtgagttgtataatcgagtttgaaacctgaggacacagagccttgcactggagatataaatttgtgagtcctctctgtgtggatg

SEQ ID NO: 191571 - DNA, 233 bp, Homo sapiens
tactcttctccctagaggaggcagttcccaaaggtggaggggagatgtctattactactttaagaactaatcggccgggcgaggtggttcacgcctgtaatcccagcactttgggaggccgaggtgggtggatcacctgaggtcaggagttaatgaccagcctggcaacacagcgagaccccgtctctacaaacattcgctgggcgggtggtgtatgcctgtaatcccagcta

SEQ ID NO: 191572 - DNA, 408 bp, Homo sapiens
aaacgacccgaagacacaaggaggccattcaaagtcacacagattatcagctgtggacatgaggcaggagccagggctaattttctattagaccactatctggagtctagggctcctacaaaatataagagccaagactttaaaaacttaaaacctcatgcaaacactctctcaaaaaagaattagcaagctagaaactactcccatggaaagagccgttgttttattttaacagaatatctaagagcagaaatatggaaaggcatgaaagtttaaaaaagtaaaaaacaaaaataactctcaaactcctacactccttgtttcccagttactcagacacaggtgggtcagtggctccaggctggctggggatgactctgtcaagtcttcgggtcgtagggagctctc

SEQ ID NO: 191573 - DNA, 282 bp, Homo sapiens
tgctgggattatacaggatcctactcgatccgctgatccagcaagttttaacttggccaaaatccaccaatcttaaactttgtgcacccttcccgctctgaagaacagtgagccagccggccagggtgcgggtatctcctacctaccctggggcccctcactgtatgttgactattgacaaatatttattgtgtgctggctgtgaataggacttgtatattgagcacttaggtgtcatgaaccatgctggatcagcggatcgagtgggaactctagggtcct

SEQ ID NO: 191574 - DNA, 372 bp, Homo sapiens
ctggggcccctcactgtatgttgactattgacaaatatttattgtgtgctggctgtgaataggacttgtatattgagcacttaggtgtcatgaaccatgctggatgttttgaccatattatcccctttaattctcacgacccaactctgtggggcacttttacagctgggaaactgagggttcaaggggttaggtatgggacttgcccaaggtcataaaggtatgtggtagccagagtccctgttcggcacagacctgttctttgctgtcctggccagtgttccaggccttggggacatagctggggctgaagcagggctgtttctgccctcaggcagtttacatcctggcagaggggagagctgggcaaca

SEQ ID NO: 191575 - DNA, 964 bp, Homo sapiens
ggcaatatctccttcctcttccctccagtgaaccctgcttatgtaggtgaaagtggtcctgtccatgcttatggaaacccaccattgtctgaatgtgattggcacaagtcaccccaaggtaagtgatatggtttggctctgtgtccccacccaactctcatttcaaattgtaatccccatgtgtcgggggagagacctggtgggaggtgattggatcatgggggtggtttcccccatgctgttctcatgatattgagggagttcccttgaaatctgatggtttaaaagtgacagcttcccctgcacccactctctctcctgcccccatgtaagatgtgcccttctttcccctatgccttccaccacgtttgtaagtttcctgagaaatgccccccagccatgaggaactgtaagacaattaaacctcttttgtctataaattatgcagtctcaggcagtatttttatagcagtgtgaaaacagactaatacagtaagacttaaaggacagtgaccaaaaagtcaaccctggagaaggaacatgtccaagacaatccacccattgccatttcctttgacctccagtgtggttactgatgcagaacctgcttaacatatcataatggagttttcttttagatgtatagtaggtggtcttctggggatcagggtgtcttcattaggaatcttctggttgcaagtgacagaaacccaactcaaacaggcattagcccagggggaattcattggctcatgtggtagaagcgtatgggggaaacttaaagaaatgaaagtagaagtattagtaccttccagcacctagtacagtgcctggcacgtagtaggtattttagggatatttgttagattaatttgttgaatgagtacagaaatcaggacctcagtctgaggtcagggaactcaatgtcacctggactctggtttcccatccatttctcatcttt

SEQ ID NO: 191576 - DNA, 852 bp, Homo sapiens
ttgccaagcacttggagagaacctgattattcagatgctgagaatggtcatgattatggctcttctgagaccccaaagatgaccaggggggtgctcagcagaacatcttcaatccagccctcatttcgtcacaggagtgatgaccccgtgggcagtctttggggagagaatgattaccctgaaggcattgaaatggcatccatggagatggcaaactcatatggccactctctgccaggtgctcctggaagtggctatgtgaaccctgcttatgtaggtgaaagtggtcctgtccatgcttatggaaacccaccattgtctgaatgtgattggcacaagtcaccccaaggacagaagttaatcgcatcccttatacccatgacatccagagacagaattaaagccatcaggaaccagccaaggaccatggaagagaaaaggaaccttaggaaaatagttgacaaagaaaaaagcaaacagacccatcgtatccttcagctcaattgctgtattcagtgtctgaactccatttcccgggcttatcggagatccaagaacagcctgtcggaaattctgaattccatcagcctgtggcagaagacgctgaagatcattggcaggcaagtttggaaccagcgtcctctcctatttcaactttctgagatggcttttgaagttcaacattttctcattcatcctgaacttcagcttcatcataatccctcagtttaccgtggccaaaaagaacaccctccagttcactgggctggagtttttcactggggtgggttattttagggacacagtgatgtactatggcttttacaccaattccaccatccagcacgggaa

SEQ ID NO: 191577 - DNA, 1040 bp, Homo sapiens
ctcctgagaaaactcctcaggggttagatgcaggagttatgttgtgatttgtgtaggggtggctttggtgagctcatcctggcattttaaaaataatgtgaatggtgtatccctttgtgatcatcatcactttttccctgcgagtcccaatcaatgcgggtgtgactgctgtatgaagtctcaggaagcccaccccagtggagaagaaggcttgcaggaggcaggagatgctgtccgatgaccacgtgaatgaaatcatcatacaggttgagaatgtttcctctggggtccaaagccacccatcctcaaatcagatttttcaagaaaaggtgctgctagactcaagcatcaacatggttttgtcaatatctgacattgatgtgatagactctcagacagtcagcaaaaggaatgaccaaaagggtaaccaggtgctgcggttttcaacatctttgaatgagtcgatgtctcagacccttcatagcctagaatgcatgggcatagacactcctggttcttcacatgaaactgttcaaggacagaagttaatcgcatcccttatacccatgacatccagagacagaattaaagccatcaggaaccagccaaggaccatggaagagaaaaggaaccttaggaaaatagttgacaaagaaaaaagcaaacagacccatcgtatccttcagctcaattgctgtattcagtgtctgaactccatttcccgggcttatcggagatccaagaacagcctgtcggaaattctgaattccatcagcctgtggcagaagacgctgaagatcattggcaggcaagtttggaaccagcgtcctctcctatttcaactttctgagatggcttttgaagttcaacattttctcattcatcctgaacttcagcttcatcataatccctcagtttaccgtggccaaaaagaacaccctccagttcactgggctggagtttttcactggggtgggttattttagggacacagtgatgtactatggcttttacaccaattccaccatccagcacgggaa

SEQ ID NO: 191578 - DNA, 446 bp, Homo sapiens
atccatcattttggattttagggtgctcagcagaacatcttcaatccagccctcatttcgtcacaggagtgatgaccccgtgggcagtctttggggagagaatgattaccctgaaggcattgaaatggcatccatggagatggcaaactcatatggccactctctgccaggtgctcctggaagtggctatggtaagcatttgttaagccaggatcatatcctgggaaaaaactgaaatcactggatttaggggtgcaatcattaaggagacttggcaataggagaattggtgtatccttccaatctcagagacccttgtttttacatacaaaagttgagaattcagtgtttagagaagccaagttaattgtcatcaattataaaaaaaatgctaggtaagagttgtggaaaatggggacctgtgcactctgttcctaccagagttg

SEQ ID NO: 191579 - DNA, 769 bp, Homo sapiens
ctcctgagaaaactcctcaggggttagatgcaggagttatgttgtgatttgtgtaggggtggctttggtgagctcatcctggcattttaaaaataatgtgaatggtgtatccctttgtgatcatcatcactttttccctgcgagtcccaatcaatgcgggtgtgactgctgtatgaagtctcaggaagcccaccccagtggagaagaaggcttgcaggaggcaggagatgctgtccgatgaccacgtgaatgaaatcatcatacaggacagaagttaatcgcatcccttatacccatgacatccagagacagaattaaagccatcaggaaccagccaaggaccatggaagagaaaaggaaccttaggaaaatagttgacaaagaaaaaagcaaacagacccatcgtatccttcagctcaattgctgtattcagtgtctgaactccatttcccgggcttatcggagatccaagaacagcctgtcggaaattctgaattccatcagcctgtggcagaagacgctgaagatcattggcaggcaagtttggaaccagcgtcctctcctatttcaactttctgagatggcttttgaagttcaacattttctcattcatcctgaacttcagcttcatcataatccctcagtttaccgtggccaaaaagaacaccctccagttcactgggctggagtttttcactggggtgggttattttagggacacagtgatgtactatggcttttacaccaattccaccatccagcacgggaa

SEQ ID NO: 191580 - DNA, 411 bp, Homo sapiens
agaaagcaggtggcatggccgcagccgcacctccgggaaaggagcagccacgggcgctgacggaggaaacagccaggtccaccttgggatgaagggggttgcgtaagctttcctacttgagtcacaatacatttaacgccattgtcaattttttaacaagataaaaatgggtcacgtacagaaatacagatgctgctcaggtacaaaacatcaaacactgaaagttggcctggccagatgcgcggagggaccccacggccatatgacgggctctggccttgcctcctcgatcctgcctcacccgtgcccaggtgcctgaactccgcagaagagaggagcaccagcacgtgggggaggcacccagtctttggtgcttggcctctgctgcgaagccagaggcacgtggctggt

SEQ ID NO: 191581 - DNA, 398 bp, Homo sapiens
gatgagattgtcccagaccaccccctttaactttgcagcctccatcccatgcctgagctccttctttgatgttcttcacgctatttacattttattgatttcatttctcccctcactgtcaaaaaagtaagtggtgtgagggcagggacttttgtctgtttcatttacggctgtatgcactatgcctggtttaaaatctgtcagtcagtacaaatttggtggacagatgacagaatgcgttggggagttgcttccgacaacacgtgagcagctgatgcccaaggccccttctgacagcccctgatggctcgtggccgccagccagcacacagaccatgttctgatctggggagtaaaacaacagcagtccacatcccagagacctgctcccccctgct

SEQ ID NO: 191582 - DNA, 472 bp, Homo sapiens
tgaggcctccatgagatgcaagttttactcttaggatgacaaagcagagaaagagaaagagcttgggccacagggtgaccctggggaacagctgtgaccctgcgttcctctgtccccacttcctcttatgtgagaacagtcagtccccatgtggtaaagctactctagacaatgttctagacccggtctctgtcactgaacgctatctctaacaaagtttgtgaaaccacaaatgtaactattaatagaatcataaataagatacatacttgccaaactacttcagaaggaaaagccagaaaaatgtctaacagcagacaacaaaagaaatatctgatgatgataacaataaaatgataataagtccacatgtatcatgcatgacaataagcagaggataaagattgtttttaagtaaaatcaaatctctctatcacctggttccaagtcactcctcaataaataaccaaca

SEQ ID NO: 191583 - DNA, 290 bp, Homo sapiens
catgcaaaagaatctttgtctccattccttccaaattcatttgaaccagctcaaaacagttgagacccagttaaaatttttgattaagtggcatggcctgcacattatttagtagactgtttaccttttgcagaactgtataatttgagaatgaaactggagcctcccaatctcattgtcatcaaagtagagtttaagttgttggttgtctgcagttgtggctaacagtatggagattagtatatactgtatgttctccttcatatgcaggtaatgtgtagaaagattga

SEQ ID NO: 191584 - DNA, 401 bp, Homo sapiens
gtggcatcatcaccctaaatatattatgaaattgataacattcagatttcttctttactgtatattaatgtgattattcatgcatactcttcctttctgtcagtctcttgggtataaggctgttgctattttctaaatagttaaataggtttgagtgtaagttagctaattcttaaaatgtaccttaaccaagccatcatatttgtcttctcaaatatttgtacatgcagattttacatatttagtttttgactttttgcagatttgagataaggctaatacttatacattagcacttcagattgaaagcatgatcgtatttagcttttaaaagagattaccttatttgatgctacttacataataaatttagggttgatggggatcctctgagacagcct

SEQ ID NO: 191585 - DNA, 307 bp, Homo sapiens
tttagataaattgagaagcgctagtttagacatcgtaaaactagggtgttttttgtttttgtttttttactgcagtgcttctctgagcattgtggctctctagggggaaaagtaggggagatggaaaagggctacttaaatttctttaaccacagaactttctttttccctaggacaaccattgtgagaacttagtgttccatcaaaggcagtttgggaaatgctacaatagatgacctcttcagatttctttcctcctgaacatttcaccattccccagctagaagaaaccgagcagatagccagg

SEQ ID NO: 191586 - DNA, 377 bp, Homo sapiens
ggtcccgcgcgtccgggaggtcaccatattgatgccgaacttagtgcggacacccgatcggtgtagcgcactacagccctaggaattgcctgggcttcaagcgatatcccattttacagacattgaaatcaaggttcagaaacgttaatgacctgattaagcaacacacgcttggtacctcaaccctacttaggttttatgccccacaccttggtgacagatgagcaggggtaggtcttcccaaccaggccctccttcttgaatttggttgggctggggtttggcagggcatggagcaggggaggaactgggcacaccagttgaaacacaccctggattaaggagggtgacttgaaggcatttccattggtttggcc

SEQ ID NO: 191587 - DNA, 891 bp, Homo sapiens
ctactagtttagtttatatttataaagtaaataaaatacaatctacatataaggaaagcttaattttgttttcattttttagataaaaatataaataggcatgctgatagtttcctcccatgccctaaaggactggcagtatatgacataaacacaataatcttgcacacttcctttaggccataggctccctgctctcccaactccaagtcattgatgcaaatagcagaagttgatggtgaactgaaaatacacacctgaatccctgtaacataattcagttttcactcaggaagcaatgccaccaaagtacagtggagactgtgctggagagcagcgttagaggtagattgtctatattacggggcagcagtggagatgtggaagagggaattcactaagcaaaggaagagaagaagggctacttccagagggcctgtataggggccttagaaggtctggaaattagaaccaggaggttgggtgttgggggaggtgagagtacagagtgacaataagacacatgcaggccatgcagctcttggaatgtcttcatgtcatggaagtgagcatgtccagtggaaggttacagagatgattctgaagcttgggagagacctaaggtctggagttcaagaccagcctggccaacatggtgaaaccccgtctctactaaaaatacaaaaaatagccatgcatggcagtggatgcctgtaatcccagctactcaggaggctgaggcaggagaacctcttgaatccgggaggtggaggttgcagtgagccaagatcgtaccactgaactccagcctgggtaacagggtgagactccatctcaaaaatatatatatgtcagagaagaaaaaaacagcgttccaaaatcaatgttaat

SEQ ID NO: 191588 - DNA, 223 bp, Homo sapiens
gtttctgcttttgtggagactcactctacaaaaaactcactgttgcccaggctagtctcaaactcctgggcttaagcagttctcctacctcagctctccaaagtgttgggatttcaggagtgagccactgtgcctagctggtacctttctttttacagaggagtaacagccttagaaactgaataactcataatatataattggatctgcactcaggtgtgtc

SEQ ID NO: 191589 - DNA, 440 bp, Homo sapiens
cagaattctgcttgtgctgatgagaatgtgtattctgcagctattagaaaaaatgttctataaatgtctgctagttccattaggtctagagtgtagtttactgtttctttttgtcctaatgacatgtacattgctgaaaatgggacactgcagtcgccttttattatactgcagtctacctctccctttaaaccaattaatatatgttttatatgtttaattactccaataatggttgcatatatatttacagttgctaattcctcttggtaaattggccactttatccttacattgatgttgtctctaatttttagtttttgacttgaagcctaatttatctaagcatagtagctacttctgagatttttgatttcctattgcatgaaatatcttttttcaaccattcactttcagtctatgtgtgtccttatagatgg

SEQ ID NO: 191590 - DNA, 223 bp, Homo sapiens
catgtattaaatattagatctacatgtaaatctaaaactacagaaattccagaaaaaaacatacaagaaaatctttgtgaactcgggttaggcaaagattccttagacacaacaaaagctataaaagctaaaaagagctctccctctccctctcactctcaccacggcccacggtctccctcttcctctctttccacggtctccctctatggtagaaccgact

SEQ ID NO: 191591 - DNA, 495 bp, Homo sapiens
gagaatcgcttgaacctggaaggcagaggttgcagccagccgagatcgcgccattgcactccaccctgggcaacagagcaatactccatctcaaaaataaataaataaataaagaagccaggagagtggttacctctggaaggagacacatggaggcttctggggttgaggaaacgttctgtctcttgatctgggaatggacttcgtgaaaaggcatcagacctacactgggtacatttctaggcagatgttctaatccaataaaatgtacatagaagtagccccagccgggcgcagtggctcatgcctgtaatcccagcactttgggaggccgaggcgggtggatcacaaggtcaggagatcgagaccatcctggctaacatggtgaaactccgtctctactaaaaatacacacacatacacactcacaaaaattagccgggcatggtggcgcgcctgtagtcccagctactcgggaggctgaggcaggagaat

SEQ ID NO: 191592 - DNA, 341 bp, Homo sapiens
tcagccttccaaatagctgggaccactggtctgcgctaccacgcccggcaaatttttaaattttttactagagatgaggtttccctatgttgcccaggctggtcttgaacttctgggcccaagtgatccttgaactttggtctcccaaaatgctgggattatagatgtgagccacctcgcctggcctctggttctgttattatcccaatttcacagactggggatactgaaactgtgcagcagaaagattattaacttgggaggcagataggcttagactcaaaccctaatcttccatttacttaccaactgtgctatcaattcctttatgaactgaagat

SEQ ID NO: 191593 - DNA, 358 bp, Homo sapiens
cccactcttctgaggcttgctgtctttgcgcagcacgaagcatgtggctctcttccacgctgatgcctgtggtgccagttcatctcctctgggtgaacacggcgcaactctgccagtgtgcactgggtgcaccgaggtgccggtggttagggatattcagtcctctcctgccatgcacgtgcacattagacagagtgcatacctaggagtgcaggagctgagtcacagagcagcgtctcttcaaactggacttgaatgtgctgtactgttttccaaagtggctgcacatggccaggcgtggtggctcatgcctgtaatcccaacactttgagaggctgaggtgggtggatcacttgag

SEQ ID NO: 191594 - DNA, 337 bp, Homo sapiens
catcacccaacacataaggcacagaacaatgtgtactttttaattatcatatacataaatgcatactgttttcatgcagtatacataatgtttatgtatatagtgtatacatgaatgtattcaggtattttgagtgtctgtatgtggcatgcaccgttctaggtgctgaatattccataggtaaaaagggttatttagcccacatttttttcgttgtatgaagagaaatggaaaaaaccaaacttacatagttcggtttgagcaagttaaatgcatggatgatgtaatgtgggagcactttccacttttcgttgatgtttgtgttgggcgataaata

SEQ ID NO: 191595 - DNA, 659 bp, Homo sapiens
gataatctccaggcattatctgcattaactatactagagattatcctaccaagtgtcaacactgaaagaaaacattggttagaagcaggatcactacaggaaataaaaggagagataaagcagaaagcaagttaaactgattcacattacgcatacaccatgaaacaaaagtattttgagtacattacagatccacttgcagaatcagaacagatgaggtccagtcagagtgaaaactcttggtgagatatcagcagttgtttacatgacaaaaaggaatgagtatgacaatttgaggttaaaaaggaattccaaatacattaacttcatatctgttttgttttttcgtttttgttttttgcttttgagacagagtcccaggctgaagtgcagtggcgcaatctcggctcactgcgacctccacctcctgggttcaagtaattctcttgcctcagcctcctgagcagctgggattacaggtgcatgtcactgcacccgactgatttttgaattttagtagaaacaaggtttcgccatgttggccaggctggtctcgaactcttgacctcaagtgatctgcccacctcagccttccaaagtgctgggattacaggcgtaagtcactgcactcagttaacttcatatctcagataaacaca

SEQ ID NO: 191596 - DNA, 309 bp, Homo sapiens
gcacaacaccacccatggagagagagggcagggccggacggtgcagctaagagctgtaatccttacagagaaggcggctgccgttagtaagctcattaaccatggagtcacatatttgagccttatgtccccctaatcagatttaaattccacatgaacactctggatgtgattcaaagaggtgactatgatggaaacttaacttaggatgtccaagcttctggtcctttccagactgagtttatgaaaacaggttgagcataactagaaggcaaatcatttaaaatgagggaacaacgttgacctagt

SEQ ID NO: 191597 - DNA, 557 bp, Homo sapiens
aactcttcagccaagccatatctaacagaactatcttcaacttttcagagtcctcctttgtcacccagcctgaagtgcagtggtgcaatctcggctcactgcaacccctgcctcctaggttcaagcaatcctcctgcctcagcctcctgagcagttgggactacaggagcatgccaccatgctgagctaattttttgtagaagcagggcttcaccatgttgcccagagtggcctcaagctttccttctgcctcagcctcccaaagtgctaggattacagacagggcctcactctgttgcccaggctggagtgcagtgatagaattatggctcactggagcctcaatctcctgggcacaaacaatcctcccacctgagcctgtcaagcagttgggagtacaggtgttggtgaggatgcagagaaaagggaaactcatacactgctgatgggaatgcaaaccagtacaacttctatggaaaacgatatggagactctcaaagaactaaaagcagaaccatcattccgtccagcaatcccaccactggtcatctacccaa

SEQ ID NO: 191598 - DNA, 537 bp, Homo sapiens
aactcttcagccaagccatatctaacagaactatcttcaacttttcagagtcctcctttgtcacccagcctgaagtgcagtggtgcaatctcggctcactgcaacccctgcctcctaggttcaagcaatcctcctgcctcagcctcctgagcagttgggactacaggagcatgccaccatgctgagctaattttttgtagaagcagggcttcaccatgttgcccagagtggcctcaagctttccttctgcctcagcctcccaaagtgctaggattacaggtgtgagccactgcgcccttttaaatgtaaatggttatttcttgacgttccctctgacccctgctttttgctgtatcccattggttctggtatgttgttttcatttttatttatatctaagtattctctaacttcccttgtgatatctcctttgatctattcattgtttaagagtgtttttaaatttcccatattggtgaattttcacaaatttgttatttgtgaataaaaatagttttccttttgttattgattttt

SEQ ID NO: 191599 - DNA, 254 bp, Homo sapiens
ctgttcttgagtatcccggtcattgctacacctgtgtgtatgtatatattattatgtgtgcatatatatgcatgtgtatgtgcgtatatttgtattaactgtagaagataaagctagacactagtaaaagtggtaaagcagattttaataatatactattgtaatagggaagaaggtacctcgtgaacggaactgaactttgtgcagaagtgactaggtgtttaagagggaggaggagggaatgtgaaggggat

SEQ ID NO: 191600 - DNA, 668 bp, Homo sapiens
  misc_feature (627)..(627): n is a, c, g, or t
ggcaaaacattcctgttcttggaaagtgaagtacacatctttgttaatccgtatgcttcttctcccgataatacttaaagccatcatgcagggtaggccaaaataaagaaagcacacaacgctgcttatgcctctttttttgagcaaaaatttgttgttactgggcctcagttatatcaaagcaggagctaatgtgcaccaatgtcttacacccaatggtctgaacacgtgtaatagtctcacctgacaatcatcggacaatcaaaacctacttccccagcatcatgcttccccagacggcaattttcctccataaaggaggtgagaaaagaaagaaaagttggaacagtaaaggaaacagaaaaaatgggataaaatgatgatcagctgaggattctctccttgaatccatcctgaggaagcaaaggcctctggactgcgttcctttgaaaggtgatcccgcgaccagctatcagccccagcagtttcaggatgaagactcagggaacagagcccacacaccgcccaatacaagatgtcaacttcaagccaggctgagggcaccgcaagtgcccatccctgtcaagctagacacagcagctagagtatggtactgggtctatcacncctgagtgaggtccccctgagtgagggctggggatcctcta

SEQ ID NO: 191601 - DNA, 174 bp, Homo sapiens
ggaaaaaactctgtgtacctttgtcataaatagaaggaaactgtaaaaacaaacacataaaaaaaacaaaacaacttgattcagttccagctggatataacttcctgtggaagctctgagctggaggcttattctctttttgttaaaaaaggagatagatgagtataaaggagg

SEQ ID NO: 191602 - DNA, 520 bp, Homo sapiens
tcacttcatacacatgcattatgtaataagtgcacttatgttggttcctcatttgtgcatactagagtgggtgttactgggattgtaaacaaaaaagtaaattcagatgcagaaattttattgtttttctctgtcatctagatgattgagaatatgcttgtgttggtttttttaaataggttattataagaattaaaatgcaaaacttaaaattcctagagggaactcagactcctttccctaccactgtgatagtggacagcaacttgagaaatgctcttagggtaagcagccaattgagtcatttaaaaaccatatagaatgtcctccaaagagaagaccattttgcccttggagggcaggtaaacaggagtctggaaacaggaaccactttacctttgttgctgtcttctgttagtcctatctcctgaagctgtggacatgtgaaccctggtttcctgtgctgcagtgttgtgcagctatatccccaagattgggacctggtgttctaaaaaaaaaa

SEQ ID NO: 191603 - DNA, 177 bp, Homo sapiens
ttcttttgttttttccctgcaaaattgtaagatttaacaaggcccaaggtgtaagttaacaagggagcagatatatattaagagccttaactaattggacaataaatgtgctaagttttatgagatgacattaaatgtcatcttatttattcttaatcctcaagttaatacatgaaa

SEQ ID NO: 191604 - DNA, 280 bp, Homo sapiens
tgactagaggatccccctcccaacggatgagcattgatacacaacatcctggtagaatacccctcctctaccctccccaccacacaatccacaacatcctggtagaatacccctcctctaccctccccaccacacaattcctcatccttgttgaataaatgccttggaccacaggtgccaggaattctcccacgcatctctccggcctcccatctcagagacctaccatcaccagtgtggggcccctctctgccagttcctgctggtggccctatgtgtt

SEQ ID NO: 191605 - DNA, 452 bp, Homo sapiens
tgcttcttggtttctacatccagagaaataatacttctctaaaaatcaattgtccccagcaacccacctacacagttcttggaaaatatgggttaaacattctgccttacaaagaaaacaaggaacaaagagggtgaaggaaattcatcaccatggtcctgcacttcacattattcacaccaaccatttttccagtcaccgagttcaaatgaccctgtcccttggggctgcaaaactatttgtaccaacacttgccattaaggaagcttcacatgctttaataaacgggattactcagtaccaagagatgctaaatggcttcaagagactggaggttaggggaactgaaaatggcatggaaggaagatgccagaataatcaatttctgacacaggagaaggaatggctggatgccagtctgctgcccagaacaccgtcggagggactgtgat

SEQ ID NO: 191606 - DNA, 220 bp, Homo sapiens
aaattaaaaacccagggataagaagaaggggagagaattggaaagcccctggttagctttaagggcctctcagtgcagcagaacccatgctggctctattcataactttgctctctggatcaatattctgaaagttggtacattcttttcatttgtgtctttcacagagggcagtaaaatttagctctaattatatttagggcatctggattctagtcag

SEQ ID NO: 191607 - DNA, 444 bp, Homo sapiens
atgcattggtggaaaactaatcatcttttcttcactaagtagacagattaatgaagttaagaatacaaattttatatgaaaatttcaagaagatttcaggtattacctcttcacttactaattttttgagcttggacaagttttgtttttttaacctttttaagcctaaattttccagtctttaaaactttattactaataatatccgatatacaaggtttggaggattgcataggtaatgaagataaagcagtaagtgcagtacttactcaataaatgtcagctgttaacattattagtattatctaatacaaattatttgaaatgtcatgacatgaataggaggaggagatgacaacatagaaaagtacacttcaaataatgtgaagttgagaaaaaggcagaatgtaagtctgtgtattattatgtttgtttgcaactaca

SEQ ID NO: 191608 - DNA, 522 bp, Homo sapiens
  misc_feature (5)..(5): n is a, c, g, or t
acgcnttaggatccccttcgacgggtctggaacggaaagcatttttgttttcccttgagatgctattctttctaacatcaaatgcaaactgccattatatactatacatcttctaaaaattgaaaatcataatatccatacttaaattttcaactttccagttttccaattacaagcaaagtaccaaattcatacctgctcagtgttgcaaaatgattttaaaatgtaatgatgtttttgtttgattttgtttcatagtattttcctctaccaatgtacaaaacactcccttgtaacaaataaactaagagaatcgcattcccagggccttgggaaataactttaagggtgtctctgttcacttacatcatgaacccagctcttatgctcctaaagttacaaatggccactcttcgttttaatagcagatttaaagaaacctaatgttagttcaacacgggtaaacagtctctcacacagtataaataaagaattctttgagttgtaaatagtagttgctca

SEQ ID NO: 191609 - DNA, 600 bp, Homo sapiens
atggtcgatctctgaggatccccccaggtagacctaacccaggtagaagaaaagtagctagtagtgagtttatcctaagaagaaaaaggaatgtttaacattttctggaacggaaagcatttttgttttcccttgagatgctattctttctaacatcaaatgcaaactgccattatatactatacatcttctaaaaattgaaaatcataatatccatacttaaattttcaactttccagttttccaattacaagcaaagtaccaaattcatacctgctcagtgttgcaaaatgattttaaaatgtaatgatgtttttgtttgattttgtttcatagtattttcctctaccaatgtacaaaacactcccttgtaacaaataaactaagagaatcgcattcccagggccttgggaaataactttaagggtgtctctgttcacttacatcatgaacccagctcttatgctcctaaagttacaaatggccactcttcgttttaatagcagatttaaagaaacctaatgttagttcaacacgggtaaacagtctctcacacagtataaataaagaattctttgagttgtaaatagtagttgctca

SEQ ID NO: 191610 - DNA, 215 bp, Homo sapiens
ggagttgctgaccaaagctttcccactagaggaaaaccatatcaagtgtaatagtccagactttaatagcctcactatgctgagcctgtggctggaagcagtgttggggtgtcatgacctcagcatgaaagtggagcagctggaggctgtttgccaactatgcttctcacagtggattcccttaaagaggattcgagcaccatcccttcatagct

SEQ ID NO: 191611 - DNA, 203 bp, Homo sapiens
tcttccatggttcgctactattgcctacttagtgcagaagagaaagtcctgttcaaagaatttgctaaacctatcagacaagactttttacatctctaatttacccgagatagcatcaactctcactattcataaacaaatcagactcctagccttttatgaaaaaaacattttttaacatttttatttcaaaatactgccca

SEQ ID NO: 191612 - DNA, 659 bp, Homo sapiens
aaaatgtcccaataaactatttttaaacctaaaaaaaggagttcccttaatttgcttatagttgatgttatgccctggctggttccagtctgcatacccctcctcactccatagttacggcctcttgaaaagtcttgcggtctcagtcttatcaacttttcttgaacagatattgccctttcttagcaggtttgatggagctgcaatccactaccctttagctcattggtgggttgtgcctgctgcaagtttgggttttattttatgacttcaaataactagacttctcttttatattaaaagctcttggccccacattctgaaaagtagatctttctactctatctcagctgttgctttaggatcctacatgaaatgtaggatgagactttatctgacttaaagtttctctcccaaggattgaaattcagcctctgaaattcagtctgcttcccgggactttgattgatgctcctgggcttttctgtgacatgagtcttcctcctcatgcttcaacaaccctctcttgtctgcttttggacttctgtctctatttctagaaggttgtcctttatttgttaccatacttgcaagcagtgtgttttctgactgggctccctgtcttgtcgcctttctgacctcgagggctggtctagttc

SEQ ID NO: 191613 - DNA, 637 bp, Homo sapiens
acctgaagggcgtgtctccagggtcaccagctggaggggagaggcatactatttcaaacctggccatgcaaaatgtagatttgctttatggaatggagacttttgaaaaactgaacctcttgtccaatttcccaacggaaatggcaaccaaatgccctccattcctttatgctctcacttcaagaaggaatctgaaggttttccattagccttagtggctgcaaactgaacagcatgctctatcagctcacctagcattggcgttttctataagctgtgcaaaattgctctccacagttactttgttaaacagttacattgttaaacaattaaacagttacatacatactttgttgaattgttactgctactgtaacaatgcaaaagaagtgatggttatactgctctgctccctcctgcctcactgcagagaggaatattggaatgattaaatgttggggtgaaaacaacattggcttttcagaagcctcaaaaaagtcttggaggccagacacagttgctcatgcctgtaatcccaacttctggaaagccaagatgggaagattgcttgaggccagagtttgagacaacatagtgagacctcatctctagggcgaaaaaagtgaccggacatggt

SEQ ID NO: 191614 - DNA, 367 bp, Homo sapiens
ggacttttttcataagggaattaataccattgatgaaggttttgtcctcatgacctaattacctcccaaaggcctcactcctaacaccatcaacttgggtgttaggatttccacatgtgagtttcagggggacacagacattcagaccatagcaagatgtgtgttttaatatgaaactcaccctgtgctggccttgaaattttgcagtgtgggtgttgggagggtagactgagtttttgggttgataaagctttgggggtttgtttagttcagctattagggtagactccccttgcttgatgccttttaaaattcttgctcagaatattgcaaaacagctggctcaactcattccacctgactttct

SEQ ID NO: 191615 - DNA, 699 bp, Homo sapiens
tacaatggggaaaggacagcctcttcagtaaatggtgtagggaaagtgtatatccacatagtagaagaatcaaatcagaccttgtctcataccatatacagaaaagaactcaaaatgaattaaagacattagaccagaaactgtaaaactactagaataaaacatagggaaaatgctccacaacattggtctgtgcaaagatttcataaatatgacctccaaaagcacagacaactaaaacaaaaattttaatttaaaatgggattgcatcaaactaaaaagttaactacacagcaaaggaaacaattgagtaaagcaacaacccacaaactgggataaaatatttgcaaatcacatatgaaataatgagctaatattcaaaatatatggaactccaacaattcaatagcaagaaaaccaagaacccaatttaaaaatgggcaagggacctaaacatacatttctcaaaagaaaacatacaaatggtcaatggacatatgaaaaactgttcattatcacttgcaaattaaaaccacaatgaagtatcacctcatacctgttagcatggctattaccaaaaacaaaaaagatgttaagtgttggtgaggttgtgtacaaaagggaatccttgtgcagttggtgaagaatgtcattaatatagccattatggaaaacagtacaggttcctcaaaaaactaa

SEQ ID NO: 191616 - DNA, 761 bp, Homo sapiens
tccgccttggacttgcaagtgctgggattacaggcgtgagccactgtgcctggcgtggatatgtggtgttattgtgattataaattgtagatggagttccttagtttgttaaagtcttggtcagcgttgtaaaaacatcaggccagttgtggtggctcaggcctgtcagcccagcactttgggaggccgaggctggtgaatgctcgaactcctgaccgcaagagatctgcccacctcggcctcccacggcctcgctgggattacaggcatgagccactgtgcctggcctaaattttaaatataagtaatgtactccccagtcttacagaaattggacgactatagaaaacaaacatcaaaaaaagtgtagaatgtgagtatttttagtttaataagtgtattttataaactatttatttgtattgacttctcggataacaacctgttataaaatctttatccccataaacataattttcctaaaatagctataatattgtgattaatgtttatgctaaagtgactattatggaattaacagacttcagttgcagtttctaaatcttgctttggttgtgatgattatataccactgaagaacattcaggattattttggcttgtttttacccttatcactcaagggctaagctgtttaaaatgcaacataaacatttgacccagttgaatgctgggatacttggaaaaataaacctgttactgtttctgtactaaaggcttatcttttaaagatatgtggtg

SEQ ID NO: 191617 - DNA, 589 bp, Homo sapiens
ggaacaatatttacttagcatgatttttaaagatctaccccaaaacagtaatggaacattagatttattcttatcatatctaatatttacctgtttctagattggagtagaaattgggagggaatttgtaggcataaaaggaaatgaaaaaatatctaaggtaaaaataaatgcagttgagtgcataaatcaaatgaatgcataaattttcatggcagaacactgaaaacaaaaataaaaagccctcacaaacttgaaaaaaatctaaatgtctataaatagagatataataaattatcccattttataatattctccagactgcaaaatattttaagataatttttgatgtttataatagttggaggaagacatatctgcatgtaaaatccaaattgtatgtgcgttattttaagtgtgtctgtgtgtaggaaaaatatataaacaaaatgacgcataaaatgttaccacaattatctcttggtcatgggaatgcaaattgtatgtgtgtgatttttaagtgtgtctgtgtgtaggacaaatatataaacaaactaacgtatgttactatgattatctcttggttttt

SEQ ID NO: 191618 - DNA, 120 bp, Homo sapiens
gtgttttaagacagaaagtagaacagatagatttaaaaagggaattcagtaatggctcaaatctaccaagggaataatctcaattatgctgccctcaggtagaggaaaaggtggtagatg

SEQ ID NO: 191619 - DNA, 348 bp, Homo sapiens
agctaatgaaaaagaaaacaggacaactgggtccccttagtagaggtccatatcagataggccaggaagtaaaaatgtaaaccatagttcaccattttaatgtaggggacaacaacatggaaagtgaaatttagaactgattttaaaactataggctgtatcttgaaagtgatcaaatttaactggaaaattatttggatattccctagtggttaggaataaataaataaatacataatttggtcatggtgctttcctctggaagaagttaagtaaaacttccatttatttaatagttaaaggttttctcttttttttttttttttttggagacagagtctcattctg

SEQ ID NO: 191620 - DNA, 198 bp, Homo sapiens
ggtacagtaaaaatacagtatgatcttaggggaccgttgtacttcggtgaccaaaacgttgtcatgtgacatacgcagtggtgacaccctttacgagcaccgtctctagaggtttaattgctttgtcctttctaaatgaaacataaatggatgtttggaaatcctaaaggcggtgtctacatcatcctatccagcatc

SEQ ID NO: 191621 - DNA, 320 bp, Homo sapiens
cccaaaaggttatcactcccatcaccaatacacagaaaatggaggaaaggctgtttccagttcttggcctttaaacaactctaaatgtcagtactcatagtggcatattacaaagtaataaacagtgcacacttgggggcaaactacatattgagctaatgaagagctcactgtgattaagattagatcaaacaacagcagaacataggcaaattttgtctgaattctgtagtgaatgtacatgctgcaataacattaaaaaagcatggcagcctattccaaaccaaagagaacagttttgggcaaagagtgggtctttg

SEQ ID NO: 191622 - DNA, 368 bp, Homo sapiens
cgtaggagtagaagggccctttccttcacaaccactgctttcagccagtgctggtcaacagaagtagggtacagagaagtgaatggctgcttgaatatcactgtggtctgggtggtccaattataaccagacacacagtgagcccagacatggattaatctggtttggggtagatcccagatatataaggtactgtaggtcagcggtggtgatgtatggaaaggtcactccctgggtaacgggtagggatggaaggaaatctggttcattctctgttctctagactgattactggatcaagtcagcctagaaccatatcctaaccccagcatggaacagggtaggcatgggagagcctagtgtgccca

SEQ ID NO: 191623 - DNA, 564 bp, Homo sapiens
gtcagtaaatgtcactgggtgaatcagcacagtgggtggtaggaacgttcctgaaagtcctatataccatgggacagacagcaatcacttaactacacatagaaatgatcacaaaactcattaatggtgtcctgcaaaacctctaactcgaggtgttccaattcaactgccagattccaaaaacatctagtgcaactctggctaccttatgtgagaacaaaggagaacctgtggtgaaaagagacagcaatttcaaccagtcgctgttgaaataccttattaatgcaaacattttaaaaaatcaccatgaaggtacagcattaggaccctgcctagggctttcaaaggggcttgtgtgccctcagaaagggtcctgaagcttaagctcctgaagctttatggcaaacccatctttgtacactccttttaggagatgtgccagcagcccatgtgataccctgtggactgctttgtatgctgcttgacaatttgagacaagtagctttaaaaataatatatattttgttttgttttaaattttaggtaatccatgctatagtaaaa

SEQ ID NO: 191624 - DNA, 359 bp, Homo sapiens
cccaaccctaccttcctcactcaaaccctgaatctctagcaacagcagcagggagcagggacagagataaagggaacagccttttcaatgtgattttggtggcaaaatgaaaactggtcaatgaaaactagttccagtatacacatcacctctgtgaactggatttctgcaagttggccaagtgcttccatctccctttcggctctgccgcagcttgaaaacgaccacgaccaccatttccaccctagtgtattcctgttctttctagaacacagatctgatcctgtctacctcctgctcagggatttggtgctccctgtaacccggggccagagctgcaggagtggcctagtgggata

SEQ ID NO: 191625 - DNA, 324 bp, Homo sapiens
ttcttgctttattagataaaatttgattttccctgtaaatgattatttatgagataaaacataaactaaaaatgattcatttccatcaagtgcaaagttagctgcaaaacataacattcttcctttatgtcacacagggaaattaatggcctggaaatgtacagctgctcaaccagtttacgagccattagtacctagtgtactggcagtgagccccagttagccatggaaaccagcttgcagctttcttaactctgtataggagaaataattgatgattcagtaacattaatgatcatatttacagcttgatgtttaattagg

SEQ ID NO: 191626 - DNA, 1073 bp, Homo sapiens
ctgtttatctttcattctcattccctcaactccattcataactgtcttgcaccaaacacttgatctccaccatttcttctccagtctctcccatctcagggatactaccaccacccaacccacagaggctcagtgctgaagctgggagccatccctccttcctcctcagtcaggaagcacctctccaacgcaccactcctctacctgcattcgacattgccacccacagatctgttcatgagcccttctctgaggaagaggaggcccttgccctctgcctgccatcctgcttctctagctttcactgctcagcttctaaaaggatttttaaatattcagggccttcatctcctcactgcgctttctaaatcacctgcgctttcacttccactgtcactccccactctactgcagctctctgatgggccaggagcttctctggtgctatcaattctgattctttggcctttgcagcagcaaacaccgacggctgtcccctaatgaatcccctcctccctcctggatggtcattcttggggtcctcaaccctaggcctcttcttttgtccttcaacattcccccataagggatgtgaccctttgtggtgctgatcctcaccagcagatgggagattcctatttctacagttccatgtctgactcttctgctgagttccatttaattcatcttctcttacccagtcactgcatcagaggttctgattctgtcaacagcactatcattctccatctctcggttggaagtcagccctgaccttgccagacctagctataacccactgacaccacgctgtgtgaatcactgtcagctcctccttggaccaaaaatctccttgctggtctccacacttgtagccactccccttcaattattatatgttgtcaccagactgattttcctaaaccagcttatccaagactttgcttcccagcatcaccaggataaatgtttaactctgcaggctgatagtcaaactttcacaatttgggccttgtcaatctttcattctcattccctcaactccattcataactgtcttgcaccaaacactt

SEQ ID NO: 191627 - DNA, 465 bp, Homo sapiens
ctgtttatctttcattctcattccctcaactccattcataactgtcttgcaccaaacacttgatctccaccatttcttctccagtctctcccatctcagggatactaccaccacccaacccacagaggctcagtgctgaagctgggagccatccctccttcctcctcagtcaggaagcacctctccaacgcaccactcctctacctgcattcgacattgccacccacagatctgttcatgagcccttctctgaggaagaggaggcccttgccctctgcctgccatcctgcttctctagctttcactgctcagcttctaaaaggatttttaaatattcagggccttcatctcctcactgcgctttctaaatcacctgcgctttcacttccactgtcactccccactctactgcagctctctgatgggccaggaggaggaggagtcctcctcctctcctcactctgg

SEQ ID NO: 191628 - DNA, 481 bp, Homo sapiens
caggagaccaggaggagctagaatctccagaccaactccttcagcgcatgggttaggcctggtctccatttccttcatgtaactgctttatgggggaacaaaggcaagcacagggggagggggggcaactggggactccagattcttcaaccaaaagtcagagctgtgtagtgtcaaagtggcaggttgggctagggctgggcttgggccaaagatgccggggctgagggcaagtggatcgcttcatcacagcagcagctgctaaagcccgcggagccggcagcttctcaaagtcacagctttatccccaagttagtccctggcacacagaagacacctgggaaatactgacaaaccaaaaaaaaaaaaaaaaaaaacaagctaagccgtgttcctctctttgttcaggagactcccgagcctctgagctctgtgcccatcattcctcatggctctccccgtcttggcccctccccatgga

SEQ ID NO: 191629 - DNA, 688 bp, Homo sapiens
agtaaatgagagcatgaacgtagattgcagcacagcgcccatcatgcgggatgctttcaataactgatgtaaaagagctaatgacacctgttgtaatgagctctctgcaggagtgtcctatgaatctgacggatgtgaattctgggggtaactatggagttctagtgactacacagagacaaagcacttcttgctgccaccatgtgaagaaggatgtgtttgcttcctcttttgccacaattgtaagtttcctgaggacttcccagccatgctgaactcagaagaggaagttggaggcatgtgaggtgcaggaaggattctaagcagtggtgctggctttgaagatggaaggcattgtacctcaatgaatgtgactggtttctagaagctgagagtagccagcccccagctgacagccaacaaggaaacagggaccttggttctccaaccacagaaaatagattctaccaacaagaatgagcttgaaagcagattcttccctcgcacttaaagtctcctgcaactatggtgatacaccttgatccggcatcttccattcacctctccagattcattctccatgcctcagtactctgtgctatttcccagaaggctgatccttaaggactacacctgtgggatcccttgtcactggcaatgggacaatgggaggtgccagcagaaaatc

SEQ ID NO: 191630 - DNA, 329 bp, Homo sapiens
acacatagaaatcattcacaaattatattattaataactcatgggctcaaacaagtcattttaacttcctttggtttaggtctttgatctgtaaaatgaggttagactagttaagttacaagttcactctaaattcctaataattaatttttagtctcctgcaactatggtgatacaccttgatccggcatcttccattcacctctccagattcattctccatgcctcagtactctgtgctatttcccagaaggctgatccttaaggactacacctgtgggatcccttgtcactggcaatgggacaatgggaggtgccagcagaaaatc

SEQ ID NO: 191631 - DNA, 426 bp, Homo sapiens
aaggagtcgggtttcagagcctgatccgcagcgtggctcctcacagcactgcgagccagagcttggcgcgcgcggttccgtgggaaatctgaacactggcggctcagcagcccggtaatcttatcagggccgcaagagaaagcattttggttccagagaaatctgaaggcagctccgcttttctccagtaataatatttaagtctgtggagccagcctgaccaaccctattcaactcattagaatctaaaaatctcagagctctgggtgaaataaaacaatctttaactgccctctgccatatggtaaagggataaaccaactcaccaagaggtatcttgaggatttaggcactattggacttttggaaagccaacagcttgcaatttttctcttacctggggagtagttcaacccaagccttcag

SEQ ID NO: 191632 - DNA, 262 bp, Homo sapiens
gaaggtgaagggccaacacaggcctgaactgactgcattagactggaagctctggcaattgggatctgtcctgggtgactttgtagaccccacagttcctcccacagagtacctccagagaacaggtacatgtgtgactgagggaccaggcagcacagatctaaacaaccacgacacactgtgtattggattgcctggtccaaatcccagagattaaggtcatataaccaaataaaaagcccacaccaggtctcctagagct

SEQ ID NO: 191633 - DNA, 370 bp, Homo sapiens
ggctcccaaagttcttcctgcctgtaatctccccaattcatcccactcacagtcctttcctattagttcccaaaagtacagttcttatcattcaccatatgtatatcaattaccaggacatgaatccctggaggtgcttatgagaatgccagggaaggttttttttttttaaagagtcaagcttcttagcttggcgttaaagccccttcaagtccaggcctcattctccatttctggccatacctcccacttgtcctccttaaatactttgggttctagccaagttaaactactttctgggcctttaatttgttctgcaatttcctacccctatgtccttggttttcctatttaaaaagcatgttcccct

SEQ ID NO: 191634 - DNA, 294 bp, Homo sapiens
tgggcttaaaaaccaaattagaattggtttgggatgtgtccttttccctatctggattaacatagtctattccacttgaactgcaacaggttgtccgaattgtttgttgttctggcttttggtcacacagaacgctacagtacttgggagttttcatctttacacgttgttatgctattatttctaaattcactgtcttcagaattctactctgtaaacagaaaaaaaaacagcatggcagagcagaaagaacattggaagagagctcaggaggcgagattccactcctgcccc

SEQ ID NO: 191635 - DNA, 220 bp, Homo sapiens
aatttatctcaacaaatctatgaaaagagagagaaaaatatttatgacatattggaatgtatcacctttaaactgggagcagatcccaatcaagtgaaaactaagagagctattgtatcgtatgcaacacaatatgctttctaagaagtaaccctcaatcttgacaagtcaacccttctcctgcatcctaagcatccttgtaggtatgggtagtgtttta

SEQ ID NO: 191636 - DNA, 361 bp, Homo sapiens
ccctctctacccaacacacagaccttgtttatcacataccaacataaaaggcagttctggactgctcacccagaactatcttaaaatattctatatgtcatttttttataccattactccattcactccttaatacagtcagcattttgcctcaccaatgtagatactccacccagtggcaaaagatctgtttagataatgaggtttaaaattttttttaactattattgttccccttcaacattaccagctctgcaatggcctcagtgatttcctagtacagcacagtgtttaagaacagattcttgagtaaaaactttttccaaaccttgatccactacttccaaattatatacctggg

SEQ ID NO: 191637 - DNA, 371 bp, Homo sapiens
ttacagtcttccccggtacgggagtggttacctgaactttggaattttaaggttctcttctaaataggaagctgacgatacagaactgagatcaactccaagagcattcctgtctattggctcaaagacctacaaaaaacttagactgtgaagacttgcctgaagctgagacccaggacggcaatgggtggaacatggctagagtcagaagcctggccccagctgctgctgggagaccccagacagcaccccgtctcctttgcagcttccttgtctgcaaaataatggaaccataggcggctgattgacctcagtggttcatttacttacagaatcaccctttttcatattatccctttgttactttatag

SEQ ID NO: 191638 - DNA, 539 bp, Homo sapiens
tagataggtaggaaagtcatatgactaccttggtagatgcgtttgataaaattagtagttcatgataaaattctcagcaagttagaaataggtaggaatgcaaagcacagtggctaacagctgtgatcccaattctttgggaggccaaggtgggaggatcacttgaagccaggagttcaagaccagcataggccacaaagcaagactctatctctacaaaatataaaaataaaataaaaaattagctgggcatggtgacatctgtagtcctagctattcaggaagctgagttggggggtattacttgagcccaggagcttgaggctgccatgaactatgattgtgctactgcactccagcctggaaaacagagtaaaaccttcaaagaaagaaggggtgggggcgggggaagagagagagagagaaagaaaaagaaagaaagagacaagaaagaaagaaaggaaagaaagaaagaaagaaagaaagaaagaaagaaagaaagaaagaaaggaaagagaaagaagaaagaaaaagaaaga

SEQ ID NO: 191639 - DNA, 322 bp, Homo sapiens
ccatgctccatgtagtcctaaagcactaagaagttgaaccttcttggttggtttaggagggacccaaagcttggatcccattgttctagacaaaatgtcccacaaggggccctgaaagtcattcttctctctgtaacctacagctccaggtttcttcagctaacgtggaagcagcccacatctcacctccacagctccactctaggtaaatgcctactagttgattctctgaactctgaaagtatggatagatgactcaatctcaagagtcattcacaatctacatcttcctggggctcacaattcacatggcgtcatcaca

SEQ ID NO: 191640 - DNA, 376 bp, Homo sapiens
ctcactgcaacctccatctcccaggttcaagcaattctcttgcctcagcctcctcagtaactgggattataggtgctcacaaccacacttggctatttttttatatttttagtagagataaggtttcaccatgttggccaggctaatcttgaacctctgacctcaaatgatccatccaccttggcctctcaaagtgctgggattacaggtgtgagccatcctgcccaccctattttattatatttttgagacaggcttcctctgttgtccaggctgtagtgcagaggtacaatcttcactcactgatggggccatgttgctctaatattttgtattcattgtaatctttgattgagctttggacattaacaaaaag

SEQ ID NO: 191641 - DNA, 438 bp, Homo sapiens
gtgtctgtgcataaagtgttaggtattattgtagtcttcaccatctgggcttatttgtagttgtccttcttgaagaggcttttcagatatttgaaaggacttgggtgttgtgatgtaagccatgtctactttagggggcaccacaagacgagtaatgctgtggttcttgcagactcacagaagtgctgccttgatggtcttggacaggatttaggagaattatctggattacctgacagaaactcctgttcctccccttactttctccaaagcaaacagagtctctttctctctctgttctgagtcaccttagctgaaagtggagtgacacacacacccctgtgggccagcactacaatgactgcactggatcagatctgaaacagcacaatactgcatctcgcccatggcctgctgtaaccattccctggctacatg

SEQ ID NO: 191642 - DNA, 175 bp, Homo sapiens
cacgtacaggccctttgaatattcctgagagatgtcacagtagtgaactgcatgcatctcctcggaaaaatccggagggctttgcctcagcagagaaggcaaatccaacccaagatgcatgaacaataaataacaactgttctgagttagcttgaaagctcccagttgcactttg

SEQ ID NO: 191643 - DNA, 397 bp, Homo sapiens
cacttaaagctaaactagatgtttcagccagtttgtaaatttctccagaaaatattgagtatgcagagaacagaaatcggaagagaaaaataaagcatagtagatattgagatatactcagagttgaaaataaacaaaaacaaggttaatttaacagtgtgaacagaaatagactaaaaataattatccatattctacatggaatctctgtttatgttacagttggtataaatgcctatttacctagtactataataaatgtaaagacagatctctaattcacaggcactgagataaaggacaatgtggttaagcaataactgaagactcaatagcacttaaagggatagtttctaagtgctaattccaatgatggaatgaaaatagcagaaaggta

SEQ ID NO: 191644 - DNA, 108 bp, Homo sapiens
agcaaagggcagaaagctctgtactgtgtctcctaaaaggtttggggaaactaaatctagaaactttctctcttaactttcgtgaaactcctgaacaaagcttaggag

SEQ ID NO: 191645 - DNA, 294 bp, Homo sapiens
ggtaactgtttctatgactgctttaccaagacaaaaaatttcaactcccaactgacttttaacttaatccttaaaagctataatattttggagttctttccttgatcagtttttaaaggttcatagccatattcatgtagatgtttcacatatcatttggacattaaaactataccaaggtgctgggattacaggtgtgaaccactgcgcccagccttctttttcttgacattgactttttgaagagaggaggccaggctgttgtcctgtagcatcccatatatgttgacttac

SEQ ID NO: 191646 - DNA, 486 bp, Homo sapiens
tcacatttaaactgtcaaggcctgaccttttacttagatacttttataattcttactaaactagatgtcttagtccatttggattgctataacaaaaatatcttaaactgggtggcttataaacaacaaacatttacttctgacagttctggaggctgggaattcccagatcaaggtgccagcaggttctgtgtctagtgaaggttatttccttgcagatggtgccttctcactgtgcccttacatgcgggtaatatgctccctggagcctcttttataagggcattaatcccgttcatgaaggtggggcccttatgacctaatcatctcccaaaggccccacttcttaataccatcttattgggtgttaggtttcaacatataaattttggggggacatcaacattcagaccatagcactggatgcaatttttaaaattaactttcttgttcctccctggggtaaatagcaaaagcaattagaga

SEQ ID NO: 191647 - DNA, 683 bp, Homo sapiens
ggaacgttgacgctacctacctctggcctggcctctacccactgctgccctggccgctaccaacatgagcctcccggagagtcctcacagccccgctactctcgactatgctctggaagacccgcaccagggccagaggtcccgagaaaagagcaaggcgacagaggtaatggcagatatgtttgatggccgcttggagccaatcgtgttcccaccgccccggcttccagaggagggggtcgcgccccaggatcccgcagatggtggccatactttccacatcttggtcgatgcgggtcgcagtcatggagccatcaaagcggggcaggaagtgactccaccacccgcggagggcctagaagcggcctctgcctcgctgacaactgacggcagcctcaaaaatggctttccgggtgaagagacgcacggcctaggtggggagaaggctctagaaacctgtggggcagggaggtcggagtctgaagtgattgcagaggggaaggccgaggacgtgaagcctgaggagtgtgccatgttctcagccccagtggatgagaagccaggaggcgaagaaatggacgtggcggaagaaaacagagcaatagatgaggtaaacagggaggcagggcctgggccgggcccgggcccctgaacgtgggtctccacctgaaccccctggagtc

SEQ ID NO: 191648 - DNA, 511 bp, Homo sapiens
gcagcaatcaataagtctcactgtgggcagatctcagcctcaaaatccgattactctgaaaaactccaaaaatggggagggttaccagtatcccctcccttaaaagaggggagctcattcttgctagccctgtcttccgagattgaccaggttggtcccccaagctgagaagtccatgctggggagactagccctgggaagggactgaatttgggggggttgtgctgagcttctgtcttctccattgctcagaatccttggcctgcaattcccagggataaaggaaccaggcaaggaaaggagctgcctcttagatcttcccattctgctcaccagccctcagagaataacttctcacagccagggaagggttaagtgtccctgccacagttatggagaggaagctgatgaaatatgggcacttggaactccaggcccagctggctttcctgtttacacttctttatacttcctcccacccattggcctcagagaaacaaaacaaaacaaa

SEQ ID NO: 191649 - DNA, 271 bp, Homo sapiens
ccacctaattctagcaatacccatctactccaaatgattatatttccactcatatttttagaagaagtgactgacttctttaaccagaaattccaatgtacacactcactgaaaatactggcattctggctagagagggaataacgtcagccactgggtaatatgcgggtctgctccaaaggtggcctcatattagccaatacagattccaagaaactggattttttaaagcactcccaagcaacccaacaatgagttgggtagtcacaga

SEQ ID NO: 191650 - DNA, 339 bp, Homo sapiens
cagtactggcaggggggcccttggagtgggctccctctctgggctgggactgggtgatggcagtagcaatggggcacgaagtcttccctctcatttgttaggaagtgtggtctgtgctcctccccactgtctggctcttgggctgggagaagctgcaggctgagtcccacggggtgtgagtgtgtgtgagcaggagtgggtgctggaaggaggtaaagctggtgaccatcagctcctcattctcttgcaccttgcatgttttctctgacaccgcagacccaagttgtggcttgctggttaacttgtttacataaccttcttaagtaactctaaacttta

SEQ ID NO: 191651 - DNA, 406 bp, Homo sapiens
tagctgggattacaggcgcatgcccgccatgcccggctgttttttgtatttttagtagagacggggtttcgccatgttggccagactggtctcaaactcctgacctcagatggtccacccgcttcagcctcccaaagtgctaggattacaggcatgagccaccgtgcccagccactaccaattatttctcttaatggattttcattgaccctaaccctgtaaattccatcacttttatcaaggtgtatattataataagtctataatacccaatcatgtagttgtgtgattattttatttttttgagacagagtctcagtgttgcccaggctggagtacagtggcaccatctcagctcactgtaagctccgcctcctgggttcacaccattctcctgcctcagcct

SEQ ID NO: 191652 - DNA, 366 bp, Homo sapiens
gtggttggttgagaggtttcagtgagctggacgcatgagctaatatatgttcatagcacagtcgataatgcacagtatgagctccgtaaatgttcatttctttactttcccatctcctttccccaactacacataaaataagacctttcggctgctctcagccagaccatccatttcccctgctaataaatgagagttttattgttccttctcagatgttgaattatactgttggtatcactgctactgtatcttaatccttttgctaatgtaccattttaccttgaattgttacacagtgtcctgcccctcctactcctctcctgccttgctgcaaagtcatgagtcaattcttttcaaatatta

SEQ ID NO: 191653 - DNA, 146 bp, Homo sapiens
actttgctggttagtgaaggattttaagtcctctagtggaattaagtgattagatttttgccttacaaaggaaactctcctatggagaacaaactaccatatgaagctagcggcctaaaccaggagaatgtggggaaagaagagag

SEQ ID NO: 191654 - DNA, 375 bp, Homo sapiens
acttcattagtcttctaaatcatgattctaaatcataagtgttacaataataatgttggttaataactaagatgctcctgtgttttctgtctaaacaaccaggttttcagttaatatgtgccaggacattttacatgtactaactaatttagttttaaaaactctatgaggtaagcactaaaatcaacttgatgcagatgaagaaactgagacacaacataatgccccatttttacagatgtgccataatttattcatctgttacgggcaatttacatggtttctaaatatgagctaccatagtgatgaacaatcatatacacatcttttaactgtatatgcaacacctgaaagagttaaaaggaactctaagtt

SEQ ID NO: 191655 - DNA, 327 bp, Homo sapiens
agtgcatatcagttttgctatttttaaaagtgcttcctaatgaaaagttctgatatttcagaaaacatttacattcttacataagaagcagttaaatagtaaacttccattagtagttaattaagaagcattatatcactcttctatatttgttagtgtatgtaacatgaatcaaagccacctgaagtaattcatggggtcataacgtgcacttttagtgtatgatgcatgttatttaatttcaattaaaatgaagtttcagttgttcttcacacaggcctttttcccttaataatacagattcatttccataatactttaggtgat

SEQ ID NO: 191656 - DNA, 231 bp, Homo sapiens
caagacatacaaagaaacaggacactgtcacctacatacaggaaaaacgacaggcaacagcaactgcccttgagaagacccagctatcagacttagctgacctcaaagcagctattataaatatgttcgggccagacacggtggctcacgcctgtaatcccagtactttgggaggtcgaggcaggtgggtcacctgaggtcaggagttcaagatcaacctggtcaacatgg

SEQ ID NO: 191657 - DNA, 120 bp, Homo sapiens
gtgaagcccagagaagaggagaaagaattgtcatctgaaggccatcccagttgatgtctctgaggttgccatgaggacgaaatcaactggtgtatgatttgtctagtagctgccaagaaa

SEQ ID NO: 191658 - DNA, 329 bp, Homo sapiens
tttaaaggtatgggtaaatttcaggaaagcaggagctgcaggcaaaattgtgaatcaatacttggaggttacacattgatttaagcctaaaaggaagcgctgtcttgaagtggggtttatgggttgtaggtagatgcaaagattttctgatttgcagttggttaaggaagaaaagctttgtataaaaatttggggtcagtagcaaaatgataactagttagggggagtgactttctttaagcccttcaggaacaaaccttagaaccttagaaagttatgatggttaactttcagtgtttacttccttttttttttttttttttttgaga

SEQ ID NO: 191659 - DNA, 343 bp, Homo sapiens
gctctcagcggaaagggaggctggaaaggggatgggaaggtgatctttccctgaagctgggctgtctctggcaggcccctctccgaagccgcactgtctgaagatagccgaatttttcctatgctcagctgcttgtatccttgacactcagccgcttgtgttgctctgccagctgaagtctttttatgggcacaggataggggcggggcaggccaaaaaggcaacatttgggctgaaaaatagggtcagctgttttcacttaggacaaacttaagggtggggcttagccaggatcccagcctttctgtcagtttgaccttaaaacctgcagcacattatatag

SEQ ID NO: 191660 - DNA, 590 bp, Homo sapiens
ggggctagatgggagttttataaggctgtgctgctttaggctgaatgcttgcagacaggatgcttgggtccagggggtgctgtgagcagcgtgcatgtaacagggtgcttgggtgctagtgagccatttggggttgacctcatttctcataacatttgccctctacccctgtttctgttcctgctatctaagcccatttgtaattttttattaactccccaggggtccacacatttttaaaattttattttttatatttttgagacaggggtctcgctgtatcgccccaggctggagtgcagtggcacggtcttggctcactggaattctcacttggctcaagcaattctcgtgcctcagcctctgaagtagctgggactacaggtgcccgctaccgggcccggataattttagtaaagctgtggttccgccatgttggccaggctggtctcaagtcatctgcccacctcggcctcccaaaatgctgggattacaacaggcatgagctaccgtgcccgtctcacacatttattgttgttatttaacttgtctgtttggtttctgtatctgatctatcatcgtcatttaat

SEQ ID NO: 191661 - DNA, 279 bp, Homo sapiens
gtgggtagtgtcactgtacgtctcgaagtcagtagccttgcttacctccctttacatggatcttgggaagattggtaagccattttagaggaaaggtgctgttttcttataaatggtaataaattaatgagtgtgatttaaaaaatattagtggccaggtgcagtggctcacacctgtaattccagtactttggaaggccgaggtgggaggatttcttgagcccagcaggagtttgacaccagcttgggcagcatggtaagaccctgtctctacaaaaa

SEQ ID NO: 191662 - DNA, 839 bp, Homo sapiens
gaatctcacactgtcgcccaggctggagtgcaatggtgcaatctcggctcactgcaagctccacctcccgggttcatgccattctcctgcctcagcctcctgagtagctgggactacaggtgcctgccaccacacccggctaattttttctatttttagtagagacggggtttcaccttgttagccaggatggtctcgatctcctgacctcatgatccgcctacctcggcctcccaaagtgctgggattacaggtgtgagccaccgcgcccggccctcagttccttttttaaaaaatataatagtgatcgggtctcactatgttgcctagactggtctcaaactcctgggctcaagcgatcctcccacctcagcctcccaaagtgctgggattgcaggcatgagccaccctgcccgccctcagttactttatagcatgtccagccagaaaggtgtgagtgcccacccactgtatcctcccacagtgtgtacatctcacctgacccaccctctgcccttcctccaggttttcctaagctaacctcccttatcgtgacacttgttgaggtgtgagttccccctgaacctgctcagcctcttcctctctcactgggttcctccaggcctttccaccagccattgctgtacacacctcaacccacttggtccccttcctgttcactgctccctcatcaagccccgcccttgcaacatattcacctcgggtcaggcttggaagctcacactcataatcctagcacatttggaggctgaggcagaaggattgcttgagctcaggattctgagaccagcctggccaacatagcaagacttcatctc

SEQ ID NO: 191663 - DNA, 558 bp, Homo sapiens
acatttagaagttggctgtcctaaaattacagcagtagattctcaaactaacaaaactttgaaaatcccgccatattctacttatgttttgaaatctcaatttcatttaatctactattctcagcaattcagttgtcaaatgttcaagtaaatattaactgtaaagggttgtagccaataatctctttaaactgcaactaattaaatgctgtagatctgattacatgttaaatcgcatatacggagaaagtatgtatgacaaacatcatgcctaagagtaactatcaatacaaatttataaaaatcaataaaaggaaaacacaaaaagggaatttcagccgggggcagtggctcaaacctgtaatcctagcactttgggacgccaaggtgggtaggtcactttgaggtcaggagttcaaaatcagcctggccaacatgataaaccccgtctctactaaaaatacaaaaattagccaggcgtggtggtgcacacctgcagtcccagccattcggggttggggtgggggctaaggcaggaggaccgcttgagcccaggag

SEQ ID NO: 191664 - DNA, 350 bp, Homo sapiens
aaaatagcaagtcatttgtgatttgttataaaagcaaaaaagaggacaagcccaagggctcacgcctgtaattccaccaccttgtgaggctgaagcaggaggattgcttgagcccaggagttcaagaccagctttggcaacataacaaggacacatctctgcaaaaaaatgaaaatagccaggtatagtgttgtatgtctgcagtcctagctgtctgggggctgaagtgagggctgcttgagtctagaagtttaaggctgcagtgagctatgatggggccgagaacataccacagcactccagcctgggtgatggatagagactgtgtctcttaaattaaaaaaaaaaaa

SEQ ID NO: 191665 - DNA, 990 bp, Homo sapiens
tgtagaaagagtaacatcctgttttatgtttagtgttggcattagtcataaggatctggggaacaggaataaattcttaacaattaactatagaaatcccaaacaccttgctggtggagtcactcttctctacctggtaaactcctacagatcctacaagatccagctcatttgcccctctgtgaggccttcattaactccttcccattaactcaagaacattcaattcactccctcttctagttctctcattagttccacccataaacatttactaaaatctatgtgtcaagcacagtgtctacaactatgcagtacacagaggaatgatacgtgcttcatgcccaggaaggactcactagttagaagtggcaggcatgtatgcaaggttattgttacacagtggactagtgctctaatggagatatgctatgcagagaaatagtcatatcatccctcaagtaccccatgaggctgtgattcattcaatcttttccatctcctccagtatgctactgacctctgaagacaggaactgtgctctagttagctccagcttccactgcctagtgaatgcagaacacaccataaacatgcaatatatgtttgttaatgcattaaaaagacaaaaactactagtgctttataattgggtcttacagctccaaacaaaaggtatttgttaactgtataacccaataatttgctacaatgtgcctgtcaacactggaggacctctggagcagatgtacttttgaacattccccctggtggcaggatattccagcccaagtctctttgatgacttatcaaagagaaagatgttaacaggtgacctatgctgaaacttgggctccaacctaaggaaataaacagcaggacacagcccacagcggtgacttagaaggttccctggctgacgttcagcacagctcttccttgtaccccaagtacaactgctctgtctccaggagaatcattttagcccta

SEQ ID NO: 191666 - DNA, 679 bp, Homo sapiens
gcaggtatggtcatgcaccgtggtgcttcatgcccaggaaggactcactagttagaagtggcaggcatgtatgcaaggttattgttacacagtggactagtgctctaatggagatatgctatgcagagaaatagtcatatcatccctcaagtaccccatgaggctgtgattcattcaatcttttccatctcctccagtatgctactgacctctgaagacaggaactgtgctctagttagctccagcttccactgcctagtgaatgcagaacacaccataaacatgcaatatatgtttgttaatgcattaaaaagacaaaaactactagtgctttataattgggtcttacagctccaaacaaaaggtatttgttaactgtataacccaataatttgctacaatgtgcctgtcaacactggaggacctctggagcagatgtacttttgaacattccccctggtggcaggatattccagcccaagtctctttgatgacttatcaaagagaaagatgttaacaggtgacctatgctgaaacttgggctccaacctaaggaaataaacagcaggacacagcccacagcggtgacttagaaggttccctggctgacgttcagcacagctcttccttgtaccccaagtacaactgctctgtctccaggagaatcattttagcccta

SEQ ID NO: 191667 - DNA, 203 bp, Homo sapiens
tcaatgagcacgtcctggtggtaccgcaggtcggcgtaagctgccacgtggatcagggaatcccggggacctgcaagcctccgcagaccctcacttaggacaggccccacgcccacgaccaagacagagatgccattgttcctcagcttctgggcaggaacggctgcatcctctgcgcctctcccgcctgtgagcaccaccac

SEQ ID NO: 191668 - DNA, 532 bp, Homo sapiens
gacaactatctggtgatgattttttcaccacatttgaaaaataaattgaataattaattaacgccaatagaatatcattaactaacagagttactgtagtgttttcaagggtaatttgattataaataacatttgccttctgtaatgtttttagaaacactgatagtcttcctaaggtatacccccattgtacatgtacaactttattcccatacacacactgtatgagttacaaaattgttgcaaaggtgactctcaacaacatggaatccagaactaacacaggcaccttgttttccccccatttttagggtgccaaatgtacccaagtccaccggacagtcctgtctctttatttcctatttcttctttatttcccagatcagtaccttcccccggtacagtaaagtagaaaagactatatgtatagatgtgtttccagagacttatatcaaactctggttgttccagtgggcccaccttggaacaaatgagtgtactaagtttgaggataaacattttctgaaagcta

SEQ ID NO: 191669 - DNA, 554 bp, Homo sapiens
atacataatgctctcgcacacttatacggtatagtgtaaccataactgttatgtacactgggggaccaaaaaagtccacatgactcactttaacgtgatggactggaaccaaaccctcagcattgctgacgtatgcttttatgtcatctccttgtttaagaaacttcagagtctcctctattgccttctggaataatcatttgctacatgtcagcagggctatcccaggagaaggtctttgtgtatcagagttaggcaagcagacgctgaacggttcatggtagggaaactgtagaagaaattcatctgaatttgaggttgaagtacttttccaagctcagttctatttctgtgatgcctcagtgtggctacccatcatcaccttatctttaagttatgtatttgtctccaggcaaactgatgattctccaaatatgtcccatgctgtctcaccttttatttgtacctttggcttgctcttctgagaataacagagtgactccttccatctttcagaagcccatctcttcaggttcagctcaaataccatgtct

SEQ ID NO: 191670 - DNA, 188 bp, Homo sapiens
atcggccttgagttctcgccactccatcaacagactaccccgggggtccagcccttccctacagacatcccgggaaaaggtcgggatggcctccaggtgatcaaatatttgcaccatatcctccttgccatagctcatcagctcctcactgctcctgggccaggcagccaggtcaaacacctggcagg

SEQ ID NO: 191671 - DNA, 644 bp, Homo sapiens
  misc_feature (519)..(519): n is a, c, g, or t
  misc_feature (584)..(584): n is a, c, g, or t
caggtcttttcccctcaaaggaaaaaaaaagatcttagtttacaatatagttgtttccacaactgtgccaaaatcatttctccacatttgaattcaccagtaatattttttcaggtgacagcacaagcataaacaggccagaaatataaaatagctttaaaaatcacaataaaagagggatattttttatgaaatgacatatcaatctctacaagacttaactctcaaactatgctacagaatcagtttaccttcaaaagtctctaaactggacctttttctttcttttctagtaacacttctccctagtcacaaaagtattcatcttctttctactgtcttctcagtaaaaatttctacaatccacatttctgcctaagaaaatggtaaagggaacctgaataatacatacggaaaacaaactcagatgtcgttatcttagagttttgttttaacttaggtggccctcaggaaagttgcttttcactgtcactttcctgttagtaactctaatatggnctctattaaaattcgtgatacaatgtgaatgctgttgatactgctattgctgtgggataaatggntagtgttgatttcaagcagttagtgctgcttagttgtttgaaagaattaatgtgggacat

SEQ ID NO: 191672 - DNA, 418 bp, Homo sapiens
ttaaagacgtgcaatggagtcactaagatattagttgttatgggttgaactatgttcctagaaaagatatgtcaaagtcctaaccaccactcccacctgtgaatgtgatcttatttggaaatagggtctctgcagatgtagttcaaatgaagttttatgggattagggcggaccttagtccaatatcactggtgtctttataaaagagaagacaaacggaacacatagggagaatgccatgtgacagtccatgcggagattagagtgatgcatctctaagccaaagaatgccaagggtttccagcaaccaagaaagcaagaagggatcctcccctggagccttcagagagagagagcaaggccctgctggcaacttgatttcagacttctagaatcctaaactgtgggacgataaatt

SEQ ID NO: 191673 - DNA, 528 bp, Homo sapiens
tgctgtgttgcccaggccagtctcaaaactcctggcctcaagggatcctcccacctcaaagtgctgggattgcaggcgtgagccaccgcagccagtctggtgcctgtccatatgtgagccacctatagagagcggttcataggagaaacccacttcacacagtcctgcatggtaagtgtgtgaagtgaaggggttagaacatgtctgggcctactatgtgctacctggtagcattattattttatttttggagacagagtctcactctgtcgcccaggctggagtgcagtggcacaatctcagctcactgcaacctccgccttccgggctcaagagattctcctgcctcagcctcctgagtagctgggattacaggcacccgccaccatgcctggctgtcagtatttttaaagtggttgcaatgccatcccactgcctgccctgtactccttgcccgcttgaccctgcttggcggttggttggtattggggtaggctgattggtgcttttgctgtcatagttaccaaa

SEQ ID NO: 191674 - DNA, 525 bp, Homo sapiens
gtgttaaaaaagcattattcaaactgcagtatatatgaatcaaagtgcttctgtggccttttgccctatttaaacctataatttgtttaagaatgcaatcaaattgccatgtagtacccatcacttcatttgccacagagttagttttaggtcaacatatgtaataaaatgggatagaaacgaaagaagactatgactattagactataattaaagctgttagcatcttggaagacaactagtaaacaaaatacctgtgacaaaccagaaagatgatctatcaaaaagaaaatgaaattcgatcaaatgtgttttttttatttttttccctttgaggccgggtctcactgtcacccaggctggagtgcagtggagtgatcatagctcactgtaatcaaactcctgggctcaagagatcctcctgcctcagcataatttctaaaaagtttaacagattgttagcaggctaaacttcatcaaaaagaaaggataacctagaggacagaaacctgctacatgcatcat

SEQ ID NO: 191675 - DNA, 839 bp, Homo sapiens
tatttaccattttgtttgaaaggcgggacagaagaaaaatgtgtaaacctattcgagtcatgcagttggaatctggttactctgtttagatgttcatgtcacagaatcagctcaagaatttcttgagaaaaataaaatagggttcacttcaaacaacaccttccacctgccttctggagtgcactaggcttttcagaggtacactcagcctcacagaatcacgtatccatgatgggccaactacacagataaagttctccttcttggtaagctccagtcgccgttcaactttctaagacagaataaaataagtgagaacccattcgtgtaaagctgaaatttcaccaggtgtcttcagccaaaacctccgtagaatttaaaaatcagtgaagatgtgagagggaaatcattgcatctatgttagaaatctggacttgactcagaagaaattccgtgtaactccattgtattctagtcatccgatgaaggaaaattcaaaccagccaccgccttcaacatgttttttatttgtgtgtgatgtagcttcatctggtccagattaaggaccgccacatatatattgctgacttgagtttactgctgaacttggcctagcaggctggtcaccccaggtcttctctcgaaaaccaatgctatgccaaagacagcaccatgtataaaaccacctcctacgccccatcaatcaaccaaatgtgcattttcacatggaaggtgcctgcctgcaaggccagcaaatgacttaaaccttggcaggaaagcctctcctctctgtgattgtcattctcagacctccgaacttgtcaaggaggccaagcatg

SEQ ID NO: 191676 - DNA, 192 bp, Homo sapiens
ccaaggtatttttaaagcaaggaaggaaagaaaatggaagataaaaggaatgaacataaaagtctcaagttgatttttatgtcagacttctgaatgccccaaaacaaaacaattctgtaaggccgggagcctcaggactgtaatctcagcactttgggaggctgaggtgggcagatcacttgaggccaggag

SEQ ID NO: 191677 - DNA, 572 bp, Homo sapiens
ggggagctcaggttcatccactgcacgtccagtattgccaggctaaaaagttaaactaaaaagttaagagtccagaaatttggatttttatacaaaatctccccattttggcaatgaatttacattaaaacagaacaaaacaaaaaatagacagcagtatggtttagaccaaactcatctgcaggctaggtaaggctgggaagtggccagtgttcggtctgtgacccagatcagaggcagggcgcaccatcccactcagtgcgctcccagaacccgttatttctggcagagagagagaatgagagagaacacgccacctgagggcatccctgctgcccgtccttgaggactccatttgatctttcttccttcctctgttgggagaaaagggagaggggagagtccttgggctccccctagagtgagagagcaggatgtgggctcagcagcaattaagctgaatattaaactcatcccccttttggatattgagtggataaatggcaattaatcagcctcccccgaaagattagcattatcattattgtttccttcagacagaatcgccactg

SEQ ID NO: 191678 - DNA, 510 bp, Homo sapiens
agacttgtgggttggaaatgggggtagttgaggaggaacaaaggcagaatagggagattcaaatcatgtcatgaaggctctgaattctgtggtgaaggtttggcactttattggcagcgagggggccactgaagtcctgaagcagataaacgctatgatctgccctcttcttcagaaacaatccttagatgtatatggagggtggacttaagatggggagaaacctgagcaaggagatgggttaggaggatatttgagtatcttgtgaaagtcgatgggattctggattgtctgcttgaatattgaattggcagggcctggtgaataaggaagaggaagatccattcttacattcattcaataattatttgtaaagctcctcttctgtgccaggcactgttttggatgctgatgctggaaatattgaggcaaaaagataaagtcctttctcttaacaaagcttgcattctactgaggaaaggaagagagagagagagagagaaaaaaaaa

SEQ ID NO: 191679 - DNA, 220 bp, Homo sapiens
tttctttcctatttcaagactggtagagaactctgagtttgtcaattgattagcaagttgaattccttggaaacacataggcaaagcctacccttgagaaaagatgaaacctggtactttgttgttgttgtatacttattcaggaaataagttgtatacttattcaggtttagactcaccctgtactttctacacatgggaaactgaaatactcttgaga

SEQ ID NO: 191680 - DNA, 188 bp, Homo sapiens
tagaacagctgggctccattcttcttatataatttttcaaacactcagagagttacttgttcatctattaattctcaatcctccacaaccctattccctgtgaagttattttagctttatattctgatagagtgttttccctaacagttaggcatatgtcctaggcctcaattctcatcttctcctgg

SEQ ID NO: 191681 - DNA, 276 bp, Homo sapiens
agtgattgcaatcttattggaagtcaggtgattcccttttgcagcccttcctaagtgccctttccctctctgtttatttgtcatcattccatctctagattcctggtagatccatgggagatgcatggaagatctctttgtggtatgtttcttgtcctctaccaaatctctccctggcatggtgctgccattcctttttgtgtcatcttctttccttgtctttgtccttcagctattttcttctctccctttgatttccccccttccactcacaca

SEQ ID NO: 191682 - DNA, 358 bp, Homo sapiens
ccttatacagatgtagaaattgagctctcaagttctctgtatgtgctgccttcccataaacattaaacattgccatgacacccagagaagccccagggagcctggtaagcagccatatacctggggaatatagctagagaacttttgttttctgcctcactctcaaaagtgtctggatttgccccctcatttgtcatatccctgttaactacagtcactactctaaacatctactttggctctctttccttacccctcttatctgctcagaacctccttaccagaaaatgtagcaactccacaatcttttcccacccttcaagcaccatatccttttatagtttcactacgacagttt

SEQ ID NO: 191683 - DNA, 446 bp, Homo sapiens
ggcccacgggccagctgcctctttttgtaaaggtttattagaacccagccatggccatacattgatgtggtgtccgtgggcgcttgcgagctataccaacagagttgagtcttgtaacagagacggcgtggcctgcaaagcctcaaatattcactgtccgggcacctccacagtctaatggctcccaacccacagattgaaaataaccctggatttgagcctgccaaggccctttgtgctgcacctctgtgagctgcatcggcccttcacgaagccagcagtgtcagtgtttccctgaaggctgagcaacagaggggttgtatatgatgcaaggcaggtgtgcctaggtgtgtgtgtggctcaggagggtgtcataggctctggtttgtcatagcaaaccagagttctgtttgctcatgaaagcccatctcgaatcccacttcctg

SEQ ID NO: 191684 - DNA, 405 bp, Homo sapiens
taaagacagtcataggaaattataagattattgactggggaagtgataaatgtccatgaaatcttcacaatttatgttcagagattgcagtaaagacaggtgtaagaaattataaaagtattcatttggggaactaataaatgtctatgaatcttcacaatttatgttcttctgccgtggcttcagctggtcccttcgtttgggttccctgacttcctgcaacaattttttggacaattactattgctcaattcctccaactttattcatgaaataggttggatttgcttttattagtcttgggaagtttgaaaatgtatttgcacagaagaaatttctcattcctttttctaatggcacctgtactttaaaaaatacatttataattatctaatggaaaagatg

SEQ ID NO: 191685 - DNA, 457 bp, Homo sapiens
aataaaaacatgaagttaaaaaaaaaaggcaaaacgaacactttccaacacacgcatgaaaatccaagcctacaaatgagaactattcattatttctaattataaaagaaaaacaccagaatagctacaatgtggaaagtggcaggaagatcctgaaatatctataaagaatgttctagagaattcaagatgcacaatttgaaagaaaatgtcaacactgtctaaaacttctgagtgaacttgtctcccctgccacctgctcaatactccccaaaaagccacttaaaatcctaatgcatgatgcactccctcacctcgccctgtccagcctacaagccttttctaatccatacccactgtgttgcagcactggggtcattcttctattttgcccatgccattcctcatccctcttctggcaacagctcctctccccacatcacacggccacacccac

SEQ ID NO: 191686 - DNA, 323 bp, Homo sapiens
agggaggcacaagaatcacttgaacctacaaggcagaggttccagtgggttcgtgccacttcactccagcctgggtgacagagggagactccctctcagaaaaaaaaaaagaagaagaagaaaaaaaaaaaggtgggccccggcagcagagcctactgtcccggaggcaggaggaaaacctgaagggaatcttgaccttgacctagaagccaaggaggaggcatggccaacaacatcaaaggcctctgagcagcgcagtgaagactgacaatagacctttcttaagtttggcaattagaaggtcattggcctcagcaagagca

SEQ ID NO: 191687 - DNA, 358 bp, Homo sapiens
gctacacagaaaattcaaactcagcacattagcttaatctattagcttttcacaaatccacttccccagcagcactacacatcagggctaagaatcatcacttcttgtcaaccaatcatctaaacccaactcattcttggcccccagtcatccaagactcatctttcatcatcctcctcatctagttgccaaggatcctttcatttctaactctcaagagccccgaattcatccttccaattcttgctaagtcatcttaagtatgaagacctgcaaaacttattgctccatggttaccctaacccccttgctctcaagaaaacagaataaaccctctccctctaaatcccttcttcag

SEQ ID NO: 191688 - DNA, 471 bp, Homo sapiens
cagaaagtttaataggcagaagaaaggagagagaagagcagcttcttgtgagagagaggtgtccgaaaaagggaaaagtggcagaccatagcagattttataggcaggcttggtaaagcccactgatccgttcaatcaggtttgatgtttacatagcccacagggaaggctggtttccccaccctaatcttattatggaaatgggctttccacttggccagcgccatcttgtctgctccttactatacacatgactgacaaagagaagggaagatggagccaccattttgaacttgcctagtcccacatagtatttttctattggcacaactgctggcattcacctgtgcaagcttccagcttgcttgtccatgtctgtagctcaattttacaggctgttctttgttagaaaagaaaatgatttgagggctgctttttattaaaaggaaaaccttaccaataccctcaata

SEQ ID NO: 191689 - DNA, 351 bp, Homo sapiens
cctgtagtcccagttacttgggaggctaaggtgggaggatcacatgagcccgggagtttgaggctgctatgagccatgatcatgccactgcactccagactgggcaacagagtgagaccttgcctcaaacaaaaaataaataaataaataacagattcatttatagttctgaaggcagttggtaggagggttggagttagacaaaacagggctttgtttctccatattgtagttgtttgaccttgggtgacatactcaacctctctcattcttaatttcctcatgtgtacattgggattgatgatctttaccagtgaggttgtttagtaactggtagctattgtgaaagtg

SEQ ID NO: 191690 - DNA, 476 bp, Homo sapiens
agaaagggatacaaaaaataagagctggatgtctcataccatttgctagaggtgagctttaaatttagctatgggcttcctagagcccaatacaaaagaaaggaagcatagctgcgtacagccctttggaacacttgctttattgaaatgccatagcaaggtgtaaggaggtgtcaccatccagttgagaagcaccctgatttgtcacactcttgccaattagaatccaatatctgcttactcctgatcacatgccattcttaggtaaaattagtctccactactgactatgtgactttgggccacttacttaattaaccctttgaagtctctggttgctgttcttctataacatggaggttaaaaaatagtacctaaatggatagacaaaatgtggtatattcattaccacagaatataattcacccttaaaaaggagaaattctgacccatgctacaacatggatgaaccttaa

SEQ ID NO: 191691 - DNA, 309 bp, Homo sapiens
tgttcttcttcactttagcaccctcagcacaggtatacacacacacacacacacacatatacatgcacaaacatgcactaccttctgtctgctcttgtctgagcaacgattcctcctcacctttcaagacttctgccagcatttcctaccccagcacacctgccctgaccaccctggctgtgatgtaacaggcttcttcacaggatggtctagctgaatactcactgatctctccccagccaggctgtgagtgccttgagattggagctttgttttttgcctccctgagtgtgtaacatggcatataat

SEQ ID NO: 191692 - DNA, 425 bp, Homo sapiens
gacagcagcgtgtgctccctgattatccattccatctcgacgtagcctcccattccagaagctcccatgccagagctgctccaggagtagaattcaagaagagttcaatatatcgatgtgcatgttatttttatctttagacatggcagctacttcatcttttcatttagcttgttgaaatatagaacgtagttcttgtaattattttcatgccttgagattgattgatatttctcctcgttctgctttattacatgtctgctttattacattttcctgctttattacatatcatgtgatctttgcacaccaaacatcatatatactttttaccttgttgagggctagatattgttatatctccccacatcatctttagcttttttttgggacacagttaaatcccttggaaacagtttgttact

SEQ ID NO: 191693 - DNA, 251 bp, Homo sapiens
tggcaaataacatcttattatcacaaagatagtctgatttcacagattccctaaaaggatgcccagaaccactgctctaatgatttcccatctcagttggtataaaagcccaggtccttacaaagataaacaatagcctacagcatccacacaggctccccttgccctcaccttttttgcccttctgatcaaatgtccttaaccaacctaacctccgtccctggctacaagtccacacaaggaattgctag

SEQ ID NO: 191694 - DNA, 266 bp, Homo sapiens
caggcttttttctgtctcagaaaaatatacatatatatatccatttggtgacacaggtttgttatgtgcacctggaaataggtagatctttattcccctccctcaagtccccttgtttcagaaacacaaggttgacttcggttcagaaaatggccagctcttcccactacctttcctgttgagagctccatagtgctgttgtcttacctactccacagtattacatcttttgctctctcgggtaagacgcttcaaataccagaaaa

SEQ ID NO: 191695 - DNA, 349 bp, Homo sapiens
ttgcatatggcaaggccaaggtcagttattgcacccagtcatgtattcctcattgatgtctttatacaaaatgacaaatgtatacaaaatgacatgctggaagccagccagcattaggatacagggacttatgcccccttttctgtgttctactagtttgctagactttcatctttatttttgatatttttcccctcaaattactggagagactttgaaatatgcaagaggtatctcttttttcaaattccatctcttgccatcagcatgaggaccacttttggcttatggacagtctgtaagacatgtggcatgtgctggtgactttcttggccttgccatatgcaca

SEQ ID NO: 191696 - DNA, 131 bp, Homo sapiens
gatcagtgcattcactgaattcctccttatggtaagcttcaaagttatgtgacagcttgttttgttttattttgtaaagaaaagctgtgataaaaatcctcttaataaagtaattctttttcttgcacagt

SEQ ID NO: 191697 - DNA, 430 bp, Homo sapiens
ggcttacaataaatgcattttaaatatacagacacaactaggttaaaagtaaaaagatggacaaagctataccaagcaacactagtcaaaagaaagctggagtgtctatattcatatcagacatagtagatttcagagcaaagaatgtactaggaataaggaagatcactttacaatgttaaagggtcaagaagcagacataacaattctaaatattcacgcactgaataacagagcttcaaatttatgaagctgaaatggatagaagtacaactacaaaaaaacacagatgaaaccaaattattgtcagagattttaatactcccctctcagtaattgatggaacaagtagacagaaaataagcaaagctacagatgacttaaacaacactatcaataacttgacttaattgatatttatagaatacac

SEQ ID NO: 191698 - DNA, 386 bp, Homo sapiens
ccccttccccttcccttccctcccctccccttcccttcccttctttcttttcgatcacaatatgcaaagaatgtagaaggagcagttcagaagccactggggcctcctggagcacatttccggtttccttgtagaataaattgaaagtaccagacccgtccacctgttgctccgggcagctattgttaagacaaagcaacttcttaaggccttgcctgatttcccactgagctccttgagtgaagctgagtcaccctctcctatgactttcttccttgtatgtcaatcagttgacaatgtttgtttgaacagtgccctttaaactttatcagttatacttcattgaatattttttttaagaaaagtaaaatttcagaagaaaacta

SEQ ID NO: 191699 - DNA, 500 bp, Homo sapiens
tatgaggaggttaatggaacattttcccctagcctttcatttcttaacatccttcctctctttgttcctgtaacttttctttttaactgttccaaagcaatcaaaaacatgactactgtatttttccattagatttgccctggaatcacagaatgccagctagcaccaaaaacagcaatcccaagatattttcgttgtttaatttaagacaactgggtactagagcaagtattaaaagatctgatttctacatctggccacagcagccagtcaaaatcacttctcaaattttcttgctgttgcttgattaataagacgctatttggtaagatgttcttaagcacaaaagacgagaagacaagttatgctttgtcattctgaataggactcaaataacataaggaaaacacatgccactttaaggcacacattcaaaaagacaccctgcacattccacccgcttaaccaaaacagctatgttagaattagtttgtgccagg

SEQ ID NO: 191700 - DNA, 327 bp, Homo sapiens
cattcaatgaggacacaactcctaacctttatcccttgctaaaaaccctaacgcacatcacctcactgctgctaatttagctgttttcaaatattccaatactgtattaccaagcactgagcacttttttcattccacaaactttacttaacatgctcttctggtttgaaaacaaataaacaaaacaccaaagaaaaagacacaacttggatcattcaagctaatagaactgagaataaaagcactttggattattggctctagttcccttatatgaaaaatcaaaaaaaaggaattttttcctctgaggataatgtctcagagatt

SEQ ID NO: 191701 - DNA, 812 bp, Homo sapiens
cgtcgtgactgtcgaaacctgcgcgcattatctctcttgtaaattcttttaacatattttaacgctattttaaaatcactctcatagaggtcacttgtgcatctgcttctgtatattttctgttgagtatggtatggaccactttttttttccatcagggaagttgagtcaaaaggatcacataatttttctttgcatgcttagtaactgtttattatgtactgagcttgggatatatgctgtgatgactgaattgttttcttctcaagaatgctgtgttttgttctggttttaaattactaatggataaccttgatgctgtgagatttgattttaagcttcattacagtaagtttatttccattttgtccttagtgctgaagcacagcctttagttctaggatgctgtcattcttccttaaggcgtggcatttggggggttcaatgggaaacaccaagtatttactcagtccttcttagtggaacttgaatttcaaactctctgtccttgggcagctgcaatcgctgctgagttttttagactttaacttgctttctcctgggttcctttaaataatcacactgcaccagcacaatttgggaatccaccaaggatttgacaggaatatgtaggcagattttagagcttactttctgaggcactctccttcccaaaatttctcttctaattttcaggtgttctagaagtcccaaatgattcctcagcctgtcaaaactgtcacattctacctgaattctatatccaagtgaactgcacaaactggaaattgccctatgggtaaaagctggtt

SEQ ID NO: 191702 - DNA, 339 bp, Homo sapiens
ggatgctctgtcccttgctgtccagggcagggatggcctccagccgcaagaagtacagcagcacctcgacctgccctcgcggagtggggaagaggagagtggctcagaggggggctcacagctgctggtgggaggtctttggggcccaagctcccaagtccacctcaggtgctagaaacccctgctggtgtcatgaaccccttacagtgggacgggggtggggtggggtcctgacaaggcatgacttgttgggtggggggtggttatttattttagagatgcacagggccttgctctgtcccccaggctggagtacagtggctccatcatggatcactg

SEQ ID NO: 191703 - DNA, 532 bp, Homo sapiens
gtaatgtcttgcctacttttcgcaacagggtaatgctatgctcacagaatgaactgagaagtatgtcctgctctccaattttctgaaagagtatgtatggaattgagataatttttttcttaaatatacagtagaattcaacagtgaagccatctgggcctgcagttttgtcagaaggtttacaagttcaatttccttaaatataggactattcaagttacctgtttcttcttgagtaagctttggtagtttgctagtttcaagaaattgtgtgcatttcttcaaaagttgaatattattggcaaaaagttaattataatattcacttattatccttcaaacatctgtgactctatagtgatgtcacctttcttgttcttgatattggtaatttgtacagaatcggatttctatctagtatgatcatccttctgcttgaagaattttaacactgtagctaaggcctatttgcaataaattctttcaatttttaatatgcctaaaacggtatatatctactgggtatagaatt

SEQ ID NO: 191704 - DNA, 679 bp, Homo sapiens
tttaaagtatgtggaaggatgtgcattggttatatgcaaatatgatgccattttgtaacaggaactcgagcatctgcacattttggtctcctgaggggttgggtgtcctggaactggtccccccaggatacctaaggatgtctgtagtcagaacattgttgacttttaatggccagacttgtgttacctgcaagtgaggatattgggggtagggatgacagtgtaaaatagataggatggatttgtggcactgatagattattgagctgtagtactaaaaagagtaagttagaatggtaaagaagtagtggttaaatactaggatagacagagaaacagtatgtataatggttagagcctggatgccagcaacaatactgttttggatcaaattcttgtttgagcaattgtagctgtgaaaccatggacagattatgcctcagtttactcatctatgaaaggggaatgctgagtatctatctcttagaaagtttaccattactaatactgtgtagtggttagaattattagtaatgacaaaatctagggtgggagtatgtaagtcaatggctaaagtagggtagaggccaaaatcattgagaaacaggtcacgaaacggaaaaccattattattggaaggatcatctgtgtggacattgaaatcaccaagaattaagac

SEQ ID NO: 191705 - DNA, 623 bp, Homo sapiens
tttaaagtatgtggaaggatgtgcattggttatatgcaaatatgatgccattttgtaacaggaactcgagcatctgcacattttggtctcctgaggggttgggtgtcctggaactggtccccccaggatacctaaggatgtctgtagtcagaacattgttgacttttaatggccagacttgtgttacctgcaagtgaggatattgggggtagggatgacagtgtaaaatagataggatggatttgtggcactgatagattattgagctgtagtactaaaaagagtaagttagaatggtaaagaagtagtggttaaatactaggatagacagagaaacagtatgtataatggttagagcctggatgccagcaacaatactgttttggatcaaattcttgtttgagcaattgtagctgtgaaaccatggacagaaagtttaccattactaatactgtgtagtggttagaattattagtaatgacaaaatctagggtgggagtatgtaagtcaatggctaaagtagggtagaggccaaaatcattgagaaacaggtcacgaaacggaaaaccattattattggaaggatcatctgtgtggacattgaaatcaccaagaattaagac

SEQ ID NO: 191706 - DNA, 146 bp, Homo sapiens
taaagttgatattttaaaattcattatgtttttaaactgtggtaaaatacgtgtagcataaaatttaccatcttaactttttgggttgtttttgtttttgtttttgagacagggtcttcctctgtcacccaggctggagcacagtg

SEQ ID NO: 191707 - DNA, 343 bp, Homo sapiens
cagatctttaatagttatttaatgagacttgacagagagagggaaatctaattagaaaaaactctcaagtttactgtttacttcctctacaaggttaaagccctccaaggtcaggatttagatctaagacaccagccatttataaatagtagataaggctgaggtagaaagcaagaaaataacaagtagaaaaaaagaaaagaatagagtcctagaatgtttttaaagaccatctactacatcctatagtaagagataaagatactaacattaagaaatcatgacttattccatcaaaaaggtagtaagtggcagagacatcactaagcactaagcttccttt

SEQ ID NO: 191708 - DNA, 592 bp, Homo sapiens
agggatacctcgtctcttcagaaaaaaaaattaaaaataagccaggtgtggtaactcacatctgtagtcccagctactcaggaggctgataagaggattgcttcagcccagatcaaggctgcagtgagccaggatcatgccattgcactccagcctgggcagcagagcaagaccctgtctccaaagaagaaaaaaaagaaaaaaaaaaaggaaaagaaataggttatggaaagggacttttccccatagagtgtctctctgagaattagagtctaaaagggctaaaatggaattcaagaacacacaggaaattcagagcccgctgctgtggcaagaatggcctggggtcagtgctagctgtggcagtggctgcaatacccctggctctaagggcatcttcagtatactgcaacaccctcaaattctggagtggtattaggggttactgagagccctctgggaattataaattattcctagagcaagaccaagccccactttggcttacagttgacctcgaaaactccaagaattcccccaaaagagaactcattcccaggaccctatcgaagaataatttgtccaagtttgc

SEQ ID NO: 191709 - DNA, 141 bp, Homo sapiens
taagtcaactccaccccttcccaataataaagcatcactcaactgtgagatacctcgactacaaaaagcactgtaccacagccctctccccctgggtccatgacaggagcagggagtaaagttgattgcaaacctcatgaa

SEQ ID NO: 191710 - DNA, 287 bp, Homo sapiens
tgcagcgtgtgctgtgggacctgcacttctcttgcaagattcacatccagcctgagagtagtagtattgccattattttgatcctggccttgagctggactgtgcactcagggaggggtcttagtcaccgtatcccccagcatgcacagcacagtgaacagcaaacacgagagttaggtgaggctcatttatacccagagaccagcatagggctttgatgcaacaaatgttcatattaaatgtcccccagctgcaggtttgcaaaacaacaatctgcctaggttctt

SEQ ID NO: 191711 - DNA, 230 bp, Homo sapiens
catgttatccccaacacctaacactggtagtgtgaaagtttgttgaaggattaatgtgtttggggtggtgcgtgcatgtagtccttactactggggaggctgatgcaggaggatcacaagcccaggatttcaagaccagcctgggcaatttattgagacccccccatctcttaaaaaaaacccaaaaaacaaaaatccaaatgaatgattaatgtgttgggcgatagcct

SEQ ID NO: 191712 - DNA, 370 bp, Homo sapiens
gaggattcgagtgttagtcaggcccttccagctgaaaatgattcattttaattaccttccagggtgatccgatacctgagcatatggtctttaagaaataaggttccccaaactgtcagcaagtgtgggcaatggtcagggacctctttctgacaccattgaccagccttggagagcgggcgctctagaaggtgcttattaaaatgccagcaggtgcagcaaaggtccccttctctgtgactcccgcaccctgcttgtgccaggtgttttataagagcctttttcttcattaaatggcattcattaagcacgtccttacacctggcacagaagctgtgcgtcacagatgacttcttcccagtggtgtttg

SEQ ID NO: 191713 - DNA, 353 bp, Homo sapiens
taaccttgtcctgttttcccctcactctttacagtcaagtcacaccaaccccctttctgtttcttgaacactctgaggtcttcaaggctcccaggcctatatccctgatgctcctctacctagaatgctcttcctacacctctttccatagctggctccttctcatccttcaagtctcagtctgaatgtcatgtccttggagaggcctttcctcactagtctacctaaagcaccctcttcctttactctctaccataacctacttattttcttcatgatgcccactaagagtttgatattcatttagtttattgtttgtctccccatcaccaaaacgtaagctttatcagggt

SEQ ID NO: 191714 - DNA, 152 bp, Homo sapiens
gacaaggaaagagtttcataactacttacaaatgaggtctcaacaaaaacagcaaaagaatactttggggatctttacaagttgatactaaaattcataagaaaataaagaagcagaataggaaaattctaaaagagaaaaataaaggatta

SEQ ID NO: 191715 - DNA, 268 bp, Homo sapiens
actttagcaggactagccattcagtccctgaaatgtgagtcatccctttgtccagtgtatccgtgctgtacagtatgtgtgtgtaggaaaaatcatagcatatacagggttagtggcagcatctgcaggttcaagcatctactggtcttggcgcgtaccctcagcagataaggggagagtactgcacatagataaggaggattttggacatactttctctttgacatacttagaagtatggagaaaaacctcatcaaactgaaatgag

SEQ ID NO: 191716 - DNA, 624 bp, Homo sapiens
aaatatcatggtatgattgtctaaaagaagttttccacatggaatgttacacaaggaacagcgcactacagcatggacaaaagcctttattcattcatgccaaataaaagcatactgaacacatagctgtgttttattaaaaaaaaaaaactgttaaaggccaaagacataggattatgcctagcctttaattcactgctctttaaatcattttaattcactgaaagaaaatgctagcaggatcctcacacttggcctcccaggatcctaacttcataccaagatggaacgtaatgtattctgcagaacgttcttcccagagatcatttccttctgttggcttattgagagcacagtgattaaaacctccagaactcttactctgttgctttggtaagttcaataagcaatctcacctggctgaatgcacctgaagttacagcaaatcagagcaagaactaaagcaagtctctgctgctggaaacagcagatacaaaacccaaagtctatgaaatgtaggttctagcggccgggccaggggaggaggaggacaggcaatttgcaaatgagcacgcacatatctgcaatcggtctggtgcagtgctcggaagaaaaataacaaga

SEQ ID NO: 191717 - DNA, 500 bp, Homo sapiens
ttttgctgttgagttatatgaattctttaaatattttggatattaatccctcatgagatatatagtttggaaatattttcttccattttctaggttgcatttccattttgttgactgtttcctttgctgtgcagagctttttagtttgatgtagtcctacgtgtttatttttgcttttattgcctgtgcttgtgtcaaaaaatcattgccaaaatgagtgtaaaggagtttttcccttaagttttcttctaggagttttgtgatttcaggtcttaaatttaagtctttaaatatttcacgttaatgtttgttatggtataagataagggtccagtttcattctcttgcatgtggagatccagtttttccagcaccgtttattggagggactatcctttccccattgtgtattctccttggtgcccttgtcaaagagagatctagtagtttctaagcagcatcatgaagctgtatctttactgatttcatgtacaacaaaa

SEQ ID NO: 191718 - DNA, 604 bp, Homo sapiens
atcgtgccactgcactccagcctgggcaacagagcgagactccatctcaaaaaaaaaaaaaaaagagagagagagagaaaaagaagtacatatgcttttcaaaaatacatagaacatatatttaaaatgataatatatcaggccaaataaaaacttaaaaaaattccaaaggcagaaattgcacaagtcaaattatctgttaaaaacaaactataaataaataacaccaggttaacaaaaagggcaaaatatttagaacttttaaaaatcatttatagaaattattttgggggaaagaggaaattaaaatggcagcttctgtttatgtacaaaacaacaaaaggaaccctacctttcaaaactgataagatgtaaacaaccctgtaatcagaggcaaaattgttatgttaagtgtttctattaagaaagaattttaaaaataaaatgtttcacataaaagaagtatgaaaaagaacaaaatgacccaaagtagcaggtagacagaatcaaacataataaaagcagacattactgaaacaaataatagaaataaatgttaaataaaaccatgacctgggtctttgataagatcaataaaataaaa

SEQ ID NO: 191719 - DNA, 301 bp, Homo sapiens
ttaccccacagaatatatttacagtagcaacacaggcaatgccttagtcttcgttataactttgtcttctgatcgactctgttcagtagcagggacttactatcctctttggtctatagacagtttggagatcaccagataagaagcatacctcaccttgcagtttcattcagtttcatattctcagaagctcttaaagggctaaaattctggcagcagctggagaaatctgcattgctcagggcctgagtgactgtgcccctttagtgctgaaagaccagaggtgcaattgtcccgtcct

SEQ ID NO: 191720 - DNA, 727 bp, Homo sapiens
gacggggcaccccggcgattatcatcatcatcatcaatatattgttgttgtcattatcagttttatgctgagtttatagataaggacagatcttacacttctcaaacacagaaactgcattttactcactctgtaggagattctaacaagctacagggcttatgtatattgaaacctaattgtttgataaataaattaaacgaattataaatcatgattttcataaacagactaaagagtattcattcatgaaggtatggtctggttactttatgggaaatttttcctcctttaatctctatttgtaggataagtcaaaaatagattagataatactaaatagctacctagaattaatgttatcatgagactcaatatgtgggatatagatatattattgatgaaaactaaaaatcttgctagatatataagcagacttcataaaacgaagagattgattcagccaagaacattaaaaaaaagatacaaagtttatcacggtaacctatacatttcaaccataaatatactaacaattctgttttcacaagtgggattagtagagaatcgttctaacattcgaaagactaaatgcattaatatacagaactgggaaaatttcagaaggatgagttgtcattatggtgtataagagatacagtcatcctccacctcctgtgaatccatattccatttccctaaaaagcgagtacccccgagggagtgc

SEQ ID NO: 191721 - DNA, 338 bp, Homo sapiens
caggtgagcccactgtaatcacataaagctcttaaaagcataagaaaacagaagagtcagttggaaagatgtagcagaagagagaaattagagagaaatgaagcctgagaagatctcaacttgctgttgttggagtggctaggtgaggaggaatgcacgtggccttaaggagctgagagtggttccgagatgacagccaaagaactgggacttcactctctaactgcagggaactgaattctgccaacactgaatgagcttgggagctgagccttttccagagcctccagaatggaatgcagctctgctgacacctcaagatcagccttgtaagactc

SEQ ID NO: 191722 - DNA, 345 bp, Homo sapiens
ctgcctcatatttatttctatacggcaatgaggatataaaggagcagaccgaaaagagaaaggaattttaaaagccatggaaagctgccctaaatgtggttggatatagagaggagagtgctgaaggcaaacagctgtgccctctttgcctttttgctgaggaaggggatttaagccaaaagaacacacgtaaacgtggatttcttaaagttctcactgtaattatgtagccttgggagatgaggaattgtaaagtagatgctggcttaaacaaatgataaatccttgaggtgatgggcaccccattttccctgatgtgattattacacatagcattcctgtatc

SEQ ID NO: 191723 - DNA, 113 bp, Homo sapiens
caatcagaggaacactaaaaagtctcccattctctcttttcaaggttgttcattagctgagctaaatctctcagaatcagagccagccaccttcgttcctcttatatatgtct

SEQ ID NO: 191724 - DNA, 420 bp, Homo sapiens
gaagatttcacaggagtccgtgtcttctgtcagcacctatgaacctgtggccaactaactttgttagcttgtaagtagggtaaaatctcagacccttcacggttcttaacaagcatttaggtcatatgaaatgcagggtaaatatttgataaatgttataataataaccattattctttatcagtgatcatttaggcattgtggaagatgatgagttagacataccagttaagaggccatagtccaagatgatgaaaacataaaaacagatattgtcagtgggaaccgaatagagagaagagagaactgagagaaactaatgagacattgacaatattgggggattaactggataggaagaaagagaatcaaggatgacttcaagatttatggttttggaaagaaacagtagccatcagt

SEQ ID NO: 191725 - DNA, 385 bp, Homo sapiens
tggtaactggacatcagcccagaagtgatgcctgaattggcgacagacaataaaaagttagtggcacgcaatgatatttaaagccataccagtgaaagcagagagaaaagaaggctagaggaaccttgaagaataggaatttctaacgcatggggaaaagaaaacagaaagtaaaaggaacaagcaaaaataaaaggtgaaagagcactcagagagataggagtgggatgtcatagagtcttcagagaagagaattggaaggaaggagagtgatcaaatgcagtcaagaaatcaagaagtcttggccgggtgcagtagctcacgcctataatcctagcactttgggaggctgacgggggtggattgcttgagcccaggagttcaa

SEQ ID NO: 191726 - DNA, 422 bp, Homo sapiens
caacactgcaggaagtgagtccaggtaggaaaaaagtgccttccgaattctggggcccaaggtgcctaccctgcagggaatagtaaacagacactctctggactgcgggggccaaggcccgccacccaaggcccttagcagccggcatataccacctgtgggtgaccttgtctacacaggactttgctatccatccgccaggacctgagggaagagaactgccggaccccattcctgccccttctgccaccatttcagacaccccacagggactcattttgggggttcccaaatgagttcccactgacttccaggaaatccataagctgctctatgaccccagcttgggtgaccatctctccttgccacgctgacccttttcccctgacctcacagtgcctcaagctccaggaatggctcag

SEQ ID NO: 191727 - DNA, 515 bp, Homo sapiens
cacaggcacaaccccacggtcccttacctcctgctcatactgggtacctatcacttcccacccgtggcttgctgcttgccttggaggtgtaagggtctgtgggacccacctggtacccacacatgcacaacctagaagtctatgggaattaatgtgccatgaagcaaacctttttccagtgagatacagaagctgaggggtccgtccacccttcctttagatggattgccctggaatgcagttatgtatacatcctcctgggagacagctttaggagaacaagcaaccaactgtacttgcaccaagggcaaccaacttcaaaatgcacccttgaactgacttaatcttccttctcccttcactcacctttcccctacctctgcttcctgagagcacacttcttgaaaaaataatagcacatacgctcttgcctcaagctgtaggttctccaggttctagggtacccaggtatagcagacactacggatgctctactcagcatcccttcagctttt

SEQ ID NO: 191728 - DNA, 202 bp, Homo sapiens
ttgggttggtgggggacaaggaatgctattggaatgttttagtgacttgatgtgacttactttttaataggaccatttgggctgctcagcccatgatgtttaaaaatgcaatcaggtcacttccactgtttaaaacctttcaatggattctggttgtacttagaataaaatctaagctcccttagctattattattatatta

SEQ ID NO: 191729 - DNA, 724 bp, Homo sapiens
caaggtgttctttatttaggtgaatggataaataaactcatacttctagacaatgggatattattcagtgctataaaggaatgagctgtcacatcatgaaaagtcatggaggagcctgaaattcatcttactaagagaaagaagccaatctgaaaagactgcatactgtatattttcaactatctgctgttttggaaaaggcaaaactaagaagacagtggattggaggggagggagggatgaataggcagagcagagaggattttttggggcagtgaaactactctataatgatggttacatatcatcatctatttgtccagacccacagaacgtacaacaccaagaacgaactccaatgtaaattatggactctgggtaataatgatgtaccaatgtgtgttatcagttgtaacaaatgtacactcttgttggggatgttgatagtcggggagacaagacagggaacatatgcgaaatctcttccttctgctcagtttcattgtgaacacaaaactactttaaaaagtaaagtttattttaaaaagaggaggtcttaggacagaaccttagagaattcttaatattgaggaactagccttagaatagttctgctcttccttgtgaaaataattaacttaaatatctgctctgaatataaaactgaacataagctgtttttgagtaaattttctgtaggcaaatgatgaaataattttttttt

SEQ ID NO: 191730 - DNA, 702 bp, Homo sapiens
gacagggtggagagtagttgttgtgaggatttttataaatgagagaatcagacaaacattctcatcctgaaagctgcctgtgagtgactatattacccgttcatccgacaaatacatatcaagtgcctactatatcagcagggcactaggttctggggatatcagtgaacaaaacagacgaagatccccgccttcgtggagcttgcattccagggggaacaaaggacagtaaatgtaataaacgtgtccaaagggagtggcacgtcactgtgtacttggcaccaccctggtgctgggaatggaaactcaagtgtctgtctgctcagggtacatcacatctccacgcctgcccacagtgtcctcactggagtcaacagcacttgaataatggagaaagaccctaatacttggaatattgcccattgctgaattcagtgtccaacacatggcaagcacacagtaaacttgtactgaatgtactgaacagtaaacgaatgaatgcgtcaatctgtgactcaatcaatcacatcgttcacttgaagggcagaaaaatgagggttctagaaagaaaagtgtaccagcaaaaaggggtttgccagcatgaggacctactgtgtatcaggcactccctgtccacgtaagacagacagacacccacatacacacacacacatgcatgcttgtgcaaggctgagcacacat

SEQ ID NO: 191731 - DNA, 181 bp, Homo sapiens
catgacctcatggcacacctctttcagaacagacattttctgctaacaaatattgcttaaaataaaaggtctcaaagctgggaaatgggaatctcttttcaatactgaatttataaaaatagcccgaaaatttgtcttatatctctctttactaattcatgacttcagagctaaacccaaa

SEQ ID NO: 191732 - DNA, 391 bp, Homo sapiens
ggagatggaggcaggagaatggcttgaacctgggaggcggaagttgcagtgagctgcagtcacgcctctgcaccccaccccaggtgacagagcgagactctgtctcaaaaagaagaaaaaaatagtaaatatttttttaaaaaaagattgaagaaaactcaacaaaagtctcagtaggagacaatatcaagcagtccaacattcttgtgattggagttctaaagaaaaggaaaggggcagaaaaagcattgaaagaaataccagcccaaaacataagaaaactacacctatgtgtatatatagtgaaactgctaaaaggcaaaagtaaagagaaaatcttgaaagcaacaaggggaaaatgatacatacagggcaacaatgggaaaaaaaa

SEQ ID NO: 191733 - DNA, 118 bp, Homo sapiens
ccctgttcctgctctggatgcctagccctccagcaggagttataagttcttggtagaaagccttaacttcactgaagaaaatttagaaattatggatgagtacccccaaatttaaaat

SEQ ID NO: 191734 - DNA, 522 bp, Homo sapiens
cacacttggacaagggaggagaaagggttcttatccctgacgcacgtggcccctgcggctgtgtcattcccctattggccagggttagaccgcacaggctaaactaattccaactggcgaatttaaagagagtgatggggtgagcactttggcgggagtccgggcagagcaggtagcaggtaattggaatgagttagggtggagcaggtgatcagaatgagtcagggtggagcaggtaattgaaaaaggttgctttacgaggaagtttgaaagtagaagccaaataattgaacatactgacatatcctttgaaaataaatgtagaactcttatctaacagtcccatacaagggaaggcttgttatctttcgactttttcataatagccaacctaacaggtgtgaggtgacatctcattgtggttttgatttgcatttccttgatgattagtgacgttgagcacctttttatatacctgttgaccatctgtacatttctagggaggcaggaaggaggctttgg

SEQ ID NO: 191735 - DNA, 374 bp, Homo sapiens
taccttctctctgcaaagcctgtccctggcctggacagctttccaactggagggcagcagcgaagagcacagctctagactccctattcttccacttactgtgaccttgggcaagtgacaaggaccctgagcctcctctgcaaaatgggaatcccaagggcacttgtggggtttaaagattaaatgaaccaatacatgtaaagcacccaagagtgcctggggcagtatcttccaggtctgtcactgctcttaagcaaagtccagaaacccagctcacactcgccctagaaaagccgatacacttgctgtggtaacctgtgtcacacagtagctcatttacctgcattaccattaattcagctgtgggctctgga

SEQ ID NO: 191736 - DNA, 372 bp, Homo sapiens
acggcagcagcctcttagtcctctgaatagatgactttattccttgtattctggtacacagaaatctcttgaattaggcttattttaagaatagagtttagataagtttcccaagctataattcatcatgaaccttattttcccaagtctagaagattctcaatactagtactttcttgatcttatcagagggtgtccatggaaggtcatgaccatcacccagctgagtgcagtagaaggaagctttctaatgtaagttgcatcacagtttcagagatgtgagagaaattcagaaatgtgagggaaattgtgaaatgtaaaacgtgagggagaaaagcattcagaatggaaaaataagacaaagagtccctt

SEQ ID NO: 191737 - DNA, 666 bp, Homo sapiens
ttagacatgggcttcaaccatgcttttgagatagccctgtgattgctctatgactattttcccagtctctaatcaactttcatgaatttatacacaagagaagtgattcccatgtttcatttgatgtgtaaatagatgggtagctgttttcaccacaaactctgcctcctcttgggtttcacaatagcactccccaaaactgcactctgctaaccttcctgtaagacatcacacctctgttaatattaaacacacacagagcagctctggtgtcgatgctgagcagtgaagcatcacacagaaagatgtccaaggttaggagacaatgtgggtgaaagacactgatcatcatacaaaatatgtagggaagtggcacagaaaggttggtattaggtgagttggtgggtggcagtgcccctcctccatcagggaatgacagagatgcctgctcttaggagagtattggagaaactaggagaagatgactcatcaagaggcatgatattagcgaagagtattgtgcaggattcaccagcatgcctatgcaaaatgtcaggtttaaatgaaaccatcgcaggtcattgtattttacacagtattgacatcaaacccatcggactgtggtggatggtgtcactcacacttgctgtaacacaagcagctcgc

SEQ ID NO: 191738 - DNA, 451 bp, Homo sapiens
agggtgggcctgatcggagaccatcaaccatctcctgtaagtctaaacagaggctcagaccgggagaaatagattcatacataactgaatcaggtccttcggaggaaagttgatatcaacattccttaaccttgacactaaccactgaggtgtggtcactgttacgttttgtaaagaatcggggtgtggcctctctgatattataggtccaaaccaatggtctctaccttggtcattcccatgaaaactattttgggattgtgctctgtccttcagaggcttaacacaaaccatacctgagacttcagccacacataaacacactccaatacttcctcccaaaccttttaagctgctttgtacgaagcacagtgacatcacacagcaccccaaagagggacaggcacccccatatgcacttgataggccggctcttcccagaagcatcatc

SEQ ID NO: 191739 - DNA, 283 bp, Homo sapiens
cggctggaagggagtggtggagagggcagccgttgtgggtgagatcaatgcattttgtttactacacataaaatctcattcctttgttgaatttcaggtcattcaaaaagtcttcaagattttattcacagcaaggaataatgacagatgtttacagagaaagttgctgctgcttttctagacagttttcagcagtttcccctctgttctctgcaggcacgtccttgtgatgcccagggctgacttggcttttctgatcccccgctaacctgtgtgtccagtt

SEQ ID NO: 191740 - DNA, 205 bp, Homo sapiens
acagagtgagactccatctcaaaaataaataagtaagtgctgagaataaaataggagttgtcagccaggggtttgtgaaaggtggaactgtcttggcctcctggtgtagtgagcattccagagaggccttccgaaatgaacaataaatgggataatgcctcattttgttcagtaaggaagtggggtggtgtgagttgttcattca

SEQ ID NO: 191741 - DNA, 315 bp, Homo sapiens
tccatgagtagattgagtctttccattccatcttcaggatgggaaaggaatgttttccatgtgagctctaactgtggagatgccaggggtgtgagggctcataaaccacctacagttgatttttggacagtttgatggtttcatatactagtgaagattcagtttctgaataccttaaacccccttgaatagactgaccctgtgatgtaggttctaatggtgttattggacctgttgccccccctctgcaactcattagggtaatttaacctttgtgggtggttagaaagcagaaataacagtccttaccacttt

SEQ ID NO: 191742 - DNA, 177 bp, Homo sapiens
  misc_feature (100)..(100): n is a, c, g, or t
actgcccatataaattttatgatgcatttcctttagattccatctttttaaccacgcacaatctaaagaaaggaaaataacagtctgaaagcctttggangagccaagaccaggcacctagaggaaatcaggtaaagaattgtagaacctgaatatggtgtaccgcagctacgaatt

SEQ ID NO: 191743 - DNA, 209 bp, Homo sapiens
attttatattgtacctacctccagaataatctggggatgtttcttttatcttcactgctgtttttacaccacagcgtttaaccctgccttacttgttactacccattccacagtagcctaattcttccctttgtcttctctatttctgggtctgtgtcatgccttatatttagaacaacatgatcaataaagttcatgaagttttctcc

SEQ ID NO: 191744 - DNA, 205 bp, Homo sapiens
ttagtctattcaggacctatctgctgtaactggggatgaggccaacttctcccaaagtacttagctctggggagaagagatggatgtttggacaaaatcagaattctctcgggaagaagacaaaagcaaaaagttagttgagtaggtaacctacaatgttctctacataaggacactattgctgaagtcagtaaatgtcacttag

SEQ ID NO: 191745 - DNA, 400 bp, Homo sapiens
aaataattctcattttccatatccaaatagttacatagttataaagctaatgtgtatactaaaaagggctcacttgagaaaatcgatgttccttcaggcctcatactttagctcttctttctagctttcttcagtactttatcagatccctagttactgttctattcttaactcttctgctttatatcctgtgtgctattgtttttccgtcttgaatctttagtctttccctctcccaatccttcctttcaaccccactgtgctattctgcctgttcatcctaaaaagctttatctctgctctgcttccctcatggactatttgtcaaaatttatactctatcccataacttttaaattctgcctctataattcctttgcagtatctctaatataactta

SEQ ID NO: 191746 - DNA, 359 bp, Homo sapiens
cactctgagggtgtcatacatgcctgaacccaccctgcagagacagagtggacagctgtccatgggctgtgattggattttgcttcagggacctctcgacaactaccccggctggtccaggacaactgcctgctggaaattctcacaatcacttatctctttggacttaggcattgaaagttgtttaaatgcaaattattttccacaaggtagagacattatcattcattaatatttgggctttaatgagtctatcaacttagaagagaatgcgccagggtcctcttttggtaatgggagccaaaaagccaaacagatgtgttttaataacgacaggtcgaagaggaaagagtaagttc

SEQ ID NO: 191747 - DNA, 383 bp, Homo sapiens
aataggcagagcacagaggagttttagagcagtgaaacgatattgtatataataatgatagatacatttgtcaaaacttctaaaagagtgaaatgaaatgtaaactactgactttggttaataatgatgtgccaatgtaggttcattgtttgtaacaaatgtatcactctggagcagcagatcgacagttggggaggctctgtgtgtggggagcatataaaacttatttgtactttttgttcaatttttctgtgaacctaaaactgctctaaaaaataaagtctattaagaaacaaacccaaataaaaccagtgtaccatcctttgttaaccttctctagactattgcctttgagaagaatggcttagaagatagcatgaaat

SEQ ID NO: 191748 - DNA, 331 bp, Homo sapiens
tctaccactcacctcttcacttactcttctctagccacactagtctcctttctgctcctcaaactcaccatataagcctccacgttagggcctttacaatggctgatctcctgcttctccctcagacatcctcaaggctcactctctcaccttcttaaagtcttcgctcaaatctcacctctcagcaagacctaattcaaattgtgattcccatccttttactcaaacagggctctattcttcctatataagcacttttcactttctaatctactatacaatgtacttgtatttattttttattttctatctcccccaactagaatgtaca

SEQ ID NO: 191749 - DNA, 204 bp, Homo sapiens
ctaaacctgtctccatctattcagaacagtgtgccttgtactgacccatttttgttttttaactttagcctgttgtcaattatgtcatgaaactcccaagtcatatggacaagcccatttataattctagttgaggtcacttgttaaaagttttcatgttttgcaaaatgtacttaagtttgagtttatgttttgtctaatagg

SEQ ID NO: 191750 - DNA, 933 bp, Homo sapiens
atgaaactaggtatatacgcctataaaaggttcatttgtttttgacaaatttgtaaactctcagccattttttttttcaaatactttttcagccccaccctccctctcctctttcttagagccatgattcaaatgttaggtctttagctagaggcccacaggtaccaattgcagtctgttttctccgctcagatttttatttcatctttaaattcagtgattgttttctcgttactcctcattctgctgtttaacccatccagtgagatttttgtttcatttactcttctcaattctaaaatttccatttgattctgccatcttctaagacttcctatttttttcatttattccaagcatgttcatgattgctcactgaatcttttttttaaatgatggctgcttcaaaatccttgtcagataattctaaaatctgtgttatcttggtgttggtgtctgttaactctctgttctcattcaggttgacatttgcctggttcttggcataagagcatggctttctgttctattctgcccatttgggtttgagacgctggaccttgtttgaatcatgttttcgtaggtctactctgacaccacccaagtgggtgacgggggcatgtggtggggttgatggttcaggctcactactgagcccctttgaatacaggcaaggggaggggtggctaagtgcagcttcccgctagaacacgtgggtcccactgataccatgggagtgggggcagttgttcctcctgggtcagggtaaaagtctaagctcccaacatggcctccactgacactatgggggtgggcctcattaccatcctgcagggatagatgtcccaagctctctgctgggctagctctgacactgctccagcaggggatggggaggcctcattacaacaggcaaagaaggtctaggctccc

SEQ ID NO: 191751 - DNA, 879 bp, Homo sapiens
atgaaactaggtatatacgcctataaaaggttcatttgtttttgacaaatttgtaaactctcagccattttttttttcaaatactttttcagccccaccctccctctcctctttcttagagccatgattcaaatgttaggtctttagctagaggcccacaggtaccaattgcagtctgttttctccgctcagatttttatttcatctttaaattcagtgattgttttctcgttactcctcattctgctgtttaacccatccagtgagatttttgtttcatttactcttctcaattctaaaatttccatttgattctgccatcttctaagacttcctatttttttcatttattccaagcatgttcatgattgctcactgaatcttttttttaaatgatggctgcttcaaaatccttgtcagataattctaaaatctgtgttatcttggtgttggtgtctgttaactctctgttctattctgcccatttgggtttgagacgctggaccttgtttgaatcatgttttcgtaggtctactctgacaccacccaagtgggtgacgggggcatgtggtggggttgatggttcaggctcactactgagcccctttgaatacaggcaaggggaggggtggctaagtgcagcttcccgctagaacacgtgggtcccactgataccatgggagtgggggcagttgttcctcctgggtcagggtaaaagtctaagctcccaacatggcctccactgacactatgggggtgggcctcattaccatcctgcagggatagatgtcccaagctctctgctgggctagctctgacactgctccagcaggggatggggaggcctcattacaacaggcaaagaaggtctaggctccc

SEQ ID NO: 191752 - DNA, 454 bp, Homo sapiens
ctgaatttaaagatgaaataaaaatctgagcggagaaaacagactgcaattggtacctgtgggcctctagctaaagacctaacatttgaatcatgttttcgtaggtctactctgacaccacccaagtgggtgacgggggcatgtggtggggttgatggttcaggctcactactgagcccctttgaatacaggcaaggggaggggtggctaagtgcagcttcccgctagaacacgtgggtcccactgataccatgggagtgggggcagttgttcctcctgggtcagggtaaaagtctaagctcccaacatggcctccactgacactatgggggtgggcctcattaccatcctgcagggatagatgtcccaagctctctgctgggctagctctgacactgctccagcaggggatggggaggcctcattacaacaggcaaagaaggtctaggctccc

SEQ ID NO: 191753 - DNA, 553 bp, Homo sapiens
tggatggatggatgttggatggatggatggatgttggatagatggatgaatggttgttggatggatagatggaggctagatggatgagagtattgcagaaaagctgtatggaagtgaaaatcttaaaaacaaaatctatttaaaattccttcctgggagaagcactctatattgtattaattaactcagcttgctaatcagggaaatgctaacgatctctccttccagttgctgaggagaggtgctggaagagcacccgcctcattcatcatttcagcttggtgctggctctgtttatttttctggtaaataaggaaaagaaattacaccatactttgagctgaaggtattttctgttggagttcaaagctgccttaatttctatcttgtggatgcatggtatacgttatctaactcaaggctggggctgtgtcacctcttatctgtcacagtgcctagaccagtgctgaacacatacatgccaaacacccaggggttcaccttaagaaataaatcctaaaggatgtgctatgtcagtttatcttcattcact

SEQ ID NO: 191754 - DNA, 395 bp, Homo sapiens
tcctcctctgtcgcccaggctggagtgcagtgacacgatctcggatcaagtgattctcctgcctcagcctcccaagtagctgggattaccggcgtgcgccaccacacctggctaattttgcgtgtttttagtagagacagagatttcaccatgttgatcaggctggtcttgaattcctgacctcaggtgatccagccgtcttggcctcccaaagtgctgagattacaggcatgagccacgtgcccggtccttttcccatttttaaattggatttatttgtaagagctctttgtatattaagaaaattatccctttgtcacagcagttgctactctttctcagtttgctgtttgttttctgctggtttattaaatatagaaatttgaaattttttt

SEQ ID NO: 191755 - DNA, 572 bp, Homo sapiens
agcgagcctagagggcagcacgtgctgttggctgagcaggtggaggatgccaccaacggcctcttcagcaccctcagcagctcggccatctgctccagcgccacgccaggtaagatcttccagcctggagggagtggaagtgccatgtggggtcggggagggctccctgaggcaagaggtcaggacccaggagcctcccaaggatggagggcaggcaagagaaacagagaccggcagcctccaccctggatgctctgcgtctccctgtgccctgccctgtgggtttcccagctgggagccccgagcttgtcttcatggaggtagaggggcccagggtttgagacccaaatgtagtaggttccctgtcccctgctcaagagacagagccaagtctcctccccctgccttggaccacacagaggagcacaaggaggctttgtgcttggtgcgagatccctgcattctagtcgtccttgtcagggtccacccaggagccacattgatgacgttatgtggaatgtacatgtgtgcccattacgcaaaagctgtgtggggtggggcccagcagagga

SEQ ID NO: 191756 - DNA, 340 bp, Homo sapiens
tttctaagacacagaaaaagaaaaggatatccattttcaccacatccataaaacatagtactgaaaattctagccagagcaattaggcaggagaaaaaaataaaaggcatccaaattagaaaagaggaagtcaaactgtccctttgcagaaataatcttatattcagaaaaacttaaagactgcaccaaaaaattcttagaactaataaacaaattcattaaagttgcaggacaaaaaaaaattggcacacaaaaatcagtagcatttctatacatcaattatgaaaaagctgaaaaagaaattgagacagcaatcccgtttacaacagtcacaaaaata

SEQ ID NO: 191757 - DNA, 228 bp, Homo sapiens
acatgtccatttcctgttgagggttaggggtgagggatggaaggtaccttcattgttatagccagcctattgaattgggggcatgttcttcaaaggaaaacaaaacactgttaccaaaaggcagagtgagggatactacacaggtagaaacaacagactctataaggacccttggcggattttactttggtaacattagtcatgccactccctaatgtgacttctctg

SEQ ID NO: 191758 - DNA, 679 bp, Homo sapiens
agccagtggtgagcatttatcgctggttagagaattgaatttggcaggagagatttctgtgcatttgggggattaatttgtcaagcaccttcgccagcagaaatgctaaggatggcagccaagagtagggtggtgcaggcagtctggcaaacataggccaaaccctcttttgtagctggttctctctagccctgagaagaaatgcaacatcactcagctttcacaccccaggagcacggctttcccttaggcacactgtcttctccccaaattagcactgtctcatcaggggccaacccaacagggaagccggggttgagaaggtggtggggtggccagacagaatgaggggacctgggaactaggcatgttcccctgggtggagcacatacttggggcctgcctatcaagaatagcaaattcacaggtgtgacaggaagtgagagaatgagccaggaatgagcatcaggtggggtcggctacagtaaggagcaagagagtccccagaggtctcagaaatgcaaataggtagagatctggcaagcagactggtgggtataatagtcattgtcattcaaaggtgtgctagagacagcttataccacttctctagaggcaattgttaaattttcaaaaagtttgcaagccagttgctaaacacagccattattaaaatgta

SEQ ID NO: 191759 - DNA, 175 bp, Homo sapiens
aaatgccaaccatgcctttctttgctcaggggtacaggggttgtaatataactttcaacaacaatagatagacttcatatgcctgtagtcctagccactcaggaggctgaggaaggaggatcccttggacccagctcaagcaaggttacagtgagctatgatcacgccacaagat

SEQ ID NO: 191760 - DNA, 398 bp, Homo sapiens
acatctaaccagcgtgtggaataatgctcctgaggctagaggtgcacattcttcatcctatcagatgtggtcaggactgctggactggagcagcaagaagggggctctggggtgtctaatgtgatttttcaggcctcagtgtgaagtggatgaaatatttctctggattatctgctctgtatactcaccaaatagccttctgttgacttacatgtcttctcaggtacctgaccttgggaacacagggctatgaataagtaatgaatggaatggttgctggcatgtatggtcactccattgaaaattactacacaaatattttgatctataagttcatctcttgttggtcagtgaccaccaatccgacgagctctaggtgtaatgacaaattaaatgtg

SEQ ID NO: 191761 - DNA, 780 bp, Homo sapiens
agcggaggaggggaaatggtcaaagagcgatgggcccagaaaagggtcggacccagatggagatgccactggctgctagcagacccccacgctgggtctagcccacccaatcccatggggatgctcctgtgctctgcagacatctgggtgctgccacaggggcccgacagagttggcatctgggtggatctgagccaagtggtgcttctgggcctcagcaagttgctggtgctgattctgggcagccaactgtggcagcatcttcaggtgcgagtgctgctgggtgaagctgcgtgggcagtccagaaagtgacgtgacagtccacagggaccgacgtagggtttccagcccctatctgtgcagatgctgtcctccaaaccatcacggtccctctctggctggggacgtgcgcctgccactgctggcttgccagcatgatcattggttgtgacctgttgagcccatcttgccagcctcacaaaggacagtactagctgcttatgacaggaaagtggaagaacttggcctggatatttctggagaattaccgtgtgtgctagtcagtctttcgtgtcaaccaggccaggctgtggggcccagtgatctcatcgagaggggccgaggtgttgctgtgatcgtgtgctgctggaatgtggtgaacacctacagtcgatttcacctaaagatcatccttgagaatgtgggtgggcctcatcctatcagctgaaagctttaagagcaaaacccgaggtgtcccagagagggaattctgccttgag

SEQ ID NO: 191762 - DNA, 616 bp, Homo sapiens
  misc_feature (45)..(45): n is a, c, g, or t
gtgttcatgcagtctttcgtgtcacccaggccaggctgtggggcncagtgatctcatcgagaggggccgaggtgttgctgtgatcgtgtgctgctggaatgtgcatgaacacccactgggtgaagctgcgtgggcagtccagaaagtgacgtgacagtccacagggaccgacgtagggtttccagcccctatctgtgcagatgctgtcctccaaaccatcacggtccctctctggctggggacgtgcgcctgccactgctggcttgccagcatgatcattggttgtgacctgttgagcccatcttgccagcctcacaaaggacagtactagctgcttatgacaggaaagtggaagaacttggcctggatatttctggagaattaccgtgtgtgctagtcagtctttcgtgtcaaccaggccaggctgtggggcccagtgatctcatcgagaggggccgaggtgttgctgtgatcgtgtgctgctggaatgtggtgaacacctacagtcgatttcacctaaagatcatccttgagaatgtgggtgggcctcatcctatcagctgaaagctttaagagcaaaacccgaggtgtcccagagagggaattctgccttgag

SEQ ID NO: 191763 - DNA, 412 bp, Homo sapiens
cccccaaattacctttacaggcccagcatccaattcagtcgccttcaaggagtctcttcagtctaatttattctagaacaattcttcaggcttcccttctctggccaagatttttgaaaaatacaggtcaatgactttgtaggttgtcttcagtttggatttgtctgctgtgtcctcatgatttatgcatctctggcaggaataccacagaaacgatgcgacattcttctcagtgtaccatattaggagtcacacaatgtcaacttgtcccattactgctgatgttaatgtttaccacttggctaagatgatgtctgccaggtttctccactggaaagttaacagtatttagtacgtgttaagtgatgagtaatgaataaatatttcatagggagatgttctgagagtataa

SEQ ID NO: 191764 - DNA, 511 bp, Homo sapiens
gttgtctttctctcattcaggttatgatttcctagttcttttgtctcataagtgatttttattgtgtcctgaatttttttttatattatgagaatttttcttattatttcgtagatggttccctattgatgtgtaacctgagagctgggtgggtgtgcgtgtttatcttcctgatgggagaagactgggcgcatcttcgtcccatcagacaagctgacctaggctgacaccttcactcaggcaaacagcaaatctcacagttggaaaaccaaccctcgcttggccctgccccggggcttaatcggcctattctccccctgcctcctcttgccctcccacctactgctctcctccataccctgaaaggatgcattatcttcctccagctcctgctcccaggaccttcgcctcaagccttggcacagtcaaagcgcacccagggtgggaaatttccaaacagtgcaggagggcggccagcggagcccactcactctccttgtgaaacctcgcg

SEQ ID NO: 191765 - DNA, 290 bp, Homo sapiens
gttgtctttctctcattcaggttatgatttcctagttcttttgtctcataagtgatttttattgtgtcctgaatttttttttatattatgagaatttttcttattatttcgtagatggttccctattgatgtgtaacctgagagctgggtgggtgtgcgtgtttatcttcctgatgggagcacgcagtcttcttcccatcagacaagggcttctggaatttgtcgatatcacagccaccaaccacactaacgagattcaagattatttgcaacagctgatgggacgaaga

SEQ ID NO: 191766 - DNA, 426 bp, Homo sapiens
tgactcagggatccattgtttcattccttcattttagagtccttttcttcttgtccagggacaaattgaggattttgttggggcctggcctggatgtggaggaagatcatttttgccttcattccattgttcagacctagttataggttctaacctaactgcttgggaggctgggaagtttaactttctttatgctcagaagaaggacatgggattaatagccatatgggcaatctttgctacagtaaatttaaattataaattgatagaagttaactagttaccatgaaaaatgtgcttaactgagtgaaacattggaaaacattgggatagagcagttttctaaaatcttacctctaagattatttctagttcaaacaatacaattattgtgttctgtatgcctttaattggtggaagtgagta

SEQ ID NO: 191767 - DNA, 241 bp, Homo sapiens
ctcataataaccctatgagagaggtataatcctgggaacttcaatactggaggcttacaaggtctctggagccatgcccattcctgtccccactaaaggcttgttcagttcaactctgcctgcattgggaaagctatcttacattcattccagcaccttctgtacttaaatctatcagtttcctgtcacttgtggccaaaaaaaaagataactgatatagaaatgagcactagaaaataaa

SEQ ID NO: 191768 - DNA, 398 bp, Homo sapiens
ttctcaccttccttattcttagggttcacccaaacatatcaaggcttccaaacagaactattggaaagctgcctcttttctcagcacttgtgctgcatggccatctcgtcccgcttcgggagctgggggaattaagcctaggggcagcttccagtcctggggtgtagcttgggacatgtgctttttcctgtaggcttggccttccacaaggaagaggaagagtaaaacttggcagaatatccacatttcccccaaatccaaaagcaaaataaaataccatgtgaacctagtcactgatggatcctgttaagtttcagcagttatatgctaacagctccagaagacttctggcatttgcaggggtgtgtgtgtgtgtgtgtgtgtgtgtgtgtgtgtgt

SEQ ID NO: 191769 - DNA, 381 bp, Homo sapiens
cagccaggaccacaggaatgcaccaccatgccccgttaatttttctatttttttgtagagaagaggtttcaccatgttgcctaggctgttctcgaactcctggactcaagcactcctcctgtcttggcttcccaaagtgctgggattacgagcgtgagcctacacatacattatttaatgccagccacaaatctattaaagtgctattattattgccattttaagatgagaaaactgagttacagtcaaaccaagtaacttgccccaggttacaaaaatgaagctaggatctgaatccagggcccatgctcttaaaccaccacaatccacagaccgtatttcttgccattcccagggatcccctgggttctctgcaagtcc

SEQ ID NO: 191770 - DNA, 552 bp, Homo sapiens
ctcaacctgtattgcttcctttctctccataatgaactcatgttccaaaacatggaaacagtttttggaacattatattccaaaaacagataattggaagagacagttggccaataaagatgaaagcataggccaggcgcggtggctcacgcctgtaatcccagcactttggggggccaaggtggacagatcacctgaggttgggagttcgagaccagcctgaccaacatggagaaaccctgtctctactaaaaatacaaaattagctgggtgtggtggcacatgcctgtaatcccagctacttgggaggctgaggcaggagaatcactggaacccaggaggtggaggttgcggtgagctaagattgcaccattgcagtccggcctgggcaataagagtgaaactccatctctacaaaaacaaaaaacataaaaaaaaggaggcaaaggctgtttaaactactcttgataaagtctttacgaagaaataaaaaaactttaagaccgggcacagtggctcacgcccataatccgagcgctctgggaggccaag

SEQ ID NO: 191771 - DNA, 455 bp, Homo sapiens
gaaaggacacatcattcccccagtgccagtccaggttcctggaacgtacacagtctccattgacagtgtgagagggggagggtcaccactgatttttaaaatctcattttaatatttcagatatttccaattataagtaactttaatacttcatatgtttacttttttggttatatttcttttagatctacagatatatttagttttttcatactagttttaacaaagctcagagcttacaattttgtctggtgttgtagcgtcacatttgagaactgctaatttgcttttcagatgtgagaagaagagaataattgcaaagtgtgctgtagatgaaagagtttaatgcttttgtagatattttgtgaaaagcagtgaaagtataggtctggttttttaaaaaatggaaatagatggtgcttacattcctacttgattcttcaatttataacaac

SEQ ID NO: 191772 - DNA, 267 bp, Homo sapiens
cttgctaaaggtgtttaatttaagctgagcttagttatagtagacaatcagacaaatccagtttgtgggactttctacaagacagttggcctgaactctaaaaatttcaaagtggtgaaaacgaaacgaaacaaaaagggcaggaagactgttctagatgaaagaagttgaaagagaaatgacagtcaagtacagtgtcaagcctggattaagaaaacaaaaaaccatagaggacattttggggataactgggaaaatttgaatatg

SEQ ID NO: 191773 - DNA, 470 bp, Homo sapiens
ggtctctaatgttaaagacgctcctaagactgcagttgctatcaggagttacagacgacgccgaccacaacacggcgctcttttccatcatgacacccagagcctgttgtttcaacgacaaccaagtgagcatttgttttcaaatacttggcaggggcagaggaagacaatcgtttactcattcagcaaccgtttcctgatcaacctcctgtgtgatggcagctcctacatggatccccttggactaatctcctctgcagtgtccacacagcaggacctgctggcagggccagaccacaaggctgacaccctccagctcctccgtgcgggcgggaattctcagatgtgcaaatggaggagatgagggcaggcggaggaggggctgctaatctgaagaaagggagaggagacgctggcttggggcttgcacacaccggaacaaatagacacacacacacagacacacacag

SEQ ID NO: 191774 - DNA, 155 bp, Homo sapiens
tttgaggctgcagtgagctatgattgcattgctatactccagactgggtgacaatgagaccctgcctgtaaaaaacagaaacaaaaatatcacaaacaaaaaaacaaagcacacattgttttgtgtataaaattatttaaagtgttggccgcaag

SEQ ID NO: 191775 - DNA, 192 bp, Homo sapiens
caacataatttcactgcttcatgtttactattctgtatcagtttacaaactaaaattaaactgacacacacttaacagaattcccgacaacacaataacattaccatacaaaagataataccaaggttgttatgagttatctagttctctgttacttccttaatgctgtaaactacaaatcagaaccccaaa

SEQ ID NO: 191776 - DNA, 404 bp, Homo sapiens
tatctgttcagcatgtatgagaatttaggccattaacaggtaaatgttaggtccacattatggtaggtccacagtatggatttgctgaataagtgcatgaatagtaagtaggtaaatgaagcttacttgcattgttaccagtcatttttattgttgctgtcatagctagttttagttctttttagctaaaaaaattactgaaacattgtaaaattttatctattaaaaagtggtaaaatatgatttcaactgagagagttcagagtcatcattgcactacacttgctatgctaacaaaaatcaaaataatgagaaatacattgagcagaagatctgtaaaatctttacactgaaaattacaaaacaaatccaaatacatagagagatatactttgtttatacat

SEQ ID NO: 191777 - DNA, 517 bp, Homo sapiens
cggaaactggctcactagatgttaaatctgcagaggaaactaaattgggaggtgttgcaaacaccaaagatggttaagtgcaaacagtcacattaaaaataagatgccagttagaaaaaatgcaaatatatacagagaaaaataatctgtagctgacaattcagtaagtgaaaaaaggaaaaattctgaagggtaaaagaggacaggtgctaggaggggctcactgcaagagtgaaagtcaggaacagcaggaaggaaaactgaattcaacccagaaaacaatatcaactccacacatgcagaaaaggcaaatcagatatgaggagataaaaatccaggaaaaggggaactccccagaaaaaggaaagggtgctagagagatctggactattaccaaagacttgatttgctggcaaaacaaacaaacaaacaaacaaacacaacaaacaaactaactaacacacccaatttccccttctgggatgtaatcaggagttatcactatagtttttttgaa

SEQ ID NO: 191778 - DNA, 657 bp, Homo sapiens
actccagctcagggcaacaacaatgtgggactccgtctcaaaaatataataaaagaaaagaaaataggctttactggctcacagttctgcatggtatacagaagtgtagtaccagaatcttctcctggtgcggcctcaggaagcttacaatcatggtgaaggcgaaggcgaaaaaggtgaatcacacagcaagagtaggagcaacagagagaagtggtggaggtcccagacttttaaacaaccagatctcatgtgaactaattgagcaagaactcacttaccaccaaggggatggtgctaaaccattcatgagggatccaccccatgatcccgtcacctcccgccaggccccacctccaacactgggagtcccatttcagcatgagatttggaggggacagacatccaaaccatattaagagtcatagtacaagaaacagaaaaacagaaggccaagtattgcacaatattgaacaatcttaagtaacctctaaaataactttaaaaagattgaaacaattttaaaaagaatggaaactataatgaaagaacaagatagtaccaaaaaatacaaatttataaaataagcatagagcaatgtactcaatgaaataaaaagcttaatagtggcataaaatgaaagagggaaaagtgata

SEQ ID NO: 191779 - DNA, 632 bp, Homo sapiens
actccagctcagggcaacaacaatgtgggactccgtctcaaaaatataataaaagaaaagaaaataggctttactggctcacagttctgcatggtatacagaagtgtagtaccagaatcttctcctggtgcggcctcaggaagcttacaatcatggtgaaggcgaaggcgaaaaaggtgaatcacacagcaagagtaggagcaacagagagaagtggtggaggtcccagacttttaaacaaccagatctcatgtgaactaattgagcaagaactcacttaccaccaaggggatggtgctaaaccattcatgagggatccaccccatgatcccgtcacctcccgccaggccccacctccaacactgggagtcccatttcagcatgtaatgttcgcggcaactcacatcagacgcatatcaagagttattgacctcgaatacaggacaccgggacgcgactactgcctggcccgactctggcctatgctcgcgggaccgtataacaattattaatctacagagactggctctggaactctatttaggaccgaatatggtagctgacaatatagaacaagtttggtccacaaaagctatagcctgtttacggtacagtcttcgcgcatgtcgtaa

SEQ ID NO: 191780 - DNA, 265 bp, Homo sapiens
agttatactgttgatacttttctttcagacacaagcatttatcaggtatctggttcatcttcaaactcaaaaaaaaaaatttatagaaacccctatgtagtctggtaagtccttcactcaaccattctttttaatatatggagatggagtctcgttctgtcacccagactggagtgcagtggcatgatctcagctcactacaacctctgcctcccgcgttcacgagattctcctgcctcagcctcctgagtagctgggattacag

SEQ ID NO: 191781 - DNA, 147 bp, Homo sapiens
tactttgaaaaacttcttaccacaaactgaaacataaaatgctacatatgattatgcccaacatttgctttttcaatatcctttacgtttttctgactacagcgaagaagtaactttggttaatctctttttagtttctacttacac

SEQ ID NO: 191782 - DNA, 126 bp, Homo sapiens
taaaacccttgtcaaaataataatcaagccattcatgagctgcctgtcaataccatgcttgtttttcgagccacagcttggggcaaggctccccgctaaattccttccatgattaggtgagaatta

SEQ ID NO: 191783 - DNA, 683 bp, Homo sapiens
cttttgtatgtatcctttataaaggtaaaagcttattgaatgttgatggtagtagcggtagcagaagagctgagttaaagcatgtatttaacactcaaagtgaaaatacagtatgtgtaagtcaaaagtaaccacctatagcaagagttattaatctggatttagttttgggctccttattggactttagtggattcagtaaacttttgaaatgataagccataagttgtgtggatatgtatatgcacaatattttttattagaaactcaatgttttcattagattttcaaaggcaatcgtaatcctgaaaggtaaagaaccattgctctatagaataaaggtaactgtaatgtattaaacatgttctaggagccaactacctattcagtattttcattatactaatttaatctatataatccttgtgaggggaggactctcatcaccattgtacagattaaaaaccatggctcaaacaggttaagcgacttatccaagcttagtaaatgatgggcttgggattccaggtcagctatgtttgactccaaaggtctttctgctgcaccatatgtatcagtcaggattcttagttgaaagctacaatactcaattatgctcatttaagcaaaaaggaaactgcactgggatgataccacagctcaaaaaacttacgggaagagcg

SEQ ID NO: 191784 - DNA, 193 bp, Homo sapiens
gatttggagcattttaccacccagtggaagactatgaaaactttgctactgattcatgcatttctaaaggttttccagtggagacacagagtaagggctgaaaggtagggacaaacatatggactgacttaagaggtccagtgaccccaatgagcagccatagtacatttaaattatttggggtggtaaagat

SEQ ID NO: 191785 - DNA, 515 bp, Homo sapiens
ggcaagtctctgaatttgtttttgaaattagtcttgaaagggactaaaaaaggtagatttaaagggtcagtgaagaaaataccttctccgagattaccttgttccacagagactgaaggctcactgtgttgaaggcatcatctacctctgtgaactctgctcacaaacattgaaaataaacagtgcacagtgactcatgcttgtactttgggaggctgaggtgaggggatcacttgagccaagagtttgagaccagcctaggtaacatagtgagaccctgtctctatttaaataaaaaataaataaataaaaatttaaaaaaaaagaaatgatcttattccctgaagagcttagtctagtgatagagagggattatagaaatagttccttttattataatcaagtagaagatgtatagggtactgtggaggggaagaagaagggacttgacctgacctaggggttcagagaaggcttcctgccaacacggagctggaaatcttccagtcgaatga

SEQ ID NO: 191786 - DNA, 267 bp, Homo sapiens
aaggcttggcagcacgcaagagaggccatgggcacccaaggaactacaagtgggatgggtcatctgaaacctccctaccaggaagtcaaggactagatggcttcactagaaaatctgacccaacatttaaagaattaaaaccaaaccttgttaaactctcaaaaaatataagaggaaggaatgcttctaaacacattctgtaaggccagcagcatcaccctgaaacaagatcaagccaaagacatcagaagaaaagaggaaagctac

SEQ ID NO: 191787 - DNA, 202 bp, Homo sapiens
agacgccccctctcccaccagagtctatactttgcatcactttagcagtttcaggctgtccttctaaacagtttcagacacttttaacaatttgcaacaaaagtgtaagccgcaaataggatgttacttctcataagtagcacctttctatttctgctatttacaagtagtatttttttttctcttttttcggacatggagt

SEQ ID NO: 191788 - DNA, 442 bp, Homo sapiens
acatggtgaaactctgtctctactgaaaatacaaaaattagctgggcgtggtggcacgcacctgtagtcccagctactcgggaggctgaggcaggagaatcacttgaacccaggtggcggaggttgcagtgagccaagaacatgccactgcattccagcctggcaacacagtgagacttcatctcaaaaaaacaaaaacaaaaaaactataacaatatgaaatagtgtgacattgtgtcgataagtaatggtatagatggacttctggaaatgattaatgtggaatggagtaggaaatgacttgtgatggaaggaggtcctctcctctgctctagagaagtgagtaggaggcagaagcaggaaggcattcctttgccctgaccaccactagaaaaaagataaatgaccgctgggcagggtggcttacgcctgtaatcccagc

SEQ ID NO: 191789 - DNA, 313 bp, Homo sapiens
ggaacaagatctcagaaagaataaagatgaaatgcattctcacacagccaaaggtaagatgcactgacctcttccttctgttaaaaaaacaaaacaaaaaactagccctgattcacacggaagatttttcttgagtcctcatgctttgcttgaaatcacgtcatggggaatgggtagtcggaggagggcaaaggaaaagaaagaagtctgatcgtttatcattctcctccctgggtatcacaaagtccccagaggttcaagtggacatggagagggaagagagaataagggtggggcagggatgtgggtacta

SEQ ID NO: 191790 - DNA, 384 bp, Homo sapiens
tcgatctagaggatcctatcggcgagatgacgactagggaaaacaagctgagaaaaaaaaggaaacaaaaagaagagagaaaatgtaaattctctggcctatagttagctattttctgcattttaacattttctgcataattaacaatgtcaaatccctttttcctgtaagctacggcctttaaggtggaactaagaaattgatagacagataaagaaagcataacatcaaaagaggtattcttctagttttatccctgcattaagatcactgaagataaactaaggatcaaaaagttccacattttcatttccaaaataccttatgactagtacaaatctaccttaattaagaagttactgctcttggcaaaaagaatacctg

SEQ ID NO: 191791 - DNA, 753 bp, Homo sapiens
acatggcaacccagaagtcaggacctagttgacaagaaagttcagaggaacctgagctgggtttggtgaaggacagaatttttgtcacctgacagtaactcatgtaattccactgacattcatgtttgctagatatgggggtgcagcgggtgtgcacaggtcagaaaaaatggaccctggagaaaatttagttttgctggacattagttcccagcagccactttatactatgaaaggataacaacaatttgggtggacaactagctagctgtctgtgccacaaatagagttctgccttccctaatcagtttctgtagctcattattaaaaaatgttttggagaatttcagtgtgaggatggtgattgtctgtctcttggtcaatttaacaatgtttctcatcacttttatggtaaacatgaatctccagtatttgtttacacagcccagcaaattccaatagcagttcttgatagcacccacacaagccgcctttccacttttatctcaattacttaaggtagcctatatactttctttattgttttgcttttagcttttattctaatttaccttcacaagagtacttatggccgtgtaattttgactaaattactttttctcttttgttaacatctcttcatgcaactttagatgccctcttcatctttcactgacggctttattgctgggccctgtttataaccagaccttgtagcattacccaaatatcaaacaattctctttcctttct

SEQ ID NO: 191792 - DNA, 424 bp, Homo sapiens
tgctgcttctcctcctcggaaaaaggcaatattacaagtaagctttttaggaacagtttaaccagttcatgtaaaaccgatcagaaacagcacacgtggctaggtgtggtggctcacacttataatcccagcactttcaggaggctgaggcagatcgcacaaggccggttgaagactagcctgagaaacatagggagactatctataaacaatttttaaaattagccaggtgtggtggcacatgcctatagtcccagctactcgggaggctgaagcagaaggattgcttgagcctagaagttcaaagctgcagtgagctatgatcgctgcattccagactaggtgacagagtgagactgtctctcaaaagaggggaaaaagaagacaaaaaggcacacatctgtgtgttctgatacggttttga

SEQ ID NO: 191793 - DNA, 431 bp, Homo sapiens
cacacgtacctcagaacttaaaaaaaaattaaaaataatttttaaaaaagaacagttatcccaaataacaattttaagaaattaaaaattgtatcatcagccgggcatggtggctcacacctgtaatcccagcactttgggaggctgaagtgggtgtatcacctgaggtcaggagttcaagactagcctgagaaacatagggagactatctataaacaatttttaaaattagccaggtgtggtggcacatgcctatagtcccagctactcgggaggctgaagcagaaggattgcttgagcctagttcacacctagcctgggcaacatagcgagacctcatctataaaaatttttaaatatcaaatttataaagtattcaaaaataatataatcaatatatcaataatgttttcactgatttttcaaggcag

SEQ ID NO: 191794 - DNA, 320 bp, Homo sapiens
ctcacaatagcactacacaagctcacaatagcaccacacaagctcacaacagcaccacacaagctcacaacagcgccgcacagctcccaacagcgccgcacagctcccaacagcaccacgcagctcccaacagcaccacacaagctcacaacagcgccgcacagtcccaacggcgccacacaagctcacaacggcaccacgcagctcacaatggcaccacagaagctcacaacagccaactgcgggcttgacattgctttgttttgtttgctttctagctttcctttattctgtttctgctgtctttcctggaccagcaa

SEQ ID NO: 191795 - DNA, 390 bp, Homo sapiens
tgtccacgtgacttactgcttcttgtcatttagatctcaactctaattgtcccctgacttctatcagtagtgctccatcacaccatcttacttttcctaaggcttaccactatctgaaaatagcctgcgtttctctattttcccctcagtaagaattaaaagttcatactagggcccatttcctagcagtgtttggcacatagtaagtatgctgaaaaaaaaaaaccttgactgactgaataaatgaacaaataaactcacttttaatgagatatcaaggttttatattaattacatgagccaagaattgtggtttcatttttaaaatgtgaggacctactggtttaatccttcatacttcacacatatgcttgtgctggaactatgact

SEQ ID NO: 191796 - DNA, 495 bp, Homo sapiens
tacattataccttgttgagagcagatctcttcttttaaataaccatagttaataaaaattgaacatatattaggcaacaaaaaaaccctttaaattccaaaaattgcaaatagcagactacatttttcgaatcacgatgccataaaaactaaattattatttaccaaaacaaaagtaaccctccttcaactgtgcagaatataaaaattcccttggctgggtgccgtggctcacgcctgtaatcccagcactttgggaggctgaggcaggtggatcatgagatgaggagttcaagaccagcctggccaacatggtgaaaacccatctctactaaaaatacaaaaattagtcaggcgtggtggtgcatgcctgtaatcccagctactcaggatgctaacacaggagaattgcttgaacctgggaggtggaggttgcagtgaccccaggttgagccactgcactccagcatgggtgacagagcaacactctgtctcg

SEQ ID NO: 191797 - DNA, 297 bp, Homo sapiens
tcaaaatgtttttaaagaaacttaatgaaatgcaagggaaatctgaaaacccatacaaagaagtcagaaaattaatttaggatatgaatgagaaatttaccaaggaaatagatatcttttcgtaaaaccaaacagaactttatggcaatgaaaaattcattgaagaaattttggaatgcatttgaaagcctcaagtatagatcagccaaggcagaagaaataatcttttaaattaacctagtgagacaaaaataatatataagactgaagaaggcctttgaaacatacgagactaca

SEQ ID NO: 191798 - DNA, 476 bp, Homo sapiens
atctggttacttcaccagctctgtgtgttctctagcaatttcacaatcactatgcaggagtcactgaggcctcgaatctgctttgcagtcttcatcccaaattctgccaccctgaatgttttcaagcatggccttacagttggacttgatgtttttcaaatctgtatgcacttccacttcaaccacacattcctcccttgtgatcatgctcaaaactctaatatcctgtcttattataacttcacattttccagttttcttactctctaccactaaacttttttttttttttaatgtacagtgtcttgctttgtcacccatgctggagtgtagtggtgccatcatggttcactgcagccttgaactcctggcctcaagcgatcatctttatatctcagctgggactgagtagctgggactacaggcgtgcaccactgcccccagctaattttcttcttttttgtagagacaagggt

SEQ ID NO: 191799 - DNA, 1013 bp, Homo sapiens
cacgccatcaccctaaatttattatggatgatatttctgtcacaaagaaaacttcaaaggctgagatcgcagaaatgtctcagttgacaagccactgacttgagttctgtgattgaaatgtactccaaggtcagcaaaccaaaaccaaacatcactggatgataatacgttcagtgtctcactggctataattcgtagatcacctttcaaagcattatatctttattaatcattgtaaatttgtgcttttgaaatcttagactcgtttccattaggcaatgaagcccagaagcttaatgttctagtctcattttaattttttcagtcttatgtgctgaattgtcagggtttaaaaatcgatttcacctcatcagattaaaaatatttatttatgcacatgttaacaatatattaaaagaaatgagagcttcaattttaaaaataggaattgtagctcattaagccatgacaatttggtttatatttacataattaataggaaggcatttatatgtttgcaaaataggtaagaaaaggtatttaacgtagatgaagcagaatgattgtttatcaaaagagtttagagatctttctagcagtctacccatggaaagttaggatctagaaaagccttctcaataagggaagaaacaacaaagaaacaacaaccaggaaactccccaacttatctctttaaattccagcctcttttctaagtggtggtttttacatactgtcctctggtaggtgggtaccctggccttgtgtattaagcagtgagggtggtttaaaggttacaaatgtgatcctgtcagattgacaactaactgttctaatgaggaaaaaatcctcaaagcatgaaatttgaatgaaatgtgtgattataattcaagtactgtttacacaaacctctggggaccttccgaataaatgcagagcaagtgagttagacaaacctctgggccttcgatacgtgtgtgtggatgtgcggtgtgtgtgtgtttattttagag

SEQ ID NO: 191800 - DNA, 673 bp, Homo sapiens
tcattatatacacttgtagcagatctaggatcaccatacttccgttgtatcaccctgcttccctcacttataacaacttttgggtaacagatactgtaaaattttttcccagattgtcattgccttttaaatttgttatttttacccaacaaagattttaacatgtatatagtcaaatttcttatttccttttccttatgaaataatctcactacatgaaattttattaaatacatgcctatcatatttgtgatttaaatttttacatacaagtgtgttaattgatttttttttttagaatgtatttagtcatatatagcctgctgtgtcagtttattgtgtaactcttcggagtttttactttcctttttttttactttttgtgaaacagggtttcactttgtcctccaggctggagtgcagtggggggatctccattcactgcagcctcgatctcgtgggctcaagccatcctcccgcctcagtcccccaagtagttgggaatacagggcacatgccaccaggcccagttaattttttcgtgttttgggtaaagatggggttcaccgtgttgccaggccggtctcaagttcctgagctcaagctatctacctgcctgagactcccaaagtgctgtgattacaggcgtgagccacggctcctggcccagagt

SEQ ID NO: 191801 - DNA, 199 bp, Homo sapiens
tcccgtttccttcatacagaatctgggtctctgggctcctgattgccttgtttggagtcccgttccatgggccttccctcttccatggttgcctttcccaagtctattctgctatgtctgtttttgaagacatccttctgtctcccttaacctgaggcacttccttcgtagtcaagcggctgtcttgttcgttccattt

SEQ ID NO: 191802 - DNA, 353 bp, Homo sapiens
atgagagagaagatatgaagaaacttctgctttaatgactttacaaagctggcatattacaatccttgacctcagtgaaagcagtcatcttcagcgttttccagccctatagccaccccaagtgtgaattctgtctgtcattggccttgggctccgtttgctctgcatcccgcatgtgaacactgaccggggcctgtttccctcctactgctccatctccaagagcagcatgacagtcacacattgctcaagctagaaatgtgacagtatctcagtctgtcctctcccttccatgtcatatctaagcagccagggagtcctgtctatcccaaggcacgcctcctgtccctttc

SEQ ID NO: 191803 - DNA, 305 bp, Homo sapiens
ctaattttgtatttttagtagagacagggtttcaccatgctggccaggctggtctcaaactactgacctcagatgatccgcccccctcagcctcccaaagtgctgcgattacaagcatgagccactacacctggcctagaatctcatttgatcctcacaacttcacaaaactgtgagctgagaatgtttggtcagggcatggagccttagtgcatctgaagttcttaaaattttgcaaagaagctcagagaagctgatttacctgcccaaggatattgagtggcagtcccaggattcatcacagg

SEQ ID NO: 191804 - DNA, 216 bp, Homo sapiens
gagctcggtacccaatcagtttacacaaaatactcagtgcagttttaaactatgcaaattagtacaccccagagcatgccaaggcaccagccttagaaatgtgtgccctgtgaccctgcatccacacctgggaatttgtcctatggaaataatcagtagttgcccaagaatgtatttatttggatagtcttcacagtgttgattgtgaaactgaaa

SEQ ID NO: 191805 - DNA, 472 bp, Homo sapiens
aggcgtgagcgcacgatggcgcgtccaacagatggaaattcctactttgcctcttggcatgcatacccagcctcttttctaaatgggtctcagtgattgtccaatgtgtgccccaaatcagatgaaatacaatcatcagatgcaaagcaggaaggtggtagatgacggacagtatgtaagtcggtctttgctgctagtggctttacttcatccttgagaaaatcatctttggtaaagtcataagtgttgaaactcgaaactagggtttaccctagacccacccattggccaaccttaatgggcacactgactttttaagagtgtgaaagttattagctaaatgacttgttccatggccccattatatcacagacatgttgatgtctctgttatcaaaagacgtgcaaaacaccccaaaatcgttgatgacattaacaggtaaaatgacagggcgcgccatcgtaacacagaa

SEQ ID NO: 191806 - DNA, 509 bp, Homo sapiens
agtaacccaagtttccaccaacagaggaatgaatggctaggcaaaatgtggtgcatacacacagtgaatgttactcatccttaaaaaggaaaggaatcctgcagtatgctgccacatggatgagccttaaggccattatgctaaatgaaatgagtcagtcacaaaaagacaaattctgtgtgattccacttatatgaggcacttagggtagtcaaaatcatagagacaggaagtagaatggtggttgccagaggctgggggaggaaggcatgagagttattgtttgtgggtatggaatttcgtttgacaagatgaagagttctggaaatggatggtggtgctagttgcacaacattgtaagtgtattcaataatattgctgagctgtacactttgataaattttgttatgtgtattttaccacaattaaaaaaataaaaacaaaaccaaacccttatgcgtggggaaaacaaatgactggatggaaataaaacaaaagcttatagtaat

SEQ ID NO: 191807 - DNA, 112 bp, Homo sapiens
tgttccaggctctttcgaatgaaacagaacaaattatattgtttgaatcataaaacatctagagaaaaatttcagtggaatctctgatccacgatgcctcaggggtctgggt

SEQ ID NO: 191808 - DNA, 287 bp, Homo sapiens
attccccaacaagagtacttctattcccctttcctaatttttttttaccatagcacttgttgaaaacaaacataatacatatgcatttttaacttatttgtggtctttctctctctaccccttgaagttaaaactctgtgataccagagactttgtgttcttcaatattctattcccagtgcataaagtcatgcttaaacattcagcaagtatttgttaattgatctgaatttcatcataactgttctcatgcaatttcatactttctgttctttttgggcactctt

SEQ ID NO: 191809 - DNA, 124 bp, Homo sapiens
ctgttgtgttaacaaatcacccaaaaacttactggcttgaaacaacaattatttcttttttctcatgaattctgtaggtcaagaaattcagaaacacctcatttgggtggctgtagcttggggt

SEQ ID NO: 191810 - DNA, 336 bp, Homo sapiens
actcactcgcctggctcccaaagcacgaccactgtcagagaaaaaggttgaatgttaaaaaggatcctcagtcccaaagagagagaggcgaggatgtaaaatgcagcattgtccgtcacagggcaaaactggaaacagtccaaatggctgtcagtggatgggttaaatgaactatggttcatccatacaatccaatactatgtagctgctctgaaaaacgaggtgaggccgggcacggtggctcacacctgtaatcccagcactttgggaggcagggggatcacttgagcccaggagttttgagaccagcctgggcaacatagcaagatgccgtct

SEQ ID NO: 191811 - DNA, 126 bp, Homo sapiens
tggtcactatacatgccagccatactgaacatttttcagttttctgaaaacatacttttccttctgtaagaagcagaacttccagaaaagactcaactgtgttactgtttaaagacagctgaagca

SEQ ID NO: 191812 - DNA, 379 bp, Homo sapiens
tcccgagtagctgggactacaggcgcccgccaccacacccggataatttcttttgtatttttagtagagacggggttttgccatgttggctaggctggtctcaaactcctgacctctggtgatccgcccacctcagcttcccaaagtactgggattataggcttgaactactgcacccagagtacagtgattctgttaaaacataagtcaatcacatcactcctctgctcaagatcgtcaatggttctccatttctctggagtaaaagatacactttttttttttaatttttttgagacggagtctccctctgtcgcccaggctggagtaagtggcgtgatcttggctcactgcaacctccacctccagggttcaagca

SEQ ID NO: 191813 - DNA, 442 bp, Homo sapiens
tagtggacgttggcatgtgctgtaggccagcgtagtaaatgctaatctcataatttcagagccagtttgaggagctctgggtttgacagcttaaagattttcattggcgtgtgtaaaacagcatctgccagcggtctctacctctgctacaggggcctcactgggggctggggctgccccaacttatatgcactgtaaaccagccagagctctaagatacgcagaaacattgcttccaagaacggtttcttagaaaacagtactccctctatacctaggcacagaaactaaaaaaataataattctcataccaaaaccttgaaaagctttatgttctcttcaagccctgcggagcacacgggtttgaaccaatcccccatatcagccccgcagaagccaagcctcagccgctggcctacagcacatgcagtgtcggctgagt

SEQ ID NO: 191814 - DNA, 637 bp, Homo sapiens
ctccaggagtaatgtggaatgtagcaaaatgtaaccagtggactcggtgtctagctagggagatacccaggaaggatattgaaagtgccaaaatgtgtatcttttagttacccaagataaagtacaggaagaaagcaataacctaaagaagaaactacagtagtcccctctgtccccagtttccctttctgcagtttcagttaccagcagtcaaccacagtccaaaaatattaaatggaaaattccaggaataaacaattcataagttttaaattgcgtgccgttctgagtagcgtgatgaaatctcatcctgcctgggacatgaaccattcctttgtccagcggatccatgctatctacgatgatcacccattagtcacttagcagacctctccatgatcagatcaactgtctgtcaggtaatgcagtgcttgtgttcaagtcacccgtattttacttaacaatggccgcaaaggacaggagtagtgatgctggcaatttggatgtgccaaagagaagctgtaaagtgcttcctttaagtgagaaggtgaaaattctcaacttaataaagaaggaaaaaattcatatgccaaagttgctaaggtctatggtaaggatgcatcctctatccaaaaat

SEQ ID NO: 191815 - DNA, 329 bp, Homo sapiens
ctctcatactgtcatgccttcccacttagaagtgcccatgccctgctcagctgtgactctactgacctcaggacctcactggacaagtcatgtggtaacccttgcaggagacctgataatggtgaaatgattctattgttatattatttatggagcaacaactttgtacagagaacgagctgcttggctttttcttccaatgccgaggatgctgctgatgctgccatgtaacagcatacttttgggtgtcctcaaggatagaacttcccctctgaataatggaaattagaacaatgaacttcacaggggaataaatattaattactgat

SEQ ID NO: 191816 - DNA, 464 bp, Homo sapiens
atgtgtgtgtgtgtgtgtgtgtgtgtgtgtgtgtgtgtgtatatatatatacacacacacatatatatttgagacagggtttccatatgttgcccaggctggtcttcaacttctgggctcaagtgatcctcccacctgggcctcccaaagtgttgggattgcaggtgtgaaccaccactcccagcctgttgtttcttaagcttctaaccaccaatctcccctttcactctacacgtgccctaactaatctcagctactcctgagcttcaacttctacctgcacactgataatctcagtctgtctctctcttgcttgcctatttctcctgaaggccagtccagtacatccaaaaacttactgaaaatttccaccgggattatctaaaagcaccctaaacatctaaaatggaatctgttatctttgttacatcataatctcacaaattcttctaaatttcctattt

SEQ ID NO: 191817 - DNA, 396 bp, Homo sapiens
atggcgcatgcttgcttcccaaagctaaggagggctctgtgcaggcgggcagcccaccctaagggaagaatcatgggaaagagatggggaactgcgacatgaagaagttaacttacctaagatcagagaatgagtcaaggacagaacaggaccatgtcatcaaatttagagaaacttgaactatgcagaaaagagatgggattcttctgtggctgtgctgctcactcaagggagtctgaaccattttgaccaggaaaagccaaaggaaaggccactgccaagggcagaccacacattgcctgaagtcattgttctccattccagccccaagaactctgcgagatcgatgaaagcatacattgagaaataaaagtcatgagaaaattttacaaatta

SEQ ID NO: 191818 - DNA, 309 bp, Homo sapiens
gcataggttcttagcttccccgccgagttggtttaggattgtcttcatcaagtcacccgtctgttatggctcaacctttattctccactttatgaaaatttttttgtcacctcttcccccattctctccatcttcttaaaacaatctctttgctgcagtttcagtagggctttgagaggggtctagatttgacatctgtgttcagttcgccccctttgctagaactccaggacactttctatgtgtgtgttttcctatcttctcaagcagaatacctttccctgtgctttcctcgcctcccctgttcta

SEQ ID NO: 191819 - DNA, 277 bp, Homo sapiens
ctttgcctagacagagagctgctgcttggagaaagagaaatcaaaaaagctttcagcagttgtattggatgaagtgagaaatggagacttcaggggcctcaagtaagtggccatttttttctcagaagagacttggtgaactctgacactttgcagaaggctggagaaccaggtcaaaggcttccaaaaagcaaagtgaaagtccccatagtttcacagtgcttgggaaactagagagagaaactgacaacaggcaagagatgccctagggggagtg

SEQ ID NO: 191820 - DNA, 315 bp, Homo sapiens
atccttctgtaatatggaatatgcgtcatactctggcagagccgaacacatgaggtggcagagcttccccaggggagcatgtggcttcagagggtcaaccgggactaggtggacggaagctcgggacaggttcctggtcagaaggagctccgagaaagctgccgggtatgtgcaggctgacctgctgcccaggagaggcttcttagagcaggtctggggaatagcctgcccaccccaggggtcaaaggtcaaggagtatggctgtaataagctattctatagttgtattcccagtatgctgtgggctactagaga

SEQ ID NO: 191821 - DNA, 246 bp, Homo sapiens
gcctctgcttgcatccaagcccctttgattaactggacatgatatccagttaaccaatccagaaatcagcagatatccaattaatcaaagcaaatcatttcacagagctccaaatcaagaatcagagaagtgtacttctcccacagaggtggcgaggagagaatgaatattgaacaataatctgccacaagggtttgtttttttttttacattccaattctttgaaaacgggtcacctgaatttaa

SEQ ID NO: 191822 - DNA, 281 bp, Homo sapiens
gctgatttcaacattcatatggatgattccacttatatctctagcccagtggtttttgacctgcaatcacttgaaaaagtttttaaaagtactgatgcttgggaccaactcaaatgaattgaatctgaatctctggggatgtggcctgaacactatagtacaactagaatcttccagctctcacacttccctactgtagtgcctcttccatttcattacaactccatatttttaaccctatcactattaagatgtattagcagtagcccatcattttgttt

SEQ ID NO: 191823 - DNA, 157 bp, Homo sapiens
cctgcttcagcctcctgagtagctgggacaataggcacttgccatcacatccagctcaaattaactttctgtctccttataagtatactgtagggattaagcgagatgaggaatggaaagcattctgaaatgtaaaaatacacattgactttggcct

SEQ ID NO: 191824 - DNA, 347 bp, Homo sapiens
gtattagggtagatgagattactagcaaaacttctttatctagaatcattcatcaggttggaaatagtacataaaccttaaaatatcatcatattaaaatatcatcatgttatttttcctagtcattaaaaacattaccattcaacaatgtatactaaaatttcttggacaaagaaaatgattttaaatatggaatgcatccctcccatttcattcatgtactggtctcattaaacagagaggagcttttccattctgctccaacacaagcccatggggaaaatgatatttgaagagttaactgagagaggcccaaggtttaccaccaaaaatgacctaacaatgta

SEQ ID NO: 191825 - DNA, 557 bp, Homo sapiens
accttcaaaatacatccagaagccagtcacttcccaccacttccactgccactctgggccgtgccccaccatcttttgcctggattgatcactgcaactgcctcctaatgggcctctctgattctgtcctttcccctgcccagtcttgtccacagagcagctggagagcttttaagtcagatcatgcctcaccttcttcagggccctacaatggcttctcatctcatgcagagtaacggcccgagtccctacaatgcccctgcaagccctgcatgatacggccctgtgacctctctttatttattattattttttgaaatggagtctcactctgttacccaggctggagtacaatggcgcaatttcagctcactgcaacctccacctcccaggttcaagagattctcgtgcctcagcctcccgagtagctgggattacaggcgtgtgccaccacacccagctaatttttgtatttttggtagagacagggtttcaccatgttggccaggctggtcttgaactcctgacctcaggtgatccacccgcctcggcctccc

SEQ ID NO: 191826 - DNA, 476 bp, Homo sapiens
gcaaaacagcaatgaagacatttcgtttatctgggcccttacttgggggagttctgtggttataattacagacagccaccctagaaagtcttacattcctatccatttctgtaattgaattgattttaatctcttcctattttatacaccaaggatttataggatgctaataactttctccccaccactaccctcttcttatccaaattcctgtaacgtaaggatatcaagttaaccacagagtttgaattgaatgcctgtggctgtttctggataagaatctgaagggaggccaggcatggtggctcacgcctataatcctagcactttgggaggccaaggtgggtggattacctgaggtcaggagttggagaccagcctggctaacatggtgaaaccccgtctctaataaaaagacaaaaaattagctgggcatggttgtgtgtgcctgtaatcccagctactcgggaggctga

SEQ ID NO: 191827 - DNA, 554 bp, Homo sapiens
agatagttgtgtgtgtctatatgacatatataaaacattgtgacattgaagcattttgttgaagtagaaagtcttgtgtatgtttatttgaataacaaatcttgctttccctttaataagtaaaagtaggaaatatcacacttgaaatgcttaagactagtttatatgatggaataggggagaatcttttacttatttgttgatgtatatagattgattgtcttgtgtttttctctagatcttagtttcattgtaccctctctgcaacctttttctgtaagaatgagaataggaaggcctgaatgttagtaggtagttgatagtctgctgtttttattttcatttttcttcttatgaagaggaagaaaaaaatagaatcctggaaatagcactgaagtggactttgggagatctttgactttgttctttgttctaatattcattcaacagtgtaaatttggacagttattattttctgtgccagtcctcatttgtaaaataagaattggaacaataggtaaggcctgtttaagttttgtaaaatatggaagggc

SEQ ID NO: 191828 - DNA, 144 bp, Homo sapiens
ggagcagatctgaggagggaaataaagagtttcatttcacacatgttccagttatttggtgaattacagagcttgtcattgaccatcctaagataaaatgtcccttgaacttgaaggttctcagaacctactagtggcacaccc

SEQ ID NO: 191829 - DNA, 505 bp, Homo sapiens
acccacctactcaagtgaggtcattacatactattttaatagagttagattcttttgtcatattctgcattacttcctgagtaccagtgttatcctaaatgattttatgttgcatatgtattaagattcaatctttgtgctgtaaagttcagtgggttttgaaaaatgtatggtgttgtatatttaccattttggtattatgcagaatagtttcactgccctaaaaaatcccttatgcttcacctatgcaaccctccctctttactgtctcccctgccaatatcgtctctgtaggcttggcttttctgcatcatataattggaatcacatagcatgtaacccttttaaactactttctttcaccaggcaataaggatttaaagatcatccatatcattctatggcttgatacttcaatctgacaatccctgtctttaatcagcatattgaaccattcacatttaaagtgattatcaatgtatttggaataacacctgtctttaaa

SEQ ID NO: 191830 - DNA, 280 bp, Homo sapiens
tatgatagcaaatccttgttggaaaaaaagatagcctaaaaagaaataagtgtgcatgttaggaagtggaaaattaggctgaacaggaagcatggagtacactctggtccttagtgcgcatccttttccttgaacaaccatggagtttctgttctaccaaagtagttattggacactaaattttacacagtattaatctcgtttctcttgttatattgtgatcctcctcaagaacagccagtgaccatgctgcctatttcctttgtatcatcccaagtgc

SEQ ID NO: 191831 - DNA, 646 bp, Homo sapiens
tggcatgtatgcacttaaacgctgagaagccttcatatagtgcctgcacacactctattttgaggtagtttctccaattcaaatacatatcctagaacggttaaagggagctttcatctcttctgcttgctgtgatcccaaaccaaaggtaaacatgtgctggcaagctaccccaggtggcgatgaaaagtggccctaacctttcctccacacccatcctcagtcccactccttcatctttaccgcccctcttgtacagagcctaaaccacagctcaacttactgacttatctgaacccttcctcctcctagagtaatagacaataagggaatgactccactcaacatcccccgagttccttgaaatgtgcccaggaactaccaagcatgaatctagtgcacggttaaattggcagaaagggacagctgggactacttcaggcatgtcctctgaccctaacaactgtggacacataatcaaaagattggtactctgtgagctagaatgagagatcccaacacaactgtaataacattatattaccagttaataggaaatactgtgcaaatggacagaatatcctgacatagcttttcatcttctttttttatttttttatttttgtgagatgcgggtttcagtctg

SEQ ID NO: 191832 - DNA, 426 bp, Homo sapiens
agagtaaaaacctgcgcatacctaaaccctcttgtacagagcctaaaccacagctcaacttactgacttatctgaacccttcctcctcctagagtaatagacaataagggaatgactccactcaacatcccccgagttccttgaaatgtgcccaggaactaccaagcatgaatctagtgcacggttaaattggcagaaagggacagctgggactacttcaggcatgtcctctgaccctaacaactgtggacacataatcaaaagattggtactctgtgagctagaatgagagatcccaacacaactgtaataacattatattaccagttaataggaaatactgtgcaaatggacagaatatcctgacatagcttttcatcttctttttttatttttttatttttgtgagatgcgggtttcagtctg

SEQ ID NO: 191833 - DNA, 511 bp, Homo sapiens
tggcatgtatgcacttaaacgctgagaagccttcatatagtgcctgcacacactctattttgaggtagtttctccaattcaaatacatatcctagaacggttaaagggagctttcatctcttctgcttgctgtgatcccaaaccaaaggtaaacatgtgctggcaagctaccccaggtggcgatgaaaagtggccctaacctttcctccacacccatcctcagtcccactccttcatctttaccgcccctcttgtacagagcctaaaccacagctcaacttactgacttatctggacattcggcgtgtgcatgcacacgccgaagctccaaaccatctccaggagcaagtcactgtggacgaagttgttgcagatcagaatggacgaagcttgttgcgccacatctatcgtccactaagatctcatgatgtagtttggacctgcaccacttcgtccataccgattgatttcacgaagtgtatggtattcggcgtgtgagatcctcagatcg

SEQ ID NO: 191834 - DNA, 500 bp, Homo sapiens
cttttttcttactcccaattaataataaaaacttagatttttgtgtattggcagcttagaagatgaatctcttagcaaacactgtcaccagtttgccctctactaccgcaatctttaggtctttgatcacggattaattataccatgggcttcaagtaggcattcctaggttcctagaacctgcttggtgcacttcctcacttcaaccacgtgatggcagtggaagccatgatttctgctaaggggcttcagtgtagagctatttctgcattcccttagcacacaagaccaagaacagccatttatccggaggtaaagataaacgtgtctaaactgtgaaaatttgtaaagcggggtcatcagtctcttttttctgcttcccttttctcttgactgacacttcattgctcctttactcattctcaaaattgggacacatctgatacctcaatgtattatgtagtttgaaattctttcataccaattctttattctgctag

SEQ ID NO: 191835 - DNA, 430 bp, Homo sapiens
tgagacacagtctggtctgttgcccaggctggagtgcagtggcatgatttcggctcactgaaacctccgcctcctgggttcaaacgattctcctgcctcagcctcccgaagtgctgggattacaggcgtgagccacaatgcctggccatcttcccattttcttgggggaaaaattctaatttaacttttaggaaccaaagactttatgtaatatgctactataagtggattaagttatcattcctcagagactcagattaagatgataatgaattagatttgaaaataagaatataaacatccactttaataaatgactaacctattaattctgaagctaatattaatgtaggagaaaagaatcttttgtgattagcttaaactaacatcctaatgaactcaagatcatttagaaatatctaaggtcgac

SEQ ID NO: 191836 - DNA, 477 bp, Homo sapiens
cagcgggtggatcacttgaggccaggagtttgagaccagcctgaccaacatgtgaaaaccccgtctctgctaaaaacacaaaagtttagtggggtgtggtggcgtgcacctgtagacccagctacttgggagactgaggcatgagaatcacttgaactggagaggttgaggttgcagtgagctgagatcacaccactacactccagactggtaggcagagcaagactttgtctccgaaaaaaaaaaaccagaaaaagataaaatgtcttctaagcatgggcccccaactcctgggctgtggtctcttaggagccgggctgcacagcaggtgagaggtgggcaagcgagcattcccacctgagctccacctcctgtcagatcagcggcagtgttagattctcataggagcgtgaaccccgtcatgaactgcacacgcgagggatgtaggctgtgcactccttatgagaatctaatgcc

SEQ ID NO: 191837 - DNA, 254 bp, Homo sapiens
aggcaatccaaacaaatattaaacaaaagaaacctagggtagcaatattaatatccagtgtattgataggatcaaagaagcacattttatagttaatgaaaagaaatttcataggaaaatattacaatattacagtaatgaactttatgcacctaaccacatggcactgaccatagagagccaagactcagacttagatggtaaaactgaaaagtctgccatcatcataggagatgttggtttttttttaatgt

SEQ ID NO: 191838 - DNA, 514 bp, Homo sapiens
gaatgatggaattatttcacatttagtctctttttcatctagccattatagtttagtttaaacaccaagttccattcctgctgcatgctgaaggatttgcagtacatcaggctatagtccatcaattcattccacaattgagtaagtaaggtatctatagtacctcaggccctgtgttaggcagggatggggtaacctagacagatttggtacctgtcctcatggagcttgactttagcggcagagacagatcttagataattgtaccagtacttaagtgttcagaaggacaagtatggaggtgggagccactccagtcctctacagtcacgtgctgcacaacaacgtttcaaccgacaacagagcacacatacagtggtgttcccataagattagaatgccatatttttactgtaccttttctatgtttagatatacaaatacttaccattgtgttccagtgatctacagtattcagtatagtaccatgctgtacagttttatagcccaggag

SEQ ID NO: 191839 - DNA, 590 bp, Homo sapiens
ttgatctagaggatcccgagtgatgatgtaggggtaagattaactcactaaaatgtgagctccatagggcaaggattcttctgttttatctacgatgtgcctatgttgaataaatcaaactaggaaagagggcaaagaagaacatttggcacagggcggcttattaacaagccagagtggtcaagatgaattccaggacaaaactgatctgagcttctggagggaggttcttcttagcctctccttggattatctcttttgcttggactccttaccttcttaagtgttttgagctattcttcttttttcctccaagaggcaggctagttgggcttgtcactttctgggctctaagtccttgcaagtttatagcctagcctgactcatcatagtagattttggtgtcaaagccctaggaccaagggcctaattataataaagaaggcttttttgtatgtggaatatcctcagtggttatctcttcagggacctagtgggacagtaggtatagccaaggcagattttcagaatactagtcatctatattcctctgtccataccatgatgactactaagcatctactctggca

SEQ ID NO: 191840 - DNA, 499 bp, Homo sapiens
gcttccgatgcaccttgggaagaaagtgattttctgaaaagctctttgctagccttaaaattctgtgggtttatgagatcctagcaacagaaaggcattttattttgttttgaagcagctttttttctggacattcccatgcaagtccagggcacatgaagcttggagtcatagagtttcctgtccccccactccaggtaaaggtggttttgatcttcattttatgactgagataatttagtcacattgattctaataagatgataggcaagtggcatcttgggcaaatacttagattgtccattgttgcctaggcccgcttcagtggagtagtgtatagaagggaaatgcagtcttcactgaggagcagttcacacacatcactcgtacctgctttccttctacctgcctatcacatgggttgttcaacattctaacaaaacagcatgcccagaagcctaaacccataggcattggatctggtaaataaatctttgag

SEQ ID NO: 191841 - DNA, 356 bp, Homo sapiens
tacagagcctcccctagagatgagggccctgggcccagagctccatgcctgtgctgatgagtctttaaggagaatgcccaccagtggcatctccagcctctggggccagaagctcatgctctaggtcttgatgggtccagaagctgtcatcacccagaatctgtcctgttctcagtcacagggcagagagttagactctgggggtatttgtgactatgattctaaacaacaagacttaggacttcagggaaccccaagatctcagaaagcccaatcacagaatcttagaaatttagaatcatagaatctctgaaacttgaacttgtaagctcttagaatcttagaatctaagaagc

SEQ ID NO: 191842 - DNA, 486 bp, Homo sapiens
atgatgcctgtacagagcatgctggatgtagctgatgatgggcagagctgctgaagtgaggggaaagtgcagtcccagaatgataggctacagtttgtgactttatcaacatcaagatcagtaagatgcagtagttttgcattgcagttgctcacttccacattggttttggtttcttcctactgttttgcgcatcagagatttagatagggtctaaatgcctgtatagggagatgatgtacgagtggttagagctcagacacaaatttcaaacccatggctctaccacttaattgctataggacttggacaggatactcaacctctctatgcctttgcttcctcaatggaaaaaaaatccttcctaaaaaactctcatgtttgtgaatagttgacatgattaccaggtttctgaaaacttgccagatactggaaattcagaggcttaaagctgtctagggtgtggagtcatgggcttagttcaaa

SEQ ID NO: 191843 - DNA, 456 bp, Homo sapiens
tcacatgcccaccaagtgctaaatatagtaccataagtaatgcggcttcttcaacataagagcaactgcataggttaaacattgttatcccaatttgcaagcaaagaaacaggaaaccaaagaggctaagaaacttggcaaaggtcacagaactaagaagtgtgagaaccaggatttgagcccaggtctgtccatttctaaaactagagtgctcttaattacacccctgtgccaggatccaaagtgtaagccttaagtttctcttgcaagttagtaaaccaacacttaaaggtatgagagaagacgctatttggctatttggagaaagaaaatgctttccttttaattctatctctcttctaaattttgaagtgtgagagcatgacaccactattaaatagacagatatgtttcatattgtcatggattttaaggcaaaacctttacttgtctaat

SEQ ID NO: 191844 - DNA, 461 bp, Homo sapiens
gatattggatttggaggagaaattgaaaggtcacggcttctagagcatctagctctcttgggcttaagatcaaattgtgctagtgaagacagtgcatctcataaaatgggaagtaggcccacagttatcacctattcacctttggatttctggatgtaatttcctttggctattgtcatttttcctttgcaaggcagaataataaaagaagatggaaaggcttctcatgatctcacctcattaagaaggtcattcctgtttcccataggaccaaaaaagaaaaaaaaaatcaacctctttccaggattatcagtcaggggtatagctctctgggcatataccttcttctcctgactcttattaagccacctacactaaggagggcttgggtgaagatagatatgaggccttcggtttgcaattcagaaaaaaagaatctgtgacaaataggaccagaaatg

SEQ ID NO: 191845 - DNA, 438 bp, Homo sapiens
gctgggattgtgcagtggctcatgtctgtaatcccaatactctgggaggccaagatgggaggatcacttgagcacttactgtttgccactgcggtgctaagcactttgcacatactagctcagtgcatccttacagcaatcctgggagggaggtgcttttctcatccgcatgtgctgacaaggctgagaagagctgggtcttgcacggtaccttaagggctaaagacctgcaaggatggtgcatgaaagcaaaaccagagaggcgccttttccaaatgccaatgcgccctccacccagtccttcacaaaccacatcagcatggatagcaccacactccacaggcttttctgcatctcctttgtgtgtgtgcacatgtgtaattaattctggggcaacttcctacatcagtacagagaaactccttgatcattatccac

SEQ ID NO: 191846 - DNA, 188 bp, Homo sapiens
atataagtaatcaaccagacagtggaatatatgttcaccattattttaaaaggttattgttaaaaacacaaaatttaaaaacttcttattgaaaacttgagactcctgaagaatactgttttattaaattctctctccaggttgaattcccaggcatggaattattaagtgaaagggtatgctcagct

SEQ ID NO: 191847 - DNA, 495 bp, Homo sapiens
tggaatcctggagttttaggttgtgatactttatttatgtagaattgaatgagatgacattgctattaactttacatattaaaggattttaataaaagttatagacttggcagtggctcagtgtcccaagtggatgtttcctatattttttcattactgaaaggggaagtctttgcaaagatcaggttttcaacatagaaaagataacattttaaacatcaagcacttctattttaaagagctcaagaaatctgtcagcagagttcttggcgcagttaaggcaggggtccgtttcattcttaatccctgaatgaactacatcttcggtatctgacgtggttgatagacacaatagcagatggttgtttcttttcctgatggggaaaggaaaggacaaacaggatccaatttacttaccagcctaacactgttgggaattgacacagtcactaggtataaatgatagagcagatacctttaaacaggacccagtgg

SEQ ID NO: 191848 - DNA, 679 bp, Homo sapiens
gttaacgtccctatttacaaaacgaaggtgcagtgaggataaaggatttgtccaagatgacacattaggcaagttgcagaacagggacttgaaaccatcatttggccacagatccttgtcttcaccatgattattcatcccatggtgttatgaggggaggtgatgtgggaactgcatcctgtgtatttagaaccataaatgactctgaaagaactgttggtagaagcgaaattccaaggactggaaatccaggctcagagtgactaaaagagagaattaatttgctttgattcaccgagtgatatttccagaaatttcaaaaagtcaccatcttcctgctctgcattagaacaggatctggggccctgaaggacatgacgaagatgtgtgatcaggtaagggagccgtttctcctttgcccagcggacagggacttccatgagccctgtttatcagttgttttcctcttggtaccatgagatctttaccatgatcctcttcgtttactttcattgatcatcctctcatctcaggtctcaaagaaacattgagggcctcctatctccaagggcttgacattataaatgagaagacatatcatagatcattatagatcattgtggcaacgaattccatccgggctgatttattttgtccagaggaatgtaagacatttaaa

SEQ ID NO: 191849 - DNA, 286 bp, Homo sapiens
acagcagagaaacagcttggcacaatcagtcatcccaggcagtgctgttttagaaacgagctaccatacagctcatgtccggttgacggggagaccatccaagtagaaaggggatgatctgggcctctggtctaccgtgcgcacaaggataacagtcacttttacctagggtgtggatggaatgtttaattcattccagtcaggcatttgtatcttgatgtcctgtctcaattgctagggtttgttttagatcttttacttttaccagggacaccttggttttatc

SEQ ID NO: 191850 - DNA, 156 bp, Homo sapiens
cttgtcaactttaagagatattttagacatagcaagcatcccagagagctctccatttccttagtcctgctccatctgaaagatctgatgatataactaagtattacagaagtttggggaggaaagaccacttggctaataataaaagatactaat

SEQ ID NO: 191851 - DNA, 474 bp, Homo sapiens
ctagatatttcaagcaagttagggttagaggaggtaaaaggctacaaaatctcatattttatctttctagaaggatttatggaagaagggctatggaatttgttcccaaagactggctaacaaagattcaatgggacttgaaccgttctttctatatgtccatagcttgctttttcagtgtctgctttttaaccaaatgctacaaccagaaaacgtaatttgtctagaacataagcacatgttttccatggttttagtctccttattggtaaggaatttagtctccttattggtaaatcatacacaataccagtaagtgggttttaagccctgggactcaggtttcagggtatctggatgtcccagggtatatcaaagaggccagtgcacagagataagatacatgcccacatttttaggggcattagtggaataagcctttgttataatacctaccaagttatcaacaatatg

SEQ ID NO: 191852 - DNA, 150 bp, Homo sapiens
ctagatatttcaagcaagttagggttagaggaggtaaaaggctacaaaatctcatattttatctttctagaaggatttatggaagaagggctatggacatatagaaagaacggttcaagtcccattgaatctttgttagccagtctttgg

SEQ ID NO: 191853 - DNA, 597 bp, Homo sapiens
taagaggtacactttgttgtacagtgttcgaacatttttatgcaagctttttgtggacatatgtggtcatttcttttgggtaaatacttagtagaattgccggattattgggtacgtttaactttttaagcaactgcacaactgttttccaaagtggttatagcatcttactcttctaccagcagtgtataagcatttcaggaactctacatctttatttatttttttattttttatttttgagacggagtttcactcttgttgtccaggctggagtgtagtggcgtgatcttggctcactgcaacctccgcctcctgggttcaagtgattctcctctctcaccctccccagtagctgggattacaggcgcccgccaccacgcccatctaattttttgtgtgtttagtagagccagggtcacaccatgttggacaggctggtttcgaagtcctgacctcaggtgatccacctgcctcggcctcccaaagtgctggggttacaggtgtgagccaccacgcccggccaggaactctaaatctttaccaataattgatattgccaacttgtaaaatttcagttctggtggggatttatgg

SEQ ID NO: 191854 - DNA, 329 bp, Homo sapiens
tcaggtgatccacctgtctcggcctcccaaagtgctgggattacaggcatgagacaccgcacccggcctcttctgggagattttcttgacattgtcttttaggttactggctgtgtattcagctgtgtccattttgatatttaacccacctattaaatttttaaactttgataatcttattttgtcaatttgattattcatgttctttacttttttaatttttgtagctacagtatccttttgatcctctctgaacctattttatttttttcatcttaagaacctttaatacagttatctaaatgcagagtttcagtttatgaaatgaa

SEQ ID NO: 191855 - DNA, 204 bp, Homo sapiens
taattagctaaccacacacacaaaaaatctggttttgagatttttctggtgatctttctcaagtgtgtgtgctttaaataaaaaactgggcccgtttgcaaacgacatggaccttattttatactttcaatcacagaactagcaaatttgatagatttgattttctatgagataattctatagagtgagggtgaccccctctag

SEQ ID NO: 191856 - DNA, 578 bp, Homo sapiens
ataggctttattgacataaatttctgttcagtttttcaagctttattatatgttttgaagaaactgacacattagttcaaagcaagtaatttgtatttctgattagtgtgcttattcttataacagaaatacctattttgctgtattaaagtgaaaatgaaataattaaaaatagaacttatatggcatcttaccctattagtttagttttttttactaccctagtagatagcatcttttaaaataataagattggttctctcttcaaattttacattaagaaatataacattttgacaaaccatttttttttctgtaatgtcagtaattttaattctgactttgatgaaaagattagcatgttggtcttagcttaaaggaaattcagaagggcatagggatgaaatgtaccacagcaggggcttgtgagtaaaggaatacattttccacttgtgtatccttgggcggaagcagtagagcctggaggcccctgcccttgagtgtccacatgcacactcatactgtaagggaagagagtcaaacaagagataccccagccttcaaaaaaccctagttgg

SEQ ID NO: 191857 - DNA, 554 bp, Homo sapiens
tgccgaggctggagtggagtgcagtaatgcaatcacagctcactgcagccttgacctccccagctcaagcaattctcccacctcagcctcctgagaagctgggactataggtacataccaccatgtctggctaattttttattttttggtaaacatggggtcctgctatgttgcccaggctggtctcaaactcctaggctcaagtgatcctcccgtctcagcctcccaaagtgctgggattacaggcctgagccaccacgcccagcctaaaatatattcttaatttaaaattaaagctataatggaaaagcaatgacctgtccaacttcaataatatatgaggtaaaatattacttattcttaactttgcagtcaccctctgtgaaacatgcaacatgtaagtctaacagatacaaccaaagcttaatttgaaatatattttaagtaaaaatcttggttaaaatgtattagtaaaggaaaatcaatgtaagtgtcaacagactttatctagagatagtattaactacccaaactatttactctgaataaaaagt

SEQ ID NO: 191858 - DNA, 307 bp, Homo sapiens
  misc_feature (253)..(253): n is a, c, g, or t
actgctccctgacactgatgtttctggtgtcaataatgtattaattttctgttgatgccaaaacagattctcacaaacgtttagcagcttgaaacaacacaaatttatcgtctcacagttctttaggtcagaagtctggattggcttgactggtttctttgatctgggtttcaaagactgaagtcaaggtgtgggccaacagggctcttattggaagaatctgggaagaatccacttccaagcttatccaggntattggcagactaattctgagatttgtttctttgctggctgtcaggggagaaga

SEQ ID NO: 191859 - DNA, 358 bp, Homo sapiens
gtttagcggtccctagctctgccaccaagacctttggtcactttacgtctctcgattcttttatgaaatgatgactttgggccagagtctctctgaggtccttcctgctctgacagccagcagttctgagtcacacagagagactgaggtggtgaggtgtttggtgacgctcagcaagaacaggtctggagagaggaagaatcaccctgctttagcatgaatagccttcacttcatgtaagcgaaagctcaggaaccaaaacatgcatcagcagaattgcctctgaggacagtgttttctgaaggtttcagcgagccatctgcaacctgttagcacagaaaaatcttgtggggaaaag

SEQ ID NO: 191860 - DNA, 347 bp, Homo sapiens
cgtgtacatatgcacacatgcatatatgtcagtgcatacatgtatatgcacacatgtacatacacatgtgcatgggcacaaatgcatgcatttacatgaacacatgcatccacacacataagcacatgcacaaatgtacacatgcattcacacatgtgcacacatgtgcatgcatgtacatacacctgtacccacatgcacacatatacatacacatatgcagagacgggcacacatacatacacatgcacacaaatacacagaacatgcatgcaccacacagtacacatatacacataccaaacacataccacatacaccttcacacaccacacacatacatacac

SEQ ID NO: 191861 - DNA, 687 bp, Homo sapiens
agggcttcctccctaacaaactggtcacaaaatcactttcctgctggcattaaggttactgctctcatcctgaacccaggatttactaggtcaaagcagcattcagacaatggttcaagctataatctcttcctaaaccggcaaaggcaggccagcatctggtgaactgcaacaaatggcaacagcatacccagagacatcaataatgatccctcgaggctacaaagacaaactctactgatggcaattgctaaaatacaacatcactgcctgttcctaacagaactgaactatagaattttatttcaggaagagtttttctcccaattagtcctaatagaccaacaggaagcctgataaaaattatcagggaagaggcagtgaggcagggctaaattcagtggtatgccatcacagtgacatatactttcatgtgtgtggtaatatacacataaagtttaccattttagctgaatttgtgtatagttcagcagcattaaatatgttcatattgttatgcaatcaataccactatccatctcccgaattttttcatcatctcatactacaactctgtattcactggcatataccttttcatggattctatttttctgatatgaacatatcctaaactgcaaatgttccctgctgcaaaaacagatccattcccactattgtcttcaa

SEQ ID NO: 191862 - DNA, 347 bp, Homo sapiens
cgtagtcccagctactcaggagactgagacaagagaatcgcttgaatccgggaggtggaggctgcagtgagccaagatcgcgccactgcactccagcctgggaaacagagcgagactctgtctcaagaaaaaaaaaaaattaaaaagggcttaatgtgctaataaacatacacacacaaatacatatcaatacatccatgcacagatgcataatgggaagcccccagaccccattcttcctcttcatagcagggtgggcttcatgaacagacataatcgaaaatgaatagaaactcttctaagaacagggagctccgcactgatcaagaagacactggtgagctaag

SEQ ID NO: 191863 - DNA, 411 bp, Homo sapiens
aacactgagcttctacgcgagcaccattggctggcatcaccatatcgagctacccaacgtgtgccaaattctgtctggctgcacaaacaaacacacatctctctgagtaatactgagacttcatttcggggtttcccagagcactccactgtgttgtaagatctcttaggtggccagaagcttagaaaatgcaaatggagatgacagtgaggagctgttgacccaaggtgtttatttttggcactttatttactgcatggttttgaagatactcccagtgttaccctagagaaactgtcccctcctcctgtaactgcaaccttgaaattgcaccattttctcccagaagagactgtggacaacagggttggagaaatccagcagtgagaagggatcaccccagaggaattc

SEQ ID NO: 191864 - DNA, 456 bp, Homo sapiens
ctcttaacacagtggttctccttcgtttcatctgctgaccacactgtgccacctgcaggctggtccgcttgctggctgttcctgcactctacaaaactagaagttgctattccttaaccctggggcctgccttgggctcaggaccagcccagtcctggaggcagccaagggtccacaaaggtcacatgggcactgggtggcaccagttccaactcaagattaagtcacatgcttgatgttcctttaatacaaagtctgttaagtacggagacagatgtgtgactgtcctacttgtggaatcagtcttacggcttaataatcacactttggccgtgcgcactgtgtgattatagaatcacatctataatctcagcactttgggaggcaaatgcaggaggactgcttgaccccaggagtttgagaccagcctgggcaacatagtgagaccccatatct

SEQ ID NO: 191865 - DNA, 420 bp, Homo sapiens
tatgcctacctcctggagtccaccatgaatgagtacattgagcagcggaaaccctgtgacaccatgaaggtgggaggtaacttggattccaaaggctatggcattgcaacacccaaggggtctgccctgagaaatccagtaaacctggcagtgttaaaactgaacgagcaggggcttttggacaaattgaaaaacaaatggtggtacgacaagggcgagtgcggcagcgggggaggtgattccaaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcgtttagtacagccaatt

SEQ ID NO: 191866 - DNA, 628 bp, Homo sapiens
ggtagtagtataccaagcaagctaaatggatatgaactgttttcttcagggcagtattgcaagtttagaatttgtaatcattgagttgctaccatattaccattatcacaatcacttccctttccatctctcccaaaatgttttctttccaaaaagaattttatttttattttcacatatttggaggcttttttgacatcctttgacacaattagagttaccttgttggctgcaaatatagggatggttaactgcttttccagaagttagttgacactggccagcctccaggaggtgctacaggaagctggggcagtgagaagtttctaaagcagtttccaagaggactgtgaagcacatctcgttccagctgtgtgtaatgattccttctcctccataagtggagccgccttaccagaaggtgttatcaaaaaagagatggggtcaggcagggtggctcacacccgtaatcccaacactctaggagaccaaggcgggtggatcactttaaggtcaggaggtccagactagcctgaccaacatggtgaaaccgcatctctactaaaaatacaaaaattagcgaggtgtggtggcaaacatttgtaatcccagctactcgggaggccta

SEQ ID NO: 191867 - DNA, 373 bp, Homo sapiens
gctcaattcccctacctttagccagtctcatttagaaattacctgggacatttgcaaaacttttttgctttgggttttgtttttcctacctgcagtagcatattaacacgtcacatactcagtgaatgtgcttagttttggggagaagcgtatactccttttgaactgttgtatctagtcagtaaagctgttatgcaagttgactgcaatatatcatttctggccctggaagtaacagcaattggttaaggttcagtctctggcctcctggttttatagttcataaagtggtagaaaaggacacacgtaactataatatatgacagatcatggcaagctgtgatgagtacaacaagaaagccacaaagtgtta

SEQ ID NO: 191868 - DNA, 391 bp, Homo sapiens
ttggaatgaggcggtgtggtaatctgacctgcacaggaccaggggcactaatcagaagctccagggaacagcagtggaaaggaagcaggcaggaaggtctctgggctcctcagggaagaggaaaggacaagcaatcaatgcagaggagtttccaagggggtggggaggggggtctagcttgaagttccagacactggttctgaggacacacatcagaaaaaatttccaaggggtctaaaacatggttttcacttatccctaaatgagcagagagtggttaaaaatgggaggcagggaagaaaaaaaaaattaagctccaattatcaacatcaaaaaagaaatattcctgtttactctttaaagaagttaaaaacaatttttaaagaacatc

SEQ ID NO: 191869 - DNA, 351 bp, Homo sapiens
tagacaccaggcccccaggagcagaggagttccatccccctgctggggcactggccccagatgtccaaggctgtgcgcactgcctgtgcttctcagcagggcagtcctgcaaccgttgcaagtctggagtccttagaagaggtgctcacgggaggaccacctgggcacagggagccagaacctgggctgctgccgcagaagggccagcgtggcaggtgcagttgcctgcaggttagatggcaagggccacccccttttccagcaggacagcctcctcctgtaccaccaggacctgtgtccttgctccggccagaggtggcctggagtggcgagcagccctgcacacaggcc

SEQ ID NO: 191870 - DNA, 401 bp, Homo sapiens
gggattggcgttctagaggatcccattatgttctgacccactcttatgtctctgtccaccaggttgaacctctttcctgcctgctaactgatacctgcctgtcattggctgtctgtgtctatgtcccaaactcctgggctcaagtgatcgtcccgtctcagcctcctgagcatcttggattacaagcatgtgccaccacacctggctgtgatgtaggaatgatttttgagactgttccatgtagacttaaggaggtatgaggggagtgattctccagatcacctgtttttttgaggcagagtctcactctgttgcccaggctggagtgcagaggtgcaatctcccgggttcaagcaattctcctgcctcagcctcctgagtagctgggattacaggtgcat

SEQ ID NO: 191871 - DNA, 386 bp, Homo sapiens
gtatagactcgagttagtacctgaacattcgtgtctctgtccaccaggttgaacctctttcctgcctgctaactgatacctgcctgtcattggctgtctgtgtctatgtcccaaactcctgggctcaagtgatcgtcccgtctcagcctcctgagcatcttggattacaagcatgtgccaccacacctggctgtgatgtaggaatgatttttgagactgttccatgtagacttaaggaggtatgaggggagtgattctccagatcacctgtttttttgaggcagagtctcactctgttgcccaggctggagtgcagaggtgcaatctcccgggttcaagcaattctcctgcctcagcctcctgagtagctgggattacaggtgcat

SEQ ID NO: 191872 - DNA, 351 bp, Homo sapiens
aaaatgatcaggttctcacatttgcttcatcagatgaggcagagtgcaaagcctcactctgctatatttcttagctgtgtgatcattgagcttgactctaagcctcagtctccttctttgtgaaagggggctagaaatggtgtccaatttcatacttaatgagtgcttactacattctagttgctttagtgtaccacagagtacaaaacagtcaaaggttcctgtactgatggatctgacattccagcaaggaagggacagtcaacaaaagcatgattactatatagtatgccatgtttagttctatggggagaaaaagacatcaaaaggaagagagaaatcagcagtgct

SEQ ID NO: 191873 - DNA, 492 bp, Homo sapiens
tgtcagattttgaaatatttgcattatgcttacccatcgagcatcccaaatccaaaaatttgaaacttgaaatgctccaataagcattctctttgagtgtcatgtaactgctcaaaaaattctggatttatgaacacttcagattttggattttggggttgtaatgcttaatccatagtagataaaggcactttgtcagctccatcagagcaagcttcctcagaagcactacctggtgatcactctcattccttcccaaagtttcatttctctctctctctctctgtctctggagacagtgtcttgctctgtcccccaggctggagtgcagtggcatgatcaccaccaggttcctggtggtgatagaagataaaagcagaatcttaaatgaaagcaaaatagaaattgagaggctgcagtctctcacagagaacctgaccaaggagcacttgatgttagaagaagaactgcggaacctgaggctggagtacg

SEQ ID NO: 191874 - DNA, 428 bp, Homo sapiens
aatgggcaaatggtctagaggtgcctgatgtccatgcattctataacacatcagaccctccctagtctcagcacacaatgaaactcatcccacatctttcttctttctctcctgtctgtatcctccagtctccactccaagctctaagtccttatgaatcttccttttcaacggacacaacgttcctactcccctcctaccccaggcagctccctcatggccagatttactaccttctcatcggtcactacccaactactctcccactgaaacttccacctagtaaatctctacccatccagtgaaagtatctacccagaccaaaaggtattttagtttcctgactcagagcatgtgagtaaagtcaatttgccagtcctgggcaggggcaaatccccaaggttgatgtatagggaagggaaggggcc

SEQ ID NO: 191875 - DNA, 617 bp, Homo sapiens
ctgacgatgagtctagaggatcccttcagcacagaagggaagtggcacctatgtgtcctgggaggtttaggattgcaactggaggatgtgggagggcacaatttggaccagatgactttggaaggtcttccttcacctcagattgtaggactttaaattctgaagattcctgctgtgccataaatcctgcttcactcttcccaccaccctccttcttgagggaatctccctactcacctcggcacttaagtgggaaatgcaaccatgtaactccctccaatgttggctgattggaccctggagttgtcctctgacccagtgcagtccagctttttggtggctggaactgtaattctggctcagaaaactgagctgcatcaatgagattcttcagttcatgttggaaaacagagtcactgagagtgagccatgttaacagaaatcaaaaaaatgcgtctgtggcaggagggcgaggcggaagccttccaggagtccacatgatgaagcaggaccaatgttgacagggagagggtgctgttgagaggataatgcattcctccacaaggagaggcaccaccctgacagaattagggtgcagtggagggcctgatagagtg

SEQ ID NO: 191876 - DNA, 599 bp, Homo sapiens
cctggcctgggctggataatctttcgttgtggctgagagtggaagaggttctgtccattataggatgtttagtaccatccctggcttctacccactagatacaagaagcacctcaaatcccaccagttatgacaaccaaaaatgtctccagatagtgccagatatcccctcggggcaaagttgcctctggttgagaaccaccatcttaaactgaaatcttacaaaacattttaaacattttgtaactgttacacactctatagccaggctattttctaccaagtcaaagcttttgtaaaaacctggggatgaggtgtaatcccaatgttcaactgtctccctaggcatctgcccatctctctgtatttgcaaattacaatgctcattgatccttcctctcatagattccattatccattcatattttgactctaagagatgtttgctcgaatcgtgtctgctgtgtctaatggtctcagtaatttaaaagcttcctgccagcaggcatttcccactattgaccgtggtgttctggaaaatgtatgttgcttttgcgagagtatggttgggtcccccactccattccaaagcttcagatg

SEQ ID NO: 191877 - DNA, 188 bp, Homo sapiens
taaagatgataagtcttggtcagaatatatttctttatcttgctccttttgtgtcaagggaaaaacatgagataaaaatgagaatttgatgatccaagcagctcacaataaaactggtggcaacacctgaacccagagttatacattggtatttgttacgtttcccatgacacaaaaggagcaagata

SEQ ID NO: 191878 - DNA, 192 bp, Homo sapiens
ttgctcattattcatgggctctgttagaatgtaactgtgctcctccttagagggcaaaaagtggattagtagtggctaatgataagaggagtttacttcctctagtttttgaaatttttttgtgtgtaaatttaacttttcccatagcatattttagatgctttagatacttaggatgtacagaaggtacat

SEQ ID NO: 191879 - DNA, 397 bp, Homo sapiens
gaaagacaaacatcacatgttctcacttagttgtgggaactaaaaatcaaaacaattgaactcataatcacagacagtagaaggatggagtatcagaggctaggaagggtagtgggggacttgggggaggtagggatggttattgagtacaaaaataataagacccactatttgatagcacaatagggtaactatagtcaataacttaattgtatactttttttttttctcctgagacagggtctgactctttcgcccaggctgaagcgcagtggtgcaatctcggttccctgcaacctctgcctcctgcgctcaagagattctcccacctcaacctcccaagcagctgcgactacagtcaagcatcaaatcaattctttttttttttttttaaaca

SEQ ID NO: 191880 - DNA, 242 bp, Homo sapiens
gaatagggctggcctgtgtgacctataggatcttgtgaaaataatggaatataacttccaaggctaggccataagaggcactgtggattcaccttgctcttttagattcctcactcggggaagccagctgccatgttgtgaagatgcagcagggaggtctacgtggtgaggaactgaggcctcccgccaacaaccacatgtacttggctgctacggctgccatagcaaaatgccacagcctg

SEQ ID NO: 191881 - DNA, 491 bp, Homo sapiens
attgacaatgattgtctgtgtaacttgggcaagttattgaatctctctgtgcttcaatttcttcagtaaaatgagaataatgatagctatctattagttgaactataggaaatttctgatatccaactatttttgacctacaagaatggtaatttgcagaaagtccccatcagcgagcaggctctcacagatgtgtcccctcaaccttggacttctcagcctccataattgcatgagcccaatgaatgaattcctgtaataaactctatctatctatctatctatctatctatctatctatctatctatctatcttatatctatccatccatccatcctattggttttgtctttctggagagccctaactaatacagagtgcttccatgttttcaccatttcatgttttctgaaggatgtattttatgtttttttcaaactactagtacctgtattctatgagtttttctttcctaggtccaactgatacc

SEQ ID NO: 191882 - DNA, 231 bp, Homo sapiens
tctgtttagtaggtcttgggtagggaccaagattctgcacatctaagaagttcctaggtgttgctgatgttgctggtctaggaaccacactttgaactaatccagaacaaaggtccaaagaaagtagactacctattgaagaaaaatcctagtctgggtagtagttccaaaaagagaagtgcagaatttgaggcaactcctaacctccagattagctctactcagggttca

SEQ ID NO: 191883 - DNA, 473 bp, Homo sapiens
tcacatttctctgtgcatgcacatccttggtgtctcttttgtgactttttaaagacataggatcttgctttgttgctcaggttgtactttaactcttgggttcaagcaatcctcccacctcggcctcccaggtagctgggactatagggtcatgccactgcacccagctttttctgacttttgacagtttgattaaaatacgtcgcagtatggacttctttgggttcatgttaattgagatctgttaggcttgaatctggatgtccacttctttccccaactttgggggtttttagccattatgtctttttttttgagatggagtctcactctatcactgagacgagtgcgatggcacaatctcagctcactgcaacctctgcctcctgggttcaagcaattctcctgcctcagactccccagtagctgggattacaggcacgcgccaccatgcttggctactttttgtactt

SEQ ID NO: 191884 - DNA, 541 bp, Homo sapiens
tcgagctcgttacccgtcctacatagtgttagaaggaggcttaattaccattcagcctaacctaggaacctttaacctccagtcaaagtagatccctgaaattagtttgtgtttgcatgtgtatatattctagggagaaggtacatagctagaaataaggttttctgagggcagtaactctaaatggttgaaaaccactgatctaattcaatcatttttcatgaaaggaatcctttatgacatttctaataatcattataacactaggtcaggtgctaaagatagagcagggaacaagacaatgatggtccctgatcttcacggggcttagggtctgtaggggagagattataaacaagaatcacataagactggtacgatcacaataatgataagcccatgaagaaaaagtatgacaggacctaaatggtctctcctgattatgacagttaggctatgacctgaaagctaagtaagtaaaaagggaccaagaagaacttcccaggtagatgatacagcagcactatgtgaggaccctgaa

SEQ ID NO: 191885 - DNA, 352 bp, Homo sapiens
caccgcctccaccgtcagactaaccctacgggaataggccatttatagcaattaattgctcttttattcctctagatatcaaagcaccaaaataccaaggaaccctggggaactttccacccaagtccccacattctttcaaaaagagatgaaaagagtgaaaagagagccttcctctacttctgaagggctttaatttcttctactaccatgacagccaattatcattcccgtctacagggctcagacccttccaagaagcagaggggaacactgtattcctgacttccagggaaggggtcaaaggatagggactgtccagggattcacggacagctgttctatttgtcat

SEQ ID NO: 191886 - DNA, 620 bp, Homo sapiens
gcaattctcctgcctcatcctcccaagtagctgggattacaggcatgcgccaccacgcccagctaattttgtatttttagtagagacagggtttctccatgttggtcaggttggtctcgaacttccagcctcaggtgatctgcccttcatggcctcctgaagtgttgggattacaggcatgagccaccacacccaaccaatcctcatttttaaatgaaccctgcctcagcctctcgagtagctgagattacaggtgcctgccaccacatccggctaatttttgtagtttttagtagagacagggtttcatcatgttggccaggctggtcttgaactcctgacctcaggtgatctgcccacctcggcctcccgaagtgccgggattacaggaatgagccaccgcacctggctcttcccttcccctccactcccctcgctccctctttttctctctcactgtctcttcttgagcttctgtggattgcacacccttcctgaaatttaccaccctttttgcaatataagccagtggttgttattctgtatgtggctaaaagactctctaacaaaacaaaattttgtccggtgaggtacaggcagtataaggaatcataataaat

SEQ ID NO: 191887 - DNA, 319 bp, Homo sapiens
ctgtggccctcctgcctacattccatttctgctgtttctctgacactttcccccactctgattcattttccgagtatgcagttgcaaaacctacgcttagaacggggggactgcaagcgtcctgtgtggcatttccctaagtcagctgtgactcagcctggcaagggcccaggtgccttcagagtggcttcctgcaaagaccagtaatgacgggccagccgctgcactcaggcacatgagccagcacctctgcgactgagatccagggaaggaacgggatcgccctcctacctcccagcactgcaaatgtcatttacat

SEQ ID NO: 191888 - DNA, 306 bp, Homo sapiens
tgctgggattacaggcaggaggcaccgcgcctggccctcatgcctgccttttgtagatcacactgttcgttcagtgagtatttatttggcatcttctttttgctggacactttctgggcagtggatggaacagtgaatctgaaggcagtgccgcctcacggggctgacatcgttgggaggggcccagatataaagaaatgagcccaatgtgtagtgcattcggtggggattgatgctgtgagatgagtagagcagggcaggttccgatctgatgatggaggtcaggaaaggtctcaccaccaggct

SEQ ID NO: 191889 - DNA, 426 bp, Homo sapiens
tcccggagtcacacaggatttgagttgtggtcccacttcggtgccttgtttccccatcctgtgaaatggaatcagagtctgggacaagaaaatgcaaagcaccggggcatggcacagagagtcttcagttaagaggagctgtctataaagtaggtggctttgaagggtcttttaaaaggctcatgcagtagaaaactgccccttccaccctcgtccctgggatagctgtgactgggtaactgctgttgtcgttgcagttacacggtgctaacaatgttggcctcagaccccagagagctgctggccgtgaccgtgggcatgcagcagcaggggctacatagaggctccccagtgcagtactgactgctttcaggagcagtcatgcccactggtgttgcatctttggcttctcagctgggttcactt

SEQ ID NO: 191890 - DNA, 99 bp, Homo sapiens
aacacaggaagcaaaaactgacagaattgaagggagaaatagacaatttaacaatagtagatggagactttaataccacaactttcaataatggataca

SEQ ID NO: 191891 - DNA, 359 bp, Homo sapiens
ggcagttgagaactaagaggtgtcaattgacagaatcttatcttttcttttttctttttttgagacagggtcttgctctgtcacctgagtgcagtggtgcaattatagctcactgcagcctgaaactcctgggctcaagccatcctccagccttccaaagtattgggattacaggcttgagccaccatgcctggcctggataatatcttcataatattataacatctggcttttcagagtttatgaggtgcttttctcattgatctttaattttgtgaggttcctagagaagttaggatgatcctcttgtcatagtcaggcaatggaggctcagagaactggcaccgtgtgttacacat

SEQ ID NO: 191892 - DNA, 269 bp, Homo sapiens
tcatcgagctcggccagtcggttctaccatcagcattgcacctatgtcctcacaaagctgtactccatccttcctattccttagaaccaccaccaaagctacttacactacccttagccattcttcacatatgaagttcagggagaaagcaattagttacttggcacatcacttttgaaatgtggatgacccctgttcaaagaatgcttttcttttgctctgccctcagtagagattagacattatagaacctgcctagaggaacatga

SEQ ID NO: 191893 - DNA, 414 bp, Homo sapiens
caggctcaagtttccccctcccacctcagcctccagagtagctggggactacagaaatgcattaccacacctggttaattaaaaatttttttctctagagacgggtcttatcatgttgcccaagctggtctagaacttctggcctcaagtgaccctcctatctcagcctccaagagcactgggattacaggtataaatactgcaactggtcacatactcttcttttgtaacacaagtctgccatcactctaagtgacttgaatatagatatgtctgatccatccaataaaactgcctcaaagttccttgacctcagttcctacaatcttcacttccatccaggaagaatcaagatcacactctgaaaagcacttcatcactgcttagaactgctctgatgctgacattatgaac

SEQ ID NO: 191894 - DNA, 485 bp, Homo sapiens
aacagtgtggttaggaaagtattctgtcataaaatgccatttgcatagatactcacaggtagtggggcagtgaaccctgtaaaagaatttgcaggcaaggaaaaacacaagttcaaaggccctggggtgagcttggcatgtttgaagagtttcaagtgaagcgggagtgtccagtctgtctggagcagaatgaacaaaagggagaatgacacaatttggggagcgggcacagagaagacattgttcagagccttgtcggccactgtaaggactccagcttttaattgggagacgttggagggtttcaggcagaggaaagacagggtctgacttctgttttaaagtggtccctctggctgctgtccttaaatatcaattgcagagaggtaagggtcggaggaaagaatcctgtggggagacttacggtattcaggggaaggatgacatcagtagtagtgtgacagcaatagacatcatgagaaggg

SEQ ID NO: 191895 - DNA, 417 bp, Homo sapiens
tggtttagccaggatggcaaaaccaggtatccaaaggcaaaagtacttaaccatgcgtaggaaggaaaggagttgttgctttgtagaaggggctagggtttgggagatttgccagacacaatcagcagggagatcacgcgtgttttcatgaagaattacagtgagcagctaaacaagaactgcctcgagataaagaagatgaaaacaatcgcagctcatccagcgcgctgacacggagcaacagagcccctgctccacagccctaactccagctttccctgggcaagagactgatttcagtaacttcctccagatcagaagaccactgacaacagactggttctgcatggtttacagacctggcaaatttcggtgccttcatgtcctgaaaagaccctttgacatacaggcttaatt

SEQ ID NO: 191896 - DNA, 377 bp, Homo sapiens
atacagtttggaccctgcatcttacaacagatgtgacagaggaatgcttatggtcaataatgatgtacagtccacagtgataaagaaattggtgggaatgagactttgagaagtataatgaatgtcagattgcaggctgcccatagtacatccagcatcagcacactgtagtttgccttaactaatttgggcctctgcagctttgggacagtattgcaaataggtggtataataagcttaaataacagatttccatcacttaaatatgaaaatctcagatttgtcacagtaataatattgacctcatgtttttgtttttattttttgttcattgacttcatgaatgaatagtttggcaggaaagcaggtaatacact

SEQ ID NO: 191897 - DNA, 359 bp, Homo sapiens
  misc_feature (171)..(171): n is a, c, g, or t
  misc_feature (181)..(181): n is a, c, g, or t
  misc_feature (192)..(192): n is a, c, g, or t
  misc_feature (222)..(222): n is a, c, g, or t
  misc_feature (229)..(229): n is a, c, g, or t
  misc_feature (246)..(246): n is a, c, g, or t
  misc_feature (249)..(249): n is a, c, g, or t
  misc_feature (336)..(336): n is a, c, g, or t
aagaaatctgagaaaggaaggggttctgttgaagatggcttttgagaatcactgaactaaatgcctggtaggtcttgaaattctaacttctgacgtattagtccattttcatattgctatgaagaaataacagagactgggtacttttttttttttttttttttttttttngggaaggggnttttttttttncccccagggtggggggggggggccaaaaantggtttnattaaaaaacccctttncangtttaagggtttttcccccccaaaccccccgggggggggggaaaaaaggggccccccaaaaggcccaatttttttttgttttttttnggaaaaaagggttttacccttgg

SEQ ID NO: 191898 - DNA, 605 bp, Homo sapiens
catccgtataacaatataaaaaaataaaccaacttcaccttacacattccttttttttttcttttcttttcttttctttttttttaagacagagattcactcttattgccaaggctagagtgtaatggcatgatctcacctcactgcaacctctgcctcccacgttcaagtgattctcctcaaccttcaaagtagctgggattacaggcatcagccaccacgcccagctgatttttgtacttttagtagaggcagggtttcaccatgttggtcagtctggtcttgaactcctgacctcaggtgatccacccgcctcagcctcccaaaatgttgggattacaggcatgagccaccgtgcccggcctacacattcatttcttatgctgcatctttttcctcaaaactatcatcagtgttacacaatgaaacagtctcaaaaaagcttattaactttaaccacaaattaataaacattccaaccaaagatacctcttttgttcccttcatctaattcagagggttttttgacattatctgtgcctttgcatgcccttgctgttttatatactctctatataactgtattgcctaatgaaggaccgtca

SEQ ID NO: 191899 - DNA, 382 bp, Homo sapiens
ctacaccatcaatcttttgcaatgatgctttgtcttccaacttaaaaaaataaaccaacttcctctttacctcacctcctcctccagctgctgtccccatttctctctttcccttttctgcaaactttttgaaagagttggctatgctgacactccaattcccctcctatcatcctttctcattcccactattatcaggcattccacaaaagcccctttgctcaagtcaccaatgactgctcagctttcatcctctggttgatctatcagcagcacttggctgcagttgatcactgcccttgttccttcacttggctcagggtggcttctggctctcctccctcttggggcttgctctctttctcacccctctgctgtccct

SEQ ID NO: 191900 - DNA, 124 bp, Homo sapiens
agtatgtgtcaaataagtacaatcatcactgcactggtgcctgtaatcaccctgtgcacatagtgagaaacagacattctagaaaggattcttgattctcccactaactgtccactggactggt

SEQ ID NO: 191901 - DNA, 617 bp, Homo sapiens
gttgaaaaagccagtgtccccttacctccagacaagtccactagtttcccaacaatggttcttaaccattccaaaatgactgcaatgacagacacagaattgagaatctggatgtcaacgaagtgcattgagattcaggagaaaattgaaacccaatccaaggaatctagcaaaatgatccaagagctgaaagatgaaatagtcattttaagaaagaaccaaactgaatttctagagctgctaagtttactacaagaatttcataatacaatacaagtatgaacaacagaatagaccaagaggaggaaagactctcagagctcaaagactggttcttcaaatcaactcattcagacaaaaataaagaaaaaatttaaaacaatgaacaaaacctccaagaaatgtgggattatgttaagagaccaaatctaggctggacacggtggctcacgcctataatcccagcattttgggaggccgaggcgggcggatcatgaggtcaggagttcgagaccaacctggccaacatagtgaaaccctgtctttactaaaaatacaaaaattagccaggcgtagtggtgggcacctgtagtcccagctacttgggaagttgaggc

SEQ ID NO: 191902 - DNA, 140 bp, Homo sapiens
caatggaagagatagaaaacaaacaaacaaacaaaatctacgcttttacgccaattgattttcaacaaaggtaccaagaatattcactggggaagggacagtccctttgataaaaggtcctgggaaaactggatatctgt

SEQ ID NO: 191903 - DNA, 664 bp, Homo sapiens
tggaatccatggatatataaggctgactgtattaatatttacactctacttatataccttaacaaccttaaaactttaacttaaaacagtaacaacccttccctcaatcttaaacggcactataaaaccatataatgcctttgttcttcaacaccatgagtgccttaagggaaaaagaaaaagccatacatttaaaatacaaatacacaagaatttctgaaatatgaaattcatttttcattaaaaaaattaaacccaccagaaataaaaattgtatttgcccagtggattaagtttaaaatgcttagtatctactatttcaagagtcaaaatgagtatttcctgacttaagcagaaaatgaatactgtatctggcaagcagcttaagatttactaaattgaaagctgtattaacaaggctacaaagtaaatcactttttacataaacaaaatttgtaaacaaatagtacatacagtacatacagcaaaaactataaaagatttgtttataatagttgtgaaaattttcaaccttgtttctcaatttaaacctaataaatccagagataactattttcctgttccatccttctctatatactgatgaaaatattaaatgaacattgggggaaaatattccattcgtctccacacaaacaaatga

SEQ ID NO: 191904 - DNA, 519 bp, Homo sapiens
aatgtggatctttagtaactaaactaaactaaactaaagaccgttagtgagtgctcgttatatttgcacagtgatcgtatgaattaggttcttttgctatcttcatacaaatcaggaggaatcaaacacctaaaacatttgggcaacctgaccaaagtcacacagcaagttgctgagaacaaggacgaaatcatggtcctttcccttaaacataacacacactaacttggaaagggaaattggaaaagatgtgcattgaaattgggaaatctttttgctccctcctcacttcgttcacttagaagcagttaaaaggacagaccatgaagtcagacatctgggcttgaaagcgatctcagaaaattggtgtaaggcactttaaactcgctaatggctaatttatgaaatggcaggctagcagtccctatattatagtgttaaaatgactaaatgagataatgccatctgacgctcccctccacctcaccaccctattctctggaaaccacatgcatcact

SEQ ID NO: 191905 - DNA, 561 bp, Homo sapiens
aactcccctgaccccatctctgcctctgggtctttgctcagatgtccccttccctgactaggtcaccctctatacagtcccagattttgaggccctccagacctgtttttctacagcccgtaacacacctgcacctgcctagtttctcctcccacctggagtgtcacagatttcatctgccatctttgtttttcaccccagcttcaggaacaacagctgattctttaagagaatactcaatacattcaagttaaataaatgattctaagagtccacaaggtgccaagcctatgattcccgcattctcttaccctgagcaacttcatgtctacaaatgctgagtttctcaatgagtattaaaaaaaaatgaaagattgatcgggcacagtggctcacgcctgtaattccagcactttgggaggccgaggccgggggatcacgaggtcaggagatcgagaccagcctgggcaacatagtgaaaacccgtctctactaaaaaatacaaaaaattagctgggcgtggtggcaggcgcctgtagtcccagctattcgggaggctga

SEQ ID NO: 191906 - DNA, 627 bp, Homo sapiens
gaactgtgcagcaacttacattttatttattcatttttatctttctaattacaaaattaaagttctgcattgtttctttaacagaaacaattattgtttacataattttgactacttgattggaaatatagtcattattgtaaagtaaggataatttgaccacagttttgtgtttaatttcagaaataaaaattgattaattgagctcagatttaaacaaaataagtttattgtgtttccaaagtttctgcttaaaagaatgtgcctcataaaagccacacacacaaaaaagtttattttttgaatcgagggtggataaacctaatttccaacatgtagtaattttcagacatttatattaagtctaaaattacttcaaaatgaaagattaaaaatcattttttaaaacttatatagacaatttgaaacttacttcaaattgtctttccctaaatattcctaccaattctcaacctcttttagccctgaatctgttttctaattttcgtttttatgaattgcttcttgattcatgattttctctatttgtgttgagttctccacttcctacatttattttctgccccctttttccatggcatttattgtctattatgtgcagaacac

SEQ ID NO: 191907 - DNA, 276 bp, Homo sapiens
agtgagtacatttttgaacacataccttaaattttaattgtttttaagccccttattccctagttttaccaggatttagcctagaaccctattgggcactacagagagtggacaaatgaagcattctaatcaaatatgctgtgcgtggtagctcatgcttgtaatcccagcactttgggagaccaaggtcgggggaatcacatgaggtcaggagttcaagaccagcctggccaaaatggcgaaaccctgtctctactaaaactacaaaaatcagcc

SEQ ID NO: 191908 - DNA, 328 bp, Homo sapiens
gtggggagtggaggaaaatgagatctggtgggcacggggcctcagtccacagaggacgaggtgtggggtcacctgcagcctccctcactgtagctgctgccatcctgccatagctggcggggccctctgctccttgggccgggttgccttccttggtcatgacactaaccttttctaaagcactagatcattcccggtccgactaaccctctcaacaacctgtgaggaaggatcaatagcctgatttgacagatggggaaaccgaggcctagagatggccttattttcctggcaagctaagggcaagaactcagtatcctggcttcct

SEQ ID NO: 191909 - DNA, 246 bp, Homo sapiens
agaggggcttcactgtccttgtctgtggcgctcacggtttgccctgggacaagggagcccgacctcagccctggaggagcgactcttttatctagctgggaagtaggacgagagcatcccctctacaggggacagggatggcttcagggccccgggcacagcagtggctgctaggggtttctcagcttggtgaaatttcagggatgagatggtcccaggatagcggggttctggggaggctctgct

SEQ ID NO: 191910 - DNA, 381 bp, Homo sapiens
tgagttcaactgagccaaaatgatttttgtgtgttaagctctgaaaatactttggggagaacacagtgatatcatttaaaagttctctgcaggaaaccgggaaattaagtactagagtggaaagccgggtaggcactaaaacatctactgaaaattaggtctcctgttgatagaggaaaagactacacaagtcgattgttttaaagatcactaggcattttaaaggttcctagaacccgatctaaaatccaattttttggccaggagcagtagctcacgcctgtaatcccagcactttggaaggctgtggcgggtcaatcacctgaggtcaggagttcgagaccagcctggccaacatggtgaaactccgtctctactaaa

SEQ ID NO: 191911 - DNA, 1302 bp, Homo sapiens
gctccgagggagaggagcttgttacaaacacacattctatggaattgagagccatcgctgcatggaaaccaccccgagcttggcgtgtgctaataaatgtgtcttctgttggtggcaccacaacaaccctgtgggcactgaatggtggtggaagatggaccagcctgaaatgatcttgaaggaagccattgaaaaccatcagaacatgattaagcagtttaaaggaacctcgagccagttactcagctgtatgtcagtgtggatgccagtaccaaagacagcctgaagaaaatcgaccgcccactcttcaaggatttctggcagcaattccttgacagtttaaaagccttggcagtcaagatggagtctcactctgttgcccaggctggagtgcagcggcccaatctcagctcactgcagcctctgcctcctgagttcaagtgattctcctgcctgagcctcccgagtagctgggattacagcaacaacgaactgtctacagactgacgctcgtgaaagcatggaacgtggacgagctccaggcctacgcgcagctcgtgtccctggggaatcctgacttcatcgaagtgaagggcgttacctactgcagagaaagttcagcaagcagtcttaccatggcccatgtgccctggcatgaggaagtggtacagtttgtccgcgagctggtggatctgatccccgaatatgaaattgcatgtgaacacgaacactctaattgcctcctgatagcacacagaaagtttaaaattggtggtgaatggtggacatggatcgattataaccgcttccaggagctcatccaggaatatgaagatagtggtggatcaaaaacgttcagcgcaaaggattatatggccagaactcctcactgggcattatttggtgccaatgaaagaagctttgatcccaaggacacaagacatcagagaaagaacaaatcaaaggctatttctggatgttgagattatctgatttcaaggtactgaaggacaaaaacttggatggcctcaaaaggttcttgaacaccactctgattctccaaggacgaattacgtaaattatactttcatacaaaggagacgataaggcagtaaacatggagacacgggggacagcgtccacactcagagggcctgggccacagccccgatgtttcttttcagaactcagcccctttcctgattttacttctaagaggaaaattattttggggaggaactacacagtcgtgattagaatttaactgatggttttgtattataacttctaagacctgccaga

SEQ ID NO: 191912 - DNA, 1180 bp, Homo sapiens
gctccgagggagaggagcttgttacaaacacacattctatggaattgagagccatcgctgcatggaaaccaccccgagcttggcgtgtgctaataaatgtgtcttctgttggtggcaccacaacaaccctgtgggcactgaatggtggtggaagatggaccagcctgaaatgatcttgaaggaagccattgaaaaccatcagaacatgattaagcagtttaaaggaacctcgagccagttactcagctgtatgtcagtgtggatgccagtaccaaagacagcctgaagaaaatcgaccgcccactcttcaaggatttctggcagcaattccttgacagtttaaaagccttggcagtcaagcaacaacgaactgtctacagactgacgctcgtgaaagcatggaacgtggacgagctccaggcctacgcgcagctcgtgtccctggggaatcctgacttcatcgaagtgaagggcgttacctactgcagagaaagttcagcaagcagtcttaccatggcccatgtgccctggcatgaggaagtggtacagtttgtccgcgagctggtggatctgatccccgaatatgaaattgcatgtgaacacgaacactctaattgcctcctgatagcacacagaaagtttaaaattggtggtgaatggtggacatggatcgattataaccgcttccaggagctcatccaggaatatgaagatagtggtggatcaaaaacgttcagcgcaaaggattatatggccagaactcctcactgggcattatttggtgccaatgaaagaagctttgatcccaaggacacaagacatcagagaaagaacaaatcaaaggctatttctggatgttgagattatctgatttcaaggtactgaaggacaaaaacttggatggcctcaaaaggttcttgaacaccactctgattctccaaggacgaattacgtaaattatactttcatacaaaggagacgataaggcagtaaacatggagacacgggggacagcgtccacactcagagggcctgggccacagccccgatgtttcttttcagaactcagcccctttcctgattttacttctaagaggaaaattattttggggaggaactacacagtcgtgattagaatttaactgatggttttgtattataacttctaagacctgccaga

SEQ ID NO: 191913 - DNA, 627 bp, Homo sapiens
gcaggcttccttcacaagcactgcaggtttcgataggatagtattggtagataacggtggacaagtagactgggtcaaattatccagaaatgctttgcataaatccaaaggattgtagtttatgatctgtgattggattctgagcagaaactagaatgataaggtaattgatgacaagatgcagaatggtttagtgttagagagactggtagcaaagagatcagttagggggcttccaccatgtttgagagtgaggtagatgaggctttgatattctgcttaggaatttttaagatgatcatattttaagtaatatctagcttaagaagtaatattttaatttttttattattacagaagtgatacataattgcaatgcaaacatttagaaaatagaattagtaagaaaaagaaaataaaacttgcccttaatctcagcatgtagggctaaaactagtattagcattttggcatctttcctgctaatctttttattttatcattccttttcttactctcttcactgtgaactgaactagcaaatgcatggaaagttgactttacatacattttattccattacaccaaaatctttagatatacttgttatatcataaaatggtatag

SEQ ID NO: 191914 - DNA, 314 bp, Homo sapiens
tatgctcattcagttctccaagtacaatcagcatttcctataataataagacatagtttatatgagacataggtaattacacaactgaaatctatgggataatatattctaaacaagctgaagggcaaatattattcttcccactaaaataattacacctagctgggtatttctccatgtaagcttaaatttcttaagtacatgggcctgtcttgcttcactttttattctttagcacttaagcacacctttcacgagtaagtatgaggatgacataacattatgtatgctaaagtcttatgaactgaaaatgg

SEQ ID NO: 191915 - DNA, 370 bp, Homo sapiens
acagatggcaccagggacaataaaatgcaacagagttgggatggacggggtccatgcaggcagccagaaatccaggcaagtgctgataggacctggaatgatgcagcgactgtgaggacagatgtcggacaccatctcataggacctagtgaccaaatccccacgctctccatcccgcctcagcttcctccccggcttccctagtggctgtccaggggtctcagcctgaatttctccctctgcaatgggttcgagacagctcgtttcagaaaaccgggctagtcaccttcccactggtcctctgtttcttacaagagtagccccacaactcagcctctcctggcccccgccttaccaagcaccagatatt

SEQ ID NO: 191916 - DNA, 394 bp, Homo sapiens
gtcgcgccaccgcactgtagcctgagtggcagagtcttagtctcaaaaaaagaaaagacattatcatcttgagccatcaaattcactgttactgaaattctttgctaaacctgaaggcaaaacaaatttagtctttttgtcttagaccaaaggctgtatgtttctttggtaggtaaggggaacagagcacaggtgacctacttactcatatctgttcatctcccagtatggggttgcctcctctgaactagggcaagggtcaagtctctgacttggtttttccctgaaaatggtcacaaagtctgctcagcattgtttagggatgtggatgcattggccccatcacctgcccatctaaagtaagcatgttatgtaatctaacaaatatttacca

SEQ ID NO: 191917 - DNA, 400 bp, Homo sapiens
ggtgggccccccccaaaataaaaaaaaaaaaaaaaaaaattaaaaaaaaaaaaaaaaaataaaaaaaagaaaaagaaaatgaaatacttgtaagcgtatggccagcatcctctgttgaataataccaaagacaggagtttcccccaaccccaaaaatcatgctttattttagagtgagaaaaggccagattagggttataagtggagggctgaaagtttgactttcagttgccaaagtttagccttaatactgctgatgattagaaaaactgtgatctaacttacaaactagatttgattgaatcattgggtaaatagaatatacaaaagtgctcccctgtcataactttttaaaccatatttgtgctatttaattctattccttcttgttttctactaa

SEQ ID NO: 191918 - DNA, 842 bp, Homo sapiens
cttactgtatttttaaatgagtgtctgtctggccacttttcattctttataaaaatatagtatcaacctgaagttctaaagagttccttggcccctgttcgaagctttcaggatactttccatactttatggaattctgtagtttgggccttttaaaaactaatttcttttgcacagttaaacaactactatatatagaaaaaaagaaaaatcttgtttattgacaattatttttatcttgtttcattctcttccagtccatgtgtagacatgtccgtatgtattagatgcctttgtatagtttaatttgagtttatatcattttttctgttcgttccatgtattagttgagttcacatatttatttatttatcttttttttttcagacagagtctccttctttcacccaggctggagtgcaatcacgatgttgcagtgagctgagatcgtgccactgcattccagcctgggcaacagatagagactgcatctcgaaaaaaaaaaaaaaagaaaaagaaaatgaaatacttgtaagcgtatggccagcatcctctgttgaataataccaaagacaggagtttcccccaaccccaaaaatcatgctttattttagagtgagaaaaggccagattagggttataagtggagggctgaaagtttgactttcagttgccaaagtttagccttaatactgctgatgattagaaaaactgtgatctaacttacaaactagatttgattgaatcattgggtaaatagaatatacaaaagtgctcccctgtcataactttttaaaccatatttgtgctatttaattctattccttcttgttttctactaa

SEQ ID NO: 191919 - DNA, 600 bp, Homo sapiens
aagttgatctgatctcttaaaagaaggctatatcattctcatagcggtgtacctgctccataaaaaggatttttttttcaactttgttaactgtgatttcatgtcttaatggggatggtgccatcaaaatcattcattttgaaattttgttttaatggaaggattttaattgtggttagggaattcagcctccatatatagaatctggaactgaggatgaactttgcaccattctatcaataagcaggtgataaatatcagctatttttgtttaaattactctgcacccagcttttgcctttcggtcgtattgcaatcaggagatatttattccagcttgtgatagtgttggaatgggtagtaattttaagcacagtaccggctctttaggagcttacgattctgccattatttttcacttaaaaaattctttgagaccttcctattctttgcatctggggggttctgagaagctaaggaatttatgatattaactggcactttggaaggcaagggagccttggaatcttgcctatagaacctgttccatacacctgaagaatagcatttattctactaattatgcagcataccctataa

SEQ ID NO: 191920 - DNA, 335 bp, Homo sapiens
catgcagaataaagctgtcccctctaaatatgtttacacactgccacctacttggcaaaagagatagaagatcttcagcctttaggaagtctggatgcaagggtccagaaggaagagagagtggactggtcattgtagtgggaattggcaagagcaggactgatgtgcttgtcatttctctctggggcagagctgatgtgaggtgtgttgaggggacagcagtgcttctagggagaagctcggttcagcgccttggggaccttgggcctggtgtagcccagcattccgtggggcttttggaatcctgttgctggcatctgccaaccctggggagc

SEQ ID NO: 191921 - DNA, 271 bp, Homo sapiens
cgggccaggacggatgtgcgacggatgtgtagttgcaaaagtgaagcttttgttaatgaaagatttaggttagacttctgaaagaacttccagctcagggtgaaggagtcaatccaaaggaaagtcagagcatctccttctgataaaaagggcagtgtttccaggcaaggggctggattccatgacctccccgaagactcagggctacagaagggtcggcagagcccccatggcacccccagggagcccccacatccgtactgacccggac

SEQ ID NO: 191922 - DNA, 435 bp, Homo sapiens
ctttggagaggatagtggtgcagaggtgtggaggtaggtctgtgcttggcctagaagacccaaattgaggaggttgtgcctgcaaagctggagggtacattcattgatcccactaggagcaagagacacatagcaggttgtggttaaacaccagaggaaagacagacaactccctacgaagttccaggatgtgtagttgcaaaagtgaagcttttgttaatgaaagatttaggttagacttctgaaagaacttccagctcagggtgaaggagtcaatccaaaggaaagtcagagcatctccttctgataaaaagggcagtgtttccaggcaaggggctggattccatgacctccccgaagactcagggctacagaagggtcggcagagcccccatggcacccccagggagcccccacatccgtactgacccggac

SEQ ID NO: 191923 - DNA, 228 bp, Homo sapiens
gggatgccatctttcttctgcccttgcacatcatactccaggttctttgggttttggactctggaacttgcaccagcagcctctcggggattctcaggccttcagccacaggttggggactacgcttttgtctttcctagttctaaggcttttggactggaatgaagccaccagcttttctggttctccagtttgtggacaccctgttagtgagacttcttcaccttt

SEQ ID NO: 191924 - DNA, 1147 bp, Homo sapiens
accccaaatggatccttcctagttgaggcttcccccaaaaagtcaatctaagtcatcactagtgattctcattcatataactattttaattgtttgcatactatttttcgctaatattttgtatgtttgtgtattattggctctatttatcttccaccactggagatgtgagcaatgacttttatcttgctcacttctcagttacctgatcttagaacaatatctggcaagtattaggccctccataattattttttgaacaaattaatgaaggaatgcatgcatacactcatgccatgggcccagcactctggtaaatctccctgatggaggcatccttcgacttgtattctgctctacttgtccccttcccttcttgcatacacagcctagtttctaggaaaagtgacctatgttctgttcttcagcagctttctacttataataaatccattacaatctggcttgtacctctacccctcgaaagaaactactcacaatagtttctccacttgccaacaacttcctatttgctaagtccagtggatttcatagtcttcatcttatataacccatcagtagcttttaacagtttcttccttgaaacatccattctgccttcatatctatgacatcatctcttttgtttttatttctcttaagccatgtatgcttgtggctgcaatttgatgtcacgtcaaataatatagctgtctttgtgggtggaaaatcatttctgcttaataatttcatgtcttcacagtgttctatctgaagaaatttgtgaaccactgcaataagggatacatggcttacatgcgtacctgttaaaactctgtttaggctgggtgtggtggctcatgcctgtaatcccagcatttggggaggctgaggcaggcggatcacttgaagtcaggatcaacctgaccaacatggcaaaacctcatctctactaaaaatacaaaaattagccaggcgtgctggcatgtgcctgtaatcccagctactctgaaggctgaggcaggaggacaacttgaacccaggaggccgaggttgcagtgagccgagatcgtgccactgtgctgcagcctgagtgacagagcaagactccatctcaaaaaaaaaaaaaaaactcttgtttaatgac

SEQ ID NO: 191925 - DNA, 326 bp, Homo sapiens
catcttttttcctcaaaacttattaaattgataaaggaggaaatgtggtatttcattcagagatcattctccttttttcaatatgactgcttctaaagtagagtgaaggtgtatggatttttttttttttttttttaatcaagacaaggcctcactttgtcacccaggctggagtgcagtggcgtaatctcggctcactgcagccttgacctcccaggttcaagtgatcctccgtgcagtttagatatgatatgccttagatgtggtttttttttttttttttttttgggggtttaaaccggggggggggccctgggacctcccgg

SEQ ID NO: 191926 - DNA, 149 bp, Homo sapiens
ttctgcaggaagcaacggacttgccctcgggacagggcagctgccccaccccaagggagcacctttgggagagcaaagttctgtttccacatcgggatgcctgtggggcctctgcctcctggtcacgccactaaggccactttggctgc

SEQ ID NO: 191927 - DNA, 514 bp, Homo sapiens
ggaggctggcatttctggccatgtttctggcctctggcttagggaggtactctgcttcccatggtaaggaagtaagtggtatcagaactagcctcctctctataggaagctataaaactggacaaaagaaatgaagcaattgtgtcagcctgtagacaacaggcagcgtaaaatttcagttcctaagagaaggaaaactcgaggtgagcgccacatttgctcagttttctgtctgaggacggtttcccaaccctgttctgtgagtggagtctaaacaggctgtgatgatttcccctgagctgaagaggcagaggtcagagtttgggcagctgaagcagttggaatctgtggggtggaccatcatagggtagggaattgttcagcaagagggtctcagaagtctgtgggggcattcctgtgaggctgaagctaaggactggcctattatttatacatggggtgaagccacctgaagcttaccatatagacagcagctggtacaggatgaatagaa

SEQ ID NO: 191928 - DNA, 152 bp, Homo sapiens
atattccaaagagagtttccaaacttctcaaatctactgctctatctcagtctgtccattcctctttctccttgatcacccttctctaccccaaggctgagaggtgattgactctcagtcatcatttccactccttgggtggtgcaacatac

SEQ ID NO: 191929 - DNA, 679 bp, Homo sapiens
agtgctgggataaaggtgtgagccaccacacctggcctaatcatatatttttaaaactggaagtggtctatgagattctaatccaaatccctttattcccaattaggaaatctagagaagtgatatgacttgacttaaggtttcacagaatacctcaaatgccacttcccagctacaggccgtatgtcctcaccactagacccattttcatttcattgttcccaccatagctctaaggcagatcacctgtgtgatctttaagaaactactcgtctagaatccagtgaaaagcacaaaaggggtcaattccggagttagctttttagtacttttgaacttaaaaaaaaaaaaaagaagctactcatctaaagatagagctagatagtctctggaacctttcataactctcttatctgtgtgatatttgccatcattctataaatctggatttgcaaatcttacatttcagccttttgtttttcaagtttaatgcctgtttgggataatttgtctacaggtaaatgtctagccctgtggttttcaaagtgtggttcccaaaccattagtatcatgttagaagtgacaggtctcagaccacacatcagacctgctaactcagaaactttgggattggagatcacttcgtttagcaagctctctaggtgatgctaatatatgc

SEQ ID NO: 191930 - DNA, 303 bp, Homo sapiens
ccctgcagcccccaagagcacacgcaacctgccccacccacacccttctctgttccttgcccttgaccttgcagactcaaccttccggattcacttcccccttgctcactctgctccagccacaaaagccaatttttggttcctcaaatcaaactaactcatgacagcattttgaattttgaagccttggggccccgaaaaagtccatcttttttttttttttttaagatcgagtctcactgtgttgcccaggctggagtgcaatgacttgattcacggctctcactgttctcctcgattctc

SEQ ID NO: 191931 - DNA, 308 bp, Homo sapiens
caagtagcagagctgggattcaaaccccagaaagctggcctcagggtccatgtcgtgaaccactagcctacactgactcccacatctctgatctgcaaactgtgccttttccatttctttctcaagacataactttcagaaattagccagtgctttgacaagtggagcacctaaagtaaaatcccagagatgggttctggggagactaagccgaactactcaacagctcccctgggcgcctaccacatgattctcctgaaggagtttactggccacacagatcgcctcgccacatctgtacttatcat

SEQ ID NO: 191932 - DNA, 322 bp, Homo sapiens
ccgagcagccaatcaagaacaacgagctaatgacttggaacaaattatggaaagtgtgaaatccaaaattggtgaattggaggatgaatcactaagtagggcttgccaccaacagaataaaataaaagatcttcaaaaggagcagaaaactttacaggtactgagttatgaattcttagatgatggttagttagtactaaaacagctcattatggtcccaggtgacttccatgttgtttgattcagtggtttttaccttttttggcttatcactgctaccttgaaattctcttcacttggtttctagaatgtcctttatttc

SEQ ID NO: 191933 - DNA, 372 bp, Homo sapiens
ggcaccatcactataacattaagaacttggaatgcatgggatatcccaataggattctactagtgtagcactgatggtattagttatggaatttatctgatttaaaaattgccagcttagtgtcagcctgatagactatatagtattgtcttttttttaaaatactagagccaagtgtgagccatattaggtgatttgtaggtaatgcaggtaattagtaggatgaggcaatgaataggatacgatctgaggtcagaggagaaatatttggggaagattaagttaaataagttaaacaattttgagaggtagaaattctgtattttgtctctttgacttgagccaactactgataaaattatattttcaaaa

SEQ ID NO: 191934 - DNA, 449 bp, Homo sapiens
tgcctcccgggttcacgccattctcctgcctcagcctcccgagtagctgggactacaggtgcccgccaccatgcccagctaattttttgtatttttagtagagacggggtttcaccgtgtttggtttagccaggatggtctcaatctcctgaccttgtgatctgtccgcctcggcctcccaaagtgctgggattacaggcgtgagccaccacgcccggcctatcacatcttaattaaaataattaacaacattatccaccactaatcagcatgtagactttcctgattgtttcataaatggtttttaaagttggtttatttgaatcagaatcaaaataagtctatacagcataattggtcaatatgtctcttaagttacttttaacgtatagtttatcctttccctttttttcttgcattttatttgttgaggaaatggtcatttttca

SEQ ID NO: 191935 - DNA, 482 bp, Homo sapiens
gggcgggcagaggggagattataggtgaattcagaatgtgtttgaagagtggtgagagaactgggacagcatacgtatgcagtttgcaaatagccagggcttgaaaatagtggagggaaaataagtgaactagcacttgggtccagattatggtggtctttgactatcaggctgaagcttcgcattttctcacgttgatcagtacatttcaaaatgagctgtggactgtggagttaaaggtcttgctggggaggtggcaaaagagggaggccaattcagggaagagaaatgcctgggacctgacccttcccttcctcggttccttctccctctaccctctgctttagcttgtcccggcttctctctcctctctctctctctttcttttttcttgctatatttggtatgccatgtaagatttcatctgaaaaaagcatcctgttattttattttactttttacgaatttgaaacacactgatg

SEQ ID NO: 191936 - DNA, 584 bp, Homo sapiens
ttatcatgctcatcaagccacattttttaaaaaatgactatctttgttaaattatctatagtaagagaatgcaatgagcagaaggctctggcaagtatttcattaattatttatttgtgttacagttgaatacattattattctagtatttatatgtcagtctcaaatgaatgtagtgacagaagccagtatctaagagccagattacccttaggtatatgaacagttttatttaaaatgaacttgaaaaattagatcttgaaatacagaaaccttcaaaagacttcatctactatgtatactagcctggatgatctgtcagcctttgtcaggcaaaaaaagcccttcggttttattaaagtctcaatcaagctgcatgatatatgaatttcttaaaaactcaaggtcattattgtgagcacctctgattgtattgtgtgatattattgtttgcagaataacagaatgttgtggctagaagagagcttagtagtcatctagtaaaatctctttattttaaagatggggaaattgaaactttcctttaaagctagcaattagagaactttgggttcctgatggtt

SEQ ID NO: 191937 - DNA, 538 bp, Homo sapiens
tgttatagatcagtttagtaatggtgggagggaagcagagggagtccaaaccacacaccactattttttgcagtagagtaggaagttaattatctgctgggaatggatgttcaggaatggagtaagaagtctcagcagcctcttaggtaaagaagcaaagatcatcagtaaagacacatgccagaaagcaatcctacctacttttgccccttagaactagtgtctggcttgaagaactggagtctctagctacactgggttacgtacaaaaaggatgaagtcagatctctcctcaatggacactaaaataaaggtctggggtagagtggggtgtccacaagttgtacttagttctgacccaacgcaatccccctaatgaatttaaaagtggccttataagaatggaagaggccaacttagaattaaaaagggcagggcagtttaaagtcaataacatccagaattatggccttaacaagcacctaagtaccatgagggaataaaaacaagatatccctactgtctatatactacatct

SEQ ID NO: 191938 - DNA, 597 bp, Homo sapiens
gctcggtaccccactgcatgtacttgcctttgtgtacttgtctgtttccatagggtaaattcctgaaagtataattcacaggaagttgcagaaatgagtcagcggccttacgttaggaaacaaggtgacaagaaggctacttccacatgaagggacaggactttacttggtgagatacaagactgggctgccctcttcactgtccccaatttttagtagttagtagcaattctaacctcaatatagaaagcacacttaaagacaaacatagtaacatgctgaagtatacaaatggctaagtcagacattaaaaaccttacaaaagattctatttcatagtaatagtaacaatcttaaaaggataaaatattcttccttcttatcagaggcaaaggcttttagatacgccactggtaggaaaataaattggtacaactttactggagggcaatttggcaaaatgttattgaagagttttaaaaggtgcaaggcctctgactcatttctgcaacttcctgtgaattatactttcaggaatttaccctatggaaacagacaagtacacaaaggtaagtacatgcagtgttacttacaaca

SEQ ID NO: 191939 - DNA, 558 bp, Homo sapiens
gtaggttcaagtacttaacaagtacttccagtctttctggaatctccacctgaaacaggaggatttcatataatttatcatttaaactgggaccctttgagagtaattactaataacatcaggacaacagataaaacagatataagctagggctgtcttggcaaacttggacacatgatctccctaccttgaagatcctacacccttgggtgcacaggtacttaaaagacccccatcatgcaacccttgctgctttacagactttgctcttgtctgaccctaataacttgtgatgaagacttgacaagaccttgcaaaaccagtctttctggagtctccacctgaagcagaagaggtcctcagcaggggtatggtagcatggtgccagtctcagagcaatcctataaaaccttttaaaagcattggccagtgatcaggtggtagtaggccccatctctgcttgtacatctcagtttcacttgaaacttttcagagaagattatgccatgatactggaaagaatgctggatcaaaagtcagaagacccaagttccagct

SEQ ID NO: 191940 - DNA, 589 bp, Homo sapiens
acaatagcgagggactgtgtacttcctgcagatcatggagatcatggaagcctcccaggggaggcacatctcggtagtgacgtgagtgaggaacggagctggtgctgcccatgccagggaggccaagctgagccaaggacacagaatatggtatgttctgaggacagggccacagccaaccagccaggcgggaaagagcaggtggtagggagagtggcagaaaggagagaagaggggtgcacagcacctggacaatgggaacctttgtaaaagacagagcaagaaacttgacttttcctggagatgggatggagagcctatggcgagcttcagccagacaatgatatcctctgatattcactttaaaagctgactctgacactctgtgagaaatagatggcacaggggaaggagtggaggcagggaggccaagtggctggtgaagacttgcatttgagagtcaggtggacacgaggaacatggctgtgtttaggatgatagcacctgtggagggactggagtagaagatgtcaactgaagaatcacaggattcaaaatttggaaagaactttatttctcatgaagggtt

SEQ ID NO: 191941 - DNA, 239 bp, Homo sapiens
gcctggagtggagagtgagggctggcctgacgtgaggtggtggaccagaccacattctggtctttatcttgagaacaatgaaaacttaaagggttttcaagcatgggtgtaacagcaactgaaaagctcactggcctgcagtctggagaatacatattgggagattaaaaccttacagaaaaaaggccagagaggatggtcatttgcactaaggtgacagtgtggcagtggagatggag

SEQ ID NO: 191942 - DNA, 332 bp, Homo sapiens
ctcgccgcccctgccctgtctccagcttattgttcatatcactgtagcatacgttatagtcatatttcttttgtaacctgagctgtgagtttctgtttttttcacacaataaataacaccacagtgaatctctctctctctctctctctctctctctgtgtgtgtgtgtgtgtgtgtgtgtgtgtgtgtgtggttttttttcttcttttgaattgttcccaggaaccttccttgattctccacaagaaacacttcccagtcctatgtggtcctgttcccacaaattaacacatgtgaagatcaggtctatcagggctgctcctcagtgccca

SEQ ID NO: 191943 - DNA, 486 bp, Homo sapiens
tatttcttttttcaccccatatatatttattaaatgaactggaaattttttcagttaaaaaaagaaagaaaatatggaattctgtcaacccaagaacctggcaattatcgcttgcaaacatgtgacatgggttattttttgttgggattaggttgtcttttttcagaaacaacagattattagttatactttcagtaaggattaacagtaagcatccatttttaacttacaatgtattcatagtaaatagtgttggttttttttctaagagtttataacttatggaaaatgttaatactttagctccagggctaaccttaattggaaaattagcatatatgtttctagaaacatttttcattagaaaataaaagcaaggctcagcttttgagagcagcactaatgaggacctttggttaaattatttgaatatgatgccagattttatatttttcttttccatcttgtcattagccacattaggcc

SEQ ID NO: 191944 - DNA, 641 bp, Homo sapiens
caattccattctttaatctcaatactcactttttaaatgatttcatctagtcccacggctttaaatatctatagactgaggactcccaaatttttatctccagtcctagcatcagtcttgagctgcagatttgtatatgcacctgcctacctaacatctctacttgaatagagtttatatgagggacttgagcctttgtggattttggtatctgttggtcaggggaggtcctggaaccattcccccatggatactgaggaatgactgtagtgagatttgggatacatcttgaaggtggaatcaatagaattggatgtgggttatacggcatcatatttgcatataacctcccatatactttttttttcctgagacgaagtctcactctgtcgcccaggatggagtgcagtggcacaatcttggctcactgcaacctctgcctcctgggttcaagcgattctcctgtctcagcctcctgagtagctgggattacaggcagtctgccaccatgcccggctaatttttgtatttttggtagagagggtttcaccatgttagccaggctggtcttgaactcctgacatcagggatccacccgcctcgcctcccaaatgcctcttggaattacaggtataagccac

SEQ ID NO: 191945 - DNA, 209 bp, Homo sapiens
ctttcagtccctcaaacatgcagtgccttgttttcccttgcctgcttcatctgtgcagagccatgcacctgggatgcccgaagccctttcctatgctctcaccagccccctgatccccaccgtgccttgccttttccccctcatcaaatcagtagaacatcaaccgctcagggaggctcttgttgattcctgagtagatatctgctact

SEQ ID NO: 191946 - DNA, 376 bp, Homo sapiens
cagacactgggtactccaaaagtggggagagaaggaggtggggaggggctgaaaaacatcctcttgggtactgtgtgcaccacctgggtgagaggatcaatggaaacccaaaccttagcatcatgaatatacccttgtaacaaacctgcccatgtaaccagtgaatctaaaataaataaaatgggggtcatgatagcacttccctcctagactgtgaagatgaaatgtggtagtacatgtgaagtattttgagcaatgttcaagcatgcctttgataaatgtgagctattagtattcaggacggtcatgtaaataattcagtgtccaaatgtgggccctttaatctgggacaaaggctgaactatatagaactcta

SEQ ID NO: 191947 - DNA, 768 bp, Homo sapiens
agacctagaaagtgcctaccatatatagttcaataaatgatagccctattatttttacaataatttttgccatcttgaaaagtgaaaagaaacattttgttgctttaatttgaatttctttgatgcttagcgaggctgagcttctataaaagtttggtgttgctttttgtatctacatcctttatctggtttttgtagcttgttgattcttctgaattatctggccacgtgggtaatcaaacacttcccagtttctcagggacagtcctgattcctgtctgctgtaccaactgatgattaacatgaacgctttgtatttagaaagataaattataggcaggacatggtgactcacacctgtaatcccagcactttgggatgtcgaggcgggcagatcacctgaagtaatgaggtccagagtttgagaccagcctggccaacatggtgaaaccccatctctactaaaaatacaaaaaaaaactcgagttttttttcttttttttaaatcgattgtatcaatttcacattttttcggagaattgctcttgagcacattgctacaggtcagattcttcctaattttctgcttttctctttctaaactgattggaagaatgcactggtcattgctgatcatggggttcccatgacgtatattagttaacattggcattttctggagcaaagattttgctttaatcctttattggtagaccgcctttgaattccttttgaaagtgcatattcttaactacctttgaggtcttt

SEQ ID NO: 191948 - DNA, 373 bp, Homo sapiens
agacctagaaagtgcctaccatatatagttcaataaatgatagccctattatttttacaataatttttgccatcttgaaaagtgaaaagaaacattttgttgctttaatttgaatttctttgatgcttagcgaggctgagcttctataaaagtttggtgttgctttttgtatctacatcctttatctggtttttgtagcttgttgattcttctgaattatctggccacgtgggtaatccacacatctccatacatctactggccaggcaaaatggctcatgcctatcatcccagcattttgggaggctgaggcgggcggatcacttgaggccaggagttcgggaccagcctgatcaacatggtagaaccgact

SEQ ID NO: 191949 - DNA, 313 bp, Homo sapiens
ataagtgactgtaggtgtaaagtagtacagaagagggaaataaagataacttctgtccactttagcttttaacatgcaatgctttcccttcaactcctgaaactatcacactgtcagggaagaggcaccaaattgtacagaatgacaacacttgtataagggtaatggaaactaaccaagccacttgacaatgctctacccatgtgttccaaaagtcaccaaaatagaagtgctttctaaaattcagcactaatgttaagataatacacaccaaacattactagataaaaaatttctcccacatgctatcact

SEQ ID NO: 191950 - DNA, 494 bp, Homo sapiens
cttagacaccccccattagccacctggacttacccacctggccttaactttatggccttacccacctagatgaccgatatagcttactaacctggcattcccacctggccttaaccttttgttctaactcacatggctttaacctcctgaactaacctgcctagctttaacctcttactattacccaggtggagctatctacctacccatatttagggaggccttaacttactggcattacccacccaggcttttcaatcacttggcttcctgacccagtcttaaccttatggttttgccaacttatatttaaccacctgccttataaacctcctggccttttgcattcagtatgaattccctggccttatgcacctgccttacccacctgtccataccccactggtgttaagatcgtgtcttaaccaaccagtagtacccaactgatcttaccttcaaaaccttccagttgccattcataattcatctcactc

SEQ ID NO: 191951 - DNA, 224 bp, Homo sapiens
agccgagatcttgccactgcactccagcctgcgtgacgagcgaaactccatccccttcccccagcaaaaaaagaaaagaaaagcgtacatctgtttaacaggtaatatcaggcccaggccaggtgctggggattcagagagaatcaaacaaatcttccacgtgatggaggacagactggctaaactggtcacatcctgggtgacaagagtgaaactccatcttt

SEQ ID NO: 191952 - DNA, 251 bp, Homo sapiens
cactaatcatcaagacaagttcatcagaaagcccaatactagaaattaatatttaggcataacataagaaagaaaaagaacatgtgagttattttaatatgactcaattctttacactgaaatagaacaaatttctagtaagagtgcctatattcaaataacacaaaatatcattacaaatataaagcaaacaaattttaagtaaacatggatcttaaaatgcttaagagaaagctgaaatcacatcacag

SEQ ID NO: 191953 - DNA, 191 bp, Homo sapiens
ttgaatccatgtcacagggggacatgaatcatgtctctagggcaacccaaactaaaataggatttcatcaacatagtgagtgcttttaactagtcggggttaaagttataaaagtgactttgtgggctctttcagagaactttgcctacagtaaagtcctgattttaggagaagctgatttttaaagtgta

SEQ ID NO: 191954 - DNA, 377 bp, Homo sapiens
ctgggctcaagtgatcctcctgcctctgtcctctgtgtagctgggaccacagacatgcaccatcatgccaggctaatttttagattttttgtagacttagggtctcactttgttgcccaggctggtctcaaactcctgggctcaagtgatcctcttgcattggcctcttaaagtgttgagattataggcatgggccactgtgtcccacctcgcattagtttattgaaaagaatgttatgtaaaattttaaaaacatctacaaaactaaatgcaacagtataataatcctctctttacccagcactcagcttcaataatttttaattcataattgaatttatttatagcttctcctacttttctctactcccatattg

SEQ ID NO: 191955 - DNA, 372 bp, Homo sapiens
cattctgccgggaccacagctgactgtcggaacatctcctcaggcactatcaacaagcatttgcagagcacttactctgcaacagggccacctccaaactgccaagcccacaggactctctgcacatgggcctctggtaactacctcttcctcccaagaaagctcactttctccaggcacagaccaaatctcccaactcttttcaatcatctatgaggcctctaacaatggccccaaccctggtagcccatgagaacacctgcaaagtatgaggcctgggttccattccataccacctgaacaagaaccagagcctgtcacattactggcaaggcatgtcctgaccacctcctcatcccctgcatgcccaat

SEQ ID NO: 191956 - DNA, 659 bp, Homo sapiens
accatgggagccaagggctagtttcgccttcattcttctgactgctggagaacacagaaacttcaggagctgtggacgggatgggaaccaggggcacattcatccgtctttgccgggcatggagatttggcctgccccctttccagagtttttcttagaaggtggtcttttctggactgctaaggaacgtcgtgtgctttctcttctcagtaatctgcttttttgaggaacgattttaacggcagatagtaagagttcctcaaggaaagtaaacagaccttttctaccccctcgaaatgtgattttaggaaatgatattcaacttcagaaaggaggcatcttaagtcacaggaggaagttgtgtttatttttactcctctcctgactttaaagtagtttttaatctgttggtagcattagggagaatgcagctaaaataagtttttgctggatgttcatgttttgcgtagctgctgccatttcggaaaaagctcctcccccattcacaaagcccttctccttccacgtgggagctgaggtcccaaagtggaaccaactctgtagcttaagggaggtgcattcctggcccctcactttctaaccctcaccttaagtggaatatgtagataatatgtagatcattaaccattgttggtgtc

SEQ ID NO: 191957 - DNA, 354 bp, Homo sapiens
cccccgccccccgccaacgggcacacacacacaccagaggcatggtgcctgggctatttgatcactgagtacagtgtgattggattaaaggttataccgtaaaggttgagaaggtcagtgatcaaagaggaggctagaggagaatggggtacataaatcctggtcctttaaagtatctcttgagctcctagtgactaacactttactataagtcaagtccttctgtattgaatactcccttgatctgtcctgaaaatgggacactccttcttggccctaacttgtaaattaaaaaaaaaaaacaaaagaatcataacttattctaaaagataggtgtgggtgaggaaattcttc

SEQ ID NO: 191958 - DNA, 658 bp, Homo sapiens
ttaatcccaaagcaaactatttttacttgaccttgggcatcagtgacctatttgcatatgaggacatgaacagcttagttttttctgggatattgatttctttggaacaatgactgaataatattgtgttattttagtaatttgaatctgagacttaccacctaattactgttacaaagaaaagggtagtttaatattttttatacatttaaatgaatgatgatgcattagtaatttatggcctatgtgtttacctaatttaccctttattatgtattttctattaaatatacagttttacttgtgatgttgcagctttaagtcaggcaagtcctaagtcctttataaaattatttctcagttggaagacagggccttaccactttccaaaaatcttgtctctcatttagttactgtgtgcatctgtacacacacatgcttcctcactgttactctcagcaaatattttttgggtatctgttacatcccaacactggtagttgcttgatatttagtagtgaataaaacaggggtgttcctaggaattagagaattcatagtcttgtgaaggatgtcaacaagtaaaatggcaattaaaactgaaggactaagatgaagaagtgtaagccgctttgggagttcctgggaaggaatgagg

SEQ ID NO: 191959 - DNA, 165 bp, Homo sapiens
tgtgaactgatgaggacctcagaaaccacatgctatttaacacacagtaatacttcactgcaacattcccactctcttctggagggaatattaaaagaggtagaacagatgcttccccaaattaagctgatcccagcagtagaaagactgttcccagcagagtgg

SEQ ID NO: 191960 - DNA, 157 bp, Homo sapiens
ttacgttctctgtcagaggtttcattgagccattcaggtagtgtgtatttgggctgcaaaactaactgagggtccactcctgattacaaattcttagggggattttgtttttctctgctcaggaccaacctttaagacaagtgatttttcttgtatt

SEQ ID NO: 191961 - DNA, 425 bp, Homo sapiens
ccttaaaacttggggtgtttgtaattctagtcccaataaagtatcagtctggaggtttgtaaactcgaggaacacatgttgttttttcctttagccccaaaggctaaaaaacgtaggagtgcttgttccagaaacctaacggtggtacacagggccgaaatgctgctgatttagtatggcttaatttattgtttcggttctgcaatgaaatgttaatgaggagtagcatattttgtcaatgatgtgtgtactagtttgttgggctggatgttttgctttctaggaaatagcactgcgtgaaaacatcagagaactttccaggctttcgcctgaagaacacagaccttactgtgttaaactgccactgtagtttttaagttgtgccctttagagaggactcctattagttttggattgcattgtgt

SEQ ID NO: 191962 - DNA, 342 bp, Homo sapiens
atgcaaaggtgtaaaggcatgaaacaatctcacatgttcaggcaataagtataagaggttccctaccttaagaactttgtagtttataaagtagtttgttttttgtttttgtttttttaaatcttttcattttttttctagaagtgattcataattactactaatttataaggagtcagagctttgctttgggataattatttgcattcaagggttgtggaaaaaacctgatagtttgttggagttctacctattccctacctgagggaaccaataaaattgagaatttttgtttctttcctagaggttgactacttggagccatgtgaatgctgcacagtc

SEQ ID NO: 191963 - DNA, 467 bp, Homo sapiens
tgagccacctttccctttaggggttccaaattgatgatttactaattttatcatgccctatatatttattagctgtcattcttctaataaagaagagttgtcccttactaactcaggctgtttgctttccttgaaatacggttcctactggaaaggcaggacaaatgattaatattttcccactaattacgagctatcagagtaaggagtttctttaatagcagcctccaatggtgacgtgagttgggtgtgtacatgtgtgtctgtggtgagagagagagagagagagagaatgcatgtgtgtgtgtggttacttagattttcaatggatcagtctgattgtgtgtggcagcagtggatattgatgagattctgaatgtatttgaaggtaaaccaatagtgtttgctgatggattggatacaggatgtgagaaagtagagttaaggactattctgaagttttttgg

SEQ ID NO: 191964 - DNA, 429 bp, Homo sapiens
ctcttttagttccttttctcttcgtgtttctacttagggactcatcaagacatctacactctctccctttctttctttctttctttctttctttctttctttctttctttctttcctttctttctctttctttcctctctttctttctttccctttcttctctttctttctctttcttttccttcttttctctctctctctctccctctctctctctctctcctctttctttctttcttatgcatatatctcacctaagacatccagacttgaacttttcacatcttctcccaatttatcagttgctctctttgcttcctgcttccatttcctagctagcccaagtcccacagtgtagctcatggacttctttcttcagcactttgaactttcttacttcctcattcctctgggacacaaaacttgtct

SEQ ID NO: 191965 - DNA, 559 bp, Homo sapiens
tgcatcaacgcgttgggagcctccatattgtcgactgcaggcggctgcgaattcactagtgattatccccggatcctggggtaggtgggacagagaggactgcctgggaagggtgtaggggcagcacctcctgggcatgaaaccatctgcagggcacaggggccaggcctgcctctgcatgcactgcttggccttgtggctaaggcctgtgctttacccagttctctgggagcaggagcagtctttctgaggcctgccctcagccctgcccagggttcaaggatctctcctcagcatcattgctgctgccaaaaccaagaggctacccaccattcctcacccgcaactctgccacgcagcaccgtctgcacagctgcagttggccacatccacttgcttttaaatgtgctgtcatttcctggaaaccatccaggccttgtagcctgccctctgcacctcctccccaaggggggcctctggagcaagaatccaagaggtgccctggcagctgcaagtgtccccagaacatttcctctatgcatgaaggactgaagcccag

SEQ ID NO: 191966 - DNA, 219 bp, Homo sapiens
ggatcctgtgatgttatcgcccacacagtcacatttcataaggatcatacggtttatttagtccacattctggggaaaggggaaaaataccatcttccttaaacttaatttttaggtacttaaaaattttttttgactttcgttaaaacctaggagtaaaacacaaggggcaagtggagtgaaggaaaatggaaggtggggggatgtggggataaatca

SEQ ID NO: 191967 - DNA, 702 bp, Homo sapiens
agaagaaagaatttctgaatttgaagacaggtcttttgaaataacccagtccaaccccccaaaaaaagaagaagaaaagaagaacaaagaacaaaagagagagcctatgagacaacacaaatgaaatttgaatattgggtgttatagaagaaaaagagatgggcaaaggcatagagaacctatttaatgaaataatagctgaaaacttcctacatcttggaagagatctagacatccagatacaggaagcttaaagatacccaaatagattgaacccgaaaaagtcttccccaaggtatattatcacttgaggaacatttcagcttataactgttgaaagccagacaaaaaaagaattctaaaatcaataagagaaaagtgtcaaatcacatataagggaactcccatcagactaatagatcctcagcagaaaccttacaggccaggagagaatgtgataatacattaaaagtgctaaaggaaaaagaaaactgtcacgcaagaacactatactcggcaaagttgtccttcaaaaattaaagagtaataaagtctttcccagccaagcaaaaactgagggcattcatcaccactataccagccctacgagaaatgcttaacatgttctacatctgaaagcaaaaggctgatatttgcatcatgaaaacatgaaactcactggtggagcagatacaaatgaga

SEQ ID NO: 191968 - DNA, 251 bp, Homo sapiens
gtaaaggccttctcattgctttttgatgcctggtgagtgcttatcttttgacggtccgttcaaatattaccctttccacaaagatttttctaagtatttctcaaccttccttaggcagttaataattcctttttctctgctcctaaagcactctatatagatctaattacaatgtgataggcacgaaattatacttagctatttaactaagtatgcctgtttgatataattgggggctcctttaagactcg

SEQ ID NO: 191969 - DNA, 1273 bp, Homo sapiens
ggccaagcttgtcttgaactcctgacctcaagtgatccacctacctggccctcccaaagtgctgggattacaggagtgagcccctgtgcccagcctgaaattcaattctaataaatttttattggagcattaaaaagttacatctgtagttgttactctttgcaaaaaattgcaagaacacagaaaaatataaagaaaaaaatcacctgtgaagaattttaatgaatctttttctacttttaggcgattttgcttacagctgccttttaatcagaatagggaagaaagagattcctttctcaggaaaaaagtgactgtggactggaaatgctttgtgaaataattttggtcatactgatggttataacaagattcgtcttcaattgagttattgctgagctttgtccaacattaaaatgaaaggtctcatttgagtctcattgtggtttgcaagtctcccttggtctagaaatatgtttggtcaaccacggcatggaggtgttccagccactttctgtctcttaaaagtttttaggacctacttttattgggactgccagggtctcttaataatagttattatacttggtaactattgtgaccttgtctcataggcagcccagcatagaaactcatttagcttttagttgctcagctccattagctgtttaaacatgtttcagatgtgagcctgacaatgtacttgggcagcttggttcacccttgactgcctgggaactttgagaagtctgaaaattatatgtagccctaaggtcttcatggtattgtttttttggaggcaccatttcccaatagccctgaggacaccaggcccatgaagccatcctgtctcagccaggaggcagaggagatggaatggaaaccacttctggatacagatccagccacttccggagtgcttcagagcatgggtcagatagaccttgctgctttctagctggcagacttggggaaggttgtttgacctctctgagtttgtgtcccagactatagcagtacccccttactggcgttatcgaagataaaatgatataatcctgataaatcacttgacccagtccttggaggtggtggtgggggctggggtaagtgccccatgaatggtggtcatcatgctccccaccaacctcctttctctcttctcctttcccgtctttcacacccctaattcctggacctgggggtggtctctccagactagatgaagaagcaatctaattatctaggaaggtgaaaggtggttgggaatact

SEQ ID NO: 191970 - DNA, 247 bp, Homo sapiens
ccagtgccctcatgttactggattcatgggtctccagggtcatgctgcccagctcatcccagcctaactggctcttgttcctgacagctggacatattcattgttcatggagctggcaaggagcctattggagtgatgctatggattcttcttacgtgttaagaagaatcctgggcagtggagcctctatatggaatctttgagttgaatcttaacattggataaatcttaagagctgggtaatctc

SEQ ID NO: 191971 - DNA, 217 bp, Homo sapiens
tgctggcttcataaaatgaatttggaattgttccttcctttgtaatattttgtaggaatttaataaaagttggtgttacttctttttttgagacagtctcactctgtcgcccaggctggagtgcagtggtgttattttggttcattgtaagtttcgcctcccaggttcacgccattctcctgcctcagcctcctgagtagctgggactacaggcgca

SEQ ID NO: 191972 - DNA, 136 bp, Homo sapiens
ttggcctctgcactgtccccaacccagtcatgtcaactacctctgactcagatggaagaatgtgcttcctggcgttacatttcccttgggctttaatcttgtgtgtgattatgcattgatgtgaatgtgtcttaga

SEQ ID NO: 191973 - DNA, 477 bp, Homo sapiens
gcttggttcacaggtgggagggtgccctgtgcaggccgtgggaggataatttgagaattcccttgcctgtccctgctccgcggttgctgggcacctggcgagagcgttgggttgtttgctttgggtaactatggcagatccttttaattgccaccaaataacttcagctcaacctcgtcagtggttgttttgctgcgtcgctcggaagaatgcctccctctttgtaagagctggatggatgggagcttggcagaggcaggccaatgctctttaatgttttccttcccatttaataagtgttgagtaaaacttgagtttagggtgtttatgtggcacaaaaggtaaaccatttgtggtgttttggaacctgggctaagtgtttctcacacacatcctcatgacatggtaatgactacctttgtgttaaacttgggtcactgtcaactttcttctgaagtgctccctgctttgttttgg

SEQ ID NO: 191974 - DNA, 418 bp, Homo sapiens
ccccaccatgaaatgatgctgcaccactgactaggccatcctagggcatgatgctttgtggtagctgcctctgccatctaaatggggaccactacagccacaagctgagcaggcattctggttcctagcttttctcattgagaaatcagggcaagcagcctcatttacctaagttgcaggttctcttgagctgtgtaggcccattctcagctccctgtggtgtcttcttcatatgtacaataacgtgtaaacatttagatgtttgtctacatatttgaagaggcatgctgatgctgaaatatttttctcttttgaagagagggaaagcagcttgactgaaaaccaatagactccccaactttataactaacttataatcacttcaccttctagggctggtttcctctaccagaaaatg

SEQ ID NO: 191975 - DNA, 545 bp, Homo sapiens
  misc_feature (221)..(221): n is a, c, g, or t
tggccacaagttcttattaataaagcagttctgcataatccttctatccaggtttgattaacaaatttacatttttttctgagtaccttctgtgggccacacactggaacacaaagaattttccttatctaacaaatttcctattagcaacgttgtaaatagctagtatcttgaataggacttattttcacaccgattctcactccttcttaacaatttanggaccaactgctttttatgcatttgtctcttcaatacaaggaaggagctcagtgtatgggaatgttaaatggctgataatgcaaccttcttgctcgtgaactaaagaatgtcagccactgtgcccgactgggtgctattttatatagaaaaaatgtttgcaagattttaaggtaagtgttgacagttgcatacacacctgtgactagaagtcaactcagtagtttcacccttattagggtaaaactttaactccgtaagtctgctacctgacaggcacagcaaatgtttaaggaaatctgcatttaacttaaacagacatctgc

SEQ ID NO: 191976 - DNA, 327 bp, Homo sapiens
tggtctctccattctaaaaagctggctttagagctttttagatgagaggtatgagagatttagacctgaagttcctctttaacctttctcagttgcgggctttttgaaagcctgatgaacatcaaagatctctccccaccacacaaatatacatacacaaatatcctcaagattttgcacttgattttcaaggagacacagatatttctcttccccctccccaagattaaaaaacccagatgtacagaattcattacactcttttgaataggaggagtagggttttaatccacattcctttggatggtgagtgcatggtcctagggc

SEQ ID NO: 191977 - DNA, 984 bp, Homo sapiens
gtgacttgtgggaaatcacaaacagctctgagcctcattttcctcgtctgtaaaatgggggttgtcatgactgcagtctctgggggccgtgtgtgagtgctctgctgtgtgatacaagcccatctgtactcagactgagacgccggcgagttctctggacgctcccagcttttgggggcaagagttggccaaaaaactccctctttatgaagctgtgctggtaggtggtcgggaagcagcctgttgggcctcaggaaactcccgaagctattgcttccctgctgtggcctggctgtatcacagccctgtggtcacggtcagtgaattgccatactgctccttgtccgtaatttggactcagcacacagggtcctctgggtagatcccatgagcgaacacaagcagtgcccttacttcaagccccggtgcgcaggcagcgcagagcgaattgcgtctgcgttatcagcagtgctaatactgttcggttgtgggacagtggtcttcccagggtcggatgggggtgacaccctggtgcctggcttcacacacaccatggtgtgatagagcctgaaatacctggttctgagtccagctttaccccttcctaggctgtgtagatgactcggagtgggtaactgacctctcccgctgtctctgcacacaggaaggaggctctttcatgaaagggttaagtgaagtcaggtgaacagcacggtgcttcccgcacctgctctcactgaggtttagccctccttccttacccaggcaggcgttggcttttgctaagatcacagccgtggcctttcagggctggtgagagccaaggctctgctgtcacagaagcctggatttgactcctcatatgccacagctgtgtgaccttaaacctctgagcctccagttcgtcatctgttaagtggggttagtcacactgactttattgtgctcttgtaaagagtaaatgaactaaggtatagcccttag

SEQ ID NO: 191978 - DNA, 470 bp, Homo sapiens
cttcccatcttaggcttgaatatcccctgctcttctgatggcctccagggtttctcccgaccacatcacaccctcagtatccttaggagtagatacagtaggtagaagactaggcatttattcctcttgtaccaacagcggctgctggttgagagcataagctccggagccagctagcctgggtttggatcctggctctgcttcttcctagccaggaatgctgggtaagtcacctaagcttctcaatcctcagtgtcctgacctacttcacctaggtgtgaggagtgcatgagttagtacatgtagagtgctgcaaacagtgcctgggggagactgagagctcagtgtgtgttctctgctctacgatattaaagtgccaggccaggtgcagtgactcacatctgtaatccctttgcactttgggaggctgaggcaggagaatcatctgaggtcaggagttggagacaaca

SEQ ID NO: 191979 - DNA, 109 bp, Homo sapiens
tccagtaacagctgaatatgggtttggagcttagcagagaggtgagaggtccagcctggagatggaattgtccgcatgtgtaggctgtaaacaatgccttaggaaggga

SEQ ID NO: 191980 - DNA, 126 bp, Homo sapiens
attttagatatttcaattactattttcaagactttaaacaccccttcttgctagaaaaagaaagtgggggaaacctgcgtcaaagatcagacccttacctataaaaataacatacacattcgctgg

SEQ ID NO: 191981 - DNA, 684 bp, Homo sapiens
aatacctcccactgggtcctgtggaaattatgagagctacaattcaagatgatatttgggtggggacacagtcaaaccatattaccatgtgattatgtgtttacttcatttcttctaaagacttgtcattctgtatctattggctgtagtctctgtttcttgatttaaaatagtttcggagcataccttcacttgaactaagccatatcttatattttctgtcctcatgagtataccgtaattcttgtcttcacaagtgtttattaatagaccatctggattgcagggtgctattatgtaagcaagttaagcaaacttgatggacctttagctctttgcccttgaagaacatttaacctcatgctaataggctcataaccaacaggctatttagatgcttaaataaacactgaaaaaaatgcacacagtttacaaaaaaagtctaatattgacaggtgcaagcgatattttaagattttttaaaatgtgttgatcagcatagcgaatgatagaatattagaccatctggagattctttacctattgaattattagaaatgtaataatattcagttttgcttctctctgttgacattgttttcccatgtggcatccatgttggcccatgtgagtgggtttgtagcatgcatatgttttcattttacttattgatttcagagcttt

SEQ ID NO: 191982 - DNA, 332 bp, Homo sapiens
tgaagagggagagtgtggaagatgcggggcaaaaggttcccaggagcctcagcaagcagcatctggaaggccctggcaggccctgactctgggttttagtcaacgtatgatgctaggctatgggagggttttaagcaagtgagcaacaggttctaatttatattaggttggtgcaaaacttcattctgacagctgttctgagaaccaactttcacatttttttttcttaagagggagacagggtttccctggagtgcagtggcatgatcgtagctgactgcagcttcgaactcctggctcaagcaatcctcctgcctccacctcccgaacag

SEQ ID NO: 191983 - DNA, 272 bp, Homo sapiens
cctctattagcattctataaagtcccacttttctaggttattttccatgatgctggatgagagggactgaaaagtctgccaatttttctccccatccaagggaacggggaggattctgcaggcccatgaccaatattcgacagggcttcttccaagaatttcctggtgggaactgagtttttttttttttttttgaggtggagtcttgctctgtcgaccagcctggagtgcagtggcacgatctcagctcactgcaacctctgcctcctggg

SEQ ID NO: 191984 - DNA, 864 bp, Homo sapiens
tattttctctcacatttagatcccggtagcatttctgcaaccctgccaagaagcaggactgtcctaacgtgctgagtgcttatgcccttagcgagggagagaggtttcatccatgctgtgagagctcattcttcatttgcattacgtgagaatcgaagcctgagtacgtgagtattttgactaccttccatcctctcagaattctggagccacactttgttttgcctgccatttgggagaagatcggggttgctgtgaagcttaaagtgctacacattttgctgaagaaagagattgcagtctcagatgtccatactgccggcagacctacatgcttatagatgtgagtgacattgaagcaggggaaacaagtcctgttccactacactgaggaggccttggactgaaggcaagagagaggagagaaggcagagcatacagtcccaaagccgagtccagcctccttagctccttgcaactcacactcaaaccccagtttaagtaattccagactgaaaaataaaaaccttaaaaatattgcagagagaagtttggtattagagtcatgataaacccttgtatagaacgtgttgcaatgattattttttagggtcaaaatgaggaaacctgacatgcacactgggttttggatgttcagacatgaagcttgtactgccaagtgaggaaggctttatgcccttaagagattaaaggaaagttggactcatcagttgattctgaaatcaacccccaaacactgcttgatctgagttttcaaaagctaacctttgggtttctcttttatatttttgcgtgatttgtcatatacttatctttaagagttttgtgttgttgttgtttaca

SEQ ID NO: 191985 - DNA, 457 bp, Homo sapiens
cttgccggtggcagcctactggagacagggagcccacacagaatcctgacctcaccagaaatggggccccaggcacttggtgggcaggtttggctgtgactggagctggtggtgagggacatagccatcccaaggctaggccgggcttccagtccttcctcagggacttgtttatggtgcctgagggctccttcctggtcctgagatgatgctgtggccccgcctgggcagctgccccagccctgttcctgccaaccctgggctttggtgatgcagcacctcttgcaccccggcctcctggcccactccaccccctcaccctgctccgtctgtgctgtggcccagtcctcttaaaaggattgaacacctccgggtgggatgagaacctgtccgttcactgtcaccaggtgtctctcaggcatacccaggtgtcctcacgtgtctctcgggtgtcctc

SEQ ID NO: 191986 - DNA, 304 bp, Homo sapiens
tttcctctcagccaagttcacggccctcgcaattctacccattggcagtttaagggaccacacagttaaggcatccaggttcaggttactttctttaaatctgccagcctaaaaagctgccgaaggttttccaataacaggggaattcaaacaaacaaacaatttatacttatcctgccctatgagatctcaaattggtagtgttttgttttgttttgtaaagacaagtcctcattatgttgcccaggctggtatcaaactcctggcctcaaacgatcctcttgtctggccttccaaagtgctg

SEQ ID NO: 191987 - DNA, 393 bp, Homo sapiens
attcataaggcaggacctgagcactgctcagacatgttcagagaatacggacagcaagttagcactgggtataccacaccactatgttcaatctttgaggagccaatcccagcccaatccaatgctgacttctaatcagaatgtttcctaagctctaattctgataggacttttttcttcttttcagacaaagtctcactttgtcacccacgctggagtgcagtggcacgatttcggcacactgcaacctccacctctcccaggttcaagcgattctcctacctcagcctcccaagtagctgggattacaggcgcctgccatcacacctggctaatttttgtatttttggcagagacagggtttcgccatgttggccaggctggtctcaaact

SEQ ID NO: 191988 - DNA, 277 bp, Homo sapiens
tccaaatgtcaccctctcagagagaccttctgtgcccactctcctaaagcagcaccctcctagctccaccaaggcccctcactctccattgccctcactcaaggctttgttttgttccacaaagtacgttctcaccactggcacagtatgcatttgcttactgtctgcctcactccactaaagcacagttgccataggaagaaaggctctggtgttaaccctagcactccgaatagagacgaacacggagcaggtccagagtaaatctttgaccgtg

SEQ ID NO: 191989 - DNA, 348 bp, Homo sapiens
tgggaaagttccttaacctctctgagcttccaaaatgaagataagaaaacttagcccaccctatcagtgtttggattattaaatacgcaaggaagttcattctacttttggacagatcttttagaaagtctcttctacatgaggatctaaaatcttgctgatatagacaggaggcagagaaataggagattgttaggaataatgggctagatgagggttgaagctgagggcttaaatgagcggaagctggggtgtggtactggtagaatgtgatttgttaaataagaaggaatggatgtcagtttgacagaacgacacaggttgaatgttagtggttatggagaagtt

SEQ ID NO: 191990 - DNA, 357 bp, Homo sapiens
gcagaagcaacatgcggagaggatgagcagggacggaggctccaccatgacactctcagtcccagcatctcctcagcccagtcaccacactggagagggaggaggcccttcagaccccgcaggcctctgcaccctgggagttccgcgtctaactctcttcctgcaatcatcagaggcaggaactgggcccaggtggggtaaaggcaggaagacgtctgcctgccctgctccctgggcacttccctggatgctgtataccacaggacagagatcgagactgtcttttgaaaaacatttagagacaggatctcaccctgtcacccagactggtctcaaactcatggcctcaaaggatcc

SEQ ID NO: 191991 - DNA, 186 bp, Homo sapiens
ctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgta

SEQ ID NO: 191992 - DNA, 438 bp, Homo sapiens
cacaggacgatgcataagacaaagtttacattttaaatatgtaatgtggtcttataagtttttaagacagaaagcacaagaatatataattacatgtgaagatatacatattttcgcacacacacagaatgaaaaccaaaaagtagaacaaacaaatcctgtagaggaatgataaccagaaatgaaaaaaactagttatctaaagaagatgagtgaaagagtagaagggacagaagaaggaatgacatttcattgattacatatttttgtatagtttttatttaagaacatttaagagtaaatgacataattaatttttttttttaatttaaaagaacaggcacgtcagatgcagtggctgatacttgtaatcccaagcactttgcaaggctgaggtgggcagattgcttgagccaaggagttcaagaccagcctagg

SEQ ID NO: 191993 - DNA, 429 bp, Homo sapiens
tcaacacatatattttgtggagacacagtttagtccataacagcaggcacatggggtctgaggatcgtctggcctctgccagcttccctgcaccttgctccctcccagaatggtagtctgctccaggcctgaccatatgccttgccattctctaagcacatcacacacttcctggcccgacgtgccttgcaagtgctcttcccgaaatccctcctccccggccgactcctccttccctgaggatcagtgctgtcaccaccacctcctcaggaagccctggtgggcaagggggcatctgggttctcccttcacctctcccgtcacctgctctctgatgttagtgttcctgcccatctctccctcccctggctgctgccccaggccctgtctgtaatgtccccatgcctagcagagactcagtaaatatct

SEQ ID NO: 191994 - DNA, 434 bp, Homo sapiens
cccttgttgctggctggcggcaaaccccactgagagcccggaaggtccctctgggggaaccactggtcctcgaccaggacctgtctgtacaggagggggcctcagtgcctcctgcaaaagcgtggcccgtcagccacagaaatctgtcctcaaacacagcccccagctgaacccagtcccatgatgtggcaggcacagtctcctgagatgggggcctgacagtgttttgtgcagccacccagtctctgtttcacgttgcagcccggcacgtgcataaacaggtgtgggcacgtgcccgtgaagctttattgacactgaaattttaatttcttataatatcaaagtaatagaacactgttctttttttttttttttttttttttggggaaaaagggccccatttgggggcccgggggggggggcaggggaaaaac

SEQ ID NO: 191995 - DNA, 482 bp, Homo sapiens
gccagcaacagccaggtctcagctgggttcaggacatggctttggaagttctttgggttgtcttagagcgatggaatctctacgctgcgaaacaacacttaaccgctttcattttcccagagatctgaagcgaaattaattaccccgccttgactgatagttgttctgttggagtatggttctaatccttattaacattctctaaagtcaggcatgaaatatgacttttataccacactctttggcatatgtttttcttttccaggagatttttcaggctatctctaagcctcactgctgttcattatttttgccataggtctaaagttgccatccccaaagctagtcccgcacagagcacagccaagcggggaggggggtgtgggaggaatgacacatctctgcttgcgacgcaaattgcttctgattattgagctttgaatatttttctccatcgtgtttttattaaaaactccagcata

SEQ ID NO: 191996 - DNA, 151 bp, Homo sapiens
tgcagaaaaaaagacgccttccaaaatattactactcattcctttttagcatgctccctaaaaaagtaacatcactgctcactgacaatgcaccaggtcgcccaagagctgtgatggagatgtacaggtgattagtgttgtttctgcagca

SEQ ID NO: 191997 - DNA, 372 bp, Homo sapiens
gaatcagactcccaaacccacagcaagggcaggtaagcacctgctaaataaatgtacctctctgctggaatgcactctctggccttagagagtacattcacatagtccacacaaatatatttataatacgtgctttgtgtcaacactgcacttagtgctgggggccataccaacaaagaagatggggtataaagtaaaaaataagcaagacaatgacagagaattagaaatgctatgaaaacaagcagagtacggggtagagaatgacggggcaggagagttagtaaagaccatcacagggccggttgtggtggctcacacctataatcccagaaactcaacaggctgaggcaagaggattgcttcagccca

SEQ ID NO: 191998 - DNA, 361 bp, Homo sapiens
gatgcaatacagttaaatcttcctttctttgtaaaattactgttgttcaattacattttacagcaaaataagactgaatattaatggacatgtttcatgtaatgctacactttttcttactgttatttcatcatctattcaaagtatccactgcatgagtagtatgtgtaacagtaggcaggcattgttgaaaatacaaacatttttaagcccccttcttaaggagtttagactcctggagagataagaaaagtctataaatagttttaaaagaaggtagaatgtgataagtgacacaagaaagacatagctgggctgagataggaattcagagacaatttgagaggagtgaagggggtga

SEQ ID NO: 191999 - DNA, 398 bp, Homo sapiens
agctagtagccaaccagtaaattattttgtctgtcatcactactttcccccatttgactattcttccaataattattctaaattacttagcctttagcccccaatctctagactctcttctttaagcagacaactttgcctattacttgaatgaaaaaattgagccagtcattcttgagctccctcagtttctggccttccacctgttttctatatctgcaattctccttacctcctttccctcagcctcagaggatgatgtgtcccctcctgcttccccgccccagcctaacctcttcacctatacccttgatccaatccacacttattttctccatgaattttgtccttcattcattcgttctcttgcccctgtcttcagtatcttcccttgtgct

SEQ ID NO: 192000 - DNA, 266 bp, Homo sapiens
caccactcctatagatcagtgcccataattatgcagccgggcacagtggctcatgcctgtaatcctccctttgggaggccaagtgggagatcacttgagcccaggagttcaaggttacggtgagctacgatcatgtcattggactccagctctagcctgggcgacagtgtgaaaccctgtctcaaaataaataacatccaaagttctatttctgaacacacccatttgacaaaatgaaaaagcaagttacagactaggagatggtg

SEQ ID NO: 192001 - DNA, 497 bp, Homo sapiens
tccagtcggtctacatgtagttataatacaaggtaaagatgtgtgaaaggcacagtgagtaaaggagcgtgattttttttgtcgcatcagtatatttaatagtcatgtaaatgactaggaaaattaaggagattttccttgcaaggctcgaagaatgtgaacggcgtagatgaaaataatttagaaaacagagagctatgctgtttctaatgcaatttttataggctttgttcttaatacgcagtggtgatctgatgtaagtgcatcatttcctttggtggaggttgtcaatgcaattaggttacggaatctgctttatggactatctagcagcagatcacaagcacataacataaagtccttttacacatgaatattcaaaatactaggaaataccctcaaatctccaccccctcccccttcacaaatacacatccacttttgtggcttggcaaggagcatagcgtttttcatgatggcagaacttttaattaacc

SEQ ID NO: 192002 - DNA, 125 bp, Homo sapiens
cgcctgctctgtgcagtcttggttctagacctctggctttactcttccaacttccaaccttctatctgccccttgcatctgatgcctaagatagactgagcacagctcatcccctgcagaagaga

SEQ ID NO: 192003 - DNA, 442 bp, Homo sapiens
gctactgagagtaggaatggcccaaagggctttttgagcagtgcattgtttcgcccttataacaagcctgcaaggtaggagagatgcttcccactttgcagatgacaaaagctgcggctcacagaggatgaacaagtttccaggatcactcagctaacaagagggtctgtagttcaagcctaggtctggagcaagatttttagccctgtctggttgactccagtggtcagggtcctcccagccatgctcttgattaactgtggtcaaaattcctgatggagtgagcttcaggcacccagcttctatggcagctaggctgggaaggcacaggtcagtacccaaagttgaggcctgagagttgactgtatataaccattactgccctcactgctcagccctggtggagctgttgggccataggagctggtgtgagtgggggcag

SEQ ID NO: 192004 - DNA, 395 bp, Homo sapiens
ccacattcccctgttctctcatgtgcagtgaaccaggcaggagccctggaccacactctgggttgcaggcaccaccttccccatccccagtgagagccctgtttagagtcctgtggtctcatctctggccatggtgaggacacaggcagctgacagtggaggtgtaagtggattcccaggccaaaggtgtgttaggaaaatgctggcttcagaacaccagcacccactccttcacttactggctgtgtggctgtggtcaagttaaacagcaataactctactggcctggcagtgttgtgagcgtgttcagtgagataatgtataccacgagcttatcaggagcttgagcactgctgatttgtttggtttcttggacaataggatgtggcaaccaa

SEQ ID NO: 192005 - DNA, 472 bp, Homo sapiens
tagcaaatgtaagtcaggtaacaaggcgatgtggcacagtggcatgagaattagacttgatataaaaagatttgctttaaaggcctggcttagtgtcataatttctgcatctgtgaaatgaagcatatacttctggtgcattacggagaagttgtcaaaataagagtgtaaatgagagaggaaagtatggggtgttccattaaattaggctttatttatctttaatttcttggtaacagctttttaatcccacaaagtaagtttttacaacgtttaaattgtctgtgtctagtgattgcagcattaagatcttggacatagggctgaagggctcctcaagtacggccaaagtgggagcccaggcagaggaggtgctgagagcaagcgagggctgtgaggactgccagcacgctgtcacctctcaatagtataatcatttaaatatactatgtattagtcattaacattgcta

SEQ ID NO: 192006 - DNA, 437 bp, Homo sapiens
gtctgaacctggtctggatgtggaagtgtcacctcaggatgctttggagaaactatagtcctcttcgggggtgtagaatgtccaacctccgtagtaggttctggagtgatggtaagtcccaggtccaaaagttgaactgtaacgctgggtgacactggatgctgagcttgatcctgacctggtgttggatttgttaccccttgatatactcgaagttggggtacaactttcttaggaggctgagttggggtctccttcatggttggagaaagttcaacctctgtcttggattctggagtgatggtaaaccccagatccaaaggttgaactgtggcttgagtcaggtgtgaatgctctggaggttgagctacaactacattagggaactctggagtctgagctggggcctcctgatgggttagggaagactcaccctc

SEQ ID NO: 192007 - DNA, 384 bp, Homo sapiens
gtctgaacctggtctggatgtggaagtgtcacctcaggatgctttggagaaactatagtcctcttcgggggtgtagaatgtccaacctccgtagtaggttctggagtgatggtaagtcccaggtccaaaagttgaactgtaacgctgggtgacactggatgctgagcttgatcctgacctggtgttggatttgttaccccttgatatactcgaagttggggtacaactttcttaggaggctgagttggggtctccttcatggttggagaaagttcaacctctgtcttggattctggagtgatggtaaaccccagatccaaaggttgaactgtggcttgagtcaggtgtgaatgctgagtctgaacctggtctggatgtggaagt

SEQ ID NO: 192008 - DNA, 347 bp, Homo sapiens
ttacaggaggtctgggaagatagaacctgacctggacaagggagaaggccaagacttcaaagaatccaggaaaacaggaagtaaaacaaggaggaggaagttaggcccaagggaataacattaggctagggatggacatgaagcttctagcagcagcagagggtttgcttaggagaggaggcgtgtaatgtaggacattgaactctagcattctcatctggactctactacaaatacactgagtgaccttggaaaataacttcattctctgtgcctcactttttccaccaatgatatgggaggactagacagaatccactctaacgttccctcatatcagagaagta

SEQ ID NO: 192009 - DNA, 336 bp, Homo sapiens
gtgacatacgcacctcccccagtgccctggtcccaccctaggtggagggacccaccccagcagcagggcagggcgggatagaggaagctggagaggagtatatttctgagaactgcgtagggctgcagtgaggcagtggaaagatgagaccacatacaggagttcagtctccattgttccatcagagtacacctacaaaacacaattctagccgggcgtggtggctcacgcctgtaatcccagcgctttgggaggccgaggtggcggatcacctgaggtcgggagtttgagaccagcctgaccaatatggagaaaccccgtctctactaaaaatca

SEQ ID NO: 192010 - DNA, 659 bp, Homo sapiens
gaggctgaggcaggagaatcacttgaacctgggaggcagaggtttcagcgagccgagatcgcgccactgcacaccagcccaggtgacagtgagtctttgtctcaaaaaaaaaaaaaaattttacgataaaatgcatcaatcttaagggttgagaatgacaagtttaggtgactgtacacagctgaccatcacccgtcacacagaacatcccgtcacacggaacatctcacctgtcacacagaacatccctttacccctcacacggaacatcctgtcacctgctgacacggaacatccgatcacccgtcacacggaacatcccatcacacagaacatcccatcacttgtcacatctcacccatcacacggaacatcccgtcagccatcacatctcacccgtcacacagaacatcccttcacccatcacatggaacatcccatcacccatcacatctcacccgtcacatggaacatcccttcacccatcacatggaacatcccgtcatctgctcacatggaacatcccatcacccatcacacggaacatcccatcacccatcacacagaacatctcacccatcacacggaacatcccgtcacccgctgacacggaacatctcacccgtcacacggaacatcccatcacctgcagacacaga

SEQ ID NO: 192011 - DNA, 555 bp, Homo sapiens
ttatgttactctccttcactccacagtcatttactgggtgtctacaaagttggaagcatcatgctagaagctgaggtgatagtggtaaacttaccactttaggttaggtaaactatcagtttaggtgggacccttgccttcatggagtatgcagtttacttttcctctcgtctggatttcctttctgtttcttcttgactgtcgtagttcttcaaagcccacctcaaagcaaaccatttatttgaaattttctctgactattccattctcagtaatctcctcctctcccaattattgctcatagcctcaaatcataatccagcaatgcagcatctattatcttgtaatatttgattgctattattttatgcataattgtttctcatcacacggacctgggatctcaaacttaaatctccagggcccagtaaaatgagaaaagcatgccctgtctaaaggggacagctgttgatcatctccagctaatttttcccttgtgccaatgtacactctgtattataaaatctctcagcttttttagaaaagcaagaaata

SEQ ID NO: 192012 - DNA, 939 bp, Homo sapiens
atgtgtgtgtaaatatatatataatatatataaaacacacatatatgtaactcatatatattaggctttatgcattcaattttactacatgttaaatatcttgaggaccctgaaggagatataagatgtggtttctactgtaggggtggaaaggtgtgataactttcttccctatcataagggtcatggctgacactcctataataaaagacaggttgacaagacaaaaacataacaaatttaatcaaagttctgcatgacatgggaacctgaagacccaaagacccagggaaaaaacatctgtttttctgcttagatttgaagatttgacagccatgtagaaatgtaattacacaaagggtatgatctaatggtaatagactgaggggagaaacatagcaaaacccgcctgttcggattcttcttggtctctttgtatagtatttcttcttctttgatatacagcaggacccctctggaatgagggtcttatgatctagacaaggtaggtcagagaatttctttatagccagctcctacacagaacgtggagggttgggggttgttggagtaactgatctaggtttcatggctggttttgaggaagagggattctagtgtccataactcatctttgagaagaggaattctaatttctgtggcctgctttgtgggagaaaggtgagtggaagccatcaaggcatgaggaagtcaaagagagactttccttctgaggctgcttctgaggccttccaatctcctatagttcaaagtactcagcacgccgaagtgccgtaatttggggtatcattttctgaccccaacattggcttttattgaattagaaaatctttagagaaaaaaagattacattgtggcaaatggtctagattgtgtggtaactattcttagtgttgtggggattcaaagaggaagatt

SEQ ID NO: 192013 - DNA, 452 bp, Homo sapiens
aagcagtcttttttggagctgcaagctgtgctgcctggggttgggggagtggtaatgcaagtactcctttagctgtcctgtctggtgtctcagtaggtttcatggctggttttgaggaagagggattctagtgtccataactcatctttgagaagaggaattctaatttctgtggcctgctttgtgggagaaaggtgagtggaagccatcaaggcatgaggaagtcaaagagagactttccttctgaggctgcttctgaggccttccaatctcctatagttcaaagtactcagcacgccgaagtgccgtaatttggggtatcattttctgaccccaacattggcttttattgaattagaaaatctttagagaaaaaaagattacattgtggcaaatggtctagattgtgtggtaactattcttagtgttgtggggattcaaagaggaagatt

SEQ ID NO: 192014 - DNA, 155 bp, Homo sapiens
atgaaatctcagatgtcaatacctgtatttccttatatgcctactatacacacatatacgcactcaatatctaggaggccagaaagaaactaaagaaagggtgtcaacagtttaaataaactctgggtaaatgaattattcaactgctagctcag

SEQ ID NO: 192015 - DNA, 380 bp, Homo sapiens
gtgacagctccccgcataggaacggttcggtggcttgggactaagctactgtctgaattacttttgtagcaggctcacaggccttgggtaaacaggtaagttaggtcacccacaagaaaaacaaaagtactcgttctctgtgagggtggaggggaagggagttccattttgccaatcaagtgttaaaaatagaacctgctgtgtctgcttagcagctctcacgttactgctcaccagatcccatgttgtgtgtacgtttctgttttgtaaagcctagcgtttacgtcagagcctgggaatgcagcactcgtgtctatacatgggagtacatgccttagggacatcatttatacaacccccttctctacagagctatgtca

SEQ ID NO: 192016 - DNA, 580 bp, Homo sapiens
cctgagattgggagttcgagaccagcccgaccaacatggagaaaccctgtctctactaaaaatacaaaattagccagacatagtggcacatgcctgtaatcccatctacttgggaggctgagacagaagaatcacttgaacctgggagacagaggttgcagtgagtatgtgatgaagttgaagggttaggataaacctggatcccaggcctcacaagctgcagtaaagacttttaatttgattccaagtgcagctgcagagttctaaaccgggagtgggagcaagtgggtctggtgcaatttgatttgtgtttgtaaacagtgagcctagctacaaagagaaggattgaaagaaaagattaggaagattagaggcactaatttgacagaggaaataaaggacataatactagatttggtgtgttgccttatttattggtaaattgtataggtgtgctgctatcattagctaaagtctcaagataagatatactttgagcgggaagtatcaacaataatggatgtaactaaccttgcatttctaatttattagaatggcatcttgtcagaactaacgaaac

SEQ ID NO: 192017 - DNA, 123 bp, Homo sapiens
acctctttgctttgcttcgtctcacccacgttgccttctaagcttcctgccctcttccacctgacttgcttattttttaagacatggctcaggtgctacctgccccaggacactttgctttac

SEQ ID NO: 192018 - DNA, 243 bp, Homo sapiens
gaaaactgtaataaatttttaatgacaaaagccaacaaaaactgggagagatgaagggtaagaggaggttaaaggaagtataagttccctcagggttcactgtggagacaatgcctcctgtctaaatttgaaatgtgaatttaaaacaaaagaaaacaaatatgtcagtctcccagtggcttttataatgttgaagagctctcacaggaattaatatccttggtgatgaacaaagatttatct

SEQ ID NO: 192019 - DNA, 334 bp, Homo sapiens
atggatacatattcaaatgagcttttatttacacttattaatctttctggtagagagaatgtctatttcgtatatggagaatctgtaaatattgagtaaagttgtcaggtatagcattgactgaagcagttctagaagtggtgtttttgattcaggtttattagagggaaataaatagctgctgttaatagtgcaagccgtttacaccattgagttttgggagatttgagaatcatggaactgatgctagcactagctcaccctgctggttggctaaaagatttctcctcttccccttaagaaacaaacatgaagatcacaggagacccagagg

SEQ ID NO: 192020 - DNA, 506 bp, Homo sapiens
aagtgtgataggtagttgaaagtgacagtgatttatgatcaccattaccaaaaaatgatactcaataagttcaagtcaaaaaatatggacaaaagaaaaataaaagggagtaaggcagggagggagggagatagaggaagacaaaaaaaaaaagaatgaaaggaaaggagttacatttcaggttactgatggaatgtgaagaacaactgaactgattatctgtacgttggaacccaaagattgggtttatctaccataataggattatcattcctttgagaaactggagatatatagagctgataatactgttagtcattccttcagaatttgctttcttgacaattggaacaggttcttctgctttccaagtttcctccctggctccagtgggctggcaactggtgaggaagatgtgggtggggccagtggtacttcaaactagtttttttaggagacagttgcaggcccacagaattttagtgggccttcacctcataaacatc

SEQ ID NO: 192021 - DNA, 382 bp, Homo sapiens
aaatcattcctgactgcgggttatagtcaaaaccccatgaaaagcatcactacagcccacgggtgtgtcagggacacagtgttgtgagccctgggaaggcagggcctgtggccagcactttatcaacactggcgcatgcaccctatgaggcaaagggatttgcattgtccccttacagtgtgggacactgaggtcgccaggggcgtggcgactgtaagggacagtgctggatgtgagcctcgcctgcaggaggcggtccaggaagcatgggtggaggggctggagaagttgagggccgcgtggcccgggaggctcccggaggagggaagggcctatctcagcgaggggcataggcggggaaggtgcggggcgaggcggccgc

SEQ ID NO: 192022 - DNA, 292 bp, Homo sapiens
tatgagtaaactacacacatattcaaagcatctggtacaatgcccagggctgagtacacaagaaatattaactattatctttattactaccattataagaacaacccatgtctctggccaaggccaagaggttcgcactgcagtctctctcactgaaccaagagacagaagaggaaagatgctttgcggagaaaggtaactttggtttttagacatgtttggtttgctggagtctgggacacatttccacggatgcaggtgggtgtgatggagaacacaggagttgagggtg

SEQ ID NO: 192023 - DNA, 580 bp, Homo sapiens
atcttttccagtgttttgtgtaccttgtttcatttatgcttcattcctatcctgtgagacaaatactatcaatgatactcattttacagataaggaagctgattttcaaagagattgacttcccaaagaaagtgcatgccactagcaagttgttgatcttgaaacacatgtgtctaggctggttgcaggggctcacgcctgtaatcccaaattttggaggctgagatggggagatacttgaaaccaggcatttgagagcagtttgggcaacatggcaaaaccccgtctgtactaaaagtacaacaaagttacctgggcgttattttatttttaattttggtggagataaggtcttgcttacgttgttggccagtctggtctcttaactcctgggctcaagcaatctcccacctcagcctccaaaagttttttgtttatactctatttaaaatgtgacctcattttaaggttcggtcatagtggacatggcttgaatttgtgatgatacgggttttttttttcttttttatgatgtaatcttactgcatcgccgaggctggagtgcagtggcgtgatctcg

SEQ ID NO: 192024 - DNA, 699 bp, Homo sapiens
tcctcctgattcttcacctggcaaacttctacttattctgtatgctttccttaaatattaccaaacttttcttttctcttttctctttttctttttttgatggagtcttgctttgttacccaggctagagtgcagtggcgcgatctcagctcaatgcaattcaagcgattctcctacctcaagcaactctcctacctcagcctcccaagtagctgtgattacaggcacgggccacatcaaccggctgatttttcgtatttagtagagacgagtttcaccatgttagtcaggctagtctcaaactcctgagctcaagcaatccatctgccttggcctcccaaactgctaggattacaggagtgagccactgtgcctggacactaccaaacattttaaagctttaattcttcaccttggatataaaatttctgacacatgctgaatatggtaacaacatgacataataagtaataattataagctccaaaaggggttccggcacagagtaaacactaaataaataataaataataaaaaagataataataacaagaaaaatgtttagtatcttaataaagaagcaaataaaaatgacaatgataataacaaggaagatgcttagtaccttaaagatacctgacagttatttgttaagtggacaagtggataaatgaataacaaactttttaaggaaattct

SEQ ID NO: 192025 - DNA, 497 bp, Homo sapiens
gcttacttcgcactcctaggcgttctgtaggtttgtaaaccagtatttatacagaaatactttctgtagaaagacaggcatcatcagattgtgcatgttaatccgggaacagaccgaaagggaaggtctcagaggagagaggcataaagggagaaaacaaaacaaagtcacaagcaaagcaagagtagttgcttttattcctaaagtgttcattataaaagaaaccagagggcagggcactgtggctcccagcactttgggaggcgggtggatcacttgaggtcagtagtttgagaccagtctggccaacaaggtgaaaccctgtctctactaaaaatacaaaatccgctgggcgtggtggcacacacctgtaatccctgctactctggaggctgaggcacgagaattgcttgaacctgggaggcagaggttgcagtgaggcgagatcacaccattgcactccagcctgggcaacaacagcaaaactccgtctcaaa

SEQ ID NO: 192026 - DNA, 187 bp, Homo sapiens
ggaaagaggtcttatgacctagctaggtgtcagacatagtagctttgttccagattataggattcagtctcagggtctgcttgtactattcagggtctgctgaattaacgtccagaaagaaagaataagttgactataccccaggttattagtgggaagatgccaatgctgatcttaaaggaatacc

SEQ ID NO: 192027 - DNA, 385 bp, Homo sapiens
aaattcatatattgaagccctaacctttaatatgatggtatttgaagatggggcctttgggaggtaattagggttagacaagttcatgggaggaattctaatgatgagattagtgcccttggctcatgcctataatcctagcacattggaaagcctcagcaggcacatcacctgaggtcaggagtttgagaccagccttgccaacatggcaaaatcccatctctactaaaaatacaaaaactaggtgacagggctgtggcgggctggagtagggtgccacctgggctcaaattcccaccattcagtcacataggtattctctccaggtcactgatggctgatatgaactgaactgaattgaccctctgacaatcatatattgaag

SEQ ID NO: 192028 - DNA, 464 bp, Homo sapiens
tgcagcccggctcggtgccgggggtgggctcagcgctggggtcgcctggcttcgttcccccgcggaggccacggccgggcgagcagtgccggggcgggtaacccgacccggctccccagagccgctcaccccgcacggcccggcaaggggagggagagggatggggggagggggaagggaaggggtggtgggtgaggggctgtgggcaccgcagggccgagtccccggcccgtctgcgctgctgtagggcggctgcccgcggcacccgggacgatccagcctctgcctcgcgggcgtcgagcctgagacaggagggagccctggggctgcacaggcttggctcagggaggcagacccgagctgctgcctccattttgtttcctgctcagcttggtctgtggtggtggtggtggtggtggtgtgggtttggggtgcggccgggtagggggttcgcctgcggccgc

SEQ ID NO: 192029 - DNA, 111 bp, Homo sapiens
ttatacaatcctgatgtttttcttaaaataatttcagatgttaaaataaaataaaaagccaatagagtcaattcagatcaaatcacaggatgctgaaggtggacaccagca

SEQ ID NO: 192030 - DNA, 541 bp, Homo sapiens
tcaaaacaatttaattggccacaaaactgcatctccctattgataggtctttagtcaatatttttactctctatgcttcagattctggtatctgatataaatctgagacttacgccacagtgttggcctaattcgtcttctagataatgttatggaagactagttcttcaggatattaatagatacccattgggagatgagagagggaggtttttcctggtaagtttgggaaatgctgagtcaaattctgctggtctttcttctagggctttgcacaacgtttgaggtactagcatgcaccgcaaatacttagatgcagtattcagcatgtcccaaacttttgtgaaggcagaactctttttttttttccccaaggatcaccttacagggagatatattggtgatggctgaagtgcattttgatttcatgttaatggagccaagtcatgaaattcaatcacaaagtggttggactgggatagatgtgagaaaaccatcttaaatatttgcagaatatcattcagattagaccaggaatgtt

SEQ ID NO: 192031 - DNA, 541 bp, Homo sapiens
attgtcctcatacactatatacctacttcccgcccacctcaagtttggaggggatcagatcaattcctgtctgtaaaaccatgtttttgaaagttcctatttactttcattaaagtgagctagggcaaatcaagagttttaaactactccccaaattgacgggagatcttatttggtctataaaactcaagcacgataactagtggaattaaaaaatggggaaaattgttttctttgaaaatccaaaccaaaagtccagacatcccagagtcatataagagtatgaaacgtagaattgtttggtgtttaaaatacactttcaactaaatctacacctaggtcacttttcttacacatttaaaattaaaactaggatcaaatacaatatattcagataaattcagcatacttctatggccactgcaagggataccgaagactcataaatgagtaattaaactgctttaataacacccagaagttcacagcccggaaagattagcttaagtgaaatacaattcaacaggtcttatcaaagagt

SEQ ID NO: 192032 - DNA, 140 bp, Homo sapiens
ctgtaaaacatcaggagattagttttcagaccagtgtggagacaaaaaggaagtattatacgcacgtaatttccaccagcaatgcatatgtaactaactagcacaatgtgcacatgtaccctaaaacttagagtataata

SEQ ID NO: 192033 - DNA, 510 bp, Homo sapiens
caaccaatcagaggaactgtccattttccatctgcagagcagaaaagcagggggtttgcaaagggagtagcttctggtccttttgttacttaggcatggaaagttgggattttcctttcgatttagctctagaaattcagtgtgaatcagccttaggttccctgcctccagaccctattctcctgcctcatactctcttaacaaatttttaagtaaacaggtacacagtattgttaactatgagcacggtgttgtatagcagatatctagaatatgtttatcttgtataactgaaactttatacctcttgaatagcaactctccattttgttaccgaaacaccagggattcagtctgagtcctgctgtttgctgcacagatagccaacggctgagatgattactgccaaggaagaaggctttaatagagtgctgcagtaggggagatgagagatcagtctcaaatccatctccctgactggctaaaattaggggtttatatagcagagaa

SEQ ID NO: 192034 - DNA, 379 bp, Homo sapiens
gacgattatctagggagaaatggcagagtgggaaaaaaaagatggccttgagaaactctaacacctagaggtgaagaaaaagaggataatctagaaaaggactgaagaaaaagtctgaggtaggagaaaaaaaaacagaagaaggtggcatccccaaatcccagtgaagaaagtttcaaggagggctgaactgtcaaacactgttaagaggtcaagtaaaataaggaattctctattttcagtttatagggaaactgaaatgcatgcatcatttagaggaaatagtataatcattggcaacatgaaagcatcatttttttaatttaagttctgggatacatgtacaggacatgcagatttgttacataggtaaacgtgt

SEQ ID NO: 192035 - DNA, 427 bp, Homo sapiens
tggattttcaaccaggagaaactggaaggtggggaggatattccatgtggagaaaatagtataaacacaaagttcaggaacaaaactgtagagcatgttcagtggaaaaatggatcatgcagtaaggaaggaatgtcagttacgagctgaaaaaaacagtgggaagttagtctggtcgaggatgtaaagctgaggattctgaaggcctgcatgaagaacctgcgtttaatttggtaagccatggagaattattgaaggtgtagaaaaactcaaattttccctctgaaggttttagtctaagtctgttgaaatgaattgaaaatagacaaattagcagggaaaaaaagcatgcaatttaattaaagtgcattagcatgggagaattacagaagactgatatcccagtaacccaacaaggtttagatgc

SEQ ID NO: 192036 - DNA, 310 bp, Homo sapiens
aaaggaggaagggaagagggagaaagaagcaaaagctaccactgcagttgagacattgagaatttactatgtgctgggtgatctcatttactactcacaaaaatactcttgaggtcatagagaactatccttatcttacagaagaaaaaactgatatttagtgacgtccatgaagtcacttgcccaaggtcacacagtggcagagttggaacttaaagccacttctttcagcctccagagcccaatactaaaaggtccctctaggatgggctgttggaggcaccaggataggagctgaacaccacctcct

SEQ ID NO: 192037 - DNA, 199 bp, Homo sapiens
ttaaaaacaaacaacaaaaaagatatggataaaatgaaaaatatgaaataaggttgaggaaggccaggtttggtcaaatcataaagaaccttgaatattgacctatgtaggcaatgggaaccatcgaagattttatagaaagaagcaaaatgatcaaaattgtaattttaaaggtctacgctggctttatttgcacaca

SEQ ID NO: 192038 - DNA, 507 bp, Homo sapiens
ggctgccgggcagagaggctcctcacttctcagatggggcggctgccgggcggagggcctcctcacttctcagacggggcggttgccaggcagagggtctcctcacttctcagacagggcggccgggcagggacgctcctcacctcccagacggggtctcggccgggcagaggcgctcctcacatcccagacggggcggcggggcagaggcgctccccacatctcagatgatgggcggccaggcagagacgctcctcacttcctagatgtgatggcggccgggaagaggtgctcctcacttcctagatgtgatggcggccgggaagaggtgctcctcacttcctagatgggatggcgtctgggcggatacgctcctcactttccagactgggcagccaggcagaggggctcctcacatctcagacgatgggtggccgggcagagacgctcctcacttcctagatgtgatggcgtcacttcctagatgtgatggcggccgggaagagg

SEQ ID NO: 192039 - DNA, 500 bp, Homo sapiens
aatcagaaagcacatgttcttcttttttattatgccctagagttacctaattctcctattccctacatatattctttgaaaagaaacagtagctggcttggtcttagcagtttttaaacacattttcttggtttttgcatgcaattccaatatcttacaggccgtcattctaacactgtcattcaaaatgggattttcttccttgacgcgtattcaacgctaacattctaaatgtcacataaaaataaagatagaagagtcttattataattgaacaatcttcctgctttaagttcaaagcactctctgacatcagttatctcttttttttttcctcccaagatcaccatgaatgaaagggctggtattagtttaaccattttttagttgaggaaatcaaggcagaaaaagattaatgacagtcaatttcacagtgtaaatatatagcttagtcagaaaagaagagaaattaggaaggcataaaaagggaaattaattga

SEQ ID NO: 192040 - DNA, 401 bp, Homo sapiens
caaagagaaaactaaattttaaagatggtaagtggtcaggcgcggtgactcatgcctgtaatcccagaactttgagaggccaaggtgagtggatcacttgaggtcaggagttcgagaccagcttggccaacatgatgaaaccccatctctactaaaaatatgaaaaaattagcttggcgtggtggcgggtgcctgtaatcccagctactcaggaggctgaggcaggaaaatcgcttgaacctgggaggcagaggttgcagtgagccaagattgtgccactgcactccagcctgggtgacaagagtgaaactctgtctgaaaagaaagaaagaaagaaaaagaaagaaaggaaagaaggaaggaagaaaagaaagaaagaaagaaaaagaaagaaaggaagg

SEQ ID NO: 192041 - DNA, 112 bp, Homo sapiens
gaactgcaaggtcacatgataaatggaatggctagagtgtgaaggatggagctatgaatgccatccctccactacagtaggtcagcgccagtaatttactaacactcagtaa

SEQ ID NO: 192042 - DNA, 419 bp, Homo sapiens
tacctcagttctaatgctggctttgcctctgctttttgatcacatttagaatacagcactcagttctgggtatgtccaagatagataggggagaaaggtaaaagagaatattaatgcaacttgattgtgcagctgttctttccacaaatatttattgaatgactgctgtttgtcacatgttgatgcatagggacacggtgcacacctgagattccattcctgtagacaggacatttgcctgcttcctggcacttatacctctccccaaattgacaccaagcattattttagaaaggcatttagtagaatgcaatatcagcaaatgaaaattgtagagttgtatcttgaagaaacttgaccccaccccccactctcacctgcatccccacatagagccaggacatctcttaagacccacc

SEQ ID NO: 192043 - DNA, 291 bp, Homo sapiens
taactatgaaaggagtcttggatgtttattaaaggaaggaaaatgaaaatagctgctaacaattacatttggaaatacttgtttttaccataaacactattcttttttgtttgtttgtttgagacaggctctccctctgtttcctagactggagtgcagtggcacaatcatagctcactgcagcgtcgtcccaggctcaagcaagctatcctcccgcctcccaaataacttttgaatgcatcatctcatcttcattcttctgctgttactgtaattcacatctccttttgt

SEQ ID NO: 192044 - DNA, 309 bp, Homo sapiens
acctgagcatgcactccatggtcctgtgcatctaggcctgtgcccctgtcctcatgtgcttggggatccagcaccacagcgggctttcaggcctggaaattcccttctctcagcgcctctgctcatgcctgttgggcctgctcagagcactcttttctactctacttgctaaagtaacttctatcctcttggatatttggtctcaaacagccctttatccaaattgtgggagaaggtgaggcctaacccgaacctcatagcatctcatcagtgacctgcacacacagcccgtgtgtagaataccctatg

SEQ ID NO: 192045 - DNA, 271 bp, Homo sapiens
ttgtttctgcaaaaaataaacaaaattagccaggtgtggcagcacatgtctgtagtcccagctacccaggaggctgaggtgggaggatcacttgagcccgggaggtctaggctgcagcgagctgagatggtgccactgcactccagcctaggtgatggagctagacccagtgtgggcaagcaagtaccatcatgtgtagtagcatatagttcaccttctagttggacagaatcactgccataaacaaagtaaattgctcttggcatatgtg

SEQ ID NO: 192046 - DNA, 164 bp, Homo sapiens
gtgaacgctgaagttaggaaagatgtgccaggaaggggccaattaacttagggaagcaatatcaatatctgattagcaatgaagatgcacttctcaggacactggaatagaattgcatcacaagtgtcttatctgactgtgtaccccttgggctgtcttagcct

SEQ ID NO: 192047 - DNA, 251 bp, Homo sapiens
tactgagaagagtttagcagaaattctaaatgtcttagctagcagcagctttcttccctagagagcccctggcaagagtatacagtcagaaatttatcattaccaccagccatcatcctcattaagtactgtgggaaaactgcattaatgattgtttttaatgctgcattgtaaatctgtggatttggttatgtatcattttcttcttaaggaatccctggattttgagccaccaggatagcttctgggga

SEQ ID NO: 192048 - DNA, 390 bp, Homo sapiens
gtcagtcacagagctctgtgctttcaccctgtgtaaactctttctcacgtcctgttctctcctctccccgcaacttactccctcaagtccggtactcctgccagtctcccaactagtaacttcaccaccatgcaaccttcatggccccagattagttttctacaacccagcatttcatcccgactcttctgctggatttttaaaatcttttcctactgatcagtgtaagatctaaaatttcttagcttagcattgagagtcatcacatctggtcctaccagcttttctagtgttaccttcactgacttccttacccagtgctactgtttactccagcaatgctgcagacgaattccagcccttgctgctccctccaccttcaatttctac

SEQ ID NO: 192049 - DNA, 244 bp, Homo sapiens
gtcagtcacagagctctgtgctttcaccctgtgtaaactctttctcacgtcctgttctctcctctccccgcaacttactccctcaagtccggtactcctgccagtctcccaactagtaacttcaccaccatgcaaccttcatggccccagattagttttctacaacccagcatttcatcccgactcttctgctggatttttaaaatcttttcctactgatctataggagtggtgggggatcctc

SEQ ID NO: 192050 - DNA, 212 bp, Homo sapiens
atatctcacctggattactgcaatagtttcctaactaactatgcttcagtctttgctcctagtctactatgaacacagcagccagagtaagcctgtaaagcatgagtcaaatcatagggctcccgtgttcaaaatcctgcaaatgttcatctcagctctccattatctgctcctcaccaccttacctctcctacctcacctcctattaccag

SEQ ID NO: 192051 - DNA, 860 bp, Homo sapiens
cctctgtgaaattgtgaagaaggaaaaagaaattcatgcatagtacacttgcatgtttagtactatctgtgtcttcaggcatccactgggggttttagaacgtatcccccacggtaagggggataccgcatttttctaggtgtctctaattgtgctgtcacagctctttccaagtctagactcatgaaatatatatattttgttcaactattattgaaaacaactaagtattgttccactaagaatataataaattttgttgtatttatgaaacttccattagagcaacaacattgttagtttagccttcccatacatttctgtttttttctctggagtgaagatagaacagcaagggaaaaaaaaactgatgcagtaatatgacctcttaaaactgaaattcatctaaaatggtcttttgaccatgatggactgcgtaagttgtaatacaacaaaatcatttcaaaatcttttttccaatagctgcacgtgtatattatttgatccaacactgaaacgaaattgcaaacattttaacagcttctttgttgcagctctgaatcagaaggggaaacttgccagaaatcctggtttttttttccccaaatcattccatccacttctaaattaatgcattggttgtattctgccccctttggttgaattacattaaagacaaatttattctttaatcttctacaataaaaagatgttaattccactatttaatttattttctagataaaataatatgtgtttctgatacatctgtttttaaattttcccatttttataagttgcttggatgtgaccaggaaaattcctcctacgatggctttaaaataaattttattaaccta

SEQ ID NO: 192052 - DNA, 384 bp, Homo sapiens
tcttctcttcctaatattcccataatgtgtaagttggcctgttgttctgctggatcacgtcccacaggtcccttaggctctgttcacttttcttcatttttttccctttctgtccctcagactcaataatttaaaaggttctatcttctagttctctgaatctttattccgcttgctgaaatcagcttttgcactaattgaatgtcttttgagttactgtacctttcagctccagaatttcctttgcgttctttattcataatttctatatctttattgatactgccattttgtacatacaccattttactgtcattattcatgtcttcctttagcattttgagcatatttaagatcacagttttaacatctctgtctagtaag

SEQ ID NO: 192053 - DNA, 203 bp, Homo sapiens
aacaggcgattttaatacagattagaaaatgtggaaccacctaggaacatctggagtctttaaaaaatagtatcacaaatatagaactaatcatgaatgccaatttcaatgaaatacaactaaaggagagggtaaagtataatcaaactctaaaaaataataaaataggccgggcacagtggctcatgcctataatctcagca

SEQ ID NO: 192054 - DNA, 239 bp, Homo sapiens
tcagatttgcttccatgatgcggaaatgaaaacattttacacaggctgcatctaaatgtggatgagtcaccaatccatatctggccttcacccatgtttgtgtcaagctgacacaccgaaataaatcccagctggtctccatctcctctctgagttttttttttttttccctttcagtttttgcttgaaagcattccttggggctgggcataagacaaagggctatggtggagcttctg

SEQ ID NO: 192055 - DNA, 399 bp, Homo sapiens
gaaaaagccaattgtaacagtacctctttatttcttggatcattattaaaagactggatctttcacgatggagtgtttttgaaactgtctcatggggcataagaagatccagaaatttgaaaatacatgccatctcaatgtgagattattttattttgctacaactgccattgagacatttgtgagatcattttatgtactacagctgctactcaaacacttgtctacataaaggaaaaacatcagagcacccacaagcgctcaaggccagcattccaccccacggaccagccttgatccactgggtagaccaagtgtacacgctgcaaagtcaacgactctattttattgttgtaaaatgaaatgtctctggctctactcctcactaaatgggctgca

SEQ ID NO: 192056 - DNA, 442 bp, Homo sapiens
gcaaacagagaatgtcttacttagtgtcgtgttctcagtgcctggtatatagtaagtactcaataaatatttgttgaatgactgtttaaaacaaattggattaacagtgttttccaactctatccatggagagatcagattcttcacatgatgtaaattcccacatacgtaaactccattagccaggttcgggatggtttacaactttgtctctttactatttagttgtcggctttgtgatcatcttgcttgcttgcttatcttacatttctacatggggatggtcacacagactgggggtgggtttagccacacagctcttcagaggcagaggaacgtggtcacccattccaggctgtgtccaacctgcttccatctttgtctccctgaacatgaagcaatttcctaacattttctaatctttgtctacattcacactgta

SEQ ID NO: 192057 - DNA, 225 bp, Homo sapiens
tcctcctaccccacgcttctgcagcaccaacactacttaaacctctttgtaactcccccaacccccaagaaagaaattatcgaacctgagggggttgcagatacccatgatttgtagtgaactcagacagaagtgtgggtaccctgaggtcctaatagttgtggctggcatctgaagtagggggcagtcttgggggctgagcccctaacccgtggggtctgcact

SEQ ID NO: 192058 - DNA, 486 bp, Homo sapiens
gagggaagagtgggggatacaagaagagcgatggtgtgaaggaatcctcagagagcaaccaacaccaccatcgaggatgaagacaccaaagtgcggaaacaggaaattataaaagtgacagagcagctgatttggagccataagcaatggagattttgagtcctacacgaagatgtgcgaccctggcatgacagccttcgaacctgaggccctggggaacctggttgagggcctggacctgagcatcgtggggaatgagaacttcggtaaacaaatgatccacccaaaggcacacaacaggctgcaataacattaatgcattaggaagctccattgtctcagaagttcctcaagactacatcttaaaatgtgtaggaacttcctgctcatggcaggcttaaaccacatcacatggagcagaaggcagtattgggcaagtctggggaacatgggagcaggccatctgggccttgaagactagggggg

SEQ ID NO: 192059 - DNA, 293 bp, Homo sapiens
ctggtctcaaactcctggattcaagtgatcctcccacctaagattctcaaatagatgagagtataggcacacgccactgtgcctacatctctcattctctcattggtaaactgtaccttctctttttcatcatgtaggcagaagattagcacatataaaatatctttttctcatttatactcttttaaaaagttaattgtttaacttttctttttttttattgagacagagtttcactcttgttgcctaggctagagtgcaatgtcgcgacctcagctcactgcaacctccac

SEQ ID NO: 192060 - DNA, 362 bp, Homo sapiens
gtagcctcgcacaatttatttcttccccatgatgccctcaaatacattctcagtctgtttctctgcctttcctccaaaaatgaacttcttctcctttccaagatctcccctaagcttctgctgccatattaacctgagttctccaaatgtgttctgtggaataccaggatattggcaagtttcatgtcatggaaaaaaagggttttggagtaagataaatttaggaagcactgagttacattggtttcttaattcaggacttctcattgtacatctttgtaagaggaattcctccttataagagaaatccatgaatcaaatatacagtatttgactctagaaccttttttccaaggaccatc

SEQ ID NO: 192061 - DNA, 1044 bp, Homo sapiens
cttgttcatttaatgcacttttcccgtgcttcatgctttccatctgtcagaattccatagctttcaaggccccttcaaatgtccctggtctcttcctctgcccctccctaccccaacaagcggtgtgtatacacatagtcccctggtggtgtgtgatcctctgttccagtacgtcgtgttctggtctgtgcttctgttcttttgcagacacacctccactatgcagtcacgaggcccttgaggacaggaaccatctctttcttcgtaatgtcacctttcccagtaggcacacggctgtttattgaataaacacagatcctgtgtacacttgctcaaattgtacaaaatttgcaggagattcaaagtggaaacattttactgaagggaattcggtcaaattacatccttgattcttgtataggtggtacagttttgtaaaggatcatcaagtattttggaagactcattggctctgccagtggcttagataaataaattcgggcaagttattgatctctctcctcagagaaaaaaattgatgtgttttcttttatataaagagaaaaagaaaaagaaaaaatgtgatctgtaactcattatgtttccttgctagaaagctcaaagatacgttatttgcctgtttttagttgctatccagttttcttacaataatctctctgcctcagtctcctcatcggattacttgtcacatgtgttaaatccttcttttaattgatggttctgttgtatatatcttttatatttatataggtagcctcaactctcctttttttggagagtggtaatagaaatataaataataaatagttgccctttggtttccccaacctgtggtgacaacaagataataaaacagatacttatcctatataaaacaggcaaaaaggctttgggacaatatgggaatcatgatgtgggtttggtggaaaacgagcaaagcaccttgtaaggatcttgtagtctgaagattaaggtgtgcttggggtaggtcatgtcctcccagctctgtgggatttgtagcac

SEQ ID NO: 192062 - DNA, 718 bp, Homo sapiens
agggaaggcggacgtggtcagtcataaaatcttgacgctctttttcacttcctctgctcgttcgtgttccacggacagttaacagctacgtcctgccaattctcctccaagcctctctgggaaccagttctttgcctctgatctcggttaagaaccgctgacctgctgcccagagtaaaaggtggcgtgcgagagctctcgtacttaggaaggaaaggatggtgccaggcgcttggtgcttgccttaagccggcagttttcaaccggggggtggttgtgcttcccacgggccatttagcaatgcctgggaacgttcctggctgtcacattgcggggtggagtgttactgacacagtaggtagaagccaggatgctgtccacgttctaccaggcgcaggacagctcctcccacagcaaagaagtacctggctcagaacgtcagcagggccaagaaaccccacaccaagcctctcctgggattattccagtctccatttggcccccagtcactttctgattccagttctccagcccaggaatgcaggacgtggattagagaagcaaagggaaagttcatccagaaagattccggttctgtgagtgttactaacggggcaagcaccttgaaggtaccgtgggacgtgggtgattcatgagcctgaattgtctcactgttatcacgtgatcagagtgaggcggcctaagggagcatcacagg

SEQ ID NO: 192063 - DNA, 477 bp, Homo sapiens
agggaaggcggacgtggtcagtcataaaatcttgacgctctttttcacttcctctgctcgttcgtgttccacggacagttaacagctacgtcctgccaattctcctccaagcctctctgggaaccagttctttgcctctgatctcggttaagaaccgctgacctgctgcccagagtaaaaggtggcgtgcgagagctctcgtacttaggaaggaaaggatggtgccaggcgcttggtgcttgccttaagccggcagttttcaaccggggggtggttgtgcttcccacgggccatttagcaatgcctgggaacgttcctggctgtcacattgcggggtggagtgttactgacacagtaggtagaagccaggatgctgtccacgttctaccaggcgcaggacagctcctcccacagcaaagaagtacctggctcagaacgtcagcagggccaacgtggcgtctgtccgggtaccgagct

SEQ ID NO: 192064 - DNA, 435 bp, Homo sapiens
cccagagatgctgcctgcagggagttacacagatgcggctgggccctctcctccagacaacccgggacacccaaaagctccagccctggaggatgtgtgcctgggggcctaaagcacggcctacagagagagacaggagctcagcggcgggcccgcacccagcacaggagacacagtgatggagatgagcaggggagccttggcaatgaaaccctccttcctctgaccctcctgcctcgcaacaggctgaccacctctaaccttggcctgcgctgggccttctggggctggggggtgtcctctggtgtcacagccacagaggagctctgccctctgtctgctggggaagcccttgactcccaggggctggtgagcagctgccagaggctgggagggagcaccaggtgggggtctcaccacgtgaaggagggcagg

SEQ ID NO: 192065 - DNA, 495 bp, Homo sapiens
tcccccttctcggtaggtctgggcctggagttggcgggcagtctgggataggaagctaccgggcgggatggcaggaggaggagggaaactgaccctacgcgcctctgcgctgtcctgctcacaaatggagagccagcctgggagaacacccgggggtgccagagtgaggggccccatttctggaatggggccttcccaggtctgacgttctgttcatacagccccgggggaccctgcccacccgggcgtgggctgctttggggataacagggtcccagtctgtttcctgggcggacacacacccaagggccagcggcctgctagaagccgcagcccgacgggcgggcggcgcagaggccgctcggggcccagcgcgccgtcccggtccccaggccagggaggccggagccgcggagcgcagaagttgctcctcccgctccggccgggttcctgtgcggcgcggctgcagctgggcgccggggcgcaggcggccgc

SEQ ID NO: 192066 - DNA, 511 bp, Homo sapiens
ctagcggatcctcatttcaaatccataccctcactgaaaataacacacacgcaaagtctcccttaaaattctgggtaggtggtgcccatgaatcttctggtgcttcacaatggaacttgcgctgcagagtcaaaggcagtacatgccgtgtgacacaaacaagaaaggcacaaataggagagctgggttgtaggacgctaacaccagctcagaatcctaattacaggactcagaaggtccaatgtgcagctctgctgaactcttgaggcatgcacaagtatatgaactgacctgtgggatcagatgagaagctgccaagccataaccctgaaagaacagagggcaccccacggatgtaaaaccacagtggatggctccccgccaagagcgcttctaaacacctttagcgcctcataattctaacactggcctagggtgcaactcttctcagctagactcttagaaccaattcatggcaaggacagtataataattatgaaatataataatt

SEQ ID NO: 192067 - DNA, 469 bp, Homo sapiens
tctgctgtatagaccaaacggatctaatagataaatacagaacatttcatccaagagctgcagagtacgcattctttacctcagcaaatggattattctcaaagaaaaactacatgttaaatcacaaaacaagtcttaaaacctcaaaaacactggaataatatcaagcgccttctctgactacaatggaataaaactagagcatgcataaacaaaagaaattgtgggcaactatacaaacacatgtaaattaaacaatatgcttctgaagtaccagtgggtcaatgaagaaattaagacagaaatttaaaaagttcttgaaacaaatgacgatggaaatacaacataccaaaacctataggatacagcaaaagccgtaggaggagggaagattatagctgtaagtacctacatcaaagaaggaggaaacaaaaaacaatctaatgattcatcttaaggaacaagaaaa

SEQ ID NO: 192068 - DNA, 672 bp, Homo sapiens
gcgctggctactcgagaggctgaggtgggaagatcgcttgaacccaggaggtcaaagctgcagtgagccaagatggtgccactgcactccagcctgggcagcgacagagcaagaccctgtctcaaaacgaacaaacaaaaaacaaaaaattttcttggacttatcttgggataaaaatcactattttcctcatatccctttccatctctacatgttctttctttggaattgaaatagcaaccatgttttcctactaaagttttctggccatgttcagtggctcacgcctgtaatcccagcactttgggaggccgaggcaggctgatcacttgagcccaggagttcgagaccagcctgggcaacatgagaaaacctcatctctacaaaaaatgcaaaattaaccgggcatggtagcccacacctgtagtccccgctactcgggaggctgaggtaggaggatcgcttgagcccaggaggcagaggttgcagtaagccaagagagagccactgaactccagcatgggtgacataatgagaccctgcctcaaaaagaaaaataatttatcaacatgattgttacatagaaaaatgatacaagattacaggaaacacacagtgctctgtacttgccccacaattctgtatctttcccggtatgatatggctcaacta

SEQ ID NO: 192069 - DNA, 1032 bp, Homo sapiens
gtgttctgacaggtctgtcagggatactacaggataagaaagctcaggcatcctttgaggaagaagataaaatatctcatatttttcacagaactacctgttcccattcccaatagagcttcagtatcaccttgaaagaaaatccacaggtgaccatgaagctgctagtccagtgttctggacaacggactctcagatcactggggctgaggccaaagctgccatggacagctgtggaacatgggctaaacctcacctggaagacagcacaacaacatgatgcctggcacataccaagctcatcggccatcatgacagtcacgcatgctcagttagtcccacagggcagtcctctactcaaaaccctcccgcatcagcttggctcatttggagtaaaagacgaagttcccactgcagccacagcgccctcctgtgctcactgctccctggccttgtccatttccaggcacactgacctccttgctgtctctgggcacactggcacttttgctcttcccgtccgtctgtccagaacatcctgcccagagactggggactggtggtccttcctgacacagcgaataaacccacaaaagtcccccaccatgtggatactccctactcccctgatttttctgatacaagcctttcttatgcttacacaagcactccccaaagcctaaagaaaagtcaaatgtccaaacacacaatccttcaacaaacttacacatgatttgccttttcaaatgtgccacccaccttcacaccacagtgcaggaagtcaaagcttctggaggaagggacaggtccctggtccccggtgccccttggaatcaggctgcaagctgggagcagttacactgcactaccccagcatgcagcatagacacaccagtttctgcggcccagaacaccgtcgaagcttcgacggtgttctgttcaggtgtgagtcagctcctggtggtgtcagaagtttacatgattgcggatatcattgattgcttcaccattccattatggttcaggaccgac

SEQ ID NO: 192070 - DNA, 534 bp, Homo sapiens
agatctggcagctctctttgtgcccaggctggagggcagtggcaaaatctcagtctcactgcaacctgggaaacaagagtgaactccatctcaaaaataaataaataaatataaaaataatcacatcatgaaattacttatactacacaatattataaccaatgagtcagggtggcctacagaatttttagcaaagagtactataagtatacatctgaaaattcatctttcacagctgattacgctacaatgcaaatacaatgatggttacgttgttaatactttttacatggtataatattatataacattaataaatagggaagaatgacatggtacctaaaatatctaactgaagcagatgaatggtatttcaaaatatcctaaagtgaatttctcttgtggaactgtagttcactcaagtagctgcaacttggtatttatgtaaagcttatcagggtctgcagaagctacaaagtgtcccatccattaaatctgccattaacttaaattccagctgaattaaacaggatg

SEQ ID NO: 192071 - DNA, 216 bp, Homo sapiens
tttacattttaacagatttttttgttgttgttttctttgaaggtctcactctgtctcccagcttgatcatagctcaccatagacttcaactccttggcctcaaacaatcctctcatacctcagcctccagcgtggctgagaccacaggggtgcaccaccatatctggctaatagttttatttttattttgtaaagacagagtctccctacatttcc

SEQ ID NO: 192072 - DNA, 188 bp, Homo sapiens
ttgcacgtttcattctcttctttcttttctctccttcgttggttgaagagtcaagggcagaagatggtggtgatagggagggggcgtgtgtaggcaaggtacttcgtcccggtcatcttatctttttcctaatttcattttatattatcgtggttcacaatagtggggcttgtggtagaatatctgtg

SEQ ID NO: 192073 - DNA, 142 bp, Homo sapiens
gcatggctgctctgctccttatccagggcctggattagcataagaatatcatcttttcccttaacaagcaactcatccattccttcccgttctctacactcctccccatcaatccttagaggaatacacacttgtacaactg

SEQ ID NO: 192074 - DNA, 435 bp, Homo sapiens
gaagataggctggagactagacaaggagggagagggcttatcctttaaatgtactgtgtctctttaagaagaagctgatgggaaagtactgtgtaatatggataagcagacaccatgactataaaaaagagaaatcggcctaggcaacatagtgagaccccttttctacttaaaaaaacaataactcttctaaatattttaacatattaatggaaatcttgaaaactaagaagtcttcagtacctggaattttaggtgttataagccagagagatactttgggacacagggaccttgctagcaatacaacttagtaattcttatcgaagacccactgtgtgctagggactttgctgagggctaggaagacaaagatgtataaaacacaaagacctaactgtggagcaagggagattcttctgtcagtaagatggt

SEQ ID NO: 192075 - DNA, 393 bp, Homo sapiens
ttttctgggtttctggaggggagcatgcagggagcctggggaactttgctcatgggcatggtgcaccatgatgctcgtgggcttggctccagctaacctggtgggcagccatctttctgaatttggcccctcacttcttggtgggcacttaggctgatcagtaatacctggactctgtgagcctcagagtggctgtgctgggagtgggagtctgggtgagaggaggtgctagtcactcctgaggaccttctctcttgttttctgggaatcttgtgatgccagtctcgaaagtagcatagtgagcccaatgtggatgggcagcatgattcttagtcctccctgatctgagggcagaactaaggcatgggaagggcaggggcggttcctcagagg

SEQ ID NO: 192076 - DNA, 545 bp, Homo sapiens
ctgagtcagcgattcctgtctccacactcagggaatacctgctccatgttccgatgtcccagtgtaacatcccagtctcaaagataataataggaatctcattgtagttatcaaagtgtgacaaacctttccaaagcgtgtcagacaccatcctaaatgtctagatttatagagccatttaatcctcaccacagtcttatgaatgtaatacactagtaattctcatgttacaaaacagaaaactgaggcacagacaggttaatcaaacttcccaaacccaaacagcaagtgagagagccacaatttgtgccagccaggcagactccatgctcttaactaccactcagggtcttctcttataaattatgtgtgtgtgtgtgtgtgtgtgtgtgttttatgagaatctaataatattttacatattaacaaaaccacttatcttgaaaatttttagttaatcttgagggtgagttatttggtgattgttaggaatgccaaaccaatttaagaataatgtatttatactggaatgcaatttctgtgtc

SEQ ID NO: 192077 - DNA, 428 bp, Homo sapiens
gtcatcttccggtcgtatcagtacttcctggccagcccgatgagtaatttatgggtgtcttgattttgagtgtgtgtgtttgagaggcatgtggcttttccagaaactcagtcccagtggaattagaaggcagcttttcctggactgccttggaccccttagatttcaagccactgaagagctatggctagtcctgcagtctactgtttaaatagcttggctgaaattagcaccaccctgagggcctctggctggtcttggttggcaaatgtgattcatattcaggatatatagctctcgtgaacatccaaaaagcacttgcctctgtcctctccctaccaagcttttccttctccccagtaagcagaacacaggtctggggagtaaattcatcaaaagtccctagtgatacccattaacattcacat

SEQ ID NO: 192078 - DNA, 397 bp, Homo sapiens
agagggtgactacagtcaacaataatttattgcatatttaaaagcaactaaaagaatataattggaatgtttgtaacacaaagaaatgataaatgcttgagatgatggctcctccatttatcctgatgtgattattacacactgtatgcctgtattaaaatatttcatgtgacccataaattcatatacttactatgtactcataagaattaaaattaaaaataaaaataaccaagaagaattcttcttcagaaaaatggaattaccacccagagaaaagacctatagtactggcattagatggttgcccaataaagaagccaagggtctttattcctcaattaccccatgtattaggccattattgcgttgctataaagaaatacctgagagactg

SEQ ID NO: 192079 - DNA, 119 bp, Homo sapiens
tttaacaaaatatgtcattttagcatgtagtcaaaatactattgagatattttaccttctctttgaaatgtgctgtggattttacacttatagcacatctccggttgggtagtcacaga

SEQ ID NO: 192080 - DNA, 340 bp, Homo sapiens
agtggaacttagaatacttacttagggtttctttaggaaaaatgaatggtatggctggaagcagttgtttccacctcaacttttctatagacatgcgggagagtggacttgagggtttgtaataaagttctgcctcactttggtgaggtggcttctgtcattcaggtcacaccgtgcactgcacaatcaaggcacaggagcctacacagttctggaataacatgcaggcatgaaaaggtgcagccctgaggcttatattctacaatgaacatgcaggatgagcaggtgtgagtgtgtcagtggtgtgcacatacctgtgtatccacaagcgtgtccactc

SEQ ID NO: 192081 - DNA, 534 bp, Homo sapiens
ctacccacctcattgtcatctaaattaggtcaatgtctatatttatttctcagactttttgtctttttccttataatagtcttcgtagtctacaattacacccttgtttgtgtttatttattctatctctgcctgtttcactggatcgtaagctccaccatgggtgggaaatcagtcttatccccagattctctgaccctccgtggtgcctggcagacagcaagcatggagtaaattctggttggatgaatgtactggaagtgtttagaggaaggaaactgacctgaggtagttgggacaaagaatgggcaactttagtttctgtaagattgagatacagataacagtacttgagtacttgtgtacttaccctttctgattaaatagaggctgagatcggataagataattttgctaatgtctgttgtggcctgaaaagcgtgtgttccttggctccttcctaggctcattcattcgctcatcaagctttgagtgagctcctgccctgtgcccacatgtaggaactcccctctc

SEQ ID NO: 192082 - DNA, 389 bp, Homo sapiens
acgatggtggtggtggtggttggacgaaggctcatgtccacgaagttgcctgagggcgcttcttctaggctgcatttgacgctgagaagaagcaggtcacggtgtctactgaataagcgtagcgtagtcaaccacgtcattgagcaccatggaatggcactgattccgggaagaatcaaggtctcctccccagggatggcgcgatttcccaaggcagaacttgatttaagaggagcgagattatgccattttgcatcatgcagaaaaacacatgccatacagaaaatcatctcttcgggtgtcatggagaagtggtggtgggtccaaccgttcctccccgaagacagcgttgtttccaggagcctcggggatggatttgatactgaggt

SEQ ID NO: 192083 - DNA, 305 bp, Homo sapiens
acagaaccctgacaaacaaaagatgtaagggagagaagggagtgggggaaaaataataagaaagtgctgtgcattggctaagaggaggacaaaacaaagcatggtgtaacttaaggcaagtgaggaaacggtctcaagaaggtaatcaaaggtgtcaaatgcagtagagatgttaagtaaggtaagaaataaaggcgtccaactaggaaggtcagtagttaccctggcaaaagccaaggtttgggcagaagccagaccttactgaactcagaagaggatgaaggtgggagaatggaaatagcaaa

SEQ ID NO: 192084 - DNA, 138 bp, Homo sapiens
cagagagccgatggttttaaagtgtggcacttccttgttctcacactcactctctcctgctgccttgtgaagaaggtgcctgcttccccttccccttctgccatgattgtaagtttcatgaggctcccatagccatgc

SEQ ID NO: 192085 - DNA, 536 bp, Homo sapiens
taaacactaagtttttgaagcaatatttcaagtcccaagaagacaaagtaagaggaaaatattaagagacagctgagctcgcacacaatagaaaactctctggcaatataaataatctcagaaagaaggaaaatagaagcaacaagcaaaagattactgagttggaactaaggaatagcaaagacaaaaaaggtgacggaggagaaagttgtaagggagaggtccaggaaggagagctttcatctcagtcctcagatagaccttgccatcccagcacctctgcatcactcaggttgcagagaaatctggagggaagaacgcaatctcatcctacaagctgagcacatcaggaggggctggggctggcagtgctctcggaagcacactttgagacagtaaaggaagtcacagatcaacagtggaaaacacaggagatgctcttgctggttgtcagcgcaggacactgagaaccccagagtccacagaagattattttaagctcaagatagttgagattcgacagatacagcaagaag

SEQ ID NO: 192086 - DNA, 592 bp, Homo sapiens
cctcttttactaatcctcctcagcacagacccttttttgggtgttgggctgggggacggtcagttctttcccttcccacgaggccacatctcaggctgtctcagtggagggaaactttggacaatgcccaggctttcttaggcagaggtccctgcggctttccgcagtgcattgtgcccttggttaatcgagactggagaatggcgatgacttttaccaagcatactacctgtaaacatattgttaacaaggcacagcctgcacagccctagatcccttaaaccttgatgccatacagcacatgtttctgtgagcacagggtcggggctaaagtttacggattaacagcatctcaaggcaaaacaattttcttagtacagatcaaaatggagtttcttatgtcttccttttctacatagacacagtaacagtcggatctctctcttttccctatacaatgctctatatgtttgagatgcccctgagatattagaacagttaacacttatggaatgcttaacaaatgccaagcactgttcttgttaccaaaacagcaggggttcaggcgaggtcctgctgcttgccgcacaga

SEQ ID NO: 192087 - DNA, 672 bp, Homo sapiens
tctcagctggcccctgttgctgtctgtggagcagtagtgtgacatattcagcagagcaaggacaattgggccagtgattattaattctgaaagatgcccttaagtggtgtcatgaaaccagatctggaggaggcaaggatttccccccaaaataaggagattaacatcccaaaggagggagtgagaaagctgcctgctaaaaaacaaactttgctgccaagtttatttttatctcatgtgtttgaagattaagcagatgtaccctgaaatatgcaatgctttgtttgagttactcaagaacacaaagtttactttaaggacaaaattattatatgattatcaacttttctttctccctacatttgagacattggtactttttgccgctgagtatatagccagagggcttctgtggtaaaattctctggacaaatccctggttttgccatctcctcagcaaacctcggtatcaggtgggctgtcacctcccagttccccttcctccttgctggcctttttcacctgcagacttccttgttgtctttccacctcagaccctctaaaaatgccccagtaccagagcagctccaatgctggcataaggttggatgcctaattttcctcacgattgttcgtacgctggtgccttcactggctgactgttctgacttc

SEQ ID NO: 192088 - DNA, 333 bp, Homo sapiens
gaagactggcatttaatttctcattaaaaggaagtctcacttagtgggtaatgatagttgattttttacatacttgtcaattatatattttaagttttacaaagtcacctgacttcatattatcctaggaatgtccttcctgcaggataattaatagattacataaaaatgtttcaatctgttcatttgcaacctctttcttagttttattgtttctttactgtggaaagaacagggatatacaattaggtttttggtaaatgttttttagaataactctattatccttttttgcttacctgttttctcagtcatttatataatttttatgtg

SEQ ID NO: 192089 - DNA, 149 bp, Homo sapiens
tctaataaatgttaatgtctgttacatatctcactgttctttcttaagtttttcataatgagaattactttgaacttcacataactgtgttatgtgttggcattttactgagattcagtctttccatccaggaacacagcgtgtctttc

SEQ ID NO: 192090 - DNA, 215 bp, Homo sapiens
caggctattattatattattagttaagttttggaggagtcaaaagttatatgtacattttcacctgcatgagggctggccgctctaaccctcacattgttcaagggtcaattgtatattgcttttaaggtaacttacattttgtcatagtcagcgactctctgaggctggcgtgcgggtggtaaaggaatttaccaagacattaatgagtgtaga

SEQ ID NO: 192091 - DNA, 326 bp, Homo sapiens
tgcaggggacatgagggagagggagggaaaggcatctctcttctgtgcaatgaccaaaacgattaacgtgccccctggaaggttgctgtgggcaccacgggcatcccgcaaagggcagtttccattcccttaaaggctcccattaaaaacacataaccgtgttaacaagggcagacagacaaaagctgtctctctgctcaatgccagctctgaaacacttgtgggtggaggggcaagaacgggtaaaggaaggagggcgacagcagcttaatcttaggggtggctggatggtgggtgaaacttttaaaaatcgctacttgtaattg

SEQ ID NO: 192092 - DNA, 435 bp, Homo sapiens
tcacagcctcattttcttgccaagatattttcgggaggtcctcaggacttcagtggcaactcaggaactatatataagggagtatgtctttgtttcccctcatctttccatgactaccttctttcctaatattagaggttgtccgtaaagttacttgaaggcggcatctcatcactgtcattgttttcagtgctttctacaagaattttaatatctgggccaagagtgttttcactcaggattcaccacaaggaaaccttaaggtgtgaagaaggtttcatgttcctgagagtcctctagaaactgagatgaggagaatggggattacccattctgtttcacattttgttatctgggcaccaaagcagtttttttttatggcaccaatatcactcaaaatccctcacaaaaacatgttacacccctacatgcatc

SEQ ID NO: 192093 - DNA, 998 bp, Homo sapiens
agtcatcccacctaatcacttagccattgttgtggtattgcagtgcttctgttcaagtaacccacattttatttaatgatggccccaaagtacaagactagtgatgctggtactttgaatatgccaaagagaagccataaagtactttttttaagtgaataggtgaaagttaaaatcccagcacgttattctgtggatatcaacacacagattttggagtttaaatggagacggcggtaaaccccaaaatagccaacacagtattggaggaggagaacaaagttggaggactgacattacctaactttcaaacttactatagagccacagtaatccagacagcgtggtactggcaaaggaatagacagatcaatcaatggaacagaataaagtgcccggaagtagacgcccagaagtagacctacataaaccaaatcaactaaattttgacaaaggagcaaaggcaaaacaatgtagtaaagacagtcttttcagcaaattgtgctgcgacaactgggcatgcaattgcaaaacagaaacgaatgtagacacagacctgacgccatttacaaaaattcacccaaaaaggatcacagacctaaatgtaaatcacaaactatgaaactcctagcagataatttaggagaaaacctaaattaccttgggtttggggatgagtttttctgatacaagaccaaagacatgatcccagaaataattgataagctggacttcataaaaattaaaaagttttgctctgtgaaggatgctgtcaagagaatgaaaagataatatatgagaaaatatttgcagaggacataactgataaaggacttttccaaaatatacaaagaactcttaaaacttaacaataaggccaggcgcggtggctcactcctgtaatcccagcactttgggaggccaaggcaggcagatcgcttgaggtcaagagtttgagaccagcctggccaacatggtgaaacctctacctaattctc

SEQ ID NO: 192094 - DNA, 441 bp, Homo sapiens
cctactcctacattatctgccacagccctgtgcaggaatccttgccacacttcttgctctcctgcgacacaggggcctaggatcatgactgccctgagtaccattctgtgatgttccatcacatgccaggaagcagtttggattccccaactgagcagaattcctctgtaaatatctcaaatacattttcctgggattgacctctcctttcttttaaaaaatattcagtgaacactactttgtgccaggaaactctgagaagtgatctttaggaaacgatttgcaggtagaagtgacagggccagataagggatgcatgtgtatatgtgtgtgtttatttatgaatctgtatggatctatgtgtttgggctgcggaagatgaatgtacaagaggcaggatgacatgtaggactcctgtttaaacaactcagccaatgatgg

SEQ ID NO: 192095 - DNA, 372 bp, Homo sapiens
gggtgtctagaggaccccctcccaacgataaggatatggaacacgaccatgcaacttcagagtcctagtacttaaggcattcagtctttgctgcctataaccacgactccacagtaagaaccagggtcagagagaaaaggaggtgacccaggaggatgatccatcatagtcttgtggaaggtaggggcctgggaatgaacccagtccaaagggagtaaaactcctagtccaaactgtgcccccaaagcttctgcatttgaacgaaggcctgaaacagacatttacaatagagtgagccagtttggactgttgaagaggctctgagtagggagttagctaccctgaagaataaggccagaaatttgccagttt

SEQ ID NO: 192096 - DNA, 493 bp, Homo sapiens
cattacagctgggttgggaaggttggaaatagaactttcgacttctattctagtgtctattaaaaatacactaaaatttatgcatggaaatatttacttttatttctgtaccaaagatgatagaacacagcccacttagaagtatttctgtgtgcatgtgtatgtaaatacacacaaacatgctctgcagctggctaataaaacacagtaatcaaagcctatagtggatattcagtgtaaaggtaagacttgctgaattttgaggcccattggggaagggcagggtcagggtgagacaagcatgtggtcacaaccagggggcgttttcttctgttgggagtcaactactgttagggaaaattcctggcagcgtggagcaaggttggtggatcccacctgtcagaaaatcctgagactgggtttagtccttgagggatggaaggacaaggcaggtaccctggaccaaagaggcaagggatccaacccaggtagt

SEQ ID NO: 192097 - DNA, 666 bp, Homo sapiens
cagcataattaggtgacaggaagaagtttaggaaagctagtgtataggctgcaaacaaaattgtatgtataagtatctgtgatctaatcctcagaaggacaggtaagatctggacacaggaagcactccatgctgcaggtacactatgaccaaagacatggatgtgcaaaagcagaagcatgtatatgaaacagctggagctgctagtttagctagagcaagggtatacagtgggaaacagacagcaaccagactacatgtacaccaaaataatttaccctgaatcctcagaaggcaagtgtgacagttaattttatgtgtcaacttggctagactttggtgtccagttgtttgatcaaacaccaatctagatatgtctgtgaaggtatattttagatgtgattaacacttaaatcaacagatttctagtaaagtggattaccctccataatacaggaaggcctcatctaacaggtaaaggctttaagagcaaagactgaggtttcctggaaaagaactacaacatagaaaccctgcctgtgtgtccagcctgctaccgagcagaatctggagttaagactgtggcaggccaggtctcactaacgcaggcctccataacaactgtttcagtactgactgagtggttaagttaaatattaaaagcta

SEQ ID NO: 192098 - DNA, 653 bp, Homo sapiens
gtaaataagtaatcattttacagtaacatcttttttacatagcacttgacatcacagaacccgtttctgcaatcaccatcccttccattcccaatcaatccatctgattctcctacttcaagaaacatttttgtagtatccacacttgactctggtccttccgtttctgtgcctatcccaatggcaagcatagctttttggtctactggagggtgagtttgccaggaaccaaaagtaagggagaacattccaagacttgtggtccatatactggtttagtaatttatgaagccacggtggacaggatggagtaggatgattggaggagggcaaggttggaggctcaaaattggggcttgaaagatatccgggtctactatgtgcaagcaataggctgtcggaaatctggcctgaaccctagaagaaaaattgctactgcatatacgaacttataggttcaaacaatgaaccacagtgagtcaaccaccagttcaggaaactacaattacagaataccctgaaagcgtgaccagactataagctgcatccataattctcttcccaggttataaggaaccgcaaattacctaataagcttgcatacacttatttggcttggacttatctgcccacatgctgcgacttcagatacg

SEQ ID NO: 192099 - DNA, 485 bp, Homo sapiens
aaaacatccctataattcttttaaggacagtacagggtcaagtggcttcctgggagaatgcaaggcaggcactgagcctggagagaactctgtagccccattagtattgagggcaacccccaggccagccctggtggcagccagatggtttggagccctcgcagtctccacagaaggcttgccgggaagcggcagatgctgctgctggaggcaggccttccctgcagggcatctggacctcataggaattcctggagcgactggagaaaggtgtcttcctgtcctttcaggggctcctgcggggaattccagaacttcagggctcctgatcaccactgtacagggcagtgagctggagctggctctttccagctcacaagaaccgagtattaaatgtttaggaattttgtgaggcaattgttaaataaccgttatcatcaaaaattgttataaatctataattaaataaactatattaaaatcta

SEQ ID NO: 192100 - DNA, 617 bp, Homo sapiens
gagaacagtttggacattcctcaaaaaactaaaattgagcttccatatgatccagtaatcccagtgctggatagatatccccatcccccaccagaaaaaaaagaaattagtatattgaagagatatctgcactcctatgtttgttgtagcactgttaactaagctaagattttgttacagcacagtttactaagctatggaaacaaccttagtgtccatcaacagacgaatgcataaacaaaatgtggtatttatacacaatggagtactattcagctagccataaaaagaatgagatcctgtcatttgcaacaacatgagtggaactggagattattatgttaagtgaaataagccaggcacaaaaagacaaacattgcatgttttcactaatttgtgggatctgaaaatcaaatcgattgaactagtgaacatagagagtagaaggatggttaccagaggctgggtagtgtagaggggggttagaaggaggtagggatggttagtgggtaaaagcaaacaaacaaaaatagaattaataagatctactttttgatgtcataatagggtgactatagtcaatgataatgtatattttaaaataaagtgtaattggg

SEQ ID NO: 192101 - DNA, 361 bp, Homo sapiens
tataaatttcacactaaaaaagaatagattcaggaaacattttttaaaaacccccatgtcctctttcttcttactcaattcattatgtaggatgtagcctacttattacagtaagttcgataaaagtttacctattctcaaacaggtaattaggggtaagacttctaacaaaattctctaggcacagtaaaaatgagatgacaagtcaaaaaagcaagtagaacaggtacccattataatgaaatgaggtgatatagcaagagtattattttttaaataacgataatctacacaggaatgagcagttgtaccatagcaatttgtatcaaatatcagagcctccccattttatgttcattgt

SEQ ID NO: 192102 - DNA, 172 bp, Homo sapiens
ttcaatatttttgtgtctcagtgaataaggaggccaaggacagcaagagaaacaggggaacaattggttagtggaggaatcagagcatacacatttattacacacaggtttacagtcttttatgaccacagtttgtggcaccccaaaacattaccatagtaacatcaaagat

SEQ ID NO: 192103 - DNA, 410 bp, Homo sapiens
agtaagacctgctttattgagcacttactatgtgccaggcaccatcccagttgctttccatgaaggattgctctttaattcttatcataatgaataggtactattattatcccagtttatgggtgaggaaaccaagtcttaggttgactaacttattaaaataaagcacatacctagtaggtggtgaacaagagccaaaacaagtctgttggtcagctaaccaccacgttatagtggctgctgcttaggggcagcatatatcctctgcatttccccagaggtgacagaagtagtggagagggtagtgctctctaggctctgacacacagcccatgtttgctgactcaacaaccacacaacgtaatgctatggcacctcaggtggcagggagggtatcgtgggctggactg

SEQ ID NO: 192104 - DNA, 199 bp, Homo sapiens
aacttataaaattggatgagcatacatctatctgtataaaataatggctttctgcaggctatgataaatagcctacagaaacaccacttggtaactcatcacatctgacaaatcaaaaaacccttccttcatttctttggctgatacataaaatttctgtataatgtaaaatacactgagtcaattctcaccattgatg

SEQ ID NO: 192105 - DNA, 611 bp, Homo sapiens
cctgcggagcgatgatcctaagctcggtttccaaagtattggcattacaggtgtgagccactgctcactaactagtgagctagttttcactgctagaaaaactagccttgttttgcttggtagagaatctctcactctcttcactgatggcttcagagggagatgaatgtgaagataataaagtctaaagtttcttcagagctcagtctgtctctctggggtcccattgcctatttcagattctgaatggtatttcaggctaccccaaaagtgtcagatctggtcaagagtgttgttcttatgtactatagagtgtgccactttttgagcaagcagtcaagtatggtagttaagagcatgcactgtgaatctttgctataagatggtggcgtcttgtactttccagacatgttattttccactttcaaccccttgctctttatagccttcattgagaagaggggtctctatcctttcctcttgaatttgcactggctcacgactagccacaactagattatgaccaatagaatatggtgaaagtaatgcacgatgactgaggctaagtcagaaaaggcagtgcagccttcaccttgttttctgggacactt

SEQ ID NO: 192106 - DNA, 194 bp, Homo sapiens
cactcccaaccctgaggttttaaaatgttttctgacaacatatatcccctttatttccacttccacatagaatctaggcaaaatacctattctttagaaagtcaaataatattgtagtttaataccaaacctaaatactgtatatatatttcacataagcaaaacacaggtgatattgtgttttcttcattgct

SEQ ID NO: 192107 - DNA, 207 bp, Homo sapiens
attccctctggtgccgaaggggtagctggtaggttcttccatgatatcatcaggatgtaggagggcatgggctccaaagtctgctggtttccaagggctggcagaggtcctcccaccaaccccaggcctgttttggggctagtctctgcctctagtcctttacgtggcctgtcaactaagtggctggagacacagtggctcatccaa

SEQ ID NO: 192108 - DNA, 585 bp, Homo sapiens
gacatcaagaatgagtcaagaacaattccacgattttggcctgagcaactagggtgatggaggtgttatgtgctgaaaggcggaaggtatgtcagaggagcaagtctgagaaataaacatccaaagctcagtttggccatggccatgttaagatatccaagtggggacactgagtaggcaactgatgtttgtgttggaggctcatgggagcagtccaggtgagaggatcatggtacttaaacctgtgatagtgaagatcactgaagaagtgggtgtaaaagacacaagaaggggacaaaggcagggcctgacgcacaccactgtcaaaagatgaagaggattgagcaaagaccactgagcaagaacagctagaaggcaagtgtgtggtgtcctggaagaaaatcaagaaaatgttttaaggagcaactaactgtgtcatatgctgctgacatatatcatgttgttcaatactttaggcttgtctattttttaacccacaaatattattttaccaggataatgtttgtttagatttctatatatgattatacttttatttactcactattctttcttacactttag

SEQ ID NO: 192109 - DNA, 164 bp, Homo sapiens
ctcctatttcacactattctcccttttacctatagaaggatagtatgcaatttccaggaaacaaaagtacaataccctatatccttcctactccctcaatgcatttcctgttgcaaacatctggttttctatatcttagctgcacttgtataacccagggacaa

SEQ ID NO: 192110 - DNA, 226 bp, Homo sapiens
taggattgaaagagaaactctaaaggggaggataggattaagctaaaaagggtcaagacactgcccaatgagagctaaacacaggatttgctgtcagagggtcttattgttctttaccaggcctcatttgcagcccatcagactcgacacctggacatccctattcaacctctgattctcccccaagcacaggttaccacagacatgccaaatacaacagcatctg

SEQ ID NO: 192111 - DNA, 424 bp, Homo sapiens
ctgtggaatccatctggatggaagacgccatccaattataaatccttaggatactttttattgccctttaagagttctgatgcttgctcttccatgcccatatgtttctgcttaagaggcttcattcaaatcaaattggaagagaagtccagatcacccaactacaattacctgagcaaaaatcccctcaattatcttggtaatccagataaattcggagtacaaaggtgagttgcctggatagcactggctaagaactgctttgtctcccatttcaccttgcattattataatctacttgattacacttcatttataacaatagggagggcttgttttatgccacacattgccacttgctcaagtgtaaaataaaccttaaatgactgatgtactgctaaatttatctcaaaaaacaatcata

SEQ ID NO: 192112 - DNA, 364 bp, Homo sapiens
tctagggcctgtgtctttcaagtcttgaataagtttgcctatttctacaaaaatcttattggtatttttgtaagaacttcattcaacctacagaatcaatttggggagaattgacagtttattatactgagttttctaatccatgaacatggtatgtctatttgtttagattttcatttattttttatcagcattttaaaaattttcagcatccagtcctgtgtatgttttgttaaatgtaaatcgaagcatattactttcgttggagtgactgtaaatgaactttttagttttggttttcatatgttcattgttaatatacagaatacggccaggcacagtggctcacgcctgtaatccagca

SEQ ID NO: 192113 - DNA, 513 bp, Homo sapiens
cgaaatccgggggtcttggcagcacataaacaatgaaatatttgccaaagcagtagggcaagaattgcaggtttactgtcttttatactctcactatgtcagtttccagaaacagctgatatcaccacttgaggcaactgttccctacagagcaagccacattacccactgtaaggtctgggttttaggccttgaactccttcctgcactaagacttcagtctccttttaactgaggagagcccagaaattatctgtttgtgtctccttcaggatgctctatgggtagacctggccttggcttaccaaaccccatgcaaataacctgttacctgcccccttttctaccccttccagtgggccactcctttaacatctcatcttccaggattcaccttctgccaacttctcttcaccacacaatctgcagaagcaaagaaaccctccaaaaaccaactttctacaaaaaagtgagtgtacctaacagaaagcttacatactcaccatatctttt

SEQ ID NO: 192114 - DNA, 241 bp, Homo sapiens
atgcctatttctccatattctctccagcaatgaggactccctttgaaacacctggcttattttatatgtggctctaaaatgtttgtattttacaatgttgataaggataaatattttcacaaatgtttactactcatttgattttttggaccatttgggaatcagtgatttttatttctatgtgtattcacaaaaggtacttataactggttgcagactgtggggagaatatgagcgaaga

SEQ ID NO: 192115 - DNA, 371 bp, Homo sapiens
ccatttcagctcaaccagaatctctcttttttttaaatcaagccaagaacttccagtttttattttttaaacattatttaacaagaaaaacattcaaccaaattaaaaagaattaggttggattaatttaccataaaataatcaaccataaaatatcagcccttccatttagggccagggaggccaatagttcctgtttaaacagcagaattgcactattgatatttttacctatatttgatggcacaaaaacataaaagtcttacaatgtccactgacatccttctctccctccagagtagagttcatataattgcatcttaggtactcaggcttttaaaaatcatcttacattttgaaatataatacaa

SEQ ID NO: 192116 - DNA, 478 bp, Homo sapiens
acagttggaaatgcagttattctgtagcatacaggttaggtaaagtttctttcttctgtttctagagcttgtaaacataggagcgattggaatagtttaagcaaagtcaaagtgagaaaatatgcagtgccagaagcttgtgtgagggagtggaaatttttgcacaaaagccagaatttgactagataatacttttcaaattgtggtccctgcagtggcattacatgggaacctggtataaaagcaaattattgggtctcaactaaaatccactgaatcaaaaaccttagggggtttttgagcccagagatccatgttttaacaagcccctcagtgattttgttatgcattaaactttgagaaccactggactaaattatgttggtttttcaatggcaggtgaataacaggcaatggaaatgcatggaaatgcatttgtgagcacagttttggaacgattaaagcattttatttaggt

SEQ ID NO: 192117 - DNA, 423 bp, Homo sapiens
gttctaccatgtgaagaaacatattttcagataaaaggaataaagccagtatgcacagagtataagtacggaaaggtcccaactatgggaaagttcccaccctagctcttcatggccatccttattcatacaatgcctattatatggtcatatgaaccaataactttttcccctacaggctacttcaagctgtatttctgttacttgaacaccaaaaagtcctaactaataaaatagagaaaccaaattgataaaaattagacatcaaaggattttttcattcaggctataaaagggcctggtatgccttctctggcttagaaaactttcatctatcaaatataatgtccctttcctctctgtattagataaaccccaaaattactatttcattctctttcaatacactctatgcaaatcaca

SEQ ID NO: 192118 - DNA, 395 bp, Homo sapiens
tcgagctcggccagtctgtctaccattagtcactgtcctaccagcctgctcgcagaaaagaaaaagttgcctaaataccatggctccaatgcctgaattcctttaccaagaaaaaacaaaaacaaaaacaaacaagtatattacaagactctggaaaaccgaagtcttacatttacaatgtacttattcagatttgtaaactcctaagtggcaggagaatattaacatgtacttttaaggaattttcatgggcaaacaggttaacttcagtaactacctgtacaaggtttataatgagctgtagacccttttttctaactctcttggccacaactggtatattttgccttcagagtattatcagtgtgtatgtattgaacattggcacagtctat

SEQ ID NO: 192119 - DNA, 322 bp, Homo sapiens
tgagggaaatgattctgaaataattattttcatctgtaaatctagtacaaagagaaaatttctatgtaacatttagaaccttagcaataataaaccaaaaactaagttcccaactcagctctactaaaagcagttcctaaatgaagtgcgaacacttaatcctcctgaaaaggtttctctaggcaatccatgataaatgatctgctgttcttgttacagaatgaattacaaaatgttttattacttattgtggtagtatgggaagcaatgccatattattgttgctgttattttccaccataggcagtcacaacttacaaac

SEQ ID NO: 192120 - DNA, 297 bp, Homo sapiens
actagccaaaccaaaatggcatttggaaaagaaaacccaaattcaccgtgaatggaatccagtgaagaaatgtttaatctagttagtgggtgggctttggttgtcatggaaactcagctctgtcatcctgtgttgttactaggcaggagcagccaggtcattccataaatcatttctgtcatagctgacggtgatgcattccatctgctccatcactgcatgccatagtctgcacatttcaaatcccttccttcaatccatctgcttccccacttcccagccggacacctccccaaa

SEQ ID NO: 192121 - DNA, 260 bp, Homo sapiens
gaattggttggtgacaagtgatgctgacttactcaatagcacgtatgtgcatgttgataacccattgagagtcataatcagatgagtgaagaagccccctgtgcatcccaaccaatccttctgaattcagggttaaagtagaaaaagcatcctcaactaacaggactattcgtatgggtgatgtcatccttctctaaacaattatttgatctaacaaattctagaattctctataaggagctgcctgccttgctctgaaa

SEQ ID NO: 192122 - DNA, 339 bp, Homo sapiens
ggcctcacaaagtgctggagttacaggtgtgagcctgtgtgtcctttctattgaggcttctctccacattttctgatcctcagtctccttatttcctgtaaggctgaggtcccaaatccagcctgtgaaagagaaatgccagcagaggcagcacccagcacaggatctattattgcagcatgccctgtggtcagggccttcagtaaaagcccacagaccctgactactttctggcggactctggaggaaggccttaaccacagacaaaaggacaaggacagtgctgtggagggactgctggctgctgcagcgtgaagagaatagggaatgcactctaca

SEQ ID NO: 192123 - DNA, 237 bp, Homo sapiens
atttacagtacatccacataatggaataccattcagcattaacaaggaatgagctattgatatgcacaacaccggggtgagtctcagacattatgctaaatgaaagaaaccaaacaagcagctatgtattttgtgattccatttatgtgacattcttgaaaaggcaaaactttggggaacagaaaagagatttgtggctgcttgggagttgaactttaaagggtcatgtgggaggtt

SEQ ID NO: 192124 - DNA, 535 bp, Homo sapiens
tcttctttatgattttacacatttatgggcttgcccaacatgtggtttttatgcaggtaccatattagctcgaaaccacgcgtgcactgctgtctcacggtgccttggattcctgcatcactgctgctttcaaagcctcagcttcctcctctatgaaatgggataataacagcacctccctcccatgtggatctaaggtgtaaagtgagtaagccttgcctacagcaagcactgaggttaccgatgctatccatgtacagaggacaggaggctctgagagctgaatatcccgtccgcccacattcatagattgggggtggaactcaggccacctgacttttttctttttttttgagacggagtcttgctctgtcgccaggctggagtgcagtggcgtggtctcggctaactgcaacctccgcctccctggttcaagcaattctcctgcctcagcctcccaagtagcatggactacaggaacctgccaccacgcccagctaatttttgtatttttaatagagacagggtttcacca

SEQ ID NO: 192125 - DNA, 357 bp, Homo sapiens
aactaaagtctagattggttagctgcctgaatcacaagaggaaaggggaaatatttaagagaattccccaacagctttaaaattgctctgtctttggccacatgaaaacaaaataaaatcatataattttattgctataagtttaaacctctaattttacaaatgtttgggaatgattttctcatctcccctttctcattgcccccagtttcaacctacctcaacctactcatgtcctctactatattaaagagaatttgccagtgccagagatctgggcatcatttctgttgagcccacttctaaatctctgtggttgatagccacttctgtccatccttgtggtgtctacccagg

SEQ ID NO: 192126 - DNA, 478 bp, Homo sapiens
ctcaaagtgctgggattacaggcatgagccactgcgcccacccatgctctctcctttaaggatggtggctacccccaccctcagctgtgcctggtttctctgtccagagcctcagattaacccaaccaattacagccacgaagttaaataaattccaagaggctttggctaaaaaggcaagaagttttgcactagagtttctgaattaaaagaaaaccaaaaaagttccctctcatctgccaaaatgagaaattcacccaattcaagcccctttacccctcccacttcgccatgcttttttcccccccgctttgataatgcctcagaacaagtattcagggtccaagtttgttttaaaataacccaatgagctgacagacggagctcctggaattctgcagcttgtgcgagagtccacagatgggaaattgcagtcagttatagggtggtgctattaccatagcccaatttttgaaag

SEQ ID NO: 192127 - DNA, 234 bp, Homo sapiens
cgctcgcgctcctctccccgcgggggcgtcccgggttccatgcagtcccccggctccgccaccccacggtgcaggagcgctcgagaaagcaggacgcggcgagcggttatgtaagcgcaccccccgcgcaccgccgcccggcttgtgcccgccaggcagcagcagccgcagccctaggagagagacgcgagaggccggagccgggggaaaagtcaaaagccccttcacgcacag

SEQ ID NO: 192128 - DNA, 384 bp, Homo sapiens
tgacttgaataactctttagaccaattggaactaacaaacatatacagaacacttcacccaacaacaggggatacacattctcaaacgcacatgtaatattctccaagacagactacatattagaccacgaaaaaagccttaaatgtaagaagattgaagtcatacaaatatattctccaacctcagcacaatgaaactacaaatcaatagcaaaaaaaacaaaaaacaggcaaatccacaaatgtataggaattaatgcagtttttaacaaccaatggggtcaaataagaaatcacaagggaatttagaaaatatctggagataaatgaaaatgaaaacacagcataccaaaactgatggaatgcaacaaaaacagtattaag

SEQ ID NO: 192129 - DNA, 656 bp, Homo sapiens
gtttcccaagagtctctgcctctgcaggaggcttctgcctgcaaacagtgggcggtggtgtgggtggtggttccttcaccaatggttaatcttcttgatgctgatctcctgatagtgagttcttatgagatctggttgtataacaggatgtggcacctcctttctctctctgtcttgctcctacttctgccatatgaaatatctcattgtcgcttggccttctggtatggttatgagggccctgatcagtgtgggcctcatcagtggacctagtcagctgggacttggtcagtgaggcctatttattgggggcgtggtcagcaggggtctacttagagagggtctcattagggggacctagtagtggggtcttggtgagtggggacctagtggcagccacttgtttggtgtctggtcagtgtaaaaactaggctgcaggactttgtcaatggagacctggtcagctggggcttagtggtggccttgtcagcatgggctgggtcactggtgaccagctcaaggggtgctattcagtggaggcctggtcacatgggacccagtcagcagggcctgctggccatgtcctcaccagtgaggcccttgtcagtggggccctggtcagcgcagcctggtcagtggaacctaatcagtggggg

SEQ ID NO: 192130 - DNA, 240 bp, Homo sapiens
taagtttttaagcacacataaatactttctcttaggttatttttcccagattactggagaggtcagtattcccactttcctgccattaagggtatttaggaggaaaatttgagatgtcttattctaatctagtagactacccttaaacatgacctccatcacaatttactgcttagattctctagttactctcaatagactcttaggccattagttggcctgactttgcatgaattctgc

SEQ ID NO: 192131 - DNA, 677 bp, Homo sapiens
ctctgccctctcatttataacatgggatcaaaaatatatatatcattctacctcctcatagggttgatgcagactaaaatgagataatatctgagaaagtgctataaaaacagctgttatcaaaaaaccatttaagtgctttatatatgtcaaactatcctaggaaactattcgaataattttttttctcagtaaaaattatactattgcagattatgttgggggccgaggatcttaaggtacagtagtatgcaatcataggtcctgaccagaaggtggcaggagaaagacttagtcagagcttcttgaggattccgtatttataatcctgaacgaaaagttcattttacttatacattacatataattagactcccagataaattcttcctatccttagctgcatgtggctctacacatttatttatccactgaccatgtcaactcatctgtaatatagaaaatggaaaaaaagaaagggagtaaataatacaatgactactactatatagtgaatacctctgcgtgctagaaaccaaattcaggatttctacacaatattccatttaacatcaatacaattccatgaggtaggtattattattcctcattttaaagatgaggaaattgagattcaagcttttgcaagtgaaaataagcagtgccagagttgcagc

SEQ ID NO: 192132 - DNA, 651 bp, Homo sapiens
tcgaaactagaggatcccccatgttacctcctcatggaattgtattgatttaaatggaatattgtgtagaaagtgctataaaaacagctgttatcaaaaaaccatttaagtgctttatatatgtcaaactatcctaggaaactattcgaataattttttttctcagtaaaaattatactattgcagattatgttgggggccgaggatcttaaggtacagtagtatgcaatcataggtcctgaccagaaggtggcaggagaaagacttagtcagagcttcttgaggattccgtatttataatcctgaacgaaaagttcattttacttatacattacatataattagactcccagataaattcttcctatccttagctgcatgtggctctacacatttatttatccactgaccatgtcaactcatctgtaatatagaaaatggaaaaaaagaaagggagtaaataatacaatgactactactatatagtgaatacctctgcgtgctagaaaccaaattcaggatttctacacaatattccatttaacatcaatacaattccatgaggtaggtattattattcctcattttaaagatgaggaaattgagattcaagcttttgcaagtgaaaataagcagtgccagagttgcagc

SEQ ID NO: 192133 - DNA, 350 bp, Homo sapiens
cacacccgcccaatcgatttactaaaggaagagaaagattatctgctgctctaaatatctctaaggtaaaaaccaaaactaacttatcacactcatatgcacatacaaagaatataaacaaatattttgtatgtgtatgcacatacaaagaatataaacatcagacaaaatatgactaagagggagaaaataaattttcctttctacttagagatgactatgcttacagggagattgctgtgtcagtgtgtctgatatggaagaaacattcagtaaatttcaaggtgaggaatatttcctaaaataagcttgctcaaacacctcaggtattgtgcagttcaacagaatcc

SEQ ID NO: 192134 - DNA, 499 bp, Homo sapiens
tcgcacctaccaacaattaaatgaaaataaagacaaagcctgtaaacacattttaaaatgtcttagtcgatactatctacgtgacaaacagtaaccaccctcattctatagcatgtgactttcttgtgtttagaaaggtagaatcaggctccaattccaactttgctgaacagggccttaaagaatgttagacactttcttcctccacccacattaaatatacaccccctaaaactgttgattcaccggattctcagctgccaaagaaagtagactagcttagtgtttgacatttccttttggcagtcattagtccttaatgtgtcactgtctagaggctaaaccgaatagttttattcatttctactttagcagctcattttcgtgggcctaagaaaatgtatcaaaggctaaatccaccctagaagaaagttgccaatctaagattttatgacacaaaaataacaatatgatcaaaacatctctttccacaagcccc

SEQ ID NO: 192135 - DNA, 666 bp, Homo sapiens
ggtcctcacttccatttcccttcctttacccccaggtaactattctatgtttgataaaggtcttccaaaatatatgtaaagtacagggtgttacctatatacatgattttaatttacctaaaggacattgtgctacagatataattctgtttctgctttcaactaacgctgcttttaggaattgttcgtattgttaggtatctgcccacttcattgtttctaattgctgcattcacaaaatttcattatccattctgttttgttgcatctccaggtttcttctaatttcccactgtgtgagaatccagcattcataccaccacacaatacttacttatgtgccttaggatatatgcatgcacaatttcattaagtactgccaggaatattctaaaatatccgaccagtttatattctcaacactggttcagagcagttccagtttccccacctgttccccagtccttggtatccttcagttttctaattcttgctaacctaattggcataaagtagtgtttcattgtccttgttactaacagctttgatcctaactctttacttccacctgtccacgagataggcgactgtggcatcagagactggaaccagggcaaacaccacctgggaatgcctgaaataaaatgtttgattctacaagacagt

SEQ ID NO: 192136 - DNA, 502 bp, Homo sapiens
gatgctcaaatttctccaaattcaccattagagagttcattgactctgcctcactcgttctttggatagtccttagagatttttttttttaggattttttttttaattattatactttaagttctagggtacatgtgcacaacatacaggtttgttacatatgtatacatgtgccatgttggtatgctgcagagacttttaagaaaactgggggccaggcgcggtggctcacgcctgtaatcccagcattttgggaggccaaggtgggcggatcacgtgaggtcaggagtttgagaacagcctggccaacagggtgaaaccctgtctctgctaaaaataccaaaaaaaaaaaaaaaagtatctgggcgtggttgtgagcccttgtagtgccagccgctcaggagtcaggagaatcacttgaacccaggaggcgaaggttgcagtgagctgagatcgtgccactgcactccagcctgggcgacagagtgagactccatctcaa

SEQ ID NO: 192137 - DNA, 330 bp, Homo sapiens
cccgaagactgtgctaaggttaacttggcactggggatccattggactggtggccaagttgttgtctggtccacatgtaaatcccatgatccctgagttagctccctagtggttgcaaagagtttctgcactcatgcagggcatttgtcctttgagaaagtggccattttagcttcaggaagcctgcccggtgcctagtgcctggtgccacatgagtcttgctcaaactgagaagcagttaacctcttataaaaccagccaccctcttagattgctttcaagtgtctcatggcaatacaaatgtacttcaccattgtcttggggtcactg

SEQ ID NO: 192138 - DNA, 423 bp, Homo sapiens
caccactacacccagataatgtctgtatttttagtagagatggggttctgctatgttggctaggctggtctcgaactcctggcctcaagcgatccgtccgtcttggcttcccaaaatgctgagattacaggtgtgagccactgcgcccagcctgcccctgactgtcttcagaaaagtagaagcaggaggtctgccacattctcatcccacccttgacacctgggtgatgtgctagagcttgaggggaaggtcagaggtaacccagttcgggaagtgaccccgtaggaggagaagaatccagccatgtgacacacagtacgaagagaacagtaaatgcaaagacctggaaacaagaggaacagcaaggacagcatgtcccagaacctggggagagaggagggagcagccggagctgagggcagc

SEQ ID NO: 192139 - DNA, 478 bp, Homo sapiens
atgtctgtagccttgcataaatattactaaataccaattccagaaaattgttgagtagttaagtaaaaagctaatttgtctggttatttccctgttatgttaaaataacagtattttacacatttccctttaacaatattattcttattcaaaatgaacaagtgaacaaaatcatattaaattgttatacctgagactcgtatctttatacttaagcctttaaaatatcacttaattataaccccagagtcattttatgtacagatacaagaaaacaggagaccctgcctgtttttttattgttaagtctgattattatgtacagcacaaggtatcactccggtcgacatgattcatctcagatcataacatatgcggtaatgaaacattttccttcccaacatgtgactgtgtcttctctctgccaattcacagtgcaagatttgctaattgagaaaaatgaaatatagcttctgta

SEQ ID NO: 192140 - DNA, 392 bp, Homo sapiens
cttacttttttttttgagatgaagttttgctcttcttgcccaggctggagtgcaatggcactgtctcagctcagtgcaacctctgcctcccgtgtacaagcgattctcctgcctcagcctcctgagtagctgggattacaggcactcgccaccatgcccggctaattttcttgtatttttagtagagacggggtttcaccatgttggccaggctggtcttgaactcctgacctcaggtgatccgcctgcctcggcctcccaaagtgctgggaatacagatgtaagccaccgaacccagcctacctaacatggcaaattttgtttttttaaatattgagtgggaaaaacagatcataaaaccatgtgcctatgtacgctgatgttttggtgaa

SEQ ID NO: 192141 - DNA, 144 bp, Homo sapiens
attcacgaaacttaggcaatgtcaagttgttgacattagcaccacaaaacttgtaaactgaagatccattattctattatttgaggaccccctggaaatgcagaaaagggactgtcgctgatacctagggaatcagtcttatcc

SEQ ID NO: 192142 - DNA, 336 bp, Homo sapiens
gtgtgtggggacgttccgggagtggagagaagtgtaaagagaagctgctatcctgggaccccaaggccttcaccacagggaggtggcaacatctggccagctccccaaccctctccattctccacgtgctctgctgtgttaccggggtgaaagaacccagctgtgttcatgccattagcaggagctgccattaattagcagggagtagggagtacctactatgtgacaagtactttacacgcgttgcttgatccccacaacagtaacgcagggtaggtgtttttgtccccattttacaggtgaggaaactgaggctgttaaccactcccgtaccag

SEQ ID NO: 192143 - DNA, 926 bp, Homo sapiens
  misc_feature (127)..(127): n is a, c, g, or t
tcaaaaaaaaaaaaaagggcgggcgggggagcactttcagtgttgatgaaaccaaatgctcgtaacctgagaccaccgcccaacacctgcagtccagccttcccccagggttgacagcatcagcctntggaccctgcagttgcagttcatttctgcgcagctctaatcgttagaaagttctgccttaccggctgggcgcggtgggttttactcttaaaaacaaacaataaaaaaaccacacactattctgcagtctcttgaatcttctaagattaaaattaaatctgagaaaatttacttcaactttcccacccaccaaaaaaacagaattaactgaagatatcaaagaaaaaacaatattttaaaggtatcactgaagagcactgtcagtacttgtctgatgagataactatggttctgtcataaattcagattacgcgagagaaatagcttttggccagtggatgtgctcttttgagaaagtcaattctgagctgaaatttcatgttggaacagtttcctctataagactcatcttgaaaggttcccgcagaagataaaatgtcatcctcacactgggcctgggcagtgcgcacttaactgggagggggcacaggcacctcagaacttaactggttttccaaactctcaatctcaaaaaaaaaaaaaaaggcgggcggggggagcactttcagtgttgatgaaaccaaatgctcgtaacctgggaccaccgcccaacacctgcagtccagccttcccccagggttgacagcatcagcctctggaccctgcagttgcagttcatttctgcgcagctctaatcgttagaaagttctgccttaccggctgggcgcggtggctcacgctcgtaatcccagcactttggcagatcaaggcgggtgaatcacctgaggtctggagttgga

SEQ ID NO: 192144 - DNA, 367 bp, Homo sapiens
accaaaagctcatatcccaaaaatcattgcaaagactaatgtcaagaaactttctccctatgttttcttctaggcattttacggttttgggtactgcatttgggtctttaagccattttggattaagttttgtacatagtgtgaggtaacggttcagtttcactcttttgcacatggatatgcagtttctccaataccatttatcgaaaagactatcctttccacatttctattcttggaacctgatcaaatgtgattttttttctaaaaaaaaatttgctttctaatttgtcacattgttctatgtgtctgaaaaaaaaaaatgtattctggccagcatgtcataaatacgagagtaataaatgat

SEQ ID NO: 192145 - DNA, 446 bp, Homo sapiens
tgaaagtaaatggatggcaaaaaatatgctacacaaacagtaggcttataaaggctggagctttattaatatcagatgaggtagacttaaagacaaagagtattaccagaaataaaccagggacatttcaaaatgacaaaagggtcaatgcatcaggaggcataacaactgcatgtttatgcctaataacagaatttcataatgcacgatgctgaatctaacagaattaaagggcaaaacaaacacttccataatcatacttggagatataaaagcctttttcttagtaattgacagaaaactaggcaaaaatatcactaagatataaacttgaacactaccaactatgttgatctaattgatatttatacaaaacgacactcaacaactgtagaatacatcttattttcaagtgcagatggcacattcctcaaaatagaacatat

SEQ ID NO: 192146 - DNA, 368 bp, Homo sapiens
cacagtattcctccttctagatttgtctgatttacttgaggtgccatttagtttgtatttcctataaacttgacattatgtctaatggagtcaagttttgcctaaaatatttcataggtgatgttgtgttgtctgcttaatgttgtatcatgttagacctgttagtggactgttactcatattaagatggctctcttaattggagtgaagataacagtttgacccttacattccatttttttcttgccaaggtccctcctggaaccctccatcctccctttcctctctagactgttctctgtgcctgctgcacagttactgttctggaacttttttttttaacatcatcctgggaaatccttttttct

SEQ ID NO: 192147 - DNA, 824 bp, Homo sapiens
ctcaagaggtcaaaaccagcctgggcaacatggagaaacctcgtcttgacaaaaaaaaaaaaaaaaaattcaaaaaaaaaaattagcggggcatggtggcgtgcgcctgtggtcccagctactcgggaggcatcacttgagcctgggaggcagaggttgcagaggtcactgcactccaacctgaatggcagtgagaccccatcaaaaacaaaaacacaaaatatgactttctgacatttagctagctatcctgaacctctttataaaagaaactgacatctgtaagggcatctcccttcctgcactcaagccactataaacttttacaatgaaaaaaacattggcttaaagtttacagagcaaaccttccctttgcttgatgcttttcctggcaattcctgactatccctttttgattcaacaaataatagtgtttagatctaagttctctgcctttgggatgtaagttttcacctgagagtcatgtctttggaagtgaaaatttagggttgtctagcaatctgaattgtttaggggagtggaacagataattaagagactgatagtctaaaggagggggggaattattttcactagcaaatgaaaaatcttataaaactgtaagatctgcttctgttagtgcatctgcatgtctttacttttatgtatcatatatatgtgatatttcactaccaaaatatatgaaacacctctaattaaccagcttaaagaaaacacaagtgcttaaatcaaatatttcatcagacaaatagaaactcaaatgtcttttagttcatgacttgggtagatctttggtaaataaa

SEQ ID NO: 192148 - DNA, 435 bp, Homo sapiens
ccaggcaatatagtgagatcctgtgtctacaaaaaaatttttttaaataagccagatgtagtggcatgtgcccatagtcccagcaattcaggaggctgaagtgggaggatcacttgagccctggaggtcaaggttacagtgagccacaattgcaccactgcactctaacctgggtgacacagcaagaccccgtctcaaaaaaataaaatagagttaacttcaaattctgtacaatctcctttagaaaaaaaaaggaaaattttctggtttgtaggtttaccctgataccaaaaccagacaaagacagtacaaaatccctgtagacagatagtcctcatgaatataaatacaaaaatcatgattagtgggacaaacatggtagcccatgcctgcaatcccagcactttgggaggccgatgtgggagaatcacttga

SEQ ID NO: 192149 - DNA, 419 bp, Homo sapiens
ctgtctacatttccccagtctgccatcatcatcacactcaatgaataaaaccaaggctgagttaaataaaactaagttaaatttgttatttaattatttgtgttagtagttttctcaaagtcactcggatgaatcatctgtaaggtagggataatgcattactcaacttccaggatcattgggatactttatgaaatgctaaagagctgtgtggcgtccctggcacaaaaaaaaacctcaattaatataagtttctaccatttccccagtcttgccatcatcatcactactcaatgaataaaaccaaggtgagttaaataaaactaagttaaatttgttattttttatttgtgttagtagttttctcaaagtcacatggatgaccaatggcagtgccaaaacaggaatggaatgccttt

SEQ ID NO: 192150 - DNA, 192 bp, Homo sapiens
tatagtcctttcctgtgataggcactgttaatttgtcatgttttatgaatgcttagacatttgaaatttgattacagttgttgatagatcagttgagttatggtagctctgctctttggaataatatggagaagttaattttccattcgatataaccgacctcaaatataaagtgctagtatgttttatatt

SEQ ID NO: 192151 - DNA, 451 bp, Homo sapiens
catttctcacttttactactgcaggcatctcctcaccaggcgccttagttccacagctcactatgcactctcttgcatatgatctacaatattgacacctgggatttctctaacctttattttgattgcggcctttagccctcagagagcttcatggtaacttgctgcattagtgaacttgctaggaaggaaggcatcccctgcttccgatcctttctcatttctttaattctctacttattcatcccctgcttctgcttctgatccttcctcagttctgctttttttttttttttttttttttgggacacaaaactttgtggctggtgttgccccggggggaagggcaggggttgtttttgtggcccctgggaagggcccccccccggggttcaacctttttgtgggccccagttccccaagagtatggtgaaaaaagactccgggggac

SEQ ID NO: 192152 - DNA, 370 bp, Homo sapiens
caaacacaacgcagaagaaaggaaataatgaagagcagaaattaataaaactgaacatgagaaaatcaatgaaacgaaagaactacttctttgtgtgttgttgttgttgctaacaagagcaagtctttgaatttcccaaatgtatttgtggatttgtctattgttgaatagagcattctataaatatcaattagatcctgttgattgatgctgttattcagttctttgatattctcacatattttatcctggtagttctatcaatttggtgagactgacgtttttaattctccaactatatttgtggacttgtctatttcacctttcagctctatcagtttttgctttcatgtacttgaatctctgttgt

SEQ ID NO: 192153 - DNA, 214 bp, Homo sapiens
agacgaaccagctcttacccgtcctacatagtgatgggccaagggttttacctgctgaccttttctctggaaaatttccctttaacagcttctcccaagaaggcttaagtctagtcttggcatttgttatttaccatttcagggggaacagtcttaagcttttaaaggaacattatgctgggcagcgtggtggttcacacctataatcccagca

SEQ ID NO: 192154 - DNA, 664 bp, Homo sapiens
ggaacaaaaaaatggaatccaagcagtaacaaattaatctaactcaattacaaatgaataaaataaccacattgaaggaggtgaaaggaaaaagcaatcttggaaaacagtattttgactgggacaccataaagctaaagacaaaaagagccgtacacaaaatctatattcttggactttaagagtcagcaaaccatgtccataaagggtcagacagtaaagcttttcagctttggaggccatatggtctctctcgcaaccatgcgtgatatataaacaaataggcggggctgtgttccaataaaactttatttacaaaaacatcaagcgggccagattgaacccatgggctacagttcactggcatgtgttctagttaataaagctgcttctcagagggatttgggttagcaaatttgaaactactttgatgttatactagagttgagcaaatgagtaaatgtattacagacagcggagtatggatttctcactgctggagaaaggagttaacaattaaggaaaagaagaaggttagaatgaatgctatggtgttaaactggaaatggaattcatcaataggaactcatttttaactgcatatgcagagagatccatatatagagattccattgggggattccatttgggatgattccacatg

SEQ ID NO: 192155 - DNA, 108 bp, Homo sapiens
aaatctctcccttttccatcccactaaatgccagtaatcccactgtaatcccaccataccatctaaaatgtatgcttcaaggcccagggttaaggcccaactacatga

SEQ ID NO: 192156 - DNA, 424 bp, Homo sapiens
tggcacccaaatgagtgcccagaaatcactctgaatggtcaaaagtaaggcagggcagggcggtagagcacagggtgtcgaattaatttcatgtgggggctgaaatcccaggtctgtcccttcctaactgtgggctgctgctggcaaggtgctggccttgctagcctcagagtcctcatgtttaaacctcagcagtttgttgtgagtgttctaggttacagtggattccaaactagccacaagtgaagcacatggctaaatggtagtcattggtattgttatcaaaagcaagttgcttagctgggtgaagtggctcatgcctataatcccagcactttgggagcctgagacaggtggattgcttgaagccaggagttcaaggccagcctgggcaataaagtgagaacctgcctctatagacaaa

SEQ ID NO: 192157 - DNA, 491 bp, Homo sapiens
taagaaaagctcctaccagaacaagctcctttcctaaattcactgggtgccccaggcactgtgaagactggggccttgcccttgaggagtttataatacactagcaattataaaaatacaagagtatatgtcaggtatacagcaacagaagtaaggaccacagaggtactaacgtgagcctgggtacaggaaggctccacgagggcctatctatataagctaaaatgtttgctatttatcacatatagaacaggaggtgagggtagcactgaacattttcagctgggataacagcttcacagcaaagtgctgagaaaggcaatctgctataggattcaggatggtttggcaggggaagaggctggtggcaccccacaaaggagtggggtatgcatgcatcatccagagtcctaagaactgacagaggaaaacagatgcccatctatgtgagaatcaggtaaattagccccttctcggcacctccctccccc

SEQ ID NO: 192158 - DNA, 564 bp, Homo sapiens
gcaacccgctttgtgcaggttctctgattctaactgtgagtctggaggcttaccacaaggtcctagtcctatcacaatgtaaagttatagtattaaaagtaatttattgaacatcggttaactgagaaacttgacatgttttctagccaacaccgagtactttgaatcaatgaaatattcttaaacccccatcaggctcaatcctaaacatatttgaactacacatccaaaagtgatattttgaaagccagagggacatacaggatttactctgcagaagaaaaatggttccaattatttctatgaactgttgtattgttaacctaagtggcagagttcatcatctttgggacaggggtctgctctggctataaaggcttcctcacaagctctgtcacaatatcatagaacacactgcaaaataagatatggaaataacctatgattattttatgaactttcaggggtatgaaaaataaatgagttctagaatagctttactgaatttcttataatgtatcaagtgacacaagagacactgtgtatttcagaatcagaataaag

SEQ ID NO: 192159 - DNA, 533 bp, Homo sapiens
taaaatcctcggcacagtgtgtggcagctcagcttctaaagcacacagcagctgttgcctggctcgcatcttagaagcttctaagcctgttctctactttgcttcttttgtaccatagccatcttttggagttcttgattttggttcccctcctcatgttgtcacagtactcccaatgaccaacagtctccaatggccattaatatctgaaactcttaactggcaacaagtatgactgctaaactctgcagagctaggaaaccaaatatacttaactctgagactctaggcttcatggtttcctaagtttaaactacaaccaaaaaagtgtgtttgaactaaggactcgaccaactgaataattatattgaaaatatagattcccacctaagaagcaaagaaatagtttttttctaacaaaaatcagtttgttgtctatgtcaactgtcagattgttagaggtatgcttattatccgtatagaaaactactaatttcccatccagttttttttgggttttttttttttttttt

SEQ ID NO: 192160 - DNA, 488 bp, Homo sapiens
tttctggtcctgctgccatcaccttaaagtcaatgcttacaacatctcacctcaactaagagacctgtaacctattggctacagtctgtcccaaacaagaatattccattatgggcttgtatcttgtcagcactccgcctccatatctacaattactggttgcctatgtaataaattccccaaccacagccaggcaaagctagcacattttaatctttccaaaggcagcagctacgatctgcccactcgcaggctctgctgtaatgctttgaatctttttcctggtaaattcctaccctgcagggtctgcgacctcccactctccctcatgggaatgccttctcccacccaatcccatccattctttatagtcgggcatcaccgggccgtggcaagcccccagaatttctccctgtcatcaactccagcccttacttatctgtcccactcaaccggaccttgtaactatatggacacagccctgtgat

SEQ ID NO: 192161 - DNA, 316 bp, Homo sapiens
gagctctgcacctttgcaacccctgcaccggcccaccgccagcacgggcatccctgctcactaaagcgtcgcccgtcactctcccctactgtctgctgtgcctgctctccctctggccctgacattctctctctctctctctctcactctaacagcccactgttggtctcttctcccaattcccaatcctccagcctcactagaatgtctcttttcaggttctgtatgagttgagtaaaaattcttcatgcttggcatcatcttggtctctgaatcttgtttgttcttatcaccacttaaaaattttcaggctctt

SEQ ID NO: 192162 - DNA, 761 bp, Homo sapiens
cctcttcagtccgtggactttcccgctgcacactgccctccgaagtcggggacgcgggctcgtgagatggaagattttcgaggtatagcagaagaatcatttccaagctttctcaccaattcgccattatttggtaacagtgggattttggaaaatgtcactctttcttcaaatcttggcttgcctgttgctgtttctacacttgctagggatagatccagcactgataacagaatatggcaacacagattctcaaaagacatctatgaattacatttctagctacacaaggagactactgaactgtctcttgatatctcatgagtttctggtccatcttaggttaggtgtctgttccaaatacagtcacctgtgactagagttttgggtcattggatctatttagaggtatcctgatatccaggcatcttacttagtagaagggagattttcagttccatccgggtcatctcccggaagccagagtgatgctgaaccaagagagaggttacagcttagcttccaggatgatgattctatctctaggaaaaagagctatgtggaacagtccaacgttgtcaaatgctctcagcaaacagtcagctttacacaatggggaacgcaggacccagaagagagccagcgggaggtacagaattcttgcagggccaagatctcttcaacagggttccaacactgggaccaaagccccagaattcacctattggatttcctttacagcctgggtaataattaggagc

SEQ ID NO: 192163 - DNA, 452 bp, Homo sapiens
cctcttcagtccgtggactttcccgctgcacactgccctccgaagtcggggacgcgggctcgtgagatggaagattttcgaggtatagcagaagaatcatttccaagctttctcaccaattcgccattatttggtaacagtgggattttggaaaatgtcactctttcttcaaatcttggcttgcctgttgctgtttctacacttgctagggatagatccagcactgataacaggtaagatttgtttgagcagatttttttccaggtccataaagcctatagcatgctgatatttatgttctgtttctcagtcaagcttgagctttttgttttatctatgagggggatggccaaatatgtgaaatgaatatagaaaagacagaatttactgtctttttcctcattgctttgccttttcagtgggtaggtttgggcgggtagggatttgagcac

SEQ ID NO: 192164 - DNA, 384 bp, Homo sapiens
ttttgattcattcaggccacatacagcagcaggagtttctgggtggtgcctcaggtctaaattttactgtaatcctacaggttagaaatcaatgagctgatcagaacatatccagtttccaaagatatgagtggcaccatcaatataaattagttctccagtaatgtcaaagggcacacttagcagtgctgtcagaacaaccagaaaaaccacattcaaaagggaacacagcctaaggcacacaactcatgataaatacctgggaaaaaaccagttagctctgcctttagctgttcccaccccaattttcacgattaaaactacaatcgacatactaattagtcggcagacatctctataatgtttatactcctaaaaaacatg

SEQ ID NO: 192165 - DNA, 373 bp, Homo sapiens
gcagcatatatatatttttaagtgaataagtacgaagagatgggaagatgtggtttgactgtaatcccacgtaaaacactctgaccccaatttttaaaaaagtatttcattaaaatgttgtaggagactattactgagaagaagaaagtttctaagttgatgggactcttgtgtctcctagtgtagagttgattttgttttttggggtcaccatggagatgagaagcatggggcttcatggcgtcatctgcccccattgggggagggcttgttggcacaggtcacctctggatcaacctcagcctcatctgctggggatgggagaagctcaagttggccaggggtttaccctatgccctcctcaaccagaatt

SEQ ID NO: 192166 - DNA, 583 bp, Homo sapiens
actagccccgtgtttctgattcagtatcactgaaatactttggaaccatataaagggcaaagtacattccacatgttgaaggacagtgcctggccctgtggggtgtcatccccaagctgtaggcatagtggcaacccaggggttcatctcaactcccatcagagttcaaacattgaattagttgtgcaatggaaggagtattaccaggacccagatgcagcccaaggaaaaaagaaaacaaaaggagacacacacagtaagtggtgtctcattgtgatttggatttgcatttccctagtgattagtgatgggaaacatattttcatgtgttattggtcatttgtttatcttctttggagaaatatttattcaagtcctctgctctcttttttttttttttttttagtcagagtctcgctgtattagtctgctctcacactgctcataaagacatacctgaagctgggtaattcataaaagaaaggtttaattgactcacagttccacattgctagggaggcaaaggaggagcaaagtcacatcttaaatggcagcaggcaagaaagtgtgtgcaggggaactt

SEQ ID NO: 192167 - DNA, 489 bp, Homo sapiens
agatagcatcagataccataggttgaaggctcagtgccacaagatggctcccacttcagatgacaatcagaagccccagatggtgaccaagggtcctaaccaactagctataagttagggttcccataaccccttcttgagctccattagtttgctagagaggctcacagaactcggaaacactatacagtcatgctgtacataatgacatttcaatgtcagcctgcatagacaatggtgatcccataagattataatactgtatttttactgtaccttttctatgtttaggtatgtttagatagacaaatagtcaatccttgaacaacttgggtttgaactgtgtgggtccatttatacatggattttttttcaataaatgtattggaaaattttttggagatttgcaacaatttgaaaaaccagatgaacctcatagactagaaatatcaaaaaaaataaaggtatgtgaagagtacataaaataca

SEQ ID NO: 192168 - DNA, 603 bp, Homo sapiens
ctactgaaacattttctaggttttatgaaaatcagaaacaaccgaaaaattagaaaatgtaaccaaaagtgtgtcttggagaactgagaaatatgcccaaagaaggtgaaagatgttttattggttcttaggaaaccaaaatgcatggagacccaaagaggctggggatagcaagcagactgagtttaggcaaattgtagagcagtatgaagttatctctcagtctgtccttaccacttcctatcccttgtgtttcagctcagcacagtaatgtactttatctaataaatatcagattcagtgaggtttttctgttagagctctaaactatttgtttaagtgcttatgtatttcaaacatctgcttgtgttacatgattgctcacaattttaaaagagggaagcttggctgtggtcttcttaattgaaaaaggaatatagagtaaaaagaaatgatttccatcttgttcaagagtataaaaagaatcctaaagcataaattgtaatacttcaaaatgctataaaaaaataagaatgttgattcttcagtaattcagttcccacaaggtgagtatttctttctatcacagagaaggacaaaaga

SEQ ID NO: 192169 - DNA, 373 bp, Homo sapiens
ggtagagataacagttttacaaaagggaactttacttctgcctcacattactgcttagaaaataagaacttgaatttcttcactactgtccaaccttaaattgttcacagtcttgtattttaaagcatatcctttgaatcatgtgtccaaagagaattacttgtgggtcagagaggtaccttaaaatggctttaaaaacttaaaaccaagattattttcagattgtttacccccttgaatcttaaaactgttcagatatccaattactgagctttctaaattagtgctcccagtttttctaaacttttaactttttttttttttttttttttttttttttttttaataaaaaaggggttacaaggtgtttccc

SEQ ID NO: 192170 - DNA, 905 bp, Homo sapiens
cagctgatggctgcggtcgatcttgaggatccccctgtaactctatgctgtgaccatctattctggtaaccatcaatgtaatttcgccacatacgatcgtcaaacctaaacaaagacaaaacacttcagagaccaattaatttcacagtgaaatgttttaggctcaggtttctcctatttctcttaacactgccctatcagtaatgtaacacactaatcagaatgggcaaggctgtattgatatttcaccaccaagcaatccaagagaaaaaaaagccctgaagctacagtctgactgatggtgaggcaccacaatcttatgaaatacagagagcccagattatcctataacacaattactcccaatatcaccataacccagagaaaacttctaactactgtaccaccagctaaggacatacctttacaccaatgttgtaagagttccttacaaaaggttgaattaggaaaaaagacaatatgaaattctttgcaaaagtttggcaaaacaggatgttagaagggaacatagaaaacctgtccactagaaatgttgagagaagttgcattagtctgttttcacaatgctgataaagacataccagagactgggcaatttacaaaacaaagaggtttaactggatttaacagttccatgcagctggggaagcctcacagtcatggcggacggcaaggaggagcaactcagtcttacgtggatggcagcaggcagagaggagcacttgtgcagggaaaatcccctttttaaaactattagatatctcatgagactcatttgctagcaagagaaaagcacaggaaagatctggcctcatgattcaattatctaccaccagtccctcctacaatatgtggagatgcggtgtttaggagctacaagatga

SEQ ID NO: 192171 - DNA, 178 bp, Homo sapiens
tagccatgacttcccaatggaagaaaaaaagactataaaagcctttgttattggtgcagatagccacagccttggctgttaaagatccctggggtttttgctgacaccaacatcagctgataagcttcacagagactatgaccactgtattctcatcagagccagaacatctgcacga

SEQ ID NO: 192172 - DNA, 568 bp, Homo sapiens
  misc_feature (20)..(20): n is a, c, g, or t
tagctgtcgagaagggtaancgaccgcttgaaaatataggaaagaattgcatttacctaattcaatgaattaaagtattttttttccatgtagatttcaagaatactactttggagctaaaattgctgtttcttctttgtctttgggaaattattatggggaggcattgagcattttggttcacagttaaaattgatgtttatctttattagcagaataagcttatagtcaagtttgtgaatttatgcaaagtgcatatgacctgttaggactttgatgacagtcagataaaagatacttgactttcaatatcagttgttgtaatatttatatttacattatattcacaggggaaaataaaattctgggagacttttatatgagctaagttttgttgattttttttcaaaactgtccagatggttcaagaattactttgatgctaatgccagaaaatacatattatattaaagtctgtttcaggttttcctttttcaaatgagtagtcctttatgaagtaaaaaggagtgatatgaattttcttatactcagacttttctaactagaa

SEQ ID NO: 192173 - DNA, 345 bp, Homo sapiens
ggggtgctggaggacgaggtttgaaggaatcagtgcatctttacagtgctagaaggctacaaatcaaggggaaagtctcatggcaggagtagtcgagtgagatccccacaactgttcttagtttctttgtcattatttcaagagtcaaacagcagtgaagggatctaatttgtcttgtttgcgtcctgggccttggctaaaagagaacaggcaggtggcttcagttctaccaaactatgttataaaatgtggtagtaagagctgaatgatgggaccagattttgtgggttcatattctagcactacgacttacagatgcttgtgctcaaacaattcatttaacct

SEQ ID NO: 192174 - DNA, 161 bp, Homo sapiens
gaactgtacctgttactgggcgttggttaagagcgcattctttttggcatggttatctatcatcttgcttgtcctaagcatgtcctcttgttttcccctgcagaggattggggtttctaggtcattctctgtgatgccgtgattctgcaaaccttatagtt

SEQ ID NO: 192175 - DNA, 301 bp, Homo sapiens
aatatacaaacatgctgtaatttctcccatcttaaagaaactccaactactccctacttctctatttcactgcaaaattgtcaggagtctccaagttctctattccttgttactttattcaatcaagctttaatttcattgctccaacaaaattgcatataaaagtcaccagtgtctaggactcctgataagccaaataagaataaggacctaaatagccattagcaactcaggagtcctagacactggtgacttttatatgcaattttgttggagcaatgaaattgaagcttgattgaat

SEQ ID NO: 192176 - DNA, 377 bp, Homo sapiens
tttctataaagagtctccatttagatgattcaaagagtatccatgaagaaatgcacattttatggaatatacagaagtgtgattagtggtgaaggagggtgaattttgtttgttatatgactatgacatgtagagaacttctcattcaaggtgagtgtgcaaaaatattacaaaacatgtggagaattaactattagagagataatgaaataattatacaaagaaacctcctagagatgaattcaccacagcaaatatgagaaatattatagcaaactaaattttccttttaagtgagtacacttagaattctcaactggctttttaagaagaaaacatccagggccaggcatggtggctcacgcctgtaatcccag

SEQ ID NO: 192177 - DNA, 410 bp, Homo sapiens
caaagttcccagaacagatgtttgtgttttgtgtcctctttcatactctcatttattcttccaccctgaagctacctccgaaatgctaccaatcacctctcaattgccagctgagtattttgttctatttctgctgtcactaatgctctctggcatttgatctttcaactctcttttccaagacttcactatggtggctggccttcttctgatctaactactccatgtgggcccctctttctctgctgactcttgagagtggtcctgcccttgccctttgatctctcacttgacatgctctgccatggacttttcttccttttggccagagttgcttcagtagatctgcagccatgacttttcctctgaactccaacttttccttttccttttcctttcccctttcccct

SEQ ID NO: 192178 - DNA, 654 bp, Homo sapiens
ctgtgccgtattatgacacgtgtgcaacctcaaacacgtgggctcaaacgatcctcccaccttggcctctagagcagctgtctagccaacttatttttaggagccaccatgtccagctaatttttgtatttttagtagagacagggtttcaccatgttgtccaggctggtctcgaactcctgacctctggtgatccacccgcctcggcctcccaaagtgctgggattacaggtgtgagcaggtgtgagcaactgcactcggctggctggcttgtttcacttaacataatgacctccagttccatccatgttgttgcagataacaggatctcattcttttttatggataaatagtactccactgtgtatatgtaccacattttctttatccattcatctgttggtggacactgaagttgcttccaaatcttggctattgtgaacagtgctgcaactaacatgggagtgcagacatctgtttgatatactgatttcctttcttttgggtagatacccagcagtgggattgctggatcatatgatagctctacttttagttttttgaggaacctccaaactgttctccatagtggttgtacgcatatagtacatatagtacataacatatataacatatgtatactacataacgtat

SEQ ID NO: 192179 - DNA, 326 bp, Homo sapiens
cccattgcatagcctccttttccacacattgtattccacattctgccgtaatgaactgtttatcattttcaggtacatagtcactgtttaatccatgtgttggccctcatgggagttcctctgtctgttccttccttcccttcttttctgaataataaatttatattcagccttccagatctacttattttttgaaacctttcctaactaccccaatttctatgccactattccttctatgctactattgtactttatgcatattgttaagaatattgttctgttttttgtttctgtctctccaaatgtgagcaccaaatagacag

SEQ ID NO: 192180 - DNA, 403 bp, Homo sapiens
tgccaataacctcctagagactgcctttggacaaccagtgctttagagaaactgtagattgttcattactgatggctttttttggtttgtttgtttggaggggggttttgggaattgtggtttatgaaataagcaaatctagatgtagatatgaattgatgttgaagtatttggacttcatcctgaagctatagataataactaaaatactttaattaagcagagttgtaatgatccagtttttgttttccaaaggtgattcttgcagcagtgtagggaatggattgaagaaaaacaaggctagggagggggagattagtaaagagactgttttaataatccagatatgaaataatgaggacttctactaatgacaggaggttattggcattgaaagatttga

SEQ ID NO: 192181 - DNA, 437 bp, Homo sapiens
taaatgtcctttccttcggagcctgttactagagactatgttcctttgggagtgtcatgtccttactttttcttgtttcttgtgtccctttgttgatatctgcacatctaatagaatagggatttttttttgtttgttttatggagtagcttttgtaggaagagatctttttcttgtagacgcatctagagtattaattgggtatggtgcgttggctttatttctggtgaactcagtaacatggtccccatgcagtttcttcagctattattctcatcagtgatgtctgtgattgcttcagtgacctaggctgtgggagttttgatggtattggcacaggtttgctgggagcaggggcactggtctggttgtcaggctgggtacatgcagtcacagagggctgacaggctatctggtgggctttctggagaggcaga

SEQ ID NO: 192182 - DNA, 364 bp, Homo sapiens
aggggttcttgaaattccggaagatgggaaaagataaagatgtgaatcagaagctggggttaaagagggtttcttaaaaaggtctcccatagctcttgcgtagagccctcaatagtagggaggtgagcccagaaagctgctcccactccatccacaccatttcggccacatttaccaatggccaccaaggacaaaagaaacaactggaggcagaggaggccatttgtgactctaaattccgctgcaagacatctgcctcacactgactgggagctaatcctaaggaaactatcttctactgcctggacacaactgaagccagggacaaaggattcttcacaaccaagaaaagctggttctgaca

SEQ ID NO: 192183 - DNA, 269 bp, Homo sapiens
ctgcagtaagagttagtataaaaatacacccaaaaggtttaacaaatccatcgtcttttgtttctctagaagtttccatgttaaaagatgtaacattaacaggaagattcattaaacggaaaagacaagaagataactgaaattgtatgagagggaactgtttccttcccaaacagaactgctttggggaagaaaaagtttggtgatggtagtagtagtagcagtattagcaggagtgggagttattgttatttaaaattggaggcaga

SEQ ID NO: 192184 - DNA, 451 bp, Homo sapiens
tcccattcacaccgtccacctaacaccccaggctgagagttgcagcttgcctacgtctttacatcccttgtggcctcagagggttgcttcttgcttgtctgatattatagaccagctccaacctgggcaaaccaacttctctgccatccagtgggctgcaactgtatttttccaacgaggtctgaaccctagcctgaagacaggctccctcttccaagtttgtcattccttgggtactcttccttggccccaggctatcataaaattttcttatatctcatattctttttcttttttttttttttttttgacagtcttactctatcgcccagctacagtgcagtggtgtgattggctcactgtagccatgacctcccagggctcaggtgactctcccacctcagcctcctgagtagctgggactacaagtgtgcaccaccatgcccagctg

SEQ ID NO: 192185 - DNA, 211 bp, Homo sapiens
tgttctgggggaataattatgttccctgtcttgggagcctttcttcagggagcttgatggttccaacccacccaggagcctgggacatctgtgcccctgggcaatcccctgcagtttcctgattccaagatgagggggtagaatccgaagattctccaaggccttgatgagtgctaccagtctgcaaattcccaagccaagttcttcaatg

SEQ ID NO: 192186 - DNA, 342 bp, Homo sapiens
tgcagttcttattttatagcttggccttctccccttcaacccccgaaagactgaaaacccactatctaatgcctaattagaattagccttcaggttacatagtttttgtgactgtttcccttggttatctgccattccttcatttcacagtaatggtagatttataacagtcctcataactgattaaatgtctcaattcttttgctttatgtggcgttcttgggcacttaattatactacattaaatggtgtcttgttgctgtcagtgcagttggattgcagtatagatagcatctttggatattttttaatatgttcctatcatacactttaagcttgtaa

SEQ ID NO: 192187 - DNA, 431 bp, Homo sapiens
acctagaacaatgtttggtatataattggtgctcaacaaatatttgttacaatatttcttttaaaagtattcagggatcttatttcaacatttctatttaccccaaagccatgacctgtagaagacatatgaaaaaactatgcctgaaggtagaaggtgtagtatgagtattggaagagaaggaacctatactattccatttctcgttagtatcagtggtaggaaacctaaaaattgatacatgcacattacaagaagtttgtggctgatgggggcagtagcaatgaaaagaaaaactagatcaatccctgaaatggcaaaagagaaagatctggtcactgtgctgacatgaaaccaaatatatatctcaaacccagaggtgtttacaccaaaaagaggccctaagaaaactctggtcctcaaaccttcga

SEQ ID NO: 192188 - DNA, 248 bp, Homo sapiens
aaactgacgaaaggatgaacagaataaacaaggaggaaaagacacatttttaaatatgtaatttagaaactgtcaaaaaaagtgggacatgtcttatttaactggtgtatgagaagaatggatggttttacaggcacataaatgcaggtacagaaaggtaataggagctttgtattacaatggaacttaaactcctctgggcagtgatcagctaagatggaacagagacagttacaatgcaatgatta

SEQ ID NO: 192189 - DNA, 1321 bp, Homo sapiens
ataattttctttaatactaacaattattctaagagaattcaaagaaaaccctttcatttcagaattttccagtgaagactttcacttacatttttactttttttcctcttctgattttatatctgtggtatcctgtaactgaaggaactctgaaggaactttttggtaggccacattgagaaatccaccaaaattctgataataaaagcaaagcggcaagagtttggtactttacacacctctggaccacttacaaagtattttcttcactgttgcagtttaattagcttcagcatttctcttcatagcagaaaagtccacataagtatccatgttgcctccttaattttagagaactagtcattttctcttttctttaggttgactttgaacaatgaatttattgtaaatgtacagttcacggagagcacagtggcacataatacagggcccagagtcagttctgactttgttttaactaagtcttataaatttaatatccactctttatatttgtccatctttatatcctatagttttataaatgttgatcttctcccagcatatttcctgaccttttcttccctttcctttccctgtaatatataaaacttttttttctgcattcaaacacatttcttgacttttatatattagataattaaaagcttcagcaattcactaagactctttgtcaggtaagagatgtaggactataaccctaacaaaaaaatgtgtaggactgacaaaacaagaaaagtataaactttattcataaatattaatatgagagaagatttgagtgaatgtaaaggcatattgtgttcctgcatgaacagttcttcccagattattacaaatttaatgtaatttcatcaaaataaccatgggatttgaggattgagaatggagatagaacttaaatgattctaaattctacataaaagtgcaataatagctaagaaaatattgaaaggaaagagacttgagacttaatagtacagatgtctgaacactttatagcagtacaataattaaaacatacatgtgcaagaatcagccatcagatcagtttaagagaaacagattgataaagaagcatcacaaactgatgagggagagattaaatcatttaataaatgaggctgggaaatgacttaaattaggtcttcgtcttcaccgtacaccataagataccaagtatgttctgcctgtatttaagagttgagtagggctgtgtgtggtggctctcgcctgtaatcccagcactttgggaggttgaggcaagaggattgtggcaggaggattgcttgagccccag

SEQ ID NO: 192190 - DNA, 329 bp, Homo sapiens
aacaagatgtgattctgccttcagaaggccacgattcagagggaagcagacaagctagatagaccagaaaatactgagagctaagtctgtgattggaaggacagggctggaggagggcaggtccaaggtccaaggctggtctgggaagtgagaagctgagacctggagaccaggaagaggggggatcttctagcagcgagaacagcaacgaaggggcccagccaaaggccgggtccacagtgggccctgacctgtggcatgagtgaatcaatgaacctaaggatgcagacaacattgctagtttgaagggccctgaagtccagaattgc

SEQ ID NO: 192191 - DNA, 302 bp, Homo sapiens
aacaagatgtgattctgccttcagaaggccacgattcagagggaagcagacaagctagatagaccagaaaatactgagagctaagtctgtgattggaaggacagggctggaggagggcaggtccaaggtccaaggctggtctgggaagtgagaagctgagacctggagaccaggaagagaaggattctggaagtatctctcaggcaaatgaaaaatgaatgaatgtgtgaattccaagtttctctcccacttcctccaacacaacaccccaatacagttttttgcctatggaccccttcccc

SEQ ID NO: 192192 - DNA, 628 bp, Homo sapiens
ttcctctcaaatggaatcactgatgcagggaaaggagactaatgagaaaattggggcaagaataagatcagagcagctccagtttctgaggtgacgaactggataacgtcattacactaatcttacctgttaccaaaaattgaggttgaggaactcttcaggattgaggactgagagactcttgctgactgctcccatggttgcttgatgctggacacctctccctggcccgatggctttgggccaccactggcttcacaggagtcccggtggaaggaccagagtgtggctggagctccctgggcagagctgctagactgatgttgaccttactccatgaagcgcctattgttttccctccttccagatgaggaaactaagtcttcatgaggttcggcactcccaaccttgatatgaactctgtgtccaggtccaggtccgtttgattccaaagcacagctctttcccatggaaagtgttatagtctatccgggtaggtaatcctaacgtgtaaaatgcttttagaaaaatgtgactatggttattatgaaattgggattacaggcgtgagccatgtctatattttatttcaaccttagtggatatataagaagattccatttggggg

SEQ ID NO: 192193 - DNA, 125 bp, Homo sapiens
tatttccttctcataattaacctgaacgtgattgagcctggggcaagatggaaaagtgtgtggttagcacctgtaggcaactagagttcaaaacaaacaaacaaacaaacaaacaaaacaggctt

SEQ ID NO: 192194 - DNA, 372 bp, Homo sapiens
tgactcagtgacatagttccgaaggccaccagataaggactaggagacattgtcttactgtaagtgatttgtgtttttattattgctgactttactgttctctgagtcttttgattccttcaaattgctaagaaatctagtattcaaatgtatgttgtgaacacaaaaagattgagaactactgatcttgtgttttagaaaataaactagaagttgacaggttgttctcctgactccttcagtaattctctatacaatttgagtgagtcatttaacctctgtccacttgacaggtgagggtgtggtacttaccgctatgttccttccagaatttaagtaggaaaaattggtaaagtgctctaacttcatttg

SEQ ID NO: 192195 - DNA, 155 bp, Homo sapiens
tcctaattagtttcccctctccagttctacacaccacatcaaactaaccttatttaaaaaaaataaaaaaatttaaaaaataacagatctgagtaggtcacttctctgttgaaaaacttttggtggttttccactctctataaaattaagtctaa

SEQ ID NO: 192196 - DNA, 236 bp, Homo sapiens
aatgtgccctcagcccctcctgctgtgcgtctctggaagcagaggtggcttctatgcatgtataaatgaacacagacacaagtcatcacacctctcctcacccagctccacattccctgtgaccagaccagagtaggccctttgctgcacccgcagcctgctccttctgtcattcaggtctcagttcaagtgtcacctcttccaggactgtcctgtctcactggctacccagcatg

SEQ ID NO: 192197 - DNA, 439 bp, Homo sapiens
cccaatggctgtgtttctggagcgacccaaggcacaggatacaaacctgtccatgccacaattattgcatctactaggacgcactgattaaaattctgttttcccctgagaagacatttatttctcaataaattcaggaaaccatttgacaacatccagtactctttaatgataagaacactcaacacgctggaaagagaagggaacttcctcaacctcataaaggatatttatataaaagccacagcaaatgtcatacttaatggtgactgactgcttttgctctaagactaggaacaagagaaggatgtctactttcactgcttctattcaacattgtactgaaggttctaactagaggaatcagggaagaaaaaaaatcataagtcatctagataaaaggaagaagtaaacccatttgtatttgcagatgacatga

SEQ ID NO: 192198 - DNA, 269 bp, Homo sapiens
ccacacctggctaatttttatatttttagatggccaggagctctcttgacctcaggagatccgcccgtcttcgccccccaaagtgttgggattacaggcatgagttgccacacccagtccctaacatgattattttggattccaagacactgcactgtattgtttcattcctttaaaacctgtagaggtttactttatggtccagtatatagtcagtttttataaatatttcctctgtgtttgaaaatgttctgtattgatacaaaaat

SEQ ID NO: 192199 - DNA, 452 bp, Homo sapiens
attttaaactctacataaagatattgctgtggtttgaatgtgtttgacccctccaaaattcatgtgttgaaacttaatccccatagtggtggtattaagagatagggactttggggaagggattaagtcatgagggttccttcaaaatgggttagtgctttataaaaggactagagggaactagtttaggtccccttgcccttctactttcctccctgtgaggacacagcaacaaggcgtcatcttggaagcagagagcagtcctcaccagacactaatgccagtgccttgatcttggactttccagcctccagaaccataagaaatacattaggccaggcgtggtggctcacgcctgtaatcccagcactttgggaggccaaggtggacggatcacaaggtcaggagatcgagaccatcctggctaacatggtgaaaccccatctctacta

SEQ ID NO: 192200 - DNA, 308 bp, Homo sapiens
agtatggaatttcagtaatggaagatgaaaaagttctagagatctgttgtacaataatgtacatatacttaatagtagtgtacattaaaaaatttgtgaagaggatagatttcatgttatgtattttttttaaccataattttaaaaaatggagagcaggagagaaaagtcaaggctggaggaattatggtcccattacttcccattaaccaaccctgaccaagttatttaacctttcttagcctgtttccacaacataaaatgaattaatcaaaatatccacctgatagagtgttccacccgacaga

SEQ ID NO: 192201 - DNA, 3066 bp, Homo sapiens
aagcatgagccactgcgcccggccagctttttcttttttgatgatacaagtgctaaatgagttagttaccttagttttctctaaagtccccttctgaaggaagccgcctcacctatggtcattgcagaaagagagatctggcctattactatgtgacccttcccagctacaatgattaactggaccagcagcagaatctttatccaaatgaaaaaaaaatgctgacttctggccttggagatagcttttctcaaccatgatgagctgggtcacttcacatccttgctccagattctaaaccaggtaattctaagtactggctggcagtgagagaggaagctgaaaggatacaaagaggcttaaagcagaaggaggcacacaagagccaacattcagaaaagcagaaaacatgagtaagaatgaggtggagagaactgatcaaatggtaagttgtcccttgatagagtaaaagcagagtatagaaacacagagagaaacagctggagagttgcttaagttacattgagatgaaagttcacttggctgctgttgagataaaataatacagtccccagttctggtttgtttccagaacggcttccagttccaaacagaatcaaactgggctgtgccataattccttacttacctgttcctttgcctccttgtgtgttcaaaatataaacaacaacaacaacaaaacaaatataggcaaatgatttcaggtatagctgcagtgaatagtgaacaaaatgctgatctgcactttataaaaagaagaaattgggagaaggaaaatgtcctggatgacaattctaaaaaacattacttattaaatgtaccaaaatgtttaaactgaaatgtttaagacggatcttctgatcttatattgtcctccgttctactccctcctccctccatcctcccaaaatacaagacacctaagaaaacactctttgacacacatagccaatttttgattggacatcccattgagctggttctcagaagcctaatattactatcatgttcctaactgctgtatttgttaagaatgtattaggttgtgtgcaacaaaactaagtaatgtttaaataaataatttttttaacaaagcaagaaatttagaataatgcagttgcagatattgatagtgtcttaaatatagactttgggagactttcataggcttttcctcactcattcatgtccacatttgaggcaggataaagggaagagggatcctcttgtcttaccagataaagtgaaagtctttccagggtccccaacagtcttccatgtatgctttcattgtcaagaattgtgtcacatggtcatttctgcttattagggaatctcaggaattacttggtaatgactggtgctgggcaccacgttcttctgcaggaaaaggagtttctattagcaagtaatagatgttataatagagatgataatactgatggaatggactctgtgacaatatggcaccaaattataaacaagtcccctaaggccataccttgagataagcaatattaaaacatttgcagctcactgactgccagatgttgactgataactctcccacccctattccacaagccataagtacagctttgatttgacaagagactgatttcagtaactttctgctgatgagagactactgatcatggacttgttctggccagtttacagaggctgcacactgagtgtcttagcctctgctgcttcaccttttgacatattgagcttcaccttttgacatattgggcctaaatacgtttaaatgttaagtctctatgccaaagatgcatgcatgcacgtttgcttaatacacatgcaggtgtccccctttgtcaatattcatatctcctcttataacctgttgaatatatatacctagctaacctgcgtagcataaattcctgtcttacctttcctccaaagtgacttgtttttcgcctctgctggagggtatctatacttccctgcaggctgaaacactttataagaaataaagttctctcgaaatttatgaaccttgagacgaatgagatgcagacaggcagcactggagaatgaacactagtcatggatgcctgggcatagcccagagccagggacttccctgggtgaggttgtcctcatactcaactagccatctgttggtgctacaacagctcaagcctaaatcctgaaatttgcacttttcttttagcttgaaaaaaatttaaagctacagaagaattgcaagaattgtacaataatatgtctatatgtatgtatgtatcattgttatataatatgtattatcatcattgttgaactaattttaaatgttgcagacatcatgaccatgaccttatcctaaatacttcaccatatatctcttaagaacaagtatatattttttacataacttagggcaataatcaaattcagaaaatttaattgatttaatactgttatctaatatacagtcatatttcaattttgtttatccttccaatactgttccctccccaccctcccaccccaattcaggagccaatctaggattatgacatggatttagttgccatgtatcttcagtttcaatttttctttgtcttttcataacattgactttttttaagagaacagctggtggttttatagaattccatcaatttgggtttgtcagattattggcttatgattagattcagttatgaattttggcaaggatattgcagaagttatgataggttcttcttagtgcaacttatcacgatacacatgatgtctgtttgtcccattattggtgatgttaacttccgtaacttgctccattgaaaagtacccccttcctttctgtaattaagtaatctgtggagaagatgctttgaaattgtatacatattttatttcctaagaaactttcatctattgataattatttcctgaatcaattattattaaagtttgttgtaaaataatgaatttctaactctattaaaatttctttactcccttccttcttcccctccttcttcgcttgcttccctcccttcctccctg

SEQ ID NO: 192202 - DNA, 232 bp, Homo sapiens
tggtgcctagaagtccaagatcaatgtgttagcagctttggtttcttcataggcctctctccttggttggtagatggctgccttcttgtttcttcacatggtttctttcctgtctatgagaggggccctggtgtctcttttttgtcccaatgtcttcctcttataagaaaaccagccagactggatgagaaacaactccatcagcctcattttaacttaatcatccctttag

SEQ ID NO: 192203 - DNA, 465 bp, Homo sapiens
cttgtccagcgctgggaatgatgaggattcctaaagtctttctattaatactaactttcctaagcattactgccttcaaaacagatgtataaggatattcctataaaagcaggaattttcatatggagttaagagggagcactgttaaaagtctacatgtgaccaccactgccactccatcccctcccttcactcctgccatattctaatgtatttcctagggaggccagtccttgtacaataacggttcagcttttagtggagttaaaactaagcaatattatcttcaagaaacaaacttacaagaacagtaagccttttaaaatcaaagagaggtttcatccattttataccttttggtgatcatgctactactatttggattatgctagacaactctgaaagccacattcattctttaaggtttctaggatactctaaatgtattccttcaatgcagttaag

SEQ ID NO: 192204 - DNA, 418 bp, Homo sapiens
gagatggagttttgctcttattgcccaggctggactaaaatggcgcgatctgggctcactgcaacctctgcctcccaggtccaagcgattctcctgcctcagcctcctgagtagttgggattacaggtgcctgccactatgcccaggtaatttttgtatttttagtagagacggggtttcaccatgttggccaggctggtctcgaacttctgacctcaggtgatctgccggcctcccaaagtactaggattaaaggtgtcagccaatgcacctggctactcttcacttttctgattgtttcctctgttgtacagagcttttttaacttgatgtcatcccatccgtccatcttttctttggttgcctgtgtttgtggtcgacgcggccgcgaatttagtagtagtagaaggcggccgct

SEQ ID NO: 192205 - DNA, 409 bp, Homo sapiens
cagtgtccctcgtcccctcattggtggtagtagttttgattgcccatttgagagtggcatccagtttctcctcttgcgaggcttttaaaacttatttattccgtttttaagaatgttccccggatactttaggcaaattaagatgcaaaaagtaaaacagcactttgggaggctaaggcaggtggatcacctgaggtcaggagttcgagaccagcctggccaacatggtggaaccccatctctactaaaaagacaaaaattagccaggcgtggtggcgggcccctgtaatcccagctactcggggggctaaggcaggagaattacttgaacccaggaggcagaggttgcagtggcccgaggttgtgccactgcactccagcctgggcaacagagtgagactcagtctca

SEQ ID NO: 192206 - DNA, 386 bp, Homo sapiens
tttcatgacctactttttatttaattaaaaagactgttttgtcagttacctttctgtaaataaggctgacattcagccactgtgcaccaatacagctgtatcaattgttggtagccgatattcattctaatttgtgggtcccagctgttcaatatctaggtatctaaagccaacattgagatttatttgaacattgttcaaaataaagaaattgagcacattccccttaatatgaaaaggcttgtaaggactgggatatatcctacttttctgagggataatgttggggtgaggaaaaaaaacctcgccctgtttttgggtgatgtaggagatgagaaaatcacccatgaagagatagtagataaaagaaggtggccttggacgga

SEQ ID NO: 192207 - DNA, 698 bp, Homo sapiens
gtccggtcaggcccagacaggagcctcagggtccagagccttgtgtggcattcagattgtgtgggggagagaggcagaagtatcatgccaagaaatccattcctggaagaggaggaacagttcccaggaaaatggggctgaggcagtaagaccaccagctgggatacagaggagccgcctatagggacagagaaatcctaggcaccccggagtgccagaaaggcggtgggttacttcgtggggcactgagattggctgaagctgtattcccagatcccaaaggtgaacaaaccatgagccccggctctgcagccctgctggcctcgcagagaggcagcttgcattacatggatgcctggactcaggcaagaccagcagaagatcccaaatgctcacttttcccaagtccacacgataaacagtgtgtgcttctgactgtgtcccaagctacttgacacctccactaaacccaaagagttaaacagaattcgtttctgggaagaattccactttgcattctgctacattagttcaaagctcttcttcgaaacaagtttggaaacgacacaaaactccagaaaattcaggagtggcatttggaaaacctgaggctgagggtggagaatggcccacagagatgctgtttgtcttgtctttcttcacacagaggccacccacctaggaagaggcaggagagg

SEQ ID NO: 192208 - DNA, 272 bp, Homo sapiens
gctctagaggatcctatcggcgagatgacgcccatatatttatttatatatttatttattttattttcaggtaattttttaattagaaattccaaattttaaataccacaatatgttatatcacagatgcctctttttttttctttttttttaattttttttttattatactttaagttttacggtacatgtgcacatggtgcaggttagttacatatgtatacatgtgccaggcgggtgcgctgcacccactaactcgtcatctcgcggat

SEQ ID NO: 192209 - DNA, 413 bp, Homo sapiens
gtcggaatcccagacttgctacttgctacttaggtgatgttaaggaggttgtattttctctacggcctttagtgtccttatctgcaaaatgagtctatcctaggtttgttgtgaggctttaatgatagttatataaaatgcctacctagtaaatgtgtgatacttaacagtcaaagcggaagttactattattattttgttaagtgggctttattagaaggaaaaactgtggaaggagaattgttagatcagaaagagaatgtctctagtgtgatcaactaaagattgagagatatgagacaggaaatgtgtgtgtgtgggtgtgggcaggtaggggacagagttgaggagttgggtgccccccttaacgagtggggagaagctggtggggagatagatcccttgcatcagtc

SEQ ID NO: 192210 - DNA, 388 bp, Homo sapiens
acatatactatttcctttttatttttttaaaatttttttgctttttgtctttacaaaataatctcaacataacagtgaagtcaaaggctttccttttcttactctgtatgtatattttccagttggttatttgaggctttgaggtatttataaacacaaaaggctgtatttctgctcccctacctcttcttatgtctgtaatgaagttttgaaatgagtcatgatttttaagtttcttttgcttggtatttattgcctaattaaaagtgtatgagttagaacaggctttttaaattatggagtaaaagaatcttagcatttttgtcccctcctaaatctgtttcttgaatgagatttatcaccatgcctgctgttgtgcaccataacg

SEQ ID NO: 192211 - DNA, 470 bp, Homo sapiens
  misc_feature (332)..(332): n is a, c, g, or t
gggaggcaaaaaaatagcaaagggaacgagatgtaaaacagcagagtgtgtctgccctgggacaggagtgaggagaagagttgcgggggccctcagggatatgtgggaaatcaggattttgaggagtagacttggcttctcaacccaacctcctcgggtgtgatctgcaaacagaccttgtttccctgtggttggacactaagtgtggtgttttttgtttttttttggtcacctcgaggtgacaaaaaaagaggatgaggcaccagaacactacaggcctaaaacatatgctcatcttcctatgaaaggacgtcaaatagagaatttctcanggaatattaagaaaatcatccacccgaaagagaatacatacagtccccaacttatgagggtgggacttcggactttttaactttacaagggatttatgaagtcttaaaggcattttcaacttagaatatttttttttt

SEQ ID NO: 192212 - DNA, 327 bp, Homo sapiens
tcaggagaaagatcagggagtcatctttgactcctgtttttctctccacacctcagagttgacccaagtcctatctgctctttccctaaacaaaaggagaatctgaccagtccccatcactgctcatgccctggtccaggccagaatctatcactcaggttataactggtctccctccctttgcctttgcacccttaggatccattgcaacacagcagattcagcaatcctttctgtgaggtctcttcttcctcagaataaagggcctatgtaaactgatcatcctctcccccagctgcttactcactcctctcccaccacactccc

SEQ ID NO: 192213 - DNA, 598 bp, Homo sapiens
actggtaagcctaactacatatttctagcaggctactcacatggagttcagtttaaatcattcagttttacaattgaaagttttttaacaataagaaagtaagttattccattagactgtgcaactgtttctgcctggaacagaatttctaatgcaaaatgaactgctattgtttttgttcaacctgccatttatgtcaaaatttaaaacaataatgtcaagaaagagctagtaagcaataaagtttaaaattatattgcacagagaaaaattagccattttacaatttacatttaaaatttatttaatgtcattcaaactcttaaaaatgaaaatctacttcaattatcataggcagttaagacaaatacctatttgtttctagtatatgcaatcatatgtcttacaatctaatagcataacgattccctgtacattaaaatgaagtaaaaaatgaaagaggcatataaaaagcacaatattacaattaaaaagggcagccatttaaatgtgtcactaaacaggtaaatactaaacaataaattttttgtcaaaagagtgaaatagtcccatatatatgtcagctgataaatatgaa

SEQ ID NO: 192214 - DNA, 335 bp, Homo sapiens
aaaaggatgtctaagcagctgctgtcatagtgcccatgtacagatggcacttgaaaactgttcattcattgaactaagatttactgagggccattatgtgtcagatactttcctgggtgctgaaaatgtagcaggaataagaatgtaagtgggtagatagagacaatagttagttacataaacaagaaaaaatcagatggataaattaaaatagaatatgacagaatggctgggtcctactttagactgagtggtagaaggtctctgagatggtatctaagctgaggtttgaatgactaaagaaccagctatctaggggatcaaagagaaaaacg

SEQ ID NO: 192215 - DNA, 445 bp, Homo sapiens
tagctgggattacaggtgtcttccaccacaccctgctaatttttgtatctttagtagagacagggtttccccatgttggccaggctggtctcaaattcctgacctcaggtgatccacccaccttggcctcccaaagtgctgagattacaggcatgagccaccatatccagcccaggttagagaattctaaaaccattaattcttcacttaataactggcccaaggagcattttaattttccataccattgtattagattgtaaagctccatgaaaacatgttagaactatattattttctacgtctcaaggcctggcaccagtagccttgtatataatgcaatccaataattgagtgaatgaataaattctctgtgagaagggaccatagagttaatttccgaatgcccaatagtgccaatctcatgattaagttaactctaacg

SEQ ID NO: 192216 - DNA, 283 bp, Homo sapiens
tttgccagaggagcgaaggatgctagaagacgtgtatgaaatcagaataaaatttcagatgaagaagaaagacaatagaagaaaatttccaaaaatatggaatataacattaggctaagactttaaaaattctatgaaaaaaaatcaataatactagtggtcctgaagaatggaagaaaacattttcctttttaccttggggaggataaaatcaaatgtaaactctgtgtcctctaatactgttagaagatcatacatttgaaagctaatacagttctctata

SEQ ID NO: 192217 - DNA, 497 bp, Homo sapiens
cacacctgtaatcccagctacttgggaggctgaggcaggagaatcgcttgaacccaggaggtggaggttgcagtgagccaagattgcaccattgcagtccagcctgggcaacaagaacaaaactgtgtcaaaaaagagtaaaaataaataaataaataaatttaaaataacaattagccaggtgtaggggcacacacctataatcccagctgctcaggaggctgaggcaggagaattgcttgaacccaggaggtggaggttgcagtgagccgagatcccaccactgcacactagccttggtgacagagcgagattccatctcaaaaaaaaaataataatatatcattcatgaacagttgttggccagagattcatttgatggatctgatttttctgaaatagacaatcctgatgattcagaccatcctgctgttagttttgtttagaaataactccaaagacagtttttatattttatgttcaccttgaaaatcaat

SEQ ID NO: 192218 - DNA, 371 bp, Homo sapiens
gtggtcagtcttggaccttggctatggtctgtctgttcagttttcagtcaccattatgctgaataggataaggtccacacttatgcagctcttgggtgagcttaggagttcataaatgactttgtgggtttgctttcctgagctttcacctctccaccatctccctcaaactttctggttcctcaagactcctctttttagttgttcagccagaaagccaacactttagttaccacacattgccatatacttcttcaagtaccccacatcaaggatcaagtggtagtggggaaggggaactaagggagaaaaaggcaatgaggagttttcatacactctttgaacgacagctcctctcttttagagttttg

SEQ ID NO: 192219 - DNA, 276 bp, Homo sapiens
agtgtacctatatattacaggaaccacaagggactattatgtcagaaatggaatgagcaaatgggagagtggtaggaaatgaagtcaggcaagtcacaataggctaacacattacctggaggccatgggaaggattttggctatttctccagatgaaaaggaagccacggcaggattttgtacaaaggaaacatacattccaacttacaagaatatataagttcaaaaggctctatctatcatgttgtgggtagatgatagatgggccaaggtaaa

SEQ ID NO: 192220 - DNA, 310 bp, Homo sapiens
aaaaaggagagtggtattccagaagcaaaccccggaaaatgtttcaagaagagactgatcaacccatttcactggaatgctggagacaaaagcttgactggaaatacagaagtaacgatgaataaatgacacagtaaacttaactgttttctttacaagcaatagggaagcaaaacaaagcaaaatttaaaaaccccttaacagtctagcaccaacagtccagagcagggttcctcacccttgcactgctgacccagggtgtttagcagcattcctggcctccaggagaggcctgcagcaccctcccact

SEQ ID NO: 192221 - DNA, 191 bp, Homo sapiens
ctaagtcggcgcagagagagagagaaagagatctatttgtttgggagaaagtacaggaaaaaaacaagagtctttatctagtaatccagagaactcttggattttgtccaagagcgtcaaggtggtacctcttaagagtctgcaagaaacacagtcctgctgggcttgaggtcccccctaaagcagataca

SEQ ID NO: 192222 - DNA, 387 bp, Homo sapiens
cacacacgcacacataaaccacatacacacacattttgaaattggtagtcactcagtttctcaatcttcctttaaagactaatttattgggctagaatttatgggtgtagttgtcaaaaattcctgcatatacccactcaggaaatattttcccaaatcttctccatctcaactctgtgaggcattggaagaggtgcttttaggatagactgatgactcatatatgatgtctgccctcagggagcacacagtttagtgaggtaaatgtctcatgaatattccacaagatccaccttgataatgctctaaagttactatagagggctgaaggtgggaagatgctttcgtctggtggcaaaggatagtagtgtagggtgacatgggcct

SEQ ID NO: 192223 - DNA, 159 bp, Homo sapiens
tgcccggctccgtggtgcatcctccagcctgctgggtgtctgctattgggacctgcaggatccccaggaacctttagaactggtaaggtcagaactgatgggcctctgaaatcccaaatctaacgccagagtccacatactgttcaatagcaaacactt

SEQ ID NO: 192224 - DNA, 302 bp, Homo sapiens
tcacctgggtcccaagcgtaaggcattgctgtacatggcggctctgagcacaatgctggtgcaggccctaaacagaagctatcatgactattacacaattcagaattagaaaatgtagaattttccacgtatttatcagaatttttcaaaactgaaaaaatatcttaaaagccatctcgttagaattcacatccaaatcttaaattccttgggatacatcctgattaattattgccttcattcatcacattcagtcagcggattgggccccaagaagatgataaactgagcatgcgattcct

SEQ ID NO: 192225 - DNA, 401 bp, Homo sapiens
agtcacagtcaaacacccccacacaacatcctcaaaagtctgaaatcttgtaacagctgagctatagttaaagctgcaaggctcacagaatcatcaaggaagccagaatgagacaatgcagataggaagtcccagcagttaatctcaatccttctttcttcatttcggataagctcagatatacctgatgtgggatatagaaagctacactggagcaagctgggtcttctgctgaattcgtcatcaaataccaagggaaaacaaggggtggggtggattttattcttaaaaagcctcagaagttactgtattataaagggacatgactgaataggtaagaaacggattcttcattgtgaattttcctgatggcttctgcaaggctcatagagatgttgatc

SEQ ID NO: 192226 - DNA, 487 bp, Homo sapiens
gagttactgatagcaatggaagggtgtgtgtggtggtaaccatttgggtgagttgcaggcagcaaccacaagttgaagcaatcatgtaataccttctatttccaacattcacaaacacccccaagatcaaaatgtagacatggggcagtcaaaatgctttcttcctccagggaccatttaaatcagagccttatcccagggtttcctaaagaacactttttttttcccccttgaaaatctctagcccagacatctgtagttggatagttgctttttccctgtatttgtattttgatgataaaatggtaggcccaactataaatggtaggtgtcaaagatccattcatctgaccttagaaatgagtcatggagggttgtatggaaatagagaaattcttcaaatagcagtctttactaggatttattttctgtggaaggtgtacttgctgctctctgctgagaattactgctgtaaagtagcaacatg

SEQ ID NO: 192227 - DNA, 448 bp, Homo sapiens
ctaaaatgaaccctatggagttagattaaatccagatacactgatgtgaattcatcatattcagaatagatagacagatacagaaatatagatgccaagtgtgtgtgttcacacgcacacacaaacacatactccctagctctgtccaccacgaggaaatgaaaacagtcccaaaatagcaacacatatatccatgacgaaatcatggtttgttaaccacatttctcctttaaaaggttttgaaataccatgctcctttaagaagtgactaattcccggggtggggcagattaaagtaaaggatgagcctgggctatcatgttttgccagagaacaaggaagtgctaaaatgatgagaaaatctcaagggggatcctattggtcaaatttgagacaatctgaacatcaaaaaacagatgacaacattgtgaatatcttcattaacagt

SEQ ID NO: 192228 - DNA, 545 bp, Homo sapiens
ccctctctcattttggagcaaacatgcaatatagtattattatttccacttacactttggaaaactgaggcttacaaaaagataacttgcctaaagtcatataaccagtctgcctaacttgaaagttcttggctttttccccttttcccctaaacaaacaaggtagaaccctggggcatgtcaacacttaagacataatcagagaaaaagaagtcaacaaaggagactgaggagtacgaaggtaacaaagtggtgggaggagacagcaagtgaagatttgggaagaggggagatgacagaagatgaggatgagaagtagattagaatcaaattggccatctatgccacgctaaagaatctggacattgtcttgtaggccatgggcctttaaaaataagtcatgattgacagcacagaggacagttttggatagggaacttttaaaaaattattaatttttaaattgatacataattatatgcatagggtatatgtgatattttgatacatgcatatgtgaaaatcaaatagggatatttaggaca

SEQ ID NO: 192229 - DNA, 381 bp, Homo sapiens
gtaaataattgattgctctattcaattcttgcattgctttctctttccctaaaccatttccttctcatttcttccagccttcaactgttcctcactaattagtaaacagttaaatattttggcaaattggcatgtcttagaaaagcaacttgcagcatagggtgggtgaaattgtcagtgaacttcaagaaagctctgggcccactggccctagtgtccctgttgtacaatatctcttaagggagaaaactttttcttggaaaaaaaagttttaatatttcttttgtctgtctttggtaattagttggctttactctttttaacaagccagctttattagctgggtttctaaaactatcctcaaaactttgacgtgtttat

SEQ ID NO: 192230 - DNA, 345 bp, Homo sapiens
atcagccacagtagttggtgagaaaaaaggacagtatttacataatgacagttgtcaatgggctgtggaaaagtcaagatagattccagcagtgattttaagatggaaaatgagaaccatgcacacagtcttcaaggtgcaatcttccaacatagttctggaacacagctggctccttccatccatggggaatgaccacatttgtgtgctgaaataacatttagtactagagataaaactggaataagtgatctaaactttgaaatgttttgaatgacctttggctacaaagtcaaattataatgctttctatttcttaagacaactctttatggaagttctagt

SEQ ID NO: 192231 - DNA, 185 bp, Homo sapiens
aaagcaaaatgttcctaaaatagactctttaaaaataaattcatttctaatatcaaagttggaaattttgggggacatgaagaatataaaaaatggaaaacgtctaatctcatgaatctactatgttagtttatttttaaatgcaggaatcctttacatggcattatgttgaatgaaacatgttc

SEQ ID NO: 192232 - DNA, 341 bp, Homo sapiens
acacagactataccatttcatccccacaactttcctgagaggtggagatcatcattctgattgaaaagtatggaaaggtcaccaaggccacatggctggtgacactggaggatctgcccaacattcacacccataggggtgatcagtatagcatgccctccatatctgagggctccacacccatggattcaaccaactgcagatcaaaaatattcaggaaaaaaaataggatgcttgtgtattaaacatgtatggacttttctccttgtcattattccctaataatacatgataacaactatttacattgtattaggtgttataagtaatctacagatggt

SEQ ID NO: 192233 - DNA, 415 bp, Homo sapiens
tcaactttgcacatacagtgaaaatatgcttcaaaatcaagagtaaaagacattttcaaataaatgacagcttacagaattcatttagaacacattttcctcaagtagatgtatactacaagaaattttaaaggaggttcttcaggatgaagggaactactaccagacggaaactcagatcttcaggaaggagagaataccagaaataatacatgttaaaataaaaggtgtacattctttattcttcttataatttccttaaaagactatctttaaaaactgtatgcttaaaaccaaaaaataaaagacaacaaaagcacagagaatacagaagttgagtaagagaaattaagcagaaaggaagaagggtcaggtatagaatgtgaaatggtacaatactgactatacacagact

SEQ ID NO: 192234 - DNA, 329 bp, Homo sapiens
cagaaacaaacacctttaacaggtatataattgtgttgagtccctttttctttggtgaagggtttattgagtctctttaaaatgattcccctagagaagttgttaatgggttataaaatacggttagatagaaggaataagttgaatatgttcaagagacaaattgtagctaacaatagattatttaatagctagaagggaagaatttgtatgttcacaacacaaaggaaagataatgtttgaggtgatggatatcccagttatcctaacttgatcattccaccttttatacaggtatcagaatatcacatataccacaaaatttctac

SEQ ID NO: 192235 - DNA, 170 bp, Homo sapiens
agcttgttgctctgctcctgggatatgtaccttatacacatgattgaagatgctcaccacaatctccacattccagcctgggaaaaagggagggaggggatagagaagacaggtgccttccttttagggccacaattcttcttgctaagttctcattagccagaccttgg

SEQ ID NO: 192236 - DNA, 363 bp, Homo sapiens
ttgatgtccatttctctggtatgcctccttcactgagctccacttctcacctcctgccctgaatacaaacaggcccaaagctccactcaaagtcctctgatcttttccccacacatcctctctcagaatctacattaaagggctttgcttgcgtttgttgcccaatagctgactgccaaaccaacatctctgtgttaagtctctattttgggttctactttgcagaaagcctgcctgctagacaccaccaggtggacggcccatcactaccccaaatgcatggtgtttctctggtcgtgaatgcgggtcctcctctacatgtcaaacgtggaggtgtgcgagttgtgggcttggccgtggtcg

SEQ ID NO: 192237 - DNA, 124 bp, Homo sapiens
agacataagataaggcatactggagagaaaggtttgaaatgtaaagaatatgtcagatcattttgcatgctttcacacctatctcaacatgaaagaatttatactagagagaattcctacaaat

SEQ ID NO: 192238 - DNA, 272 bp, Homo sapiens
ttcagtacaaaaagactccaccctacccagcttctgccgcgacttttccttgctctgaaaactccagcccacagaacagagctcctctaactaaaatgcctttagtgctccgttttaagcattcactcttttcttattttaaacgtcccactctcacactcagccaaaaggacttattgtaggctttcccagaaaaatttagtagtgtactctctccaacggtggatctagaagctccggatttacaaacatcccaattgtctttcaagtcg

SEQ ID NO: 192239 - DNA, 390 bp, Homo sapiens
ctaggctcgacgacgggaagttattatgtaatttgtctagatataaaagaaatttagaagatggagttacaaatgctggaactcttctttaccctttttgttagcaagaaaaatctacagacagtaataagtagctacatcgttttgtgaaagtgatactattatgggatttttcaattggaaaagctctcctgtacttttatatcaaaatgccgttaagtgattatgtgaccattcccgcagaaatatatagttactatgaatgcaaaataagtcaggaggctaatttgttcatattcaaatttgtcctttgctttctaattctacaaaggcagtttacctttcagtgtcctcaagatgtaaggatttgttttcagcatgtagttctgc

SEQ ID NO: 192240 - DNA, 403 bp, Homo sapiens
taagtgtcgatttctcgctcatgttctaaatgttggacttgctttatcagaaagtagaattgtttttttcttttgataagatgagacttgataagttttggcctaaggattttatgttttcattaaacttgtaactcttcaaatgatgtaacaagtctgatgtatacaatcaaaaatcctgttaggattggagggtcatgttaaatggaaaaatactattcttggagataacttggaaagtatcatggtcaaactcgggaacatgaatattttcctttttttttttttttgagacaatcttgttttgtcacccaggctggagtgcagtggtgcagtcatagttcactgcagcctccaactccagtcctctggcattagcctctagagtagctaacactacagg

SEQ ID NO: 192241 - DNA, 616 bp, Homo sapiens
agagctgttctagagtatccccgttatccagtagaagacacgctgtggtgctctgtcttctgtctgttctgtgtctccctctgagggcagggacacttgtgtgttgtgttgcctgctgtatccccaccactaagcacacagtaggcagtctaaagtccttgctgctagctgattataagttcaagacaaaagagggaggagtctaggattgccacctggagctccaagtgcagatagggaacagccaggggctgcaggtgatacccaggcctggggctcaagcgaggtgtggggtggagggaccacatcgggctcatctacatacggggcggcagcagagaaaaaggctctcaggccgggcacagtggctcacacctgtaatcccagcactttgggaggccaaggtgggtggatcacctgaggtcaggagttcaagaccagcctgactaacatggcgaaaccccatctctactaaaaatacaaaaattagtcgggcatggtggcaggcgcctgtagttccagctactcaggaagctgaggcaggagaattgcttgaacctgggagacaggggttgcagtgagctgagatcttgccactgccctccagcctgggtga

SEQ ID NO: 192242 - DNA, 316 bp, Homo sapiens
ttcggccaaagagagaaggagagcaaaagagacagggtctctagctctgggaactcacaacccagccatgaacagagaaccccaggcaggtcaactggcagtggggattccaatgaagaatggcctcagccgacagagccgacagggctttctgactgaatgcatgtcggggaaggagaatctggtgatagtgctgaggtttctaacctgagtgcctgggagaatggtggtaccattactaagatccggaaaaagcagtcttggggaaatggcagggttgtgagttcccagagctagagaccctgtctcttttgct

SEQ ID NO: 192243 - DNA, 434 bp, Homo sapiens
gcataacctatgccccaaacctattttctaggatgaagtgaggcagtgtgtaatggatggtggatctctggattagaagtcggagctctatactagtagtatcactaactacagtgttggccatgggcaagccatcgctagtctcatgtgcttcagctgtaagatggaggaggttgattgctatggtctcacagaattgctctctttgaagagctaaaagaagaatgaagctcgtgtaaacagacaacccgagacagaaacctcgaagcctgagaggagtgggagaagaaagagagagcgggagagatgtaaacgcctggactaaaaacatgtattggcatatggcaggcaagcatatttaggcttttgaggataacttctgcaaaatttatctcaatctattctctcacgctcttgttatagagtttctatcc

SEQ ID NO: 192244 - DNA, 484 bp, Homo sapiens
cagaggaggttgtggttagcggggctcctcccagaacatggggcccagtcgttctcagttacgtctttcctatagttgggattttgatcacacagttttttagtaaagccaggccatcatctcccacattgggctggcgacatcctttctggccctgcagggtgcagtgtgaacctatagagcagcatgggagcggggctcggggaagttctggagctgcagtgagccagtgagctcgagccagctctgacaggctgatgtgagggaagccgctgggccgcaggtgcttgtttctaggatgtgtgggacctgagttgggctttgaacaaggcagccccagtccttggtgatcaaggaaatctgacctgcctttttcgtcgatgttcacattcaccacgaatttgcaagctgctttcctcaatttctttctgtcctgagtgtgaagagaaagtggagttttctgtgtggcgtgggagctgcaggt

SEQ ID NO: 192245 - DNA, 631 bp, Homo sapiens
tagtgcgagtcaattctccaataaactccccttcatatgtacatctaccctattagttctgtccctctagagaaccctcattaatacaatatggaatgataaacaccaaacatgaaatactgaagacgatatggaacgataaacaccaattacaggatactgattccctctgaaagaaagagaaggaaaaagaagtatgatagaaatgaggtccacagagactgcaaatgaatttgtaatatttatttcttaagctagactatagttacagtggtacttactatcttattcactgtatcttttcatatgtataaaatatttaatcatatacacaaaaatgatagtagagggcatcattttgtaaaattcaaacaaaattacctactgtaatgtttctaggtgtttttgtctagaccctataaggtaggcactgttatttaccccatttcacaggtgagaaaagtgagtcccttgcccaaaattacacacacaataggtggcagagccagtatccaaaccttggtagccttgtttcagagacccaagctttcaattactaaaccaagcaggttgttgggaaataacagaatatacaccaagaggagatcggataaatgcaatttgctcgttc

SEQ ID NO: 192246 - DNA, 340 bp, Homo sapiens
ttcagcatcacactcaggggtatccacggctgcattcagcatcatgctcaagggtatccagggctgcggggagctgcttcagttcatttacctccaagtcacctccctccctagcatgagccacttcttcgagggcaatcttggcttctctcagcacaaggcgccctccttttcctccacagagacttgtctctacctctgcctcttccagcacagtaaaaagagcacatgaactcttgagtagtaacaccctcaaataatatccctacacaaatatgttcacccagtccttgctactggtttatttcttgaatggctactttttttccctccttacttt

SEQ ID NO: 192247 - DNA, 226 bp, Homo sapiens
cttccatgattttttgacttagcacttatcactatgtactatgtattttacttaactgtcttatgttctacctacctcactagcaataagttctatgagggtagagattattgtctgttttattttaccctttatttataacacctaggtctgtgcctgacccgtaataggtactatatcaaatatttggtgaaggatgaacgcagaatacaaaagaaagcctcag

SEQ ID NO: 192248 - DNA, 250 bp, Homo sapiens
tcccaaggcagagggattggcaagtgatgtgaggggagcttggcacattcagggaatgatgagaaggctcatttggatgaatgagtgaggaaggaagcacatggaaggtagcacaaggccagaatacaggatacctcatgaaccagtacaaagaatttgactcttactgagcaagatgggaagccattggagggttttgagccaaaactgtgcagtagtaccgtttacattttgaaaggatcactgtggc

SEQ ID NO: 192249 - DNA, 265 bp, Homo sapiens
taacttcaacacaaaacaggcaaaggcaagcaccagaaatttctcatgtttctgggaccccaacaattttcattatattgctttcttctctgaacctactttaacttgtataataccagttagatttcattttgtgttattactaaaccctttaaaaataagattatgagccttacacatgggaggaaattactaagccaaatttctcatatgttgtacaatgtgtactctgtatatttagatgtctgagtatacaacttaagct

SEQ ID NO: 192250 - DNA, 414 bp, Homo sapiens
tgtctatgccttggccaaaggaaacagaaaacacataagatattcctatatcatacatgatgaggtacagggaagaccggtaaggataaactcgctcttgcttgtcatagttctataaaataatacaacaaaataacttgactaattgagcccataagaaaacaatttctaaaaatattttgtgtgtgtgctagaaatcgtcactagcaccagttagtgttgaagccaaagaacaatgattaattcacttataggatttgggtcagttattatttattattgttattatttatccttagaattgggcaaatattggagttatacaatcatattatttcaaggaaatctccccaaagaaaataataaccttcatcaatatgtaaatccattctacttggcctttgtgaaatctaa

SEQ ID NO: 192251 - DNA, 572 bp, Homo sapiens
agcctccttaccaagcctaattttaagtggggagaatgagcatcattttaaatctgtgtatctcttaaaattctggttatacaattcattttaacaacttaatgaacaggttttaaagttttggttacttggaaatgtaaattcatacaaccactatggagaacagtttggaggttcctcaaaaaactaaaaatagagctaccatatgatccagcaatcccactgctgggtatatacccaaaagaaaggaaaccactatgtcaaagaaatatctgcactcccatgtttgttgtagcactgttcacaaaagccaagatttggaagcaacccaagcgtacatcaacagatgaatggataaagaaaatgtacatatacacaatggagtactattcagtcataaaaaagaaagagatcctgcaacaacatgttgatccacacaacagcatggatgaactggagatcatattaagtgaaataagccaggcacagaaagacaaacatcccatgttctcactcatttgtgggatctaaaaatcaaaacaattgaactcatggacatagacggtagaaga

SEQ ID NO: 192252 - DNA, 469 bp, Homo sapiens
caataaacaaatggctgattgtaatgatgaaaaagatccaaatttctccagtaaagttgggggagaaatgcccagttacaagcagctgaatggaggtcagagagaaccataatcccagataaaaaataagcaggcaaaattttctgtagcacaatccctctctcatttcaagaatctgcccacacgctcctcacacctcctcctctcctgtcactaccaccatgatcttgtggttacacaatttcattcagagtcaaaattagaaattaactaaagaagctatggtatggtattttattctaagatgtcatctcttttcaaatgaatcatcaatttaataacagttttccaagtgttaaaaatgtggggtaaaaatgcattttagaatcaaagaaatgtactaatccctatgaagatggtaatccaattaaagtgtaatttctccatatttgaagacattttcagtgca

SEQ ID NO: 192253 - DNA, 105 bp, Homo sapiens
tgtattagaaatgcaacttatttttgtaaactgattttatagtgaaataaatagtagctaaattctcctatttttactaattctattatttctaattatttatta

SEQ ID NO: 192254 - DNA, 428 bp, Homo sapiens
aaacagctaacttgatacatctaaacacctcatctctataagcttccatgatactcttctctagctttcttaactcactaaattctcttaagctatctagagctcctcagctgtcactacccctttgacttactttatagccctctgtactccctaccgaaataccatacaatcccatgcctttaggtgccacctatatgctgatttatctatctatctatctatctttctttctatctatctatctatctatctatctctctatgtgtgtgtgtgatctatctatcagggtgtgtgtgatctatctataagtgtgtgtgtgtgtgtgtgtggattccttatagttttctgtgtacaagatcatgtaatttgtgaatagatgtagttttacttgttcctttccaaacttttctttttcttgcctaatt

SEQ ID NO: 192255 - DNA, 406 bp, Homo sapiens
atatgaccgagcaattccattcctgggtatattcccaagagaaatggaaacaggtgctcaaacaaaccttgtacacaaatgttcatagcagcattatttatttattttttaactttgcagcattatttataatagtcaaaaaatggggaaaaggcaaatttatatcacctgattaataaacaaaatgtggtacaactgaatattattaagctgtaaaaaggaatgaagtactgataaatcaatgagccttgaaaatattatgctgggcaacagaagccaggcaccaaaagtcatatattatatgatttgatttatatgaaatatccagagtaggcaaatccatagaggtagaaagcagactagtggttgccaggggctgggggaaggaagggatggagaatgacca

SEQ ID NO: 192256 - DNA, 424 bp, Homo sapiens
aggcaggggattctagggtatttgtgaacgacattaaaatgttgggatatcatttctaatttggaaagcgaggaaagtggagtctgatagatggagataaaaatggaggagtcagaacactggaggcacatggtaaagtttaagaacagttgctgtgagggcatttggcaaacaagttggaagagaagcagagtgtggatgtggagttgtgtgattccactgataatttcagaggtggcaatctgtttcctttcattggagaaggagctccttaagaacaaatgatttatatacagctctgttgagctcagctcagccagccctaactactgcctagaagcctggtctctaacattccaggtgtaccctaaccttctcaaacttctagctcgctcattctcgtccaaccaaatcttaatgccta

SEQ ID NO: 192257 - DNA, 794 bp, Homo sapiens
ttcactatgggcaagtttccactttccattcttctttcttttcccttagcctgtattcttaagaacttaaaacctcttcaactctcacctgacctaaaatctaagtgtctcattttcttctgcaatgccgcttgaccccaatacaaactcgaccgtagttccaaatagccggaaaatggcactttcaatttttccatcctacaagatctaaataattcttgtcataaaatgggcaaatggtctgaggtgcctgacatccaggcattcttttacacatcagtcccttcctagtctctgtgcccagtgcaactcattctgaatcttccttctttccctcccgcctgtcccctcagtcccaaccccaagcatcactgagtctttctaatcttccttttctacagacccatctgacctctcccctccttgccaggccaagctaggtcccaattcttcctcagcctcccaagtagctgggattacaggcacgtgccaccatgcccagctaattttttatttttagtagagatggtgttttaccatgttggccaggctggtccctttttttttcatttttaaaatgttgtcttttaaaatgcactagttttttattttgatgaggtccagtttatcttggttttggaatagtatcgaagaaatctttgcctaactcaaactcttgggggaatattttctcatgttttgctctaaaaaaatttattgttttatctcttaaatataagtctgtgatccattttgagttaattttgggtgtcaggtcagggttcatctttttg

SEQ ID NO: 192258 - DNA, 474 bp, Homo sapiens
gctcctttttttctttattttattttatttatttttttgagatagagtttcactctgtggccctggttggaatgcagtggcgtgatctcggcccactccaacttctgcctcccggttcaagtgattctcctgcctcagcctcccaagtagctgggattacaggcacgtgccaccatgcccagctaattttttatttttagtagagatggtgttttaccatgttggccaggctggtccctttttttttcatttttaaaatgttgtcttttaaaatgcactagttttttattttgatgaggtccagtttatcttggttttggaatagtatcgaagaaatctttgcctaactcaaactcttgggggaatattttctcatgttttgctctaaaaaaatttattgttttatctcttaaatataagtctgtgatccattttgagttaattttgggtgtcaggtcagggttcatctttttg

SEQ ID NO: 192259 - DNA, 474 bp, Homo sapiens
agccttcataaaaaccttaaattttggaaagcttctgagttggtgaatacatggaggtgctggaaggaaggcatgcccagagaggacaccccttctcccatttcttgccctgtgtacttcttcatctggctgttgatttgtgtcttttttaataccttttgtaataaactgttatatgtaagtaggcctgttgtggtggctcacacctgtaagcccagtactttgggaggccaagacaggaggataacttgagctcaggtgtttgagatcagcctgggccacgtggagagaccctgtctctacaaaaaattaaaaaagaaaaaactagccaggtgtggtggtccatgcttgtagtcctcactaccctggaggctgaggtgagaggatctcttggggccaggaggtcaaggctgcagtgagctgcgttagtgccactacgctccagcctgagtgacagagcaagaccttgtctca

SEQ ID NO: 192260 - DNA, 358 bp, Homo sapiens
aagataaatgatactctcactgtgcttcagcttcttactctataatagtagttttcacttaggtgagcctcaagcacctggagagctagtaaacatgcaggtacccggaccccacacgcagagctgctgattgagtggacttgtggtgggactggagaatctgcaattctaacaagcacccaagcagtactgctgctggtagaccagtgagcacacttttcgtagcattcatctataatatttagaaagccactttcaactctaattttctataattctgtgatttcatattctgacatctgaggcatctgtgtgagaccaaaggtgagcactgacgattgaacttgcccaaccattt

SEQ ID NO: 192261 - DNA, 473 bp, Homo sapiens
cgtggtttcaccatgttggccaggctgatctcgaactcctgacctcaagtgaccggcccaactcagcctcccaaagtgctgggattacaggcatgagctactgtgcccagctgagcatgtgttcttctatggaaaaacactagtgggagaattagagtcatcctttcattaactgtgtgacctgtctttgcctcagtgttcttatctataaaatatagatgattataatgatgcctgctttctgggaatggtctaaagatcaactgagttagtacatgacagcataaaagcatgatgcaaatgtcaggaggaattatttttgtgataaatttggtacccatcacattggtgatgagagaactgactctcatattcaggaactactggtttttgtgtttctttttctccttgttttcagaaattatgctgcctaattaaaatctccattaactatggatgaatgattagcctct

SEQ ID NO: 192262 - DNA, 220 bp, Homo sapiens
aataccatatgaatattctgagttaaaattccagaggtaacaaagaaagtgttacctttggaggactagggtcatagaagaattctgttctcttgacaggtttccttgtttccttccttagacgtcgctggtggttacagattcatcattctctaaagattcagcattttgtctcgctttcctgacttttggcattaataattgacacaggtttcctaac

SEQ ID NO: 192263 - DNA, 487 bp, Homo sapiens
agaaaaacaccctcaaattaactgaatgctgtatctttttaaagtttgaatatgaacattaggaaggatcaaagtaaaatgaacaaaaatttgtggttacagattgttatatcaatctagcacagagatattttaaaattcttcttacctctttgaaataatagtgcttaattcctaataaacttttgcaactaacaacttactatatagtctaactctttttcttagaattaagacaatacagagttatttcaaacaatataaaatttatggttttaaataaagttaggatgaaacaatttagtaggcattctttcaaatctataagcaaattgcatgtaattataaataaatatttaaaaataaaattattatttgaatttgtttaaaagaatacatttttaccactagtgtgcctgctaactcttctcttttgttattattttatgaaaatgtgaggcagggttcaccagaatgggagctggag

SEQ ID NO: 192264 - DNA, 369 bp, Homo sapiens
gagacagagtctcactctgtcgcccaggctggagtgcagtggctagatcttggctcactgcaagctctgccttccaggttcacgccattctcctgcctcagcctcccaagtagctggaactacaggcggccaccaccacacccagctaagtttttgtatttttagtagagacggggtttcactgtgttagccagaatggtcttgatctcctgacctcgtgatccacctgcctcggcctcccaaagtgctgggattacaggcgtgagccaccgtgcctggccctcatactattttttttgagacagagtacagcagcataaccacaactcactgtaaccttgaactcctggactgttacaatcctcccac

SEQ ID NO: 192265 - DNA, 441 bp, Homo sapiens
tgtccatgaggatgactgcgttgctgtttagaagattgtgttctgcatggggatgatggcattgctgccagtaaaggaccaacactactcagagggcaacttcctgggaagaaggctatgtggagttgatgggttggcagtggggatgcatgctagaaatgtatagggcctggttcaaaagctagttagagtagtgtccccttccccttggtttcagtttcagttacctgtggtcaacagcagcccaaaaatattaaaatgaaaaattccagaaataaacaattagtaagctttaacttgcatgccgttctgcggagcatgatgaaatctcacgccatccagctctgtctgcctgagacataaatcatccctttgtctggtgtttccactctgtctacactacctgcctgttgggttatcagactgaaataacatggtata

SEQ ID NO: 192266 - DNA, 697 bp, Homo sapiens
gtggtggctcatgcctataatcccaacaactttgggagtctgagggcaagaggatcacttggggccatgagttcaagaccagcctgggcaacatagcaagggcttgtcttaaaaaaaaaatagctaggcatggtggcatgcatctgtagtccctgctacttgggaggctgaggtggaaggctctcttgatccctagaattcaaggttacagtgagctgtgatgtgtgatggcacctctgcactccagagcaagaccctgtctcaaaaaacaaaacccaaaataacaacaacaacaaaaaatggaacacactggatctaattagaggctactgtctaaggtacggcatgttcatttctattatcctaactccaaactatttcaatcctgcagacacttgagcttctgatgtctgtactagtcaagaaaaccctgttttttcacaaaggaggaaacatggaatgtaagcaaccttctcaaggtcacgtagctaataacaggcaaaacgtaagcaagagccactgtctggagggttttcctctgcatttaaaagcttctgctaaagatatgccccaaagtattcaatccactagtcctttttccaagtgctcagacaggtcaggcaatatccgttccattttctttcttgaagatcttctcacctcctcccattctcttgtttctggtcagcattctctg

SEQ ID NO: 192267 - DNA, 305 bp, Homo sapiens
gtaatcagaaaatataacagaggcatgtgtacagggtattatgagaccactgagaagggggcacctaacacagcccgcatagagatgttaggttctttgaggatagatatttgatcattcgatttgaacagcaattctgtgtagagatctagagaaaggagttctcctcctcttacttaaacactgagtgactttccaattaaatcttttgtctaaccacctgtatttgaaacagaggattctagaactgagtagatcacttttatgtcacataggattggggatatgtcttattacagactatg

SEQ ID NO: 192268 - DNA, 327 bp, Homo sapiens
tcccatcttatcacccacaccctctactcccctttgccctgctttagcacttaccacctgccgtcaatttttgtttactatctatctgcctccactagaatgtaacatgagtgaggacagggactttgtctttgtttattgcacaatatctccagttcctgcaacagtgcttggcatgtagtagatacgcaaaagaatttgttgaatgaacaggtaaagtttcagggacttcatagtctaggacttcacactaccccactccactccaaaacagctacctcctgaaatgcagatgcaccaaaacaaccacagaaacactcatagata

SEQ ID NO: 192269 - DNA, 321 bp, Homo sapiens
acagccatgttcctcatcccccagagcgcaccacggtcactcagtacagcacgtgtgcgctgcttactgccctgtgcctgctgctgcctgtgctgcaggaaacagcccagagtcgaaggatggtcaccagccacccggaagacagtcctgctctggcacgcaaacacggagcatcgcaaccggccggcctcggctttccaagaactcagactgtcactcccgccttcacattccagaccccaacagcagctgagcccgcacttctgagcgcgtggctgggtagagctccagaaactgagacaatcacagacatggcaggtg

SEQ ID NO: 192270 - DNA, 686 bp, Homo sapiens
ccctatttactgatggaatgaacactaaaaacattttaggtggccaggtatggtggctcatgcctctactcccaataccgggaagctgaggcaggaggatcgctgcagcccagcagttcaagaccagcctgagaaacacagtgaaaccccatgtctacaaaactttttaaacaattagccaggcatggcaatacatgcctgtagtcacagctactagggaggctgaggtgggaggctgacttgagccccagagataagaggctgcagaagctatgctcactgggcagcagaacctgggcaacagagcaagaccccacctcagttttaaaaaaagaaaaaacaaacatgtgaggccacagttctagactacttccccaaggactctggctcaggggttgaagcaccgattttaagactgaactcctatattctctttcccagcatgccagttaaaaacttcaatcaaggccaggtgcagttactcatgcctgtaatcccagcattttgggaagccgaggcggcagatcacctgcggtcaggcgttcgagaccagcctggccaatgtagtgaaaccccatctctactataaatacaaaaattagccggacgtgttggcacgcacctgtaataccagctacttgggaagctgaggcaggagaactgcttgaacccaggaggcggaggtt

SEQ ID NO: 192271 - DNA, 592 bp, Homo sapiens
ccctatttactgatggaatgaacactaaaaacattttaggtggccaggtatggtggctcatgcctctactcccaataccgggaagctgaggcaggaggatcgctgcagcccagcagttcaagaccagcctgagaaacacagtgaaaccccatgtctacaaaactttttaaacaattagccaggcatggcaatacatgcctgtagtcacagctactagggaggctgaggtgggaggctgacttgagccccagagataagaggctgcagaagctatgctcactgggcagcagaacctgggcaacagagcaagaccccacctcagttttaaaaaaagaaaaaacaaacatgtgaggccacagttctagaaatcaaggccaggtgcagttactcatgcctgtaatcccagcattttgggaagccgaggcggcagatcacctgcggtcaggcgttcgagaccagcctggccaatgtagtgaaaccccatctctactataaatacaaaaattagccggacgtgttggcacgcacctgtaataccagctacttgggaagctgaggcaggagaactgcttgaacccaggaggcggaggtt

SEQ ID NO: 192272 - DNA, 192 bp, Homo sapiens
cctggaggagtcaaaaccttgatctgtgtagcccatctctcctcaggcagcctcctggggaggggatatgactgtgggatggaagaatcagccccatggtacttcatgtggactccttccacctctcttcatccttctggtatctgcagtggttggaaagctgactgcgtttctaagacacacatgcaactg

SEQ ID NO: 192273 - DNA, 480 bp, Homo sapiens
ccaaactcatgccacaagtaaggggtagagctgaaagtttaacctaaactctgaccctagggagggcccatgctttaaaaccctatgctttactgcccctgcagcctttttctgaattatgtcagctgacaggtagaggaaccataaactattagaaatgttcagaatgagagattagatttttattgtggacagtctgaaattagtaagcatggtcacttgattcacatatcactctgtttttttacccaccaacttacagctatactcctttgagagaattgtttgccatttggcacaagttaatttcattggttaacagagcaagtgaccaaggacaaatattttattctgttgacttaaacttggttctctagtatctttgtcactttataagctatagaataatttctaggccaggcatggtgcttcatgcctgtaatcccagcactttgataggccgaggcagaaggattgctt

SEQ ID NO: 192274 - DNA, 450 bp, Homo sapiens
cagcctgggggacgactccatctcaaaaaaataaataaatattaactaggtcaaggagggcagataggtttcagctctttggcttcttggaacacaggtttgaggaggatgctgaagccacatcagggcttagaaaagtctgtgattgattgattgtcaatatctacagagggcttggaaacaggaggtagcagcactgaaatatttgctctccttgaactttaccatcagcctaaagcagtccattgtctggaacttaaaagaaactcaccactttccacagttcatttagtttgtacattcaaagtgtgtatatgactctagcacattggttatactggatgataccaatttataacaaatgaaattataacattgaaataataagcatggccctcaaaattctttcctctgtcttgcttttctgttttcctttttaaaaaatatttc

SEQ ID NO: 192275 - DNA, 584 bp, Homo sapiens
tggtcccagccttgtcccacattggcgtgcgttttgccccctcagctctcagctgcccccaaagtcgatgtcaggtctgcttaacaggaagcctgaggtctttctgccatgattatctttcccagtcttctcatacttagatactgaattttagttctagttcctgtttcttttacagtcaaactttccacatatggtacctggtcttttggtactgcatggatctgcctcatggtgctaggtacactcctcatgtgagggttgtttccttttttttgttgttgttgtttttttttttttaaacagtctcactctgtcacccaggctggaatgcagtggtaccatatcggctcactgcaacctccacctcctggtttcaagtgattctcatgccttagcctcctgagtagctgagaagacaggcacacgccaccacacctggctaatttttgtattttgcttcaccatattgcccaggctggtcttgaactccttacctcatgtgacccacctgcctcagccttccaaagtgctgggattacaggtgtgagctaccgcacctggcctcatgtgaaggtttttaa

SEQ ID NO: 192276 - DNA, 577 bp, Homo sapiens
tggcaaatccatgtaaatttcccatcatttctctctgcagcatttttaaaaagacatatagctgaaattttatcaatcctaaaaatattttgtaattatctgcccagatttgcatttgggtagattgtgctgtagaagatatatcttgctttaagatagctgccactgattattttagtctattttaatcaacttattgccttgtaatctttcctttttcattctctaaatttctgaaattccatctttcgtgttccccaggaaagactagtaagatgtgtttttattaacaagacttactatcctcatttcaccatgacataagttgggctttctgttccaatttatcctacttgaatggtggacacttccacctgagtatttgtcattttcacctcaaccccagcacattaaaacaatcccttcttagctctttaaaagaagcttctgtctccagccttttcctagtcagtatcacatcttttgagcccggtatggggattacagtttcagatttcacctcaagtcttcctcttctggttcctgaagctctgccaacctctactttgaaacactg

SEQ ID NO: 192277 - DNA, 469 bp, Homo sapiens
gttcttattcttacacttcaccgtgtactaaagaacggctcatgaatcaactgcatcagtatacctggagtgcttattaaaatgcagattcctgggtcctagctcggacctacagattcctctaggtgagagacccaggaatctatcttttctaaacattctctccaggtgatttttcttttttttttagacaagagtctcacactgtcacctaggctggagtgcagtggcaggatctcggctcaccacaacctccacctcccaggttcaagcgattctcctgcctcagcctcccaagtagctgggattacaggcacttgccaccacacccggggaagctgaggctgcagcaagctgtgattgtgccactgcagtccagcctggatgacagagaccctgtctcaaaaaaaatagtagtaataatcattcctcagacaaaactcttgtgaaatgactcaaaatgaaggat

SEQ ID NO: 192278 - DNA, 209 bp, Homo sapiens
aatccgcttttacatttgctgtgacaaacctgcataaaactagattttatagatataacttctttggaagagataaaaatttaaaagtttgacattgttttcagttattcttttcttcattgttttgattggcccctgttagattgatgtattgtcaatctacttttgatggcatgaatataaaatgacaacataaaaagcacttctag

SEQ ID NO: 192279 - DNA, 391 bp, Homo sapiens
tctgggcgccacccctgatgcacttaatactcacatgtagatgcttctaccagggatacctacagacctgctctccatccacaaaggcagtccaggaaacccagaggaattcacagctcagagaaccaagggtttcaagccatggacaagttacgcaaatgccaactgggatagcaagatggatttgggggtcatggaggtccgggctcaaatttcaacttctgacactcacttattttgtgactctacactagtcacctacccttcaggggcctcagtttcctcatctgtaaaacagagatggtaatatgccttcacaggacagctgaatgatgctgtggctggcggtgtcaccaggtctttgctgggtgaagggtgggtgctccctgct

SEQ ID NO: 192280 - DNA, 363 bp, Homo sapiens
agcagtgctgaaaacctgggaggggtatacctacagataagaacagaacggaatttataaagaatacaaagtaggctggggtcggggaaataacaaaatgcaatacacttgaggaaccagacacccaaaacaagaagaaagtgggatctccaaaaaagatgagttttcttagcaagaaggattaagagaagcatatcctgagcggtcagccagagagcaaaaccatagtaaaacactgtgtagctaaagcctctagtacagctctatgtatgtaggagatgtgacacttggacagtgtgattatgaaaaaaggagactgcctcctgaggaacagtaagcacctgtaccaaaaggtcaagctac

SEQ ID NO: 192281 - DNA, 432 bp, Homo sapiens
cttcttcatatgtttggtagaatttggctatgaatgcaaccagtgggcttttctttattgggaggctttttattgctgattcaatctcattacctgttactgggctgtccaggttttccatttcttcctgattcagtcttggtagcttgcatgtttccatacaagcagaatttatccattttcactaggttttcagatttcttggcatacagttgtttgtaatagcctctaatgatcctttgtatttctgtggcatcagttgtaatgtcctctttttcatttctgattttatttctttaggttttttctctttttttcttggttagtctagctgatggtttctcaattttgtttatcttttcaaagccaactttttatttagctgatttcttgtattgctttttagtctcaattttaaaatttttgccctaa

SEQ ID NO: 192282 - DNA, 654 bp, Homo sapiens
aaaaaaaaaaaaaaaatccaaaacaaacaaaataactcaaaggggcaggaggaaacttttagaggtgatggatatgtgttttaccttgattgtagtgatggtttcatggttatgtgtacatgtacagacccatcagcttgtatacactaaataggtgcagtttttaatataacaattacatcccaataaagctgttgaaataaatgaacaaatagaagtgacatcacattttctagaagtagtacctcttaccaaggaggagctgattgacaggtggttctgaaacagaattcttgattttatcgaatcacaggcatggccatgcgtcccgtagccccctctggtactgcccctcccacgcttctccatcatctactgagatactttatgattgtggctcctggagcacctccattgaaaccacctggctgcatgttccataatatccaagtctcagggttgggaatagcatcttaacaagctcctatgctgacttctgaagcacatcaacatttgagatttattggcctctaaggtaagatccaaaccaaataacatgtgatgtacaagatccttcatgactaggtttttccaccttactaaaaccatctgccactgtctcctgcctgccagtgatctgtgctatgatactga

SEQ ID NO: 192283 - DNA, 278 bp, Homo sapiens
agagtcagactcggttatggtgctcaccacgtatctttgaatggatgtggaatcaacaaatgagagaaaaattcaccttctctacagggagctgacctgttgacatgaaaatgtcctgaaggcctagatgaccctgcttgtgtcatttgagaggagacgaccaaacaaagcctggtgacctatttgtgataggtgacatgggagaggagatggggtctagattgagaggtagattcaggaaagggacagacattaggaggtcataacaccacacaatt

SEQ ID NO: 192284 - DNA, 382 bp, Homo sapiens
aggtgccaaaaaattaggaagattatttaagtgacagatttggaattcaaaataagggctgtgtagctctaaagccattatttttcgccacaccacgctgtttctactttaaacatatatgtaattatttgtgttttctgaactaggctgctctgttttttcagtagttactagttcttcttaagctctattatcttcatggatttaacaaaattaattgaaagttaactgcttcttctaccgttttgttttggattgcttttttatttcgcatagagtatttacaaatgtagaatattctttcaaatggcactaaaaattgagaaatctgaacttgacttaatccaacaatctggtttgtttttttttttttttttttttt

SEQ ID NO: 192285 - DNA, 400 bp, Homo sapiens
gaggggtctccagaggcaaggcaccgctgaggggctggggagtagccaggaggaatccttcaactggtgggctaccctgagggaaccaatagactaccctttccccaactccattccattactctgccctgtctaggcagctgagaaggtttagggaaagctgaggaattggaaacactggatatctgaacctctgagaagtgttgcaaggtgcgggggttggatgggagattgcctctgggttgttggctcctttgccctttctcttctctgtgcccaggggcagtagagatcagctggacctggagggagaaggaagacatcccaaccccagcatagttgcttctaactggaactcttggctgcttgggaaataggggcttgggaagcagtggaagag

SEQ ID NO: 192286 - DNA, 502 bp, Homo sapiens
agagcccctcccatcccaacccatctcactacccagaggtgattacttaagagtacttctttgagtctaatgtaagtatctgttgtagtacttaacaaaaagttgccttatttatataattgtttgtgttaaggactgatctccattcgctggtcatgaattatttccgttctcagcactagaagtttacatttccttgcacccccacccatacacactcctgccacttagcagactcgaacacttgggcggttctggggtaaacaacagcacaagacactccaaaacatatctagactgggttatgatgggatctaggacaagggaacccttctttccttatgtatccaggaccagggcactctttcttaatctctgctgtatttctgaagtcattttagttataacaacccacataagaagccgattgccctagaaaggaatctagaactggggactggtagaattttttttgaatacaaatcaagataaggtctttatt

SEQ ID NO: 192287 - DNA, 213 bp, Homo sapiens
agttgcgacctgtgccatggccgggaacagacagcagccctggcctgggggctccttagtcaggcgcacctcaggcctgccaggagtggatctgcatttgaacagggtcccccagtgagatcctccccagctctctagatccccaacctgtcagcaaagtgacctgaggggcttttcttttcttatcttttttttttgagacgggttctacct

SEQ ID NO: 192288 - DNA, 534 bp, Homo sapiens
ccacatctaaagcaggggctgctaataaagagagctcagaaaaagacccattggtttgacctgtggcctagaaagtgacagaggttgaattcattttttttttgtgtgtgtgtgtccttccttccttccttccttcctgttttcttttgtaaaatattttttcatagatcctttttgggaaagtagtagtctttgtattttgaggatacaatggaaaactttagagatgagagcggccagttgcaggggctcatgcccatatcccagcactttgggagcctgatgtggaaggatgacttgaggccaggatttgagactggcctgggcagcatagcgagatcctgtctctacaaaaaaatttcttaaaaattagctgggcatgttggcacgtgcctgtgagcccagctacccgggaggctggagcgggaggatctctggagcccaggagttagaggctgcagtgagccgtgattgcaccactgcactccagcccgtgtgacagagtaagagtctgatacaaaagaataatacaaa

SEQ ID NO: 192289 - DNA, 115 bp, Homo sapiens
gacaaataatattccactctatggatatacaatatttttgtttatcctgtcaattgaaggacatttggttttatccacccactggccgttatgaataatactgcagtaaacattt

SEQ ID NO: 192290 - DNA, 456 bp, Homo sapiens
aatgcttggatgaaatgaattgaaggtatatgcagaaaatttccagatatctttttggcttatatttccctctgagtattggagtcatacctgattatctacttcacttgggtttcaaaccagactttgggaaatgtgaaaaaaaacaaaaaaatggaaagagcaaaacagaaatcatgctgttccattggactgaatcacctactatctttatcaaaaaacttgtattaataacccaagttttctacagtaagacatcttggtttggtttaatagaagaatcacggaaaaaggaaaatgttttattttagatgggagggcatttatgcttatcctataaaactaagatttgtatggtgctttggagtttgttttgttttatattttctaatgcattcttataatatccttctggagtaaggatcacactccttttatggttaagacgaatgaggc

SEQ ID NO: 192291 - DNA, 272 bp, Homo sapiens
ggcctctgacactaataaccaaatcttcagacccttggtgtctcattctgttgcttagttgggatctctgtatcctccaggcagtcatcttgagtggaacctttcttgaaatgaataaaaatttcttccccaggattgacactgatccaacaataaattcatgaatctgtcctgtgcagctgggtcgatctcataaagcatttattggtcaaagttcagccttaaacagttgtttcttgaattttcaagaggcagataccagtgcccatgat

SEQ ID NO: 192292 - DNA, 227 bp, Homo sapiens
agacgaggttccaccatgttggccaagatggtctcgatctcctgaccttgtgacccacctgcctcagcctcccaaagtgctgggattacaggtgtgagccactgtgcctggcttattatataactcttatgcatactttaaaaaggaaaacataagtgaaataaaagtggctaaaattctttccttctcagagtgttatactcttctcatctcttctcttctcttct

SEQ ID NO: 192293 - DNA, 185 bp, Homo sapiens
ctttctctcttcctctctgtgtctctgtctctctccccttcctttctttgcaatttccttcttttctcaagctcatgatgaaaattgacccttcagttttattttcagatgaaagctcaagcaacaagccagcgcttgcctccattagtggctctgggtagtccttgcaggagaaatcaccatca

SEQ ID NO: 192294 - DNA, 499 bp, Homo sapiens
gcgtattcagtgaattggcccatattttatctccctacaaaatagctatttaaatatccctcaagtatgcactttctgaatcattaaggcttcagggtgcatcaattacactaatttgggaaagtgatcaaattcatgcagggctgttatttttaaagaaaagacattttagtgtattgatgggatattggtgtccagagtatatagatttccagttatctcctgtcatggcaagagtccatcggtttcctttaagagacagagaacacattatgcctggtattaacaaagatcaatttcagtaaaggaagacattcaacacaagggaattgaactgagctgggaataaatgatgatgtaatgtttgaagcaataagggataagtcatgctgggactccaagttcttgtataaatgatgattaaatggaatttttgtccctgctttttgctaggggtgatttttctttactgtaaagtataatgtatctatttcagcct

SEQ ID NO: 192295 - DNA, 657 bp, Homo sapiens
cctgtaatcccagcactttgggaggctgaggcaggagaattgcttgaacccaagaggcgtggttgcagtgagacgagatcgcaccactgcactccagtgtgggtgacagcgagactccgtctccaaaaaaaaatagcctaccatgtgcccagaaagccgagagccagaaatatttggaaaatgaattaatgattactctttattcttttctttgactttctgatttttgtttaactcctagcttttgctagttaattgaattttaccatcattcctcccttacttaatttgagataatatgagtttatttaaatgatactcatagtagttcacattgtttccatgggttagaagttttggcacaagtagaataaggttgctaggattttcctacttaaaatatgaggcatgaaactggtacaaaaagataagcagttaaaagaataattgagtttaaattatttcaaggtgtcatttgtcatagtagaaatagacaatgagctttggagtcaggcaggcctggagtcaaatactacctctgtcgtttgagcgacttgtgatcttagacaaattatgttgcctctctgagccgtaattttaccatttataaatacaagaaagtaggaatatatctattcaaatgtcaagtaaaacatg

SEQ ID NO: 192296 - DNA, 465 bp, Homo sapiens
tccactgtgtcactcaaggctaccatcatctaatgcttgcactactgtagcttccatgagtgtctctgcttctcagtctttacctgacttccactcatccctccagtttccatttaaacacatctactgaaaacactttctggagagaacacacacatatgcgtgaagacacaccgcacacatacatactcaggcttctgataacatcctacatagcacctgtgctgcaaaagactcagctttcaaggttgcaattaatatcagccttctctgaaaggctataagactatttttctgatttctgtgtccttagtgcttagctctgagttagacatgtagtctacactttctaataaaatagttacaattcacttagtgaatgaagtaacaaaacctacttgtgagagagacccaaagtctaaacagcagaagtttccatttctttcttttttaaaaaatttatct

SEQ ID NO: 192297 - DNA, 860 bp, Homo sapiens
acaaagccactggtgtctgaagcccttgcagttgtgcacagaagaccagtgatatgtctggagggtccttgaggggaggatgaccgaaccccacagaggtctcagatggggagcagcccagcctgcccgatcatcagtcatccaaggctgaggcccgggcctcttccatgctggctgctcgaccaggcaatcactcattcagcaagcactgattgaatgacaagtgctggcccctgcaaggcactggagagtcagcactgaacaaaatgattggaaagcttccctcattgggaaggggatgagtgaggcaagaacacacgttaggtcttgggaaaactgagtcaggcagtctggctggaggagagcgtgatgattcgtggagaaaggagtgggactcaacttcgaaacctgaacagaagactaaggactctggactctccctaagcagtggggtgccatcaaagtatctgaacacagtgacatagaagttttcataagaagaatctcctggtgaagagaggaagagcctgtggtccaaaaggcccaccagaggcatatggtaaataaagccaaattgggtaggagagagaacaatggggaagtgagagaaacaagagccatggagaaaggaagcaccatcaaaacgggctggggagtggggaacaaggaagatggagggaggactcggagatgagtccaaggtttcaaggctgggagtctggtttcagcagagacagaaatggggaagtctgcacaggaagcctgctttgtggatgcagagttgggctctggatattgctcaagttgaaatagggcatcaagtgaaaataacccgcatgtacttggaggccgaagcaggt

SEQ ID NO: 192298 - DNA, 458 bp, Homo sapiens
gagatcaggaaagctagtggtgtgattcagtctgactacaaaggcctgcgaactggtgggcatgggagtgaggggcacactggcattaagtcctggagtctgaaggcctgagaaccaggagctctgatgtctaagggtaggagaagattgatgtctcagcttaagaagagagagagaattcgcccattgtccgcctttttgttctattcaggtccttgacagattggatgatgtctgcccacgttggcgagggcggatcttctttactctgtctgctaatccaaatgctggtctcttgcagaaatattttaccaggtatctgggcatccctcagcccactcaagttgacataaaattaaccatcacaacagtacttgatattaaaacctatggaaacaacccaaaccaggctcaagaaaattcaaagctttaaatgctttttccttttagccccacat

SEQ ID NO: 192299 - DNA, 639 bp, Homo sapiens
tctcaaagtgctgggattacaggcgtgagccactgcgcccagctgatatgcagaagagtttaaaaagatttccatatttttatttaaagcctttacaaaaggcaaataaaaagcttaggcaactaattgattaaaaaaaattaaatctgccttgtactctttgctgacagctatgagtgacaggattaggcacgtacaggaccttagaacctggggaaacttttccccccaaaggtgaaatttaagggctgatgggacagctggaaaaggtccctttgtgaccaaaaagtgaccacttgaacttttgattcagtatcactgcaatgggtgggtgatatggctttgttgtgtccccaactaaatctcatcttgaattgtagctcccataattcccatgtgttgtgggagggacctagtgggagagaattaaatcatggtggcggtttcccccatactgttctcatggtagtgagtaagtctcacgagatttgatggtttttataaggggaaatcccttttgcttggttttcattctctcgtctgctgccatgtaagacgtgccttttgcctttcaccataactgtgaggcctcccccaccacgtggaactgtgagaccatcaaacctctttttctttata

SEQ ID NO: 192300 - DNA, 763 bp, Homo sapiens
ttaatgtttcataatgaacattttcccaaagcaaactgcttgttgcaaaacaaccgtatctttaagccagcattgtgggagagttctagattcctgccagagttaaacccaaggtagtcatatgtgtaattcaagtgctcataaaacagctggaaggaaaaaaaatttggatataaaataaattataggtggggcacagtggctctcacttgtaatcccagcacttcggaagcccaaggtgggagaattgctgagcccaggagttccagagcagcctgggcaacatagcaagaccttgtctctacaaaaaaattaaaaaattagccgggtgtagtgttgtgtacctgtaatcccagctactcaggaggcggaggcacaagaatcacttgagcctgggaggcggaggttgcagtgagccaaggtcatgccactgcactctagcctgggtgacagagtaagactctgtctcaaaaaaaaaaaaaaaaaaaagtctgtacggatacagggagcacactgcttccttttaaaggcaagaccgctatgttgaacattccacttctgctaaaccctaattatccagaagttataagactgcgaagcaatctagcttggtggccatgtgctctgtgctatataagaagctgaggtcagtactggggacaaccaatgctctctgccatattctgagcttagtaaacttgagagtgttgaattaatttagattaatgtagctgattggtaaattctgatctttgtggtaggg

SEQ ID NO: 192301 - DNA, 368 bp, Homo sapiens
ttagatttcttaccaatttatagaagcacttactatgttcaggttatatgttacaagtatgtcttgtggcatatcttttaactattgttcttgtgttttattatacttagatattgaatatttgtgtaatcaaatataaagtgtcaaaaaatttcagagaatgaccctaatattaacaaattagtggtgatagggcttattacagaaatacttctttatatcagtggtgaatcttgacaagatatcatgctgtagcgtgtccagacctttgggttggcatatgtttgtgattctttaataacacattttaaaccttgtgcatatgtgaatttttttttttttttttttttgagacggattctagctct

SEQ ID NO: 192302 - DNA, 266 bp, Homo sapiens
taatcaaggaagtatgcaggcaggctaaagagcctcttaactctcaaaatagggaagacttcattacaagactttatatcatatttcattccaaaaccaagtgttttttctcttccttctcactttatttacaaccactatagagttcagggtttccttggtttccctcttggtccttaacatgcaactaggagtcctccccgcaaaaagttttctacttgtcttagacagcaactctcgtggttttagcctggtagcaaaggcct

SEQ ID NO: 192303 - DNA, 510 bp, Homo sapiens
agtgctggaggtaactactttagacccttttgctgccctttgcgtctttccccatgtgaggacatagaattttccctttttgctcatttcccgcttccaccatgtgaggatgcagcacgaagaacctcaccagacaccaaaggccggtgctttgattttggacttcccagcctccacaactaaaggaaatacatttctgttctttataaactacctagtctcaagtattttgttagagcagcacaaatatgttaagacaatgtttatttaaaatttaataatggggttcattaggccaaaatctaatttgaaatgtagggagaaattataatttttccctttgacctataaataaaatataataaaagtttagttcattttcctttagatttgcctgcataggctttggggatttaaatgtaacagcttgccatttaatctgcaacagtttgactctagatttcagccctacaaatatagtgaggacactgtggttgttgacagaaagga

SEQ ID NO: 192304 - DNA, 515 bp, Homo sapiens
cagagagttcccatatgctctgatttccccagttgtgaccgtcttctcttagtatggcatatttgtcacagttaacaaaccaataatgatgtgttatgattaaccacgcctgcacttggttcagatttccgcagttttcactcacatccttttcttctcccagaatcccatctgggagcccccgtggcattcagtcctcgtgcctcctctgggctgtgacagtttgttagactctgcttggttttggtgacgttgaccgatttgttttttgttttgttttgtgtttttgagaagcagtctcacactccggcctgggcaacaagagcgaaactctatttcaaaaagacaaataaacaaaaaacaaagaaactatctaaattaaatccttagcaatcagaacagctgcttcagtagattttgccaacctccaatcatgttggactgaggttatctgttcctctttctgaaactattaagatggataattacccagcacacttgctcttataaaggca

SEQ ID NO: 192305 - DNA, 615 bp, Homo sapiens
gaccaccctggctaacacggtgaaaccccgtctctacgaaaaatacaaaaaaattagctgggcatggtggcaggcgcctgtagtcccagctactcgggaggctgaggcaagagcatggcgtgaacctgggaggtggagcttgcagtgagccaagactgcgccactgcactccagcctgggagacagcgagactccctctcaaaaaaaaaaaaaaaaagcagggatacatgtattactatgcaattagtattttccttagtttgcccatccagtcccataggatcttatgcccttggagaaggggtgagggctgtcttaaaactcagtgactaggccgggtgtggtggctcacacctataatcccagcactttgggaggctgaggcgggcagatcacgaggtcaggcattcaaaaccagcttggccaacatggcgaaatcccatctctactaaaaatacaaaaaaaattaactgggcatggtggtgtgtgcctataatcccagctactcaggaggctgaggcgggagaatcacttgaacctgggaggtggaggttgcagcaagctgagatcgcaccactgcactccagcccgggcaacagagcaagactctgtctc

SEQ ID NO: 192306 - DNA, 457 bp, Homo sapiens
ttccaatgctgaggactgaccctgggaaacagtcaacggttactgatctttcttcttcctgattaccaataactgatccatcacatgccctgtcaattctaccttcaataaagatcacaaaatccatccatctctgtccatctctatcacctcaatccaatccaacattatcttttgcttggactatgcagcaatctcccaatgagtttcccacttattgcttctcttcaattccacagattgatactattaagtattttggatcatgtcatcactttgcataaactcttcaaaagcttactttaaaaatcccaacttggctggatatggaggctcatgcctgtaatcccagcacttttggagcccaaagagggagaattgttaagcgcaggagtttgaaaccagcctgggcatcatagtgagacctcatctctactaaacattaaaaaaattagcc

SEQ ID NO: 192307 - DNA, 732 bp, Homo sapiens
gaaagatcaaacattcccagaaaagcattagaaattggggagtctttgaataaaatgcattaacaatgaatagaacaaataattgaggaaaaaagattccaccatgagaaatggataaacaaaaaagaaaaagaaaaccaatcacagcttcctaatccttatctcaattttctaaaagatacaacttccccaactcaaaacactgatttttttaaggacacactaatgaacagacagctaactgctcatgacttagagatgaaccaatgactactcttgaggtctaaatttcaggacctagccataaatattcagtatttccacactggatggataaaagctacttaaaaaataaccaattggcctgtgtgtaggctaacaaacactgtatcacaaactttaataacacatacaggtatacttccattctgtgcaatgacctgcatgttctctaaattccttcctcccttcccccctcttttttttttttttgtacatcattttgtcttctcattctctgcttttattattgaggtttggatctccaacttgctgtttctaaactttgatgatcttatataagtttcatgagtcatgaattgacagctggtcattaattaactctagctacatattaatgacaaaatatgtaatacagcctcatagagaccatcagtgtggcaggttggaaagcaggtagctttttgtgtattaaatggtgttgttgagctg

SEQ ID NO: 192308 - DNA, 370 bp, Homo sapiens
tttacagtgtggaaagaaacaagcctgtttctgaggtagtaggggcagccagagggatttgagctttgcccttaatattgtatactgcaactgatttagagaagcctgtgtcccttgtaagatttaagagtaattttttttttttagacagagtctcactctgtcgcccaggctggagattttccaaacttttagactccgctttcctttttaagtcccaatttttaagtcattcctttgctcccacatctatctgatcataggctgttagaagcagccacagcacatcttggatgtttggttgcttaatgattacttccactagataccctaagtcatcactcttaagttccaacttccacacttcata

SEQ ID NO: 192309 - DNA, 339 bp, Homo sapiens
acgtagggaagaggaagaagatgagttgtgggtgaagtgtaaggtggacaggagaaaagaatcttagtgtccatgctcagaaatcagctcttcagctgctgaaacagaggaccccggttccttggtttctgttttgggaaagccaggccatgccaaacagagggaattaatgatgcaggcacacaccggaaaggtagggaccaggaatgaggcacagcagcgagttctgagatgtttagtctggtgtctggcttgttaactccactgtggtttctgagccaggcctcctcgctgagacagaaggtactttaacatatgagccaggcatctttattaatt

SEQ ID NO: 192310 - DNA, 503 bp, Homo sapiens
gcaatatattttgtcaaaatttgagtgacattaaattcttacctctttatcaggcaggctaaagaggaattctctatcaaagcgaccaggccttcgtaaagcaggatctatagaatctagcctgttcgtagcaccaatgaccacaatttcccctctgctgtccaatccatccataagagctagcagggtggaaacaatagaactaaattttaaaaataagagagaagagattaatactatgaacacagtctatatcattcagtaatatttcttcttttgtaagatttaacgcattacatgtgaataaattttctcagggcacctcactatttccaatggattaaaaaaatctataaaataacatcccaaatggcccacagaaattgaaatcaatggaaaacagacggttgttagaccccccacaaatgaatcctagaagacattttataaagcataatttcacaaaggaacttaagagttctcaaacaatatataacatcaaa

SEQ ID NO: 192311 - DNA, 279 bp, Homo sapiens
tagtttagtgttaccttttctagaatttcatataaatgaaagcatacagtatgtgatctttttcaggttttccctccttagcagaatgttttggagattcatcagtgttattgtgggtatcctttttattgttgaatggatttcattgtatgaatatactacagttttttattcatttatctattgatagacatttgggttgtgttctaggttttggttattatgaataaagccgtgatgaacacttgtacagaagtctttttgtggttatgtgtttcc

SEQ ID NO: 192312 - DNA, 617 bp, Homo sapiens
tcattcctcttctgactcccctgagcttgatcttaagagaaaaggccctcttcctccttaggccaacagtacgtgggcaagtttgatttacccagcatgcccaaaccaggctctcaaaccttgtgacttctgctgccctgcaacattcctcatggcaatccacaacagagtatggcctctttagcccacaaaccaggtagtcagtctatggggaccatcctaggatctgccattgcagaacaggcagccctttatggtagataaaacaagcatttaaattaagaatgatttgtttggcttatccaagatcctgagaagaaagggttgatttcagagccaacatgtgcctccctactgccttcttccaataacattgcttccccctcaaccaaggaagaaaatttagattccaagagatgctaaacaacccatttcttagccatccacctcattacacagccaacactaacagcagagcacatacctcctaacctagttgggagctggctagatgacagaagagataaggcctgacagcacaactataaccgcatctaaacacagaggaaaaaaataacttgaaaactgtcaagtttctgtggaagtcacagccaatt

SEQ ID NO: 192313 - DNA, 557 bp, Homo sapiens
gattttgtttatccgttcaacagttggtggacatttgggttttccaatttttttttttactattatgaacatttgtgtacaagtttttgtgtggacaaatgttttcattttcctgattacacacctaagagtggaattggtgagtcataagataactgtgtttagcttcttgaggaagtgccagattattttccctagtggctgcaccattttacattcccaccagcagtggatgaggctgccagtttctccacatttttgtgcatgtgaagtggctgtctcatcgtggtgtttgccttttcttaaggactcaaaagtttgcagatacaggcattcacttgccattttcttaaggtagagttgaaagtactgctgccagttcatcatctgaaatgagggctgttttctttcctgtttaattggattgcaactatttgcctttcctaaagatgaaatagtgtgcttcctacattattctgacaacattcctttaattgttaatttcagatgaatttctgaaaactgcttttatcagaacagatttacttaaatgaagg

SEQ ID NO: 192314 - DNA, 144 bp, Homo sapiens
tctctagattcttcatgaaggatacacaagcttcaatagctgattcaatcaagtggaaccactgtacttagagcaagacagaagcagtctgctgtctcctgtatacactggcccttcagatatttgaagacgtctgacctctcc

SEQ ID NO: 192315 - DNA, 494 bp, Homo sapiens
ggttgcagcgagcccagattgcgccattgcactccagcctaggcaacaagagtgtaactttgtctcagaaaaaaaagaaaaacaaacagagctatgcgtgctggctccaggcagcctgtccaggggcctgctgagcctgttcccacccctcccattggtcaggttcataccaaggaaaagaaaattaagttaaaccccctggtggtaagcagatgtgggcttccacacacagtccaggaggaggtagaggtgagctggtgaatcctggagaaggagcgcatgagatgtacccacatggtcgtccttgcagcccacacttgggctcctggtggctgttggaggctaaggctgcagctctgcagggagaataggcagggagcgggaggcgcgtggagcaggaggctcacggaagctggaagccgccttcctcctctgccaccccttcagtgctggggcagggctggtggccccatcaggaggaattgtgctgctgt

SEQ ID NO: 192316 - DNA, 297 bp, Homo sapiens
gtcagggctccggtggagatgggggagaaggcagaggccccaccactttcagggcttttcagggccagcagctcagcatccctggatatgaggagccttagaggctctcactcactttggcccggccatgaacttctcaacggctgccagttgagggtgtgcatgtcagccctgttctgggcagagcccggtgttcacactcagtctcccttgctctaaggggcttccacagccctgggcatacccaggaaggcagcccagatttccgtgggcatccccaccccacagagtcccagg

SEQ ID NO: 192317 - DNA, 311 bp, Homo sapiens
cctcagcccattttcagagccccatgccatactggcttagtttctatcgaaagtagaaggcagagggaacatcttggtaccaacccatggctccagttagttgctcctcatggagacgttccatcagttccccagctttcaactccatttccatgataccctgtgcttctgagacaagaaccccagtatttacacaggatgcatcctctcctcttgtcagtgatacttggtaagctgctggactgactcatttccacctcttcatctgtttctcgtgagaatttcttgatgtgtctcatctactttttctc

SEQ ID NO: 192318 - DNA, 236 bp, Homo sapiens
ccaatcaatcattcaggaagctccctccagttttcagaaggagaaaaagattttatactaacgtgctatagagaaagcctagcatttaaagaggtcattcaaggaactcttccagttcccagaggggaggaaaaagtggaaagggggcaaaatgccatagtaagaactagtttggaatttaaaaaattctgattatgttatgaattattctcattttagattgactcaaaggcatt

SEQ ID NO: 192319 - DNA, 1066 bp, Homo sapiens
tcctgctcttttcccctcaaaacatctggaacaatcacttacagtggaacaatgactgtgtttcactacattttatcactgtttatctatttgccttccccattagatcataagctacttaagggcaagaattccaggcaagtgcacggttcacgcctgcaatcccagcactttggcaggccaaggcgggctgatcacttgagcccaggaattttagaccaccctgggcaatatggagaaacctcatctctacaaaaaatagaaaaattagccggacatggtggcgcatgtctgtagtcccagctactcaggagactaaggtgaaaagatcatctgagcctgggaagttgtggctgcagtgagttgtgatcatgcctctgtactctagcctgggcaacagagtgagactctgtctcaaaaaaaaaaagagaatttcatccatttctgtatttgtatccatttctgtatccccagtgcttcatacagtaggatttaatatatgcagggtgatgagggaggttaagtgacttgctcaatgccacactgaaaatttagcacaaagccaggtctggagcagaggtggcttgaccctcattcaaggcttttcaaatggtgccacagactctcctcagcagggccccacactgtcttcccattacagtgatgacactgtaggaaactatgtgccctatctggcttgatcaccttgtaacctatggtgggaacctgtgggtgctagacggctggggctgaagtctggcctatggaatagaattctcaccagggtgtcaattaagaccttgtcaattagcacagtgcctcaacccctacactcttcatacaagccaccatgctggtttgagattcctcttgaaatcacagaaacctatttctccaacacccatttcacaacagtcattctaatcatcttacctagggttaagtaaaccagtccaagggcctaattgggcctttcacctgttttgcaaataaagtttttctggaaaacatccatgctcatttgtttatatattctctgtggctgcagatttgagtggagacccta

SEQ ID NO: 192320 - DNA, 151 bp, Homo sapiens
tgtttttttttaaagatgattcacgttgctccaggcgaaagcatgatcctgatgacacgtggggaaaagcaggctggagcctcagaagagctggccctgcacactcaggtacttacagcagtaaatccaggatttgaacaccagggagtaa

SEQ ID NO: 192321 - DNA, 472 bp, Homo sapiens
tcagtatgggcattcgagcgatgttttcttttttttttttgagatgagtctcactccgtcagccagtctggagcgcagtggtgcgatctcagctcactgcaacctccgcctcccgggttgaagcaattatctgcctcagcctcccgagtcgagtgatgttttctatgggttctcatgttggaagaagatatattcttagacttagaatatgaaaggtcctcttttggggatttgttgagatttggagctagtctctagtgccatataaataatcacaaaaagccctctgaaaatccagagcttttgctgccttagagacaatttaataaaagaagaggctgggccttctgaccttagtatttgccatttgaaatcctaagtatatgttttgcatcttttgattttgaaatctttctgttaacccaaaaattttatggcagggaatatttgtaacattaaacaaccctttaga

SEQ ID NO: 192322 - DNA, 341 bp, Homo sapiens
gtgagctcctactcggaatttatttcatggttatccctaaaatgggtttccctcacatttggagccacagatgcttcttaactagaacataaactccagtccatggtttctggggctaagtctaacaacaataggccaaaatgagaatatattttgtttcctccttcctgtccagtgaatactgatatattcttgggcaaggacagccatcagggagccacagtgaagctgtcattcaggctatgagcttgctccttttttctgtagcctctcatgacccatgaggacccaagagggaaatgacaggatgaaaaattcggaaggaatcatctggtccaacc

SEQ ID NO: 192323 - DNA, 1944 bp, Homo sapiens
gtcaattcatactggggagcaaccttacaaatgtgatgaatgtgaaaaggttttcagtcgtaaatcaagccttgagacacataagataggtcatactggagagaaaccatacaaatgtaaggtttgtgacaaggcttttgcgtgtcattcctatctggcaaaacatactagaattcatagtggagagaaaccttacaagtgtaatgagtgcagcaagaccttcagtcacaggtcataccttgtatgccatcatagagttcatagtggtgagaaaccttacaagtgtaatgagtgcagcaagaccttcagtcgcaggtcatcccttcattgccatcgtagacttcatagtggtgagaaaccttacaagtgtaatgagtgtggcaataccttccgtcactgctcatcccttatataccatcgtagacttcatactggagagaaatcttacaaatgtacaatttgtgacaaggctttcgtgcgtaattcactcctgtcaagacataccagaattcacactgcagagaaaccttacaagtgtaatgaatgtgggaaggcttttaatcaacaatcacacctttcacgtcatcatagaattcatactggagagaaaccttagaaatgtgaagcatgtgacaaagtttccatttggaaatcacaccttaaagacataggagaatttatactggagagaaagcttacaaatgtaaggtttctgacaagacttgggagtgattcacacctggaacaacatactggacttcacactggagagaaaccttacaagtgtaatgagtgtggcaaagcctttggcaagcagtcaacacttattcaccatcaggcaattcatggtgtagggaaacttgactaatgtaatgattgtcacaaagtcttcagtaatgctacaacgattacaaatcattggagaatccataatgaagagagatcttacaagtgtaataaatgtggcaaatttttcagagatcgttcacatattgcaggtcatcggtgaactcatactggagagaaaccttacaaatgtcatgactgtgccaaggtcttcagtcaagcttcatcctatgcaaaacataggagaatttatacaggagagaaacctcacaagtgtgatgattgtggcaaagcctttgcttcacgttcacacgtcattagacatcagagaatctatactggacagaaatcttacaaatgtcatcagtgtggcaaggtcttcagtccaagatcactccatgcagaacatcagaaaattcatttttgagataaccgttcccaatgaaatgagtatagcaaaccatcaagcattaattgacattggagtcaattcagcattgacttgagtttgtgttgacttaacattgagttcaagcctttattgacattcaagtgtttatgttaagaggatggggccaggtgtggtggctccgacctgtaatcccagcacgtcgggaggccaaggcacataggtcacttgaggtcaggagtttgaaaccagcatggccaacagatgtgagccacttttctcagcctgttttttgtttcttattttctattatttttttgagccagtactttttaaagagatagtacttttttcagttagtactttttgaaagggatatatcatagtaatttttaaaagggatatgaggccaggcacggaggctcatgcctataatcccagcactttgggaggccgaggcaggcagatcacggggtcaggagatcgagactttcctggctaacagggtgaatccctgtctctactaaaaatacaaaaaattagctgggcatggtggctggcgcctgtagtcccagctactccagatgctgaggcaggagaatggcatgaacctgtgaggcggagcttgcagggagtcgagatcgcaccactgggctccagcctgggcgacagagtgagagtctatctca

SEQ ID NO: 192324 - DNA, 492 bp, Homo sapiens
gcagcctaactccaggcagggcccgggctcagaagggggtctacagggctgaagaggcagctggccagagattccacaggaagcatcttgttgacacatcttcatcactttggaatttgagcaacaacatttaccccttctgaaactcacccagaggaagcggattttctgacgcatatgaagagtgagaactgtctacatctaagtcttctttgagaacaataccagctgagcggctatttacattccagcttcttttgagaatctctgaagatgattaagtcattgtcagctggtaagggttggtctcaccacttctcatgttggatcattgaggcaagaaaccttcaaagaatcctttttgggtatcttttagtgaggaaaaaagtggggacaaagatacgtaaggcagtacttgccagaagtcgcggggtgggaagaggaagtgtgcagagttctagagcctgtcttcacctgggggatgtgcactga

SEQ ID NO: 192325 - DNA, 360 bp, Homo sapiens
agagaaagaaataaaggggatccaaattgttatagaggaagtcaaactgtcactatttgctgatgatattattgtttacttagaaaatcctagagtcctccagaaagctcctagaactgataaaacaattcagcaaaatttctggatacaaaattaatgcatgcgaatcagtagctcttctatacaccaacagcgaccaagctgagaatcaaatcaagaactcaaccccttttacaacagctgcaaaaaataaaataaaataaaatacttaggaatatacctaaccaaggaggtgaaagacctctacaaggaaaactacaaaacactgctgaaggaaatcatagacgacacaaatgaatg

SEQ ID NO: 192326 - DNA, 247 bp, Homo sapiens
ggcatactttagttcaactggatttgaaatttaaagatcagcattgacttgaggggtttagttcaagtggattagaaacttaaaggttagcgttgacgtaagaggttcaggcccccctgtgacttgagctggtgtgcgaacccaggttacagctctcttaagcatcattctctcctcctgccccactgatcaattctcttggacattcctgaattcacttgagtcactcaaactcctgtacagcgcc

SEQ ID NO: 192327 - DNA, 217 bp, Homo sapiens
tgttgggattgcaggcatgagtcaccgtgtccagtgttgtctaagaaattcttgcttatgctgaggctgtcaagatattctcctgtattgtctttttaaagttttctatgtttgcttttcacactttagtctttaatctacttaaagttgattttgtattgggtgttgctaaggctccaattccatttttttcacctacaaatgtctaatttttcca

SEQ ID NO: 192328 - DNA, 532 bp, Homo sapiens
cccagactgcttgttggccctctgggggaccaagacaaactagggaacagtgagccgtgcctcccggtgcctggtagggagtggcgagaatgaggagccaggtctcaggagaggctgaggagagttggacagggatggagcctggctttcctgcccagttcacagaggggagggcacagctgctggcttggagggctcccaggaaggccaggagcagaaagtctgagaagcagattgggggcagcagagggagtctggcccttggtgccgggggtgccctggtggacagaggtgggggcagcatggagccggcatttatggaggccctagtatgtaccaggccatttagacacgaggtcttatcatgtctctagaaaagccctgcgtagtccactttatgattatgattatgattatgattatgattattattattttgagacggagtctcgctctgtctcccaggctggaaagcagtgatgcgatctcggctcactgcaacctccacttcccgggttcaagcgattgtccc

SEQ ID NO: 192329 - DNA, 374 bp, Homo sapiens
ttactggggcttactatgtgccaggcaaactaatgaaccatggaaccccaaacaacaacctcatgaggtcagtatcataattatcctcattttactggtggggaaactgaggcaaagagaagttacttgcccaaggtcacctatgatcgttctgtggtccatgtgtgagtaatgaagaggggtgattatttcttaaagatattacttaatctggccttttaaactagcctcagagttattcttctataaaaaccaaaataggctgggaagcagtggctcaagcctgtaatcccagcactttgagaggccgaggcaggcagatcacctgaggtcaggagtttgagaccagcctggctaacatggcgaaaccccgt

SEQ ID NO: 192330 - DNA, 410 bp, Homo sapiens
aggtgactctagagcgaccccggatggtggtgtatgagactttctggaatctgtgggtagaaatcagtttatctctctttggtattcatttcaaagatctttaaggtgttagcaatccctgctttgctaagacagattcagctcatttagttcactttcaatccctaattaatttgtttaactctctagtctacttttaactattgtcctattctcgttgtttgtgtgtgtttatacattttgagtgagaggtttgggggccgaagagacaaatgcatgtacttttttacgatgttaaacaatgaatttgtcttcacattattcaactttatttctcaccattgaattacatgttcgtctactttttacatattgatcaacaaatatttattgcataacaccacacaatt

SEQ ID NO: 192331 - DNA, 413 bp, Homo sapiens
ttccaccagagcgtatgtcattgtcaaaaatgttcacctctcctcccttcttaggacttccctcttcctttgtttctaggacaataatgtctggattctcctacctgcccaattgctccttgtctatcttcttttagccccttagtgaaggtgtttccaagtctctgtctttggttttcttttctcttaaaaatccctataacaatcccttcccctatccacactatatccagaacactcaagaattcattttgtcatgaaatctgtaactatatttccaaaaatcttctggacatcttgacctcagtgttctgctatcactttcagtttaacttatccaaaactgaatttaccttcttctactatcaccactccttttcttgatcttaatagtttagtaaccttacggctgg

SEQ ID NO: 192332 - DNA, 350 bp, Homo sapiens
agacagcatggggaaagtagtagcactctccatttgagttgttggactgattttgagtttctttctttcacagtgaaagttgtttgaattgttaatgagaggaaattttagaaaatgcttcacctttaatatattaggttatatctcttctctgtaacggcatcttttcaattctcttcatcactttttttgtttacctagtatgtgatcaaaattaaagttgtctgctgtggctgccttttcaatgaggtacacagtatcacattgccacatgtaatttccactcaggtgacactgttctcactgctgagagaaatggcaggattagcagaaagggtggtattagatat

SEQ ID NO: 192333 - DNA, 430 bp, Homo sapiens
cgtgatccgcctgcctcggcctcccaaagtgctgggattacaggcgtgagccaccacgcccggcctaggggaattttaatagctctaattaggagctgctttcttgatatcaagtaccattgctaatgattctgtattaactttgtgtctcagtctgataactggccttctgtcttgcttgtatgatgaaattctcaactatacctcaaatccagtcactgatttcctgtattggcactttgccttggccttagaaacctgcccagaatctcttaatcctccttgattttctacacttttctggctctccacctcccccacgcccatgcctacacacatgccagatttaactcctgcttgagtctcagtgtattttatcatgtaagggagacttcatcagaagtctagttaacgtctaacatgttgtctg

SEQ ID NO: 192334 - DNA, 218 bp, Homo sapiens
cctcctaactccagccagtgctcctcctccatgccacactgcacctcctagccctggcagtggataggggagcggttgctgactcttcagccaagttcattgtcaccattccatttctagggccctctctttggctaccctagtgacttctacctctgcttatcaatgggagctgtctaaagagggaagggcagcaccagatccttggaggttattgg

SEQ ID NO: 192335 - DNA, 340 bp, Homo sapiens
gcttctttgctgagggataacagagacctagtgattgtagcaactactaataaagaaactaagagctcaaatacctctgggatgaaggtctggctcacacctagtaggctgcctaggcctgctgaagtattggcaaagaatgatgaaaatctagtttcaatctcttccatgattgagtcttttgtagaggtgtggctggccaccatcttgaagattccgtgatgatggagcacacaaactgatctgagtgatgcaagaagtagactaaattcagcaactcttgcgcccactgcacaacctctctgcctttcaccacagcagcccagttacagcaccctgc

SEQ ID NO: 192336 - DNA, 232 bp, Homo sapiens
ccacaaataaaaaaaaaatgtaaatcttatctaccatcccataatgcagatatattttggtgtatatgcttctaacttgttgtatacatatggcctaatcttaatgtacataattattgaatgtgttctttatgtgtaacagtatgcaataatcattttctatgccatttaatgcacttctacattaaatacatttcataaacaatacttcacctaatggcagtagcacata

SEQ ID NO: 192337 - DNA, 223 bp, Homo sapiens
cttagacttccagcctccagaactgtgagaaaataaattctgttggttaagttacccagtctgcagtattttgttatggaagccctagatgactaatacaagaaggaaagtatattgcaattactcatatatttgctttccacgttcttttttctttcttttttttttttttttcgaaaagtgattattgcccttttcgctcaggctgaaacgcattgttgca

SEQ ID NO: 192338 - DNA, 743 bp, Homo sapiens
tggaagagaaaaataaagaaataaaaaccttttctgagaagagtctgtaggtttcaccagactatcaaagagtctatggcataaaacaggttgagaacctgcattagaaaaaggagaatagctatgaggtaaaggcaccggacaaagtcttcataggcagagaagcaggattcacatgttgagggaagctaggacccagaatgatggagagatagagaaagctggtgagggaatgatgatgatggtaacacgtcatcactgatgatatgaatgaggttgatggtaacagtaacacagcagttattatttaccgagtgggtcacaaagtttcagacgctgactaagccccttgcaaacatgatcacattcacttttgacaataactgtacaaaggtgtgaatgctatttctcttttacagcctaggaaacacagccccagatatgtccagggtctactctcgggtctcctagctagcaagtcgtagagctagaattcaggccatgggctgcctgattccccagcttgtgcccttactcactcgtccattctgccaagcgcagggaaggtcttgttctcatttaaccaatgaaaaaaactaaggctcagaacgagtaaagtgaagccaagcccaggatctcaatatgcttaggaaaagcaggtgagatttctcccttgcttcactgctactgatttccttccttatccctgatggtacctccagggcctgggaggctcaaggaac

SEQ ID NO: 192339 - DNA, 343 bp, Homo sapiens
attttcagtacatgaagaaaccaaatattttgctgctatcctttggaaacttcttactatgattggttctgggtggcattggaatcagtttgaaatgatgccattaatgaccacatgtttggatttcttgactatgggtaaatgtgattagaacagaaatcccttaataatagggattctttatctttgtgtccctagtgcctcatagtatctggccctaattaggagctttagaagtgcttattgactgattgcttttttatctgaatcggccctttctatcccatcattatgataacatccatcttggtagtagtaaaactgttgcaaactgaaatgagct

SEQ ID NO: 192340 - DNA, 259 bp, Homo sapiens
atttggatctctgcagcgtagtatagggctgcccttccaaagtgtgttgagaagggccttaaaagatgatatacaaaaaaagggggattccatagccaaataaatttgggaagtgctggattaatgttactggtgttctttactgaaggatatctcagaaaacttactgtgccagcatgctttatgaatcctcaagacaaggtttacagcatttcccaagtgtttggctatgttatcttgtttgtgaggcactgtccag

SEQ ID NO: 192341 - DNA, 492 bp, Homo sapiens
ccgaaagcgggaagcaacccaagtgtccatcgagggataaatggagaaagaaaatgtggtgtttacaaaaaatggaatattattcagcctgaaaagggaagaaactcctgtcccatgttacaatatggatggaccctgaggaggttatgctcagtggataagccagtgacagaaggacaaatactgttcaattccacctatgtaaggtccctaaagaatcaaattcattagaggcagaaagtagaatgctggttactagggatggaggtggggagcaatggggagttattgttcaatgggaacagagacgcagttggaaagatgaaaagagttttggagatggatggtggtgatggttgaaaaatgagaatgtacttaatgccattgaactgtacacttaaaaatggttaagatggtatattttgtgttttatgtatttaaaataatgatttttaaaaagcataggatttcgttataggatttctgtgctat

SEQ ID NO: 192342 - DNA, 384 bp, Homo sapiens
aatgtaagatggagccctggcacaaggggattctgctgtagttcacagttggggctgaggaagtccatgcattgagctctgttttaactctgcattaatgattcatccttgggctatatccactccagactaggcacgtttgtggcatgcatgctgttcctccctccacacaaggcatcaatgacaaccaactaatcacagcaccatatcctgttaaaaccaaacacaacctcagaatcttcctcagcaaggtgttctgcagagacacaccaatccattcaatgaactcggcattgaaacctacctaccattccctggtttatcaatttagatcattaaagaaaacaaaacaaattactctctaaaacaactggcattttgggg

SEQ ID NO: 192343 - DNA, 320 bp, Homo sapiens
tggattaatccacccacgagggcaaagtcctcattactcaatcaccactaaaaggccccaactttcaatactgccaaattaaggactaaattttaacgtgagtttttgagaggacaaatgttcagactgtaagacccacgtagcacaaagtatgggaggaaataaatagaagtatacttttgtgagtttctttcttcttttttttttttaagacagggtcttgctctgtcactcaggctggagtgcagtggtgagagcacagctcactgcagccttcacctcctgggcttaagcaattctcccacctccacaccctcagt

SEQ ID NO: 192344 - DNA, 170 bp, Homo sapiens
caagagctcacatagctagtttaataagatttctgctgaaagagcacaggggacaggcaggagaaaacattgtcaccatggatcaggtcttttggggtatgggtggtggtgatttcctgagttgttccacacactatcataattcctttccttcagcacctgcaaagaac

SEQ ID NO: 192345 - DNA, 856 bp, Homo sapiens
gaattcggtttgctagtattctgttgaggatttttgcatctatgttcattggcttgaagtgttcttttgttgttgtgtctctgcgagattttggtatcaggctgatgctgtctttgtagaattagttagggagaagccccttctccttgatttttaagcagagtttcagtaggattggtaccagttctttgtatgtctggtagaatttgactgtgaatctatctggttcatggcgcttaatgattcaatttcctaacttgttattggtctgttccaagtgttcactctcttcttggttcaatctttggaggttgtatgtttccagggatttgacaatttcctgtagattttctagtttgtgtgcacagaattgtccacagtattctatgaggatctctgtgggatcagctgttatgtcatctttataaactcgaattgtactaatttggatcttctctgattttattctttgttaatctagctagtgttctgtcaatcttattgtttttttgaagaacgacctcttggtttcattgatcttttgtatggatttttgcatctcaatctcattaagttctctaatttttgttatttattttcctctgctagctttagggttgttctttttttttccttcctagttcctttaggtgaaaagttagattgttaattcgaaacctttctaacttcttaatgaaagccttttagggctataaacttttctcttaacactgctttggctgcatcctagagattttggtaaattgtgtccctattttcattaatttctaattttttttatttctgacaatttctatgttcacccaggagttattcaggagcaaattgtttaatt

SEQ ID NO: 192346 - DNA, 533 bp, Homo sapiens
atctaaggcaaatctaagaaaagtctgggctattagtatttcatgctcttatttccatttgtgtacacaaatagctttgtgcatagatgcacttaatatatgttaatagaaagcaaggccatattttcactcaaactagttaagttattctagtctatcattcagtcttactgctttttaatttttttcaaagtgtagattttgctcatcagtaatgtgaagcactgttcaccacctccctcgaaaaaaagagcttccatattaagaagtaacttccttttttcattttccttccatctgtactttacaacactaacaaaagacaaaaataatgaacaagcttccatttcctgcaagatggtggattgtcctaccataaaaataattaaatgtgtgactaaaataaacatttcaaaatacgttgaactggcaagaaaattaggaaactttagaagcaaaaatctgagaaagctaagtcataggaatgtgaaccaacactgaagcaagatttgctctgatgacatttgcctaac

SEQ ID NO: 192347 - DNA, 248 bp, Homo sapiens
tccatatcttaatgctctttctactacaaagaaaagttatctatttttacatgttttagaaatgtagatgaactcatacataatatttttggtcttttaattgatcacatactacttaggtcagaaatggtttataacagttccctttgtaatcttttaaacttttccataaatatattgatgatactttaatacaaaagctcaaagaaaaactcacttgattattttcccattggggtagtcacaga

SEQ ID NO: 192348 - DNA, 519 bp, Homo sapiens
tagatagctactaatggtttagtagaaacttggctctaaatttattatgcattctatggtacctaactgccttttactcacagcaaaaaaataacaaaagttcatagagcacctattgtgtattaggttggtgcaaaactttcagtggcaaaaattgcaattattttgcaccaacctatcaggtattgtgctaagtacttaaaagtacaagtataaagagactatttttgggagtggaggggcagacaggcctgggtgacagatgagaccctgtctcaaaacatataaataaatgaaataaaacttttttgtagagatggatctcactatgttgcccaggacagtcttgaactcctggcctcaagcagccctcccaccttgacctcccaaagcactggaattacaagcatgagccatggcttctggctaaagaggactttaaggctagatctcaactggtgtttttgttatgttacaagaaaaaaggtagctccaagtcagcttaaacaatatcagaaa

SEQ ID NO: 192349 - DNA, 384 bp, Homo sapiens
attacaggcgtgagccaccacacccagaccaaaggctacacgctcttaagctccttgctcatctcacagcaacctgacgatgtggtatcaagacttagagaagggaagtgagtctggatttggatccaggtttctctgactctgaagcccgtatcttaagcacgtgtactgggctgcgaagctgttatgggacagcagacgcaataggtggattttgttccggctgtggagcaccatgagaaggaggacgaggaggattgggacgcccagttccggagtgctggcctcagagcatgcaatttatatgttgagaagagacttaagaaagcaagccaaggagcagagccgcagtggccaccgagttggggggtggttgagtgctca

SEQ ID NO: 192350 - DNA, 479 bp, Homo sapiens
tcgagctcggctccatttggttggacgatattctctgaaagaggatgatagtctgtcttttaaaggtggtttagactctaaaaatagtcatgatctgccacaaaataggtcaggttctcctggggccacccgagagatgtcctggaactcagaagctgcatggcctcaggaaggttttctgggacagacctggtcccagggagagtgaggagaagcgtgtgagatgtccctgaagtgctcctgggagaaatgacagctggcttggttcatcagcatttcataaagagtaacactcacacacgctgcaagactggggccaaagaacgacctcgccaccacccaatcccttgttaaactccaacctgttgaggagaaaatcaaggactaaacacggtgctttgtgctgatgtggtcattttcatttcaaaccaatcccggttaaaacaacaaaagcaacaaacgacatcccaaatagcacc

SEQ ID NO: 192351 - DNA, 323 bp, Homo sapiens
gaggtgacaaaaaatggctcatatgttgtccaaaacccttgataatatctttaatttttttttttggtcacctcgaggtgacaaaaaaatctactatagagaggcctgcctgcccaaagaagctaatgtaaattctgacttcatttctagagatctaacatccagagcaagataaggcaatagtcctattctgctgtacatgcttagattccctgtgtagttttatattcagtgctagcattttaagaagaaaataacaacctagatcatgtccaaagaagaacaacaaagaaggtaaaaagtttgacaccatggagtataaa

SEQ ID NO: 192352 - DNA, 447 bp, Homo sapiens
tcaagcgattctttgcctcagcctcttgggtagctgcgattacaggtgcccgccaccatgccctgctaatttttgtatttttagtacagacaggatttagccatcttggccagctgctcctaaactcctgacctcatgatccacccacttcggcctccaaagtgctgggattacaggcgtgagctaccatgcctggccagaacccaatattttctacaatattttatacatttctttctacatggattatataaattgggctttccagcagaaaaaggaaaagaaaaagcatatgtctcaatgagagcacacaattatgagaatggcaaccatgtaaagaaaaattgcaaggacttagtgctgatgaggatttacagcaactaaaactagaaatgttaaatgatacagtaaaacaatttaacggtttattgtaatgttatatataca

SEQ ID NO: 192353 - DNA, 261 bp, Homo sapiens
attaccaaatgaacgaacaggaggaaatagcttaaggtcttcgaagagagagggcagtagattacctgatgtccaaataggatttaatagcatacgatcatggaagagagagggctgtagatgacatgatgtccaaataggaggtaatatcataaggtgctggaagagagagggcattacattacctgatgtccaagtaggaggtaatagcataaggtcctggaagagagagggttgtagattacatgatgttcgaaatag

SEQ ID NO: 192354 - DNA, 119 bp, Homo sapiens
tctgccccaaccctacaggagacattgaagtaagctggtccagcagccagcagatgcaggccaggctccaggatgaatattggacagacagagaggacaatggtgactgtctctagcag

SEQ ID NO: 192355 - DNA, 516 bp, Homo sapiens
gacttaagtcttggactaggagatggtggcagaggcccagcaacagggtatctaccaggggagaggcatcagctgtttgggcagggatttgcattttttcttccctttctttaccataacttgaaaaggtaaaattggaaggcaaggtaagtcagtgaacacctgagtgactttttataaaatatggctcaccaacaaggggcgcatggctctctcacctgaggcgtgaagcacagatctgtagcaataagccccatatacaaaaggtgaccaatgatacgctcttccttttcatttcccattgagtaggttacctggggcaactggggcaacaggtgacactacagcaaacagacattgggtgatctaggtactaatcctgcctctgcattcacaggctatgagatgtggggctggcttaacctctctgaatgccagtttcctcatctgtaagataagccccatgacacctgtgtcttgacagcctcctgaatcagctgcaaagtgtgatggatg

SEQ ID NO: 192356 - DNA, 550 bp, Homo sapiens
cgtccgagagagtcaacgacctgagactttctatccatgagaggaagacaatcatcagtgcttacttgttgattgtcttcctctctatccatgagaggaagacaatcaacaagtaagcactgatgatgagcactgtggagaaaaataggcagggaaggggaggaaaggcttctctaataacgtggcacttgagcggagaccggaaggaagtgagaatacagatcttatgggtatctggggaaaaaacgtccagacagagggaaggtcaggtgcaaaggccctggggcaggagtgtgctgctgtataggaggcacagggacgaggccagagtggctggagagagagcacctgggaatgaagggtctcggatggtgctgggtcttgtcaagtgccctggctcttactccaggaaagtttgtgcagagcctgccttatgctttaaaaagaccaacctggacactgtatgcagaaaaagttaaggcatctgttgcaatgggttactgttgcagaatccaagggagagaggacagtggcttggacaagggtgggg

SEQ ID NO: 192357 - DNA, 397 bp, Homo sapiens
aaagctggcaacggtagctaactttgattgaatgtacatcagtgccaggcactggtacatgcaccttccacctattgattcctttaactcccgcaccatagatatgaaggcacagacagtggagcacacagctagcaacgagcccactctgaacccaggggggttggtttcccgagcctatgtgtccctgatgactaccctttcattgccgccctggaaaacaaacagaactcactcactgtgtactgcaacaccaacacataacaaagctggaggtttggttctgctgagagcgtcaggaaaagccactgagggtggccagatttgagctggaccttgatgaatgcataggagtctccctagcagataaaggggaggagttgcatagcaaaggtgg

SEQ ID NO: 192358 - DNA, 713 bp, Homo sapiens
agcagggccccgccatcgtagaatgcaggtcggcctccacatgcgggcacagaatgtttccctttggcattccatgccctgtatggctcagggcccaggcaggcagttcagcagagggaatttagcaagagaactagttacagagatgacatgtcttacagctgcaggaagccactatcacccagaggactggggatgaaaggggacgagggtccccagcagcgtggcagccacctgtgggctgtcccagagaaacccactgaccaccaagggcaagcagctagtgctggggaggctgcgaagccaagagagggagagggagatggagacagagaggagggacaggagccagctctcccctccgcccatcctccaggctcccaccagcacttcccagtcagaagcctgttgacaagagatcccggtcagtgtcattttccaaggccagccctgtccactccaccagagaaacagcagaggcacagtgggagtggggaatgggtctgagagcgggcgggcaagggcaggctcggccccttggcggtaggcccgtcagagtcttccttctgccttcttgtaggacagtttctaaccagagttctggtaagcactggtgacatttcacattggcttaagcaataaggaaaagcagtcatctcacgtagcaacgtggcttggggaagggagtctccagtttcatgtattcggagcct

SEQ ID NO: 192359 - DNA, 448 bp, Homo sapiens
atcagccagaggcagcagcctccactgagcatgtgaactggccccaacacacgtcctccaggtgccactggtggctacctggagaggtgcagtttatggacgtgtgttcctgatactaagatttggcattggccaggcatggtgactcacaccagagatcccagcactttagcaggccaagacgggaggattgcttgaacccaggagtttgagaacagcctgggtaacatagcaagaccttgtctttgcaaaaaaataaaattagctgggtgtggtggcacacatctgtggtctcagctactgaggaggctgaggtgggaggatcacctgagcccaagaggtcatggctgcagtgagctatgatcatgcacttgcactccagcctggtggcagagtgggatcctatctcagaaaaacaacacagagttggctttgtaacgttaagagc

SEQ ID NO: 192360 - DNA, 201 bp, Homo sapiens
cagccagggagggaatctaggagaatgtagagggtgtggtgtcctccaagccaaccaagtaaagtctttcaggaaggaaggagtcttcaactgtgttacatgtggctgatgggtgaggtaaaatgagggctaagcattaactcgtgggtttaacaacataggctggtctgatgtaaaaagagagctgtgccaatcagattt

SEQ ID NO: 192361 - DNA, 235 bp, Homo sapiens
ttatacagtacgtaaaatttatcatatgtatcaatagcatcattagcaagccaaattctttcaaatggttatttgcattctcagctactgtgatgaaatatggagtattttattttattttattttgagatggagtctcactctgttgctcaggctagagtgccatggtacaatctcggctcactgcaacctccgactcccaggttcaagcaattctccttgcatcagcctcctg

SEQ ID NO: 192362 - DNA, 264 bp, Homo sapiens
tgggggagtcttccatgattaccctaagaatagggtaagcattcttcctccctgcttccatagaaagtaggaaactattgcacttacacattgtaatgtggctatagtatgatcaaaataattaaatctaaacaatactgtgtggattcaaatttttctcagctactcacaagctgctatccattttaccaagcctcctgcatgtattactatgtctaatcctcatatcaactcatatataaactagattttatgattatggct

SEQ ID NO: 192363 - DNA, 359 bp, Homo sapiens
cttcttttgcggccatggaagctggagaaaacagatcttccatccagatagccagggctctctctctatctataaaaggcctctgttttctctcttttggcataaagaaactcaattcctttgtttttaactgctcccatttctctgttctgtactgacttgattcctccttcctgaatgatctttgagtcttctgtgtactttttaggttgtaaaacaaagaaatcagtgaagacacacacaaatggaaaaacatgtcatgctcatggataggaagaattaatgtcattaaaatggctatactgcccaaagtaatttacagatgcaagttatccctattaaattaccagcggcattcc

SEQ ID NO: 192364 - DNA, 165 bp, Homo sapiens
ggagaaggagggagagagagagagagagggggagagagggagagggagaaggagggagagagagagagaccgtgaaaagtacagtcaggggatgctggcaagatagttcacctggggtggtcctgatggagaggagagaagtgtaaggcactgcctagtcaggga

SEQ ID NO: 192365 - DNA, 616 bp, Homo sapiens
cagggctaacttccagatgacgaaccaaggggatactgagccgaagaaggttttgtggaaagggagggaaataattaccttgacaggaagaactctcacagagattttcttcatagtggtgtggaaacacaggtagatgcaggtgagtcataccgaaccataatagttcaaggggcatgaatcaagcctttcatttagataccataaatgactaaatgtggttatgagtgtgccctgcaaattgaaggtgttttgccaatgtgggtgacagcgatgcctgccaagtcacattcatgaggacaataggtgttttacccattataacatgtgtaactgtgatgaaaacatgaaagacactgctaaccctgagctcccacagggaaatcatcctagcttactttccctatgactggttaggccaagttgatcgacccagtttcctttctgcattttctggaaggatgtttttttttttcccgggaactagtctaaaaagttaatttgtaaaggatcggtctatagtactggaaggctgacggcctgggtctaagggagactttataaaaagaagtcatatgttacctttggtaaatcctagccatcagtggcggggcat

SEQ ID NO: 192366 - DNA, 342 bp, Homo sapiens
tggtctcgagtagcggagaaacattttttgcaccaccgcgaccagccttagagcgcggcggcggcggccacggcaacatcagcccagccatcagccgagcagacgcccagcacccgggagcgcggcgagcttcggctcagcccggagttcacctccgagtgccccgggggctgagctcaccccttctgctctctcacacacgaacactctctttcactcacacacacacacgtattcacactctctcgcacacacataggaccctgggcgcaagcacccttctggcagcggtcgtccgctggtgcaatagtagctaggttcggttcctgcctccggcggccg

SEQ ID NO: 192367 - DNA, 313 bp, Homo sapiens
tggtctcgagtagcggagaaacattttttgcaccaccgcgaccagccttagagcgcggcggcggcggccacggcaacatcagcccagccatcagccgagcagacgcccagcacccgggagcgcggcgagcttcggctcagcccggagttcacctccgagtgccccgggggctgagctcaccccttctgctctctcacacacgaacactctctttcactcacacacacacacgtattcacactctctcgcacacacaacccacgcgcccacaacccacgcgaaacccacgcgcccacaacccacgcgcccacaa

SEQ ID NO: 192368 - DNA, 630 bp, Homo sapiens
tattgtccaaggtttctccccatgtgatagtctgaaatacagcctcatgggaaaggaaagacctgactgtcccccagcccgacacccgtaaagggtctgtgctgaggaggattagtaaaagaggaaggaaggcctctttgcagttgagataagaggaaggcgtctgtctcctgctcatccctgggcaatggaatgtctcggtgtaaagcccgattgtatattccatctactgagataggagaaaaccgccttaggactggaggtgggacatgctggcagcaatactgctctttaaggcattgagatgtttatgtatatgcacatcaaaagcacagcacttttttctttaccttgtttatgatgcagagacatttgttcacgtgtttacctgctgatcttctctccactattatcctattgtcctgccacatccccctctccggaaacgcccgataatgatcaataaatactaagggaactcagaggccagtgccggcatgggtcctccggcatgggtcctccgtatgcgttcagcatacggtcccctgggcccatttttctttctctgtactttgtctctgtgtctctttcttttccaagtctctccttccacctaacgagaaacgccca

SEQ ID NO: 192369 - DNA, 408 bp, Homo sapiens
taacataatctcaagtaaatcccatgttataatgaaacatcacccctaaacactccaatatatgtctttaaatgtcagaaaatgtttgtatatatcagtgagttttgattttcgtactccaaacttacttttggttcttttttttaaaaaacctcttcagtgcatttgactgcaactattttttccttaaagctctcttgcctgtctctattttctaattattttccctccttcctcctggccactcttttttggtctcattcgtatgttcttctcccctgatccctgctcctggacacacattttaattatgtgataaacctgagtttcctccttcaacatccatcttacagcagggcttagtataagaactatttgcagagcaataagaacttaaaaattgacaaa

SEQ ID NO: 192370 - DNA, 443 bp, Homo sapiens
gataagcacctcactggtcatgattttatgtgtgtatgtatatatgtatgtatgtatgtatgtatgtatgtatgtatgtacacatgtatttattctctgcatcatatgatagtcatggttctttatctggagttacctaaaccttcattcctgaagagcctgggctattacttgtcctgcctagattggtttgttgtaacttccaattgaccttaatcacagggtatggtagtactaagaggcaccctaggggatcttctgtattccagaagatcttccttgcctccactatggagtagtagtccaatttcccattggtagtctggatcagtcaccgcagccaacaccgtaactccctgcttagcctgttgactcagaggcatgaggaaccccaaggggccaagtggcatccttatcttctgcttgagtggaatcattgttgt

SEQ ID NO: 192371 - DNA, 292 bp, Homo sapiens
taaaagcgggaggcaaatggattactgactgtggtctcctgctttccttcagagaacacacaatcaaaaaagtactagatctggactatcatagagaaagatgagactttgtaagcatataaggagaatatggagaataaataaatgtagctaatagttgtaggttaatgtctctgtctcagtaccatcatagagaaagacaagacttggtaagcaaaaattcctatgaagagaatatggagaataaagtagctaatagtggaggttaatgtctctgtctcagttggactta

SEQ ID NO: 192372 - DNA, 738 bp, Homo sapiens
ttcctcaagtgattttaggcagaatgtgtcactgcccttcctgtgtaaaataactcttaaaaatcatacagctcttcatgttacgtgttgacatagtttacagcaatcctacttgattagcttttttatatggaaaacataatcatactgtgtgtagccaattttaagattgtgttattcaagagtcttatattgccatgtaaataccatctcaaaatgtgccctgttgtgagataaagaaaaacttaagagatttattctattaagctatagctttttatctagaaaaatggcaaatgagtagaatttccatatgcaaatttctattaaataaagatttaaagcatgtttcctggaacattttacttatagacaggaaatgtcttgtgaaggtattgtgagcacactgctttctgatcagtaaaatttgggaattaaaatattttccttttaagattatggtgagaattaaaatatatatttgcaaaagaattggcaaatgcagatattcaataaatgttagctcccctcccagacaagcttatataaatgtgtgtgctccgtaaatgaaattcaaagtttaaagtgtatttttagaaaacagtctacttagtgagccatctggggcttatatggcatctttctagtaacagttggctctcctttccaccactatcagtcagtggggtcacagaataataaacttgtctgtcagccatgaaacacaagctctcattc

SEQ ID NO: 192373 - DNA, 508 bp, Homo sapiens
gatggacaacaggagagagaagatgagaaagctagagactgttctagaagtccacatctactgaataagtgatccagaaatagtaaacaaggaaaacagtaaccatgtaattaccaggcagtaatatgaggaaatgttcaggattaaaggatgtgactctccagattaaaagggttcatcaaatgcatagcataatggttggagtaaaacacacatacacacacacacacgcacgcacacacacacccctccaaggcacatcattgtgaaatatcaaaatgttatttaaaatcaaagaaaggccaggcgtggtggaatcctgtctgtactaaaaataaaaaaaaattagctgggcgtggtggcgggcgcctgtagtcccagccactagggaggctgaggcaggagaatggcatgaaatcgagaccatcctggctaacacggtgaaacctcgtatctactaaaaatacaaaaaattagccaggcatggtggcgggcgcctgagtcccag

SEQ ID NO: 192374 - DNA, 286 bp, Homo sapiens
ctgggggtttatgtcctcaaacaatggagagaaagtagaaatcttcaggcaggaaagtgacaaaaacatgaggattcaagtaacaggaagagcctagtaacattataatcatctcaaaggcattattcagtgttatactatttacatgttgctcagtcaatttggtcctgataccaatacaaaagaaatttaagtatatattacaatctattccactctatgatatcagtagtctcagggctcagtcattagccctcttctttactccctagctgacctaaccagt

SEQ ID NO: 192375 - DNA, 346 bp, Homo sapiens
aacatgaagcgtgatgcaagcgtatgggaatatttgggcattaggatggactctgagggattgcctggcacggtgaggaagctgtgtaagctagtgtccagatggctctccaggtgtttgattctctgctaagtcagcatcttgcctggggtgaccaactcccaactgccctccttcacagtccctgagcaggatgtggacacagtccatccttgggcctggtgtttggaatggaagcatggcacgaacccacctacagaaaggtaatcaggtccctaatttcatagctgcctcctttgctttttcctaggtggtatgtttttccactaatatgattctggcctca

SEQ ID NO: 192376 - DNA, 436 bp, Homo sapiens
tagcatgtccaatggtcaactcaatagctcatagttcatacatccaagtctgatctccagatttcacttcccaaaccttctctactcagttttcctgattccagttgatggcaactccatccttccagttgctcgggacaaaaccttggagtcgtcattgaccctgtctttctctcacacctcacagccaatccctcgggcaatcctgttggttctactttcaaaatgcattcagaatcccaccattttcccccagcccctctactcccacgctggcctgagccaccgcatctctcatctaatcatggaaacagcctcctgactgttccctttctcctactctgggctcactgcagctgtttatagcatggccaccagagggatcctttggaaacacaagatcccatcacttctctgctggcatcttactcagaaa

SEQ ID NO: 192377 - DNA, 583 bp, Homo sapiens
ctgccaggttatgttatctactacttgattttaagtgctatctgtgggatttacatgtaaactgtaaattgatgttttctttttcttacctatacaacagaaaataaagggtttcagaatttttatatcactggatattctggcaatgaaatattaaatggctttaggagaaatgtgttttttacaggggaaaacaggacacattataaacctctccatcactctaatcaggcttctgacaagaaaataatagggctgcgcaggaacacgtctgttcccatcccaagcacggggctctaggtaaagacatagcacagacggttagttagcggaaagtggagaggtgccttttggagagatgtttgtttgaatatttgtatttgctttgcaaggctaagcagcaccctttggttaattttgagggtgttttggcatctgtcacctgaagtgtgtgactcacccagattctgactcaatagatggaaaaagactaacctgctcacaagatattcatttcatgggtgaggagttctgtgaattaccattttactctactctctaatgctctgaacatatttcacaa

SEQ ID NO: 192378 - DNA, 277 bp, Homo sapiens
ttcagctagaatatatcttggttgagaatgtatctgatgatcatacacagaggcctggacaggcctcaccccaggccacccatgacactgtaatagagtgatcttttctacttaaaacaaaatctgggcggatcatgaggtcaggagattgagaccacggtgaaaccccatctctactaaaaatacaaaaaaaaattagccgggcgtggtggcgggcgcctgtagtcccagctactgggaaggctgaggcaggagaatggtgtgaacccgagaggcg

SEQ ID NO: 192379 - DNA, 426 bp, Homo sapiens
aacacaatccccgtatggggtgtaattacatcttagctttctgcagaagaatagtttatggcttaaatgctattaattgtaagccgttttgttccatgggaagttgttcattgataactacccaattagggttattttgcaattagtctattcacagtaaatttattgcaaatgggggagtctgtggtgtagcaaattaaagcgtcgctgaggctgggtgtgcaatggcttttaaatgccaatcttattaaccagctcacaggtcctgggagggtgcgctatcctggccagtgcactaaaggcctcaggacaaactccggcaaactcacactgcaaagccatccggagataacctcagcatgaccaggagaagtgcaggaacccctggcctaagatgctgaggttctgatttttttgaacaactgt

SEQ ID NO: 192380 - DNA, 521 bp, Homo sapiens
gtgttggacgacggtaagtcactgcaaaccagaactgctagagaagttcatagatctgagcctgccacagattatttctacattaacacatgcagctcgcatgttgcctgtggtttctatgcagacatctacactcaaatttttaaatgctgtgtattatgttttttaaattgctgcagcacaaatgaccacaaattcagtggcttcaacagcatccgtttatgagctcatagttctgtaggctggaggtctgagcagggcacggctggcttttctgcttagggcagcacaaggctgcaatcaaaatgttgactggtgggttctcatctggtgcttgggatctgcattcccgttgtttccttacggctgcaggactgaggtcctgtgtccctgctggctgtcagccagggactgcgttcagctcctgggggcaacatgtagtccttgccacatgacctcttccattgtgaaagccggcaatgattggccaggcacggtggctcacgcctgtaatcccagca

SEQ ID NO: 192381 - DNA, 367 bp, Homo sapiens
tatgtgtttatctgtgtgttctgtgactatgtgtgtatatatgcatatagacttgaggaagaggtaaaaccaaagatgtgggggtatgatatttaaatctaaagagagaagcaggtgctatatggtagaaaactaaatgctgagaggtttggacatcattttataggatttaggcaaagatgtgctgtgatgatatttttaagtattacttcagcagtggcaaggaagaaggaatagcagggacaaatctagaggaagagagtcaagttaggagttacagtaacccaggtgagagatgaagagaatctaaagtcacataatggggtatcctaataatactatcgctgttctatagctactctcataa

SEQ ID NO: 192382 - DNA, 341 bp, Homo sapiens
agaagacaaatccgggtctgcaaaggaaagaggtttccaatgtgtttgaagcctgtggtgtgaattggctgagaagcaggagaagggggaagaaatcagagaaaaatgtacactctttcaattgaagaagagaaatgggagctagaaaggaaacaagccagggatgaggggttgttgtgtttctggtttctttggcccagagaagattcatgtaaattcagctatgtccccatttggccctgcagtcaactgccttcttggcagaaaggaaaaaaaaaatcatgagactaattgaatgatgcccagagacagccagaaacgaacccccttgaacagctgca

SEQ ID NO: 192383 - DNA, 246 bp, Homo sapiens
aagaaagaaagagagaaatcagcggtaaggtaagcaggacccagaggagctgatattcacagttcttacatggacaactctttcaggaattatccataaagtactttattttacaacctgcttttcttgtaaaactaaaggtgcacttttttacataaaagttttatacagtgttaaaaccagaactgtgtgtaaaatactgcatgtaaatgtttctaaatagtcttgttccattggttcatcggt

SEQ ID NO: 192384 - DNA, 383 bp, Homo sapiens
tagctgggactacaggcgtgcgctaccacacccggataattttttgtattttcagtagagatggggtttcaccatgttggccaggctggtctcgagcttgtgacctcatgatccgcccgcctcggcctcccaaagtgctgggattacaggcgtgaaccaccgcgtccggccagctcttttcttttagttatgttgctatgattatttcagatgtgcttcctgggtctgtcctttggaatgtgtgatagggacactccccaaagaagggaacagggtgggtaggcactccaagtgtctatagaaaatatcacacttctacagttttttaaactttagagaacactctcatacattattttatgcagacgtctcaaggaaggact

SEQ ID NO: 192385 - DNA, 560 bp, Homo sapiens
tcagggaaattatacaggctgggactagaagcagatatgaatcagaggaggagtccatggaaaaggagtagaggaagaagactcttgttcttgttaatagcgtcctgggcagctttgcgtccttaaagtgaggaagggacttaatgtggatttctgtagcccaagagaagctactcaaggtggggccagtttcaggctgatacccagaattctggggttcatatggcccaggaggaaggccctttggcccagtccagaggtccacttcctccaggtagcctcaccaggactcccttcatccagtgttgttctctctttggcgtcttcaccttccaaacacacacatttcagaatcttctactttaactgtgcacgatgcgtacatatatgtgtatatgaaaactttcccgtgcatgaggttggagactataagcttggagttggtctccccatgagatggagagggaatttcagagggtgctgtcttcttttggtctgacctgttctgtagcacagtgggccctggacaggtgttggtgacccaggagattgccctgcct

SEQ ID NO: 192386 - DNA, 216 bp, Homo sapiens
tttttctttaattacttgaacatggaatcactttattttgtgagctaaacaacaataattccaataacttttcttatgaataactttgtttttttcctctaaataaagcccccaaagatggcctctgaattaatcagttatgggccttatgtatgtgaaggatccaaaattattgaaaagtaattgctagctaggtgcagtggtttatgcttgtaa

SEQ ID NO: 192387 - DNA, 1070 bp, Homo sapiens
tatgcaggtcaagtattaatttctagttcctcaacttccgtaagtactctttccctaaaattgatctggatgttatatttgcaatactctagttcttcttacccatctcccttttaaagatcacccttctctcactgtacaaaagaaaggttcccaaacacatatctagcagccttcctcatctatatcagttgttcaggccaataaccttggagcaaccttcactgttcttgtttactcacacctcatatctaaaccatcaggaattcctactgctattatcttcaaaatacatccagaatccaatcacttctcatcactgctatacccagatccactaggacttcatcagctgactaatctggtattagtacaaggacagatccttacacacttaccatctattctcaacacagcaatcagagtgatccatacagataatgtccctcaaaactctaaaatgactccctgtttttctcagataaaaaaggaaaagcccttacaatgacctgaaaggacctacagagagatactactacctagtaaccctttgacttcgtttcctactcctctccccaactcactcactctgctgtagacacattggcttttttgttgttgttttgtttttactattcttgaatatgttctctactagcgtaaggccttagcattgactattcctcagatggaatgctctttctcccagatagtctcatggcaaactatttcatcttggttcaagtctttgctcaatcattatcttctgaataatgccaacctggaccactctagttaaactgacaccccaaaacccttaccttctccacactgctggcattctcaaatctacttatactagtttatcccttcccccgcctcccataacacttaacaccatctaacacaccatgcaatatatttatttactgtggttgtagtttgtgcatccctcctctaatactaagtttcacaggcaaagatttctatgtaccttgctaactgaatacctcaagggtcaagaagagagctgcccagaatcttagcattgcgcaaatgctccagtgtgt

SEQ ID NO: 192388 - DNA, 487 bp, Homo sapiens
gcagcctgttccctggaggcctggtcagtggggcctcatctatggtgccaggcaatggggtcatgatcagtggaacctggtcagtgaggccctggtcagtaagaacctggtcagtgaggccctggtcagtaaggtcctggtcagtggggtcctggacactgttggcctagcagcaagggcctggttagtggggcctggtcatggggttctaatcagtgagagtgtggtcagggaggacctgatttcctccatcctgtccagcaggatgggctggacagtgggacagcctgtgtgcacattttgtggcaagtaggagtgacacaccatccctgggaggcaccatggttcctgccaaacccaaccccagaactctgtccctgaggtggttttaccaaaacccaaaacccagaattgtgcttgtggctcaggggtcagcacctgctagtaccaggacactactgggaggctgggacctgaccgaagccca

SEQ ID NO: 192389 - DNA, 225 bp, Homo sapiens
gttggaatgcctgtgcctctctgttgactgccttttccctcctgggttctacttctctggtctctcacgccaggcatcccctaagtctttctttcccatcagaactttcctcctttcacactgaggtgcaaatggttgataacagttgagagtgacagttcctgagagctttctctgtactaccgttttaagataattgtttataatagaaaatgtcaatcatgt

SEQ ID NO: 192390 - DNA, 563 bp, Homo sapiens
ggaggtggctattggggacaacaacagaaggagtcttatggcaggtgccagattcttcaaggctggggcttagctgaaagagccttccctgggcaaaccattcctgaggccccctctgtggccaaccctgccctccaagggcccctggtccagcaggtgggacagacacagaaaaacacaaccagactatcagctgctaccataagccacggccacaagacatgtctgtgacagcacacagcacactaatcctgaggccaaaactatgaccagctccatccggctgctgagcaaagggaggctcagagaggtgaagccacttgtctggtcactcaggaaggaccgcagaagcagaatgacagaagggaaggggggcaggcaagggagccaggcacggcttcccagaggaggactcttcactcagacacagaaggtcacaatcagagactctctgaatgccaggtttggaaggggatgttctgctcacccttcacgcaccctgctagctccccagtcctgttctcattcacccctcctcccagctgtcccctcagccatcagcc

SEQ ID NO: 192391 - DNA, 615 bp, Homo sapiens
gtactggtatgcaaatatagaatgacctgatggttcctgaacgtgttatttagctggtccaataaccttcattcacgccttcctccctgtcaccatgagatcgaaatttctctatactctggcatcccaacaatttggtattactcgtctgtcccctcaaagggaacatgccacctgtcaggtccagggtgtatctttcttcacagtattctaacccctgtaacataaaatacacgcaaatattaatctgattctaggcaaaaagtcactctaaaattaaatattctccaaatttaaagattgttcacacaatacaaagaaaacaatttagactgaagagaaccaatcatggaaaaaggctctaaaattttacatactttaaaacaaataaaaagtgagatttagtctctcaaaaataattaccaacaagtcttctaaagttatttaacacagaagccctcatgcactactggttggtatgtaaactggaataaccatcaaaattatatatgcatatatctcagaccagcaatactatacctgtgttctcacagaaattcttgctctagaatagttcttagacttttagcttattgatacctttaagaatctgac

SEQ ID NO: 192392 - DNA, 278 bp, Homo sapiens
tttattgtttagttatcatagcatctggagagcaagaaatatctagtatctcatatagaactgaataaattccgttaattactattccgattttctgaactgccaggagtatgaaatctagaaaataacacctgtcataaattttaaatccagccttcacatgacatatttcaagtactttaactaaccttcattcacgccttcctccctgtcaccatgagatcgaaatttctctatactctccagattgctatgtataactaaaaaattttttaaaa

SEQ ID NO: 192393 - DNA, 245 bp, Homo sapiens
ccactatcctagactagaaacaacaaggtgaagttttacagaggaaagactccactaccttgagaaaaggaaagaaaaaaagagacgtgagtgaaactcaaaaaattaaacacatttaagagacaaaccaacagaaaagaatagtaatgacaaacttccttcctctacgaattcaccaatagcatgaagtactaaagaaaataagttatgaaattagaccaatgtgggtttaaattctggctcta

SEQ ID NO: 192394 - DNA, 494 bp, Homo sapiens
tacatggcaactggcttgccccagagtgagtgatcagatgacagagtgaccaagaaagaagccacagtgtcttttataacctaatcttgtatgttacatatgattacttctgtcatattctattggtcacacagacaaaccctggtaccatatgggagaggggatttacaagtgcatgaatatcagtacatggacagcattggggatggatcatcctggaggctggttaccacactggcttgtagaaaatttcctcagaataaccatttcttcaagaaataccaacaaatatgtggcccctaaaatactagagttcccaaccctatctgggttggagcctgaacgaggacagtccaaagagcaggggcttcaaaaactgctgagagtctgaagattttatttcaattctgcatgagcatgcttttttcttcaaagccccacttcctctaggcctggcctcattatttcattcagccaattaactcaacttgtaa

SEQ ID NO: 192395 - DNA, 626 bp, Homo sapiens
agttggaatacccagatgtgcttagctgagggaccagtgctgcctgccttcatccaaagttgtctgtgggaaaggggacaacaatggtgccgaggtgtccgtctagtctgtccagcaggacttgtggcatcagaaaatctggcctttgttatacttggagcatcaaagtagacacagccactgaaccaggcaggactgaaagcagcagaaagagggcaaagtcacggtagcagctggctggttcgccccaatgctgctgaaacaggatgaactcgaccccatggctgagtacacactgtgaatccaacagcatctctgcatctccactgctcagcgcacagcttggccaggaggaagcgagactcgggacaagttgttgagtttaactgaagtttcattctgaagccttctgtgtgggcagggccactctcccctcccttggggcacagtacagatgcttgtcggaaagccatttgtcctagcaaaccttggaccccacactccttccgtcgttttccctgggcaccttgagccaaggggctgccaggactcagagcgcaggcctggggtcttcctgggaaagcagggagagggaggcagggcggggaaaagcatgctcaccaagc

SEQ ID NO: 192396 - DNA, 455 bp, Homo sapiens
catattaaaggtgaatgcagcaagctccacacaggctgcctggaagggacgcgggacaagggtaggttttccctgtgatggacaggagacaggcggccctcccacagccctgcctggcaaagcagatgtgtccccaaaaggcactgggggcagctggagtgctgtgcggaggcgggctcacccgggccctgggtttgctctgattgcagcggtttcccgccagctccttggagagctggcagatgacccagccccacagcaggagctgtgaatggcagaacgagatacaacaatttgatatccacttgccagatgagccgggtgtcgtcagtcgcctggctctgcgccaacctctttttgcacaaacacttatgaattcagccaggaggaaaagcactctgattatgaattgagcagaaggaaacaaagttctgcgaataaacaccaatgagaca

SEQ ID NO: 192397 - DNA, 114 bp, Homo sapiens
ttcccccggaagcatccttggagctccaggttggactaagtgctcctttgctgtacttttaaagtgctctgccaacattctattctctcattcttcctattaccttgaaatgac

SEQ ID NO: 192398 - DNA, 667 bp, Homo sapiens
agtacgtacacacacacacacacacacacacacacacacacacacccctacacacctgacccagctactggcaatgggtgcaactgagtttacctgatgtaaaatgcaggatcgctttccctcccgaaagtttatatgtaggattatcacctccaattaagggtcagtgttagtctatttaaacttttgccttcgtgtccctactacatagaatcatgactgcaactctagggaggaatatcagtcgaatataaaaatccaagcagacttcctagggctcagcaaagaacattacttgcaatttttctctttcccaatttctccttttccagaattctttgttagaattttggagaaggtatcatggattctgtaataattacagaagaagaaaagatataaggtgaagtaaggacaacagtgcaataaaaaaagatggataaaagtggcaggatttgaggataaaataatggctggagagatcaggttattaaaacaaacaagtgaaatggacagaaaaaaggaagaagaccctttggctgaggggaaggaaaaggttaacacgacatgaaaatcaagatttaataaaaattaatccttgaaaacaccatcactgatttaaaatcaatttgaaatagtgaaatagcaaagcagaacaaaataaatc

SEQ ID NO: 192399 - DNA, 216 bp, Homo sapiens
caaggggctgaagcattctgagcctcactttcctgctctgcaaaataggattcatggtcactaacatgaggctgaagtaggaattggcaaggcctgagaggctcaaaaaatgaagatgaacatgaacttaaatgggaaaataacagcacaaagtcattcatcaaagcagtgatgggaatcatagcagacacagtgaatcccttcaaacacctcatg

SEQ ID NO: 192400 - DNA, 318 bp, Homo sapiens
tgaaacggagtcttattctgttacccaggtcgcgagtgcagtggtgtgtgcctgtggtcccagctactcaggaagctgcagtgggaggacctcagcagtggccctgatgacaccactgcattccagtctgggcaacaaagcaagaccttgtctcaaaaaataaaataaaataatgtagaggggaaaggaaagtgggggaggtatagctaaatcaaaactggccatatgtgtggtggctcacgaaccattctttagcacagcatactggagaagccatgggcaaatacttagtaatctcttactttagaaggagggaag

SEQ ID NO: 192401 - DNA, 281 bp, Homo sapiens
tcacacttgcaatcctagcattttaggaggctaaggtgggaggattgcttgaacccaggagttcaagacctgcttgggcaacacagggagactctgtctcccccaaaaatagctagatatggtggcatgtgtctgtggtcgagctactcaagagactgaagtgagaaggatcccttgaacatgagagaccaaggctgcagtgagccttcatcacaacattgcactgtggcctgagtgagagagcaagactttgtcaaaagagagagagagaagaaaaaaat

SEQ ID NO: 192402 - DNA, 158 bp, Homo sapiens
attgagttttttcactgtgaggtgggacaggcctaaatttctccccttaggcctgccattcactgagggtgtgcagtcatcatgctaagttctctttcttgctccattttcatcttcactcaccccttactttctgcaaagcgttgatggtgttgggt

SEQ ID NO: 192403 - DNA, 385 bp, Homo sapiens
agaaaaattcatatattgaattttggctcttaaaagaacagaaagggctggtcttaactacagcaagtttatcttgcaaagatgcccaattttatggagccctgaaagtcgctgaggaatgctactcctaggctgtgaaagaagtggaagcccaggatttaaacaggtgcaacttgtttgtagcaatttttcttgctagtctcatgattattggggctccttttcttccttcaacagttttgttctttaagaggccttcccaaaacagtctcaaatttctcagatatatagtgaaaggtgaggcacatctgggaaaataagcagaggacagctttcagcagcattcattctgtgatgacattcttccccttattcaggtaattta

SEQ ID NO: 192404 - DNA, 149 bp, Homo sapiens
catagagaagaagggagacgtcttctggttgggatatcagccacaaatgtgttggatcctgagatatgaaaaggatttcgagtaggggaggctgaacgggtggaaatgagaagaaacagggcactccgggcagctagaatcaggttagc

SEQ ID NO: 192405 - DNA, 736 bp, Homo sapiens
tctggggtctggaggttggtggccatctgcgtgggggctccaagcccatattttccttccacatttccctagtagaggttttccaagaggatctgcctctgcatcaggcttctgcctggaaacagtgggagttgggggtggggggcaaatccttcaccaatggttaaacaccatctttttgatgctgaccttgtgagttctcatgagatctgcttgtataatagggcatggcacctctttcctctctctgtctttctcctactcctgccacgtgaatcatctcattgccccttgacattctggtatgattgggaggcttcctgagtcctcccagattcagaagccagtatgtttccttacagcctgcagaatcatgaggttctttatgatcatagagaaaattagtactgggaagtggatgtatgagatgtcttcaaggccttttccctattgtcttgggagtcggtactcggcttcttttcattcaagtatctgagggcttcttgaattttctccctgaaaatggacttgtcttcctttaccacattgccaggctgtgacaaagatagctgataatgtagaagcaggttcagaagggggtggcagacagagatcaggagagtttggagggcttcgaagacaggaaaatgaagaaaagtttggatctttgtaaagaattgttaactacttgtgatcagaaggctgacaggaaaatggccagtgaaaaccagacttg

SEQ ID NO: 192406 - DNA, 389 bp, Homo sapiens
gcctagtccacaggccatgatgctgcttcaatcatctacacttccatagcacctaggtgaatgtttatgctctatatgtaagatggatttaaaaatctgtgtaattggtatgactcatagatgccaaccctacttactgcttctaacccactcatccacaatgaagccacaactaaatggatatgacagtctcaggcttataaacaagaccatctaaggagcatacagattcaacaaaaattatcttgtagtaacatctttttcattacatgtaattctcaagggagcagatactggcccaaataagaaaacactgaaaatactaacttctgtgtgccctggaacatttatatcgattaagtgaaaggtagaggaagcaatgggaggca

SEQ ID NO: 192407 - DNA, 244 bp, Homo sapiens
gtttaccatgttgtatacttttttaaaaaaggtaaattaaaacataatttcaaaataaagtaatgaagctgatagaaaagaaaatattttcactgatttgtaaatgggttcataaacaactacattaatgaaaatacagtggatcctagaggtaaggactgtactcgagagcaacacgaaaggaaaaggggaccatgaccatcaaaaaaaaatttttggctgggtacggtggctcacacctgtt

SEQ ID NO: 192408 - DNA, 587 bp, Homo sapiens
tttgagcagaaattcgaaggaagttaggcatcaagctgttttaagtgcagaagccctgacgcaaaagtgtgcttgctgtattccatgaacaggagtgttcagaggtaagatggtgaccttctagactattagggatactttgtttttgacctttgttctgaatgagatgagatcactgagcagaggagtggtgatatatggtatgacttcccttctaggatctttctggccgctgtgctgagaatgggttgtaggagggtaaggattgaagcaggaaaagcagttggaggctgttacggtagagcaggagagagatgaggtgatttacctgcatcttggtgatagttgggaagtttgctaagttgcatacaggctggttggtgtatagtcagtcacccttcagccctctttgacttaatcctttattccagttccctgaaactgctctgccaaggtcatccataatggtgggttgccaaaccagtggatattcagaccacatcttactgcatctcttaccagagttatccacgtaatttatcctctttcttggatcccagcctgttggcttctgtaatctcataatc

SEQ ID NO: 192409 - DNA, 323 bp, Homo sapiens
ggacagagcctttacagttagtgatatataggactctactaaatgacagaagcagcaaaaatactgcaaaaagacatgcgtttttactctagagaatagttcctaaaagttcaagtgtcaatttaaagctaaggtagatagaaggtgagacattgttaattgtagctatatacttaagccctgttcaggcttttatctgctggtgacacattttgcttgttgtgctttgttctagtctatgataataaactataatatttctaaatcctaagcttccttattcctggctgggaaaacaaagctgcttctgtttcctgtgttca

SEQ ID NO: 192410 - DNA, 499 bp, Homo sapiens
ggctgatctttgtcctgtgggtattgggagccccgaagggtttcaggcagggactgggtattggggtggaggtgacagaatcagatctgcgtttttgagccatcactctgggtgttgactagaaggtagattggagttgcttccaccagctgccatagctgaggttaaaaaccggtggctggcaagacccaaaggaatacttatagtataaatccattcataccacgtttataagcaggcacagctcatctgtagcacttagagaccataggacagtgactatgtcaagaggtgggagagcattgccactgagaaggacggggcggcaggggatggccctctggggcaaagcaatgtcccctcctgacctggaaagtggctacatggatactcactctattcaccaagttggatgtttatgttttatacacaggaagaatgttctgtttcaccttagcatagcaacatttccagtactttccacccaacaaagactcta

SEQ ID NO: 192411 - DNA, 305 bp, Homo sapiens
gcagcacctcttagacatgggcgtgggggagctctgtctgcctgaggctgaattttctgcctgccctgccatagaggtacaggcaggattatattaatttaaaggaaataaacacaaatgcccaagtctatgcacagatttatgccataaaacaaaggaattagccttcattgaatgtctaatagccaatatttattgattcctccttatgtgccaggcactggctagctcatttaaccatcatagtggtcctgtgaggtagatgctcttgtctccataacatgatagacacattgaggtgaagt

SEQ ID NO: 192412 - DNA, 526 bp, Homo sapiens
gaacctacttccattactatggcattatcattgatgagggtagagccctcatagcctaatcacctcttttaatggcctcaactcttaatactaccacactggcaattaaatttcaatatgcgttgtggaggagacatttagaccacagtaaagaatgagcaaacacttgataggggctagcatgatgtgagagggatgtaaggagtctgatctcaatggaataaagtgttaattactgggaatggtggcagataaatttgtattagtagggtagagctagattatgaaaggtgtattggtgtcaggttgaatttaatctgctaagcaataaagaagccagtagaggttgatagggagcaagatgcgcgcatcttgctcccatcagggttggggtgagtgtgtcagatatttattgagctggaactcagcagaagttggacaacaatcaggtcgactacgtggtttatccactgatctagtgtcaatgcatgagagagtaactattagcactacacctgatggtaac

SEQ ID NO: 192413 - DNA, 637 bp, Homo sapiens
agactgggaagaaccagaacatggcactggcatctggcagggccgtcatgctatgtcatcccatggtgtaaggtagaagagcaagagagggtgagagaacaagaacagagagggcagaacttgctttttatcaggaacctacttccattactatggcattatcattgatgagggtagagccctcatagcctaatcacctcttttaatggcctcaactcttaatactaccacactggcaattaaatttcaatatgcgttgtggaggagacatttagaccacagtaaagaatgagcaaacacttgataggggctagcatgatgtgagagggatgtaaggagtctgatctcaatggaataaagtgttaattactgggaatggtggcagataaatttgtattagtagggtagagctagattatgaaaggtgtattggtgtcaggttgaatttaatctgctaagcaataaagaagccagtagaggttgatagggagcaggagaaaacatgagagtgtttttcagaaagattactcgttcaatagtgtgcagcatattttggggatgacacttgaggtttgtttgaaaaattagagaccaagccactgaggtaaggagctattctgagagacgttaggatgga

SEQ ID NO: 192414 - DNA, 165 bp, Homo sapiens
ctgtttatcccagtggcataccctgtatgaaatttcttaagagattatattaatgctacatttatggttttcaaaaatatttaaaagttgaaatctggctgagcatggtggtgcatgcctgtaatgccaacactttgagaggccaaggcaggaggatcccttgag

SEQ ID NO: 192415 - DNA, 254 bp, Homo sapiens
gtgagcacttattgctagtactattttgtatttgagcacataatgcacttgtgtagcttagattattaccaatttcatgtctctgtcctttttttttctctgaaactataagccttcttcatccattcacataatacttattaaggccttttgccaaaaacagaatcatgatgaagacaaataaaagtctctgccttcctagagagtatcaccgagcagggaaggaggcatgaggactgtgggggaaaagtata

SEQ ID NO: 192416 - DNA, 307 bp, Homo sapiens
ggttaggaaagagaatattcttgttcttagaaaatacacactgaagtatgaaggaaaacggcaccatgatgtgtgcaacctgctctcaaatggcttaggaataatacctgtgcatgtcagtacatagtgtgtgattgtgtgtatgtgtgacagagacagagagagaaagcagctatggccaaataacaattggtgaatctggttaaggaggaatcaagagttccaggtactattctagaaacttttctaagtttgaaattatttcaaactacaaccttttcaaaatctataaaagaaagttaagagt

SEQ ID NO: 192417 - DNA, 207 bp, Homo sapiens
tacacacccaccagaatgtctaaaataaaagatgaaaaatagtaagtgttgagggcacagaactgaaattctcatatgctgctgtaagagtacaaaatgatacaatcacacaggaaagctaaatgcatataagcataccctctgtcccaacaattccactccttaattatacactcaacagaaataaatacatatgttcacaacaat

SEQ ID NO: 192418 - DNA, 578 bp, Homo sapiens
gccaaaggattccttgggaacttgtaaaaggtagagtggggtgggtgacaatgaacatgtacttgtgggtttgttttctgggaatagtggaacctaaacttctacatctgaaaggaaaatagattaacctttttaaagtttattactgaatttttaggcctcgtgttttggacatgtgagtacaagccagtggtacagtgccagtcatttactgcgggcacctgagattgctactgatctacatcacatcagcaagccaatagttggcattagactatgtaaaaaaacaaaatccaggccgggtgcggtggctcacgcctgtagtcctagcactttgggaagctgaggtgggcagattgcttgagcccaggacttcaagaccagcctgcgcaacatggcaaaacctggtctctataaaaaatacaaaaattagctgagcatggtagcgtgtgccttggtcccagctgcttgagaggctgaggtgggagcttgagcctgggaggttgaggctgcagtaagctgtgatcatgccactgcactcttgtctggttgacagaaccagaccctttctccaaaaa

SEQ ID NO: 192419 - DNA, 737 bp, Homo sapiens
aaagccaccagtgccgcaggtcccccatggatggaatccctggggcaaaaggtccttttggcaagagtgaggaagtcaagggtgaacatccactaaccagaaaaagggaccgtcccctgcccacccccacaaccatggtgggtgcctggctaatgcctggtgctccctggagggactgctggcaggagggcaggaaaagacactccctagaatcagggagggccagtgcccaaagggggccccatcagcacctaacccatcagctcctaatgacctcagatccaacagtccacctttaaaataaatattttctaatgccaccccgatattgccaggaaataaaattcacagatactagaaactttcagtatacccacccccaatataattccttctaactgttaaggtgcagacaaactagaagaaggacattgtttacaacacaaccgtctgcatctccatgtgaaatgctcatacctacacagatggagtgaccgtgaatgtgaagaccactagtgccgaataagctggcgaccccctcccaccagccctgctgcttaacagtgaagtggagaaaagctcttggaaaagttccagattaaaagccagcactggagagtgctgcccttaggacactgtagaacaaccctccactgacagcaatcagaacactacacaacagaaacaataacgaatcccccccatcacacacacacagcgaccgacctgagggttct

SEQ ID NO: 192420 - DNA, 266 bp, Homo sapiens
tgtgctccgaccaccttgggtacagatcctcaggagctccagaggctgtcacaggcacatcctcaatcttggcaaaataatctaaattaaccgagacctgtctcagatatttggggttcacaggctcaagcacagcagcaaggaaccccccacccaaccatcccctgcaggtggcgagtgtgcgtcctggaggagggagggcagcttggtcctgggcactcaggagtgtggccgactgggagacggggaagctgagccttctggcc

SEQ ID NO: 192421 - DNA, 362 bp, Homo sapiens
tacttagcatctactccatgactgaattaagagatagatggggaatagattaagaagccactacagaattgcaaaaaataaaataaaataaagtgagttaaaatgtcagggtaatataggaaaatacattgggaaatgaaaaaacactccatgtgactgtttcacggaaatgaatgaccctcttcctcttctgtttctttcttaggtaaagactagggcagaattctatacccaaggttcagacctattgaggctatttatgaatagactttggtggtgtttgctgatcaaaaactctttgaaatgtataaaaaaacttgtatacacgtgtatttgcattttttctaggaataggatctgtc

SEQ ID NO: 192422 - DNA, 443 bp, Homo sapiens
gcctgggtgacagagcaagactccatctcggaaaataaataaataataaataaatattggatcggtgaatattggatgttagaaacaaaaccaggacttggtttggccaggacaaatcagaaccttaaatgtttcatcttaaatgactcctttctttccttttctcctaagtgacctaccctaacttctatataggtagaatttggtctcctattttgccacctaggggcttgcttaaagtgagatttgattaataggaatgttctactgaaaacgcgagagcaaaagccttcaaccctctatggggcccaaccttcctgaaagataagtttgtctatactgggaaccctacgaccaacaggttgccattcttcttggcctaccagattaaattctgttcaatttgttttctatttattgagttcctgcaatgtgctgaggct

SEQ ID NO: 192423 - DNA, 614 bp, Homo sapiens
aagatacaaataggggcaagggcagaacttaacttgggacctgtttagatagtgcagttgctgaaggcctctttgagtaagagatgttttaccaagtctgagggatggaaaaaagccaagagaatttcaagcacaaggcaccatggtaaaaagagctgaaggtgttcaagggactgaaaatacattgtgtgactcaggggaattggcaggagatgagatcagcaagggaggccaggggctgggtcaggccatggtgcagaacaggaaacctggaatgatttaggcaggagagtgataagacttgatttatgttttaaaaagattactttagctgctgtgggcagaatacactagagggaggtggagtggcggcagtagaaatgagaagatcaaacatgtcagttaataagtgagtactgtaatttcaactcttaagttgaacttactaagttaactaatcatttacaagttggaatatatgattgtgtatgtgttgatgtgtgtaaaagactggaaagaaacataaagatttgccaatgattgtgatgatggtgctgtggttatatgggagaatgtcctttatttttcaaagagattcagttaaggtctcatga

SEQ ID NO: 192424 - DNA, 613 bp, Homo sapiens
  misc_feature (556)..(556): n is a, c, g, or t
  misc_feature (563)..(563): n is a, c, g, or t
taagaaaaagaaaggggtggattattctcgtgaccagaggctgctcatcattcaggcctcaactacagtagcctctcttggagaggccttcactgacagcccatctaaaagttgctcactaacacagcgccctatctgatcttccaagcagtcatcatgatctgaaatgacctcgtctagtcctgttgccagaaggctcaggaggtctctggatactggtgacaccccagccccagccagtttccaggttcttgacaccttggagagaaagaattcaagaatgagttgaatgaagcaaagggcaagaaggtttttttttgttgtttgttgtttttgttttttttgagacaggatctcagtctgtcacccaggctggagtacagaggcgcaatcatggctcactgcagtcttgatctcccgggctcgggtgattcccgccacctcagcttcctgagcagctgggactagtaccacaccggctaagtttttggggttttttttgtttttgtaagaagcctggggcaacacaaatggaagaccccgtctttactaaaanatacaanaaattagccgggcatggcgaacgtggcacatgtaaatcccagctactcgg

SEQ ID NO: 192425 - DNA, 182 bp, Homo sapiens
aggcacgggagtggaaataaaatgtagcagaaaaaacctcaagggagagtgcacctctgcctatttgtattaagtagtgcatgtgtggatggtgacacacggtactcctgggatagtttgtgctgcttcattccctctccttgccacacaggatcctaatcgagtgtccactcccgtaccag

SEQ ID NO: 192426 - DNA, 396 bp, Homo sapiens
tgtgcttttggaaggcacatatgggaattatatataaaataatagcacgacctacattaatcagtggtagagaagggcaaaatcaaagttgcacctgcagcagcaaacatacagacataaaattatttctagcaattctcagtcttagtttcataattgttcttaccgactttagttcctattagttagctggtaatagtttgttgtagaatatgttaactgggtagactgaccatggtactaaatgaataacttaaatttgatctttatgacttacatgctttgctatatgcactttattttgaaacaaaaacttctgcttttttatgctagaaaggaaaaggtaagttttgttacactaaaatgaaaaacttccagtgtcaaggaaaaatacaa

SEQ ID NO: 192427 - DNA, 365 bp, Homo sapiens
agggcactcacaggatcctgctgtgcagatgcaggatccgcagtggggacaggatggataggactgtagagcttgtttgatgcagagattctaggcaggaatgtgaaagcctcaggtgttaagtttcactgtttttactaacactggatattaacaatttaaaacacctttgacatattttcatttgtatttcatgtcttgatggttaagagttgagctgttgagcctagttctattgttgactggctttctgctgaaaagctaacaggttaaatggtttgttaaatccagaaccttcgaggtaggcccacattatcacattaaactcacaagtgtggatcacaagtgaaggagtattgcacaga

SEQ ID NO: 192428 - DNA, 223 bp, Homo sapiens
cctggactcctatagaatctggtctaaggagctgatgaacaataaattaaaaatactttaagatgtcattttcatctattaaaatggaaaaaaatacaaatgtttcacagctcacagtattaacagtatgttcccatattgccataatctgcaaagattggaaaactccatgtccctcattagggacttgggtatatctctatagagcagtaatatgcagcca

SEQ ID NO: 192429 - DNA, 491 bp, Homo sapiens
cttgtaacacttccccagcaggagcaaacaataaaacactgagaagtacaaaggtaatacttccctcacaagtcaagatagcaaggaaggcatctggtacagagaagaactacctttacaatgatagggcagtttacgccaagacagtgatggacctaagcatgacctatcagattttgctttaaagaagaggataggttctcctttctccttaaatctatgttaatcactgaataacaaaagataataatatattaaaagctggtgaatgcggttgtccacaaaactttttaataagtaggtgaaggccaatttgtgtctagccacaaatgtacaaaacaagtgaatgcttactggcaactgttaattttttagaaataaaaggctaaaaaataaaaacaaaggaaaaaggggtaaagtcacaatgctatgtaagtaattaccttcaaacaaatccataaaactctggccaagcacttgtgtatgggtaa

SEQ ID NO: 192430 - DNA, 172 bp, Homo sapiens
tcacccccaccattaccgctgccaaaagtataagtagaaagaaaataagcaaaggcctgaagtggtgcacccaagcataaggtttcagtctctcgttctgaactggatgggctggtttggaagcaaagagtggctacttctctgcacaaaatacaccctaatggtagggatt

SEQ ID NO: 192431 - DNA, 326 bp, Homo sapiens
catcgagctcggtaccagtctgtctaccataagcagtaatttctaggaaatacaatgcagacctccatcttaaagctcccttgtgttggagtgtacaggctctggaaatgaagacggaaatggggaatcaactgttttctacatgccccccaactcaaagatcctgacaactttacaagcagaactcaccagttttctccacatcttcctatttcttttcttgcccagtagttcgatcctgggctcacccaggagggaagaatctgaactcagcaaatctactttattcactagggaacttttagacaatcctccaacccaaataa

SEQ ID NO: 192432 - DNA, 392 bp, Homo sapiens
atgtttgggtggggagaaacataaatttggcctatgtgcatgtccaggcatagtaccatcccttaaacttaattatgatatagattcttttgctcacatgttttttgttgaccttctccttatcatcaccctgctctcctactacattccttttttgctaaaataatgaaaataataatcaataaaaactgagggaactcagaggccgatgccggtgcaggtccttggtgtgctgagtgccggtcccctgggcccactgttgtttctctatactttgtctctgtgtcttatttcttttctcagtctctcatcccacccgactagaaatacccacaagtgtggaggggcaggccaccccttcaggggagcagaggcgggagaatgtcagacca

SEQ ID NO: 192433 - DNA, 333 bp, Homo sapiens
gaaagtgtttataagatttcaaggtgatgggctggacacagttgctcatgcctaataatctgcacgcctgtaatcccagctattcgggagcctgaggcaggagaatcacttgaacccaggaggcagaggttgcagtgggccgagatagtgccattgcactctagcctgggcgacaaaggtgaaactccatctcaaataaaaaaaaagatttcaaggtgatgggtttcatgtggaccaattttatccttccctgatgataatttgacatatgagtcagatattttcctaattttcgtaattcgagtgggtagtcacggactgggtagtcacaga

SEQ ID NO: 192434 - DNA, 315 bp, Homo sapiens
tggactgccttcactccattctcaacatagtaaccagagtgatcctttcactcatggtgtatcatgacactccttcctttgaagttctccggtagttcttcaattcacacagaataaagggcaaagaccttacagtggcctttccttcttcctcttttatttcctggacctcatttcctaatgctctctcccttaattcccttcgcttcctcttaggaacctttgagtttattaatccctcttcttcaagacgcttcctcagatatcttctgggcctgcttcctcactttctttggttttttacctaaatattgc

SEQ ID NO: 192435 - DNA, 317 bp, Homo sapiens
tacacacttttcctacacaaattcctaatacttacatagagctcactgtgtaccaggcaataatctagggattttacatatattacctcatttaacccttaccaccattctacaaggtaggtgctattgtacctattttactggtatggaaaccaaggcacagaaaggttaggaaacttcatggattcatagtccatgctctttaaccactaaggctctaaatctaaccgccatctctgaatttttatcaactgctgtctttccccaataaacaaggcttctgtatctggttttccatgattcatctgattttccgt

SEQ ID NO: 192436 - DNA, 551 bp, Homo sapiens
cctggcggcagggacctgaattggtttgtagttatgcttgtgcgcgtcctcataaccccagtctcgccctagcgctgtcccctttcctctccctccagcttttcctggactttttcacctgagggtcctgcagtaatggcaggtggcctgcccagaaccatgcccttacctgcttcttctccccattttgtttaaaggcagtgacagctaccagttactcaggcttgaggctttatccctgaattctgcctcgccctcgccttcctcatggggttcttacgggtctgagcctctggatgctctctcagatttctgctgtggatgaagggactcagctgctcgctgcaggtcacctgacctccctcatgccgtcacccatccactctgacgggtgggtcatatgcagaagcttctcagcacctggccaagttgtagctgatggtctgtccgaaaatgctggttcactctccactggccaactgtctgtctgcactgcactgccagttgcctcttgcctgggccattgcgctaacatctccactactgttcca

SEQ ID NO: 192437 - DNA, 496 bp, Homo sapiens
acttcttcatcttatgccctggagaaacacagaccaaagcaaaatttgactcaggttgtaactcaatgataaacttctgtctagagtagaataagctttattttgtataagacaaaaatagaacctgaggtacaaagagagctctcagatctgtaggtaaaattgttgggttcatgcataactcacagggcactacatactacccttttcttttgcatagaagaatgaacctcagagaggccaggtgtggtgacttacacctgtaatcccagcactttgggataccaaggctggtagatcaggttggagacgaccctggccaatatggggaatccccgtctctgctaaaaatgcaaaaatcagtcaggagtggtggcacatgcctataatcccagccactcaggagactgggcaggagaatcgcttgaaccctgatgttgccgttagctgagattgagccaattctcttcagcctgagcaataaagcaagacctat

SEQ ID NO: 192438 - DNA, 337 bp, Homo sapiens
tattgagagcttaatgtgtcctcaccaagatcatgttggttgagtgttgttattatactcattttacagaacaaaatagatcatcgtggatggatatgaaaaggtctccaagacacatcatttcatgggaggatgggggaagcaagttgcaaatctacagatgcagtctgacatgaatgacgtgaaaacccagcaacacataaaacaatgtcgatattttctgtgggcacatagatatgtctataaagtcttctcaagttaaaaacacaaaaggtatttaaaagaaaaaaaatcacaagattaccaggcttaccaacattacatttgttctttcatg

SEQ ID NO: 192439 - DNA, 384 bp, Homo sapiens
tctctggctagctatttgggaaaaagtaacatgaatgcctctctcataggttataccattgactcaatcaacaaatatttgctgatcacctattttaagcattgagaaaaacttagaataaaaaaatctttgccctcctaagacaattcgttaagcagtacagtttcatatgggtattttcctatatgtatgttaagcctccatttaaaagttaaaataaaaagcctgacttcatggatcttacattctagtggtgagatatagacactaaacaaaaaagtaaaatatacagtgtacgtgcagtgctatggagaaaacaaaaagcaggcagtactgagatgtgggttgtgattttaaattaagtggtcagggaaagtcttactg

SEQ ID NO: 192440 - DNA, 444 bp, Homo sapiens
tcctgaatgcagcctgctgaggcacaagaattgcttaaacctgggaggcagaggttgttatgagctgagattgcaccaccgcactccagcctggtcaacagagtgagaccctgtctcaacacagaacaaaacatactgagaccccgtctctacaaaaaaatacaaatattactcaggcacagtggggcaaacctgaggtcccaactgcttgagaggctgaggcaggagaatcagttgaacccaggaggttgaggctacagtgagccaagaccgcatcactgcactccaacctgggtgacagagcgagaccctgtctcaaaaaaagaaaggaagaaaaagatctttcctgctttcttgctaaggcaacacagagcccatccctaatcctttttccatgccaggactataatagagagaaggtgtcaccgaaaactagtgcctttt

SEQ ID NO: 192441 - DNA, 403 bp, Homo sapiens
cagcaaaagtgatactttaatgtctttaataaggagaaggtaacaaggaaactcacatttactatgtaaaaactaatagactacatactttacattaattttaattctgacaaaagcctctgaagtaggcattattccattttacagatgaggaaactgagctttatcatgcttaaaagtatgtattgctgtcttggggaaaaaggcaggatatgactactaaataatgaggttaactgcctaggaggctcatacactataaattcaccttgaaaattatttatgggcctcaaatttatgttcctgggaaagaggagcaaaagattaaatcatttttattagttcagtgacaattctaaaaatgaaacccagaaatgtactcactcctaaccactccaataat

SEQ ID NO: 192442 - DNA, 218 bp, Homo sapiens
tcacagaggaagtgtaacagtgatttattcattcaataatttttaaattatggataaaaccatatatctaggatttaatagggaaggggaatgagtgtgagtatggataaaatgagaatggccatttgataattatagagtgatgacgatagatctagacaaatagatctacctaagaaaagcttttgttgaaagagctaagcgttggtagctttgta

SEQ ID NO: 192443 - DNA, 438 bp, Homo sapiens
catgagatttgggcagggacacaaatccaaaccatgtcagtattccatatttcattctttactgaagtcaaagttgaaaacagaatacaaggtggaagctcccaagaatgaaaggacagactggtgatttctcagagcatgttagaatccttcatttaaactcaaatattctagcatccaaaaatgaatttggatgtgtagcatcattaattcactatgaagtaatagtgcatatatcatcacccaacattaaaagatatgtaggttctgcttactggcgttgtctttaagataaatcaccttttctgccttcaagaagctctatagagtaattaagcaaaaagataattgtaattaagtgccacggtagatgaaccaagagaggtataatggtaatgagaggaaggaatacctaagactgcctagatcacttagagg

SEQ ID NO: 192444 - DNA, 192 bp, Homo sapiens
ttcagagagaggagaccggagggagaaagtccttgtaaggatggctctgatttgcagtactcctgggccagccccaccacccagagacagacaagttatcctgtaactgtgtcccaaacacaggggcaccgtgacttgttttgtgggattaaatgaaagtaggctatttcctcatgcagtggactgcatttt

SEQ ID NO: 192445 - DNA, 378 bp, Homo sapiens
tcgtcttttgataggactgttcccctgtttttcattgacaggactgtctttctcacttaaggagcctggacacaggttccttctacacttctctatgtaagttgtgtgtattgccttttcctttccttaagcacctccaacacctgctttgctccaggctcccagggaaggagtcagagtcaggagtctaataggcacctaagtgtatccactttgcctgctctctggctgtcaggtgactgtccaaatcggtagctcttgtgtgcccaggttctattaacacttccttcctctatctgacaatgctttgtgcctccctgtgccaagaattgccttcattgacattgtcactacctatcaaaagacgatagaccatag

SEQ ID NO: 192446 - DNA, 541 bp, Homo sapiens
agttgctcccacttttcctcacgctatggaaatcccagcccatcagtgggactatgtaccaggggcaccttttgattaaaaggctggggcaaaatgaatctggcctgaagtccttggaagaaggaggaggaggccaggtaacaagtaattgaaacaattcctacagcagcttggtcagagattttaatggttatcaaattatgtccctaccttttaatttcttgtaatctgttccaaaaaggcaagaaataagatcagaaatacggagcaatatttatgcacaaagatgtcccctgcagtgttgtttataatagccccaatgggaacaacctaaatagccaatcgttagagaatgacttaagcaaattatggtaaaatattacatggccataaaaattctacttacaaagcaaaataagattcttgatgttggggaaaatacctatgacaaaatgttaaggaaaaaaaaactttttaaaagcagactggaattctctgtatgcattatgagatcatgtgtaaaaaagaaaaatcacaggga

SEQ ID NO: 192447 - DNA, 624 bp, Homo sapiens
ggctgatgctgggtagcaaaccctgtgaggcaggcggttccactcttgtttagcaggtcctgctttcttaagaaccttgagcagctgaaccgggattggaacccctttctaccacagctgctttgcatagtagctggtactgggaaagccctcgccccaggtgggtgactgcacgcaggcctcagggagcatggcttctatttcccatcattattaagaattggggccatagtggtgagtattagagagccctgtcccctcctctttgctttctgtcccctctcccgatggttcttcctgcccccacccccgggccagccccacagcagatgccctgggactgggaggaaacatgtgctccccctcctctctgggcccatgcaccatggccattatagccccagcctcagaagttggtcctggctgagaccagaaacctgttgtgtgtttagtcacctgcaccccagacgaacgtgctgagtaacatgttctggggactgcataaaccacctgtagtagcggccggccagcattagcaaaggccggagaagcccgagtgcccagtggcagggtgagtgacgggcgtgcttgagttggtgccgtcgccacaggtgttgataaata

SEQ ID NO: 192448 - DNA, 443 bp, Homo sapiens
aaccttcaacaaccagtccaggaaggcaacctactatgtccagtaaccagtccaagaaatcagattactatatttagcaaccagtccaggaagccaagcaataacccttgtagcaatctaccccaaatggccaggacgtgattaataacttacagcttctgtaagttttgtcagggcttccaactcaaggccagctagagagagccaaatatctacccacccctaaataattacataggatgccctgcttttagttagcccacctgcagcttctccatgccaacagccttgaattggcatacctgaagctttcccttttttccactctaaagctttctcactcctctgcctgccgttgagtctctgacaaatgcaagtgatgatggctgactcccttgctattgtaagctccaaataaatttggctttgcttgttctcattta

SEQ ID NO: 192449 - DNA, 491 bp, Homo sapiens
agaaagaaaagtctgatcccctctcccccaccacttctttagatgcctgaaaacttaagcctggcacccctgacaagccaaattgatctggaaagcctcttcagagaggccagttgcattaaaagaacaaataaaggactctccttgcaaaggagacaaggaagacaaaggggaactcaggggtggggcccttccccatctcggcagcccctgtaggtgaagacagggaggcagggcagtccctgcgtgagctgctcatgccacattatctgctttgtggtagaactcaaaccacagccttgaataaaaagccatagcagggaccaaaatgaggaagagaggttttcagcaccaacaagatggagaggctgacaggcaggcacagctccccgggtcagtgaattaacaccagcccgctcctccaggcagagacccggctacgagttatgcagccttcagggtccccaagcaactgggtcttcgggtcgttt

SEQ ID NO: 192450 - DNA, 417 bp, Homo sapiens
gggattacaggcatgagccaccatgcccagccatgtgggtgtcttgtagactctgtgtttttagattctttgattccacaagcactaagctgtctaagttattatagctttataataagtcttatctcattgtggaacccttcctacttgtctcttcttcaagagtaccttggctgttcttgaccttttgcagatcaatatatgttttagaattacttgtcaacttctaaaataattcttccagatgttgtttgggattacattgaaggtctacatctattcgtggagaactggattattatagatctctgaatatttttgtacaaggctttgtatgggtgtagactttcatatctcttgggaatggttggactaggactggaatggctgaatcatatggtaggtgtatgtttaact

SEQ ID NO: 192451 - DNA, 524 bp, Homo sapiens
atcaattcatacattatttacttcccaaaaaagtgtgaatggttatgtacacttttgctataaaattaagagtcctaaaaggtagtgtttattgcagatggcagtgaggggtggaacacaggtctggcatcagacacctttaccctgattatgacagtactttcttctgaaggggagctgggtatccatctgttaggtggatttttaagtaggtggggtatgtgtgttattatctgatgtatataggctttgaggcaggagaggagagttaaagcactgacaggcaaaaactgtggtaaattaccattctcatttaaaggcagcttcctacttaatcaatgtacacttaggggttggggcaagtcacatgtttggaaaaggcatcaaaagggttaggacgaggacaactgcagcaataaatgctgccaattaaaacatatggtgtgactgggaaagggtatacaaagacttttagaagcttctggggtgatagcagtattttatttcttgatggaggtggtgat

SEQ ID NO: 192452 - DNA, 431 bp, Homo sapiens
tttccctcctcatcccattgacattcttaagatggaaggaaaaaggcctattttttagcttgattaaaacttaatagctgaagtaaccaaaacattcataaaatgaggagattgaaactgcttacagatataatttttctctggagcatcctaaatatttattccttggtaatttttttttaaagtatgtatattagtactactagccattagtaaattttagttatagctttcctccctttcacttaaatttcctggaacatgaattggaaaatttttaaaatttagaatctgtcttgaattttttgaggtgacagctaggtagacattaaaagtagatagaatttttaaatcttgaaaatagaaattatattaaaaatgttctttgtcacctgtatctggaagtttgaaaggtcgttgttacacattca

SEQ ID NO: 192453 - DNA, 343 bp, Homo sapiens
tgatagatctagaggatcccgagatgcttccctaccagggatcagggagaggagggactccgtcctcagcttcagtcactggagcagtggatggtccaggagctccttggaagccactctgggcccaggaagactgtgccccaccccagggtctatgggactcccagggacccaggccgcaagtgctctttcctggcagtttagcccgggtctgcccagacaaggatttcaggcccaggcctgagtatccatttctcagtctcactggcctgacacctctggccaccctcccaggcccccttgttctgggccatctcccccgaccctcccaggcctcgtcacc

SEQ ID NO: 192454 - DNA, 456 bp, Homo sapiens
ctcggacccacattactgagtcccctgagcccaagatcacctgagcccaggaggtcaaggctgtagtgagctgtgatcgtgccactgcactccagcctgggtgacagaatgagacctgtctcaaaaaaataaataaataaaaataaacaaggccttactctgtattggctatttccaagaaagtagagaatcccagccaagaatgtctagggcatcataaatatttcctcaagaaactatcaacattttagaaccgggaaacatgacagtgttgattacagcaatgcttctcttttaactcaagtgttgcttggtatacattgtaatttacttcagaattcctatattatattcagcagatagagggtagcctagaagagtatactgattaggggctggtgatactttaaataagtctcttcttgtttttctgaaatcataaatggcaatattcat

SEQ ID NO: 192455 - DNA, 593 bp, Homo sapiens
caactggaaacaccctaaataccccccaccaggggcctgctgcataaagcacggggcatccacactacgcaagccccacagcagctaataagaagtagggagatgtacccgctgaggtgagaagctctctgaggtctaatactaaatggaaaaaaagcaagttgcagaatgatagatccaatatggtatcattcattttttaatcaaaaatcaatataacattgtttctgtggatacacataacactatatttcactgaacgtaagacaccgtggatggtaaaatgcaccattattttacagaccactgaaaaagaaaaacaaaacccactgtcaattaaaccatgacaagccactagttgaaagatgcacctcaatttcagaaatgttaaaatgtgtcttagaatctatgaaatacagtattacgtaaaggtgtaggagaaggtctggaatcaagaaagccaaaatggtaataacagtagttaacaagggggtggggacagcctgaagcctatctttgaaatttttacaaacagaatacatttatggccagacgcagtagctcatgcctctaatcccaacactttgggaggc

SEQ ID NO: 192456 - DNA, 239 bp, Homo sapiens
gatcgctggaagccaccagaagtgggaagacaaaaggaaggatttttccctggagctttcagagggagcatggccccacggacaccttgatcttggactttaagcatccagaactgagatggaatacatgtctgcgttttgagtcatccagttttggtactttgttatggcagctccagggaacttaatacagattgtgaaccagataaaataagtccatcactcagaggctgcaaaca

SEQ ID NO: 192457 - DNA, 566 bp, Homo sapiens
gagtaacagatgcatgaatcaatggaacagaatagaggacccagaaacagatccacaaacaaatggtgctctagcaattggacatccacagaccaaacaaataaaattaacaaatcgaccccaaagcctcaacctaaacctcagacctgatatgaaaatgaattcaaaatggatcgtagacttaaatgtaaaatgtgaagctattaaaacttttagaagaaaacaagagaaaatcttcaccaccaaaaacataatctagaagataatatatataagttgaactttaaaatttgctctgcaaaaagtgctgttagagaattaagaaaaaactacagcctgagaaaaaatatttgcaaaccgtctatccaacataggactcatatctagagaatataaacaactcttaaagcttagcagctaaaaaacagtttaattagaaaatggtggcctggcatggtggctcacacctgtaatcccatcacttcgggaggctaaggtggatgaaccacttgaggccaggggttcaagaccagcctacccaacatggtgaaaccctatctctacta

SEQ ID NO: 192458 - DNA, 267 bp, Homo sapiens
tcagtatcacgggaacttgttagaaatgcaaattctccagcaactagacctactgaggcagaaactctagggctggggcccagcaacctgggtttcagtaagcccttcaggtgactctgatgcacatccaagggtaagaaatgtttgcacacagcaccaggagagaagaacagcaatgttcccaacagcacttctttagagaaaccacaaactggaaactctgatgtccttcaacagtggaaaggataattattttatatcagaata

SEQ ID NO: 192459 - DNA, 123 bp, Homo sapiens
ctgctggaagcatctgttgcagagatgtagagaaagaaaagtaatatgtcatcttaactggctaaaagagaatggtatgttagtctattccttggcacagattgttatacaatcccaaatatt

SEQ ID NO: 192460 - DNA, 337 bp, Homo sapiens
agaagttttcttctcctcttgcaatgtctgtctccttcaagctcctttgctttcctgtgtattttggacactgtctttcctggtgcaggcttccctcaatgccatttgttgctagctgtctaattctatttaagaatgaggcactgaacacctgactgagacctctgtgggaagcagtgcctcgctgtggaatgactgggcatcactgcattgtggtcaggtactcccatgcaactgtaccttcacatccctcctgcaggtggttcaaggtacccgaagaaggctattccaaggtcttagctgtgggtgaaggcctggccacgttctgagatggtgg

SEQ ID NO: 192461 - DNA, 500 bp, Homo sapiens
tcagggctgtatatgacaaatttttttttacagtctttctgggtgtgaaatcaggaaaaaaacaaatggacgaaaggacagttttcttagaaggtgctaattaatttgacgataccagttttccgggaagaaatgtcccgatgatctgtgcagcatcttgactgggctttctgaggagttggagttctttttcagcagtcgcacaggtacattccttctgttgatacacaatgcttgtacaaactcacagcttaactttgtaataacacaggagtccctgacccccagtgttgtctaccaaatgttgtgtttacgtccgtttgtgactggggagaagggccttaggtgttacttgatactcagaagtctcctctccgaaagattaagaaccaccacagtgaaccagtatgttcagttttcaaactcaagcagagacagttaggagcaataaaatcagtaggttacagactttaaaaatgaaatacactcacagcttacac

SEQ ID NO: 192462 - DNA, 413 bp, Homo sapiens
tgacctcagttgatccgcccaccttggcctcccaaagtgctgaatttataggcatgagccaccatgcccggcctgacatcgggagtcttggtagagaactctggtgttcactgtgtggctctcccagcaaaaaacaggtgtgttcgtttcttctcgtgatctgtcatttgaacgtgggcaccgttgactgaactcagcagcacattgccaggtagaatttgtgaaggacgtacgttcattttggggtaggcgtggggaatatcaaattcatggaagcaatatgatcagaaccctgaaagctgttcttttaagtcgaaagatgtggtagatgttaagtaaagcaaattggatcgctgaaggaagtggatgaaatgtgttaataaggacaggtgaggagaaagctgtcactcatg

SEQ ID NO: 192463 - DNA, 243 bp, Homo sapiens
tcctgacaactgtggagctaagaagttggagacacatggctagggaaattgccatctagcaaccgaagccaaccttcaaaaattctaacacagactaagaatcaaagactacatgtacattacgatgctaaagagggactaagaatccactgccatgctgcataccatcagtgctccactggctttcaggtcccctatactctcagggctgctgatcattacccatgcgttctaaccacataa

SEQ ID NO: 192464 - DNA, 326 bp, Homo sapiens
cgggtttatggaaaggccaagaagtggtaaaatcatagattttcatacaaaatgaatgggcaattcaacttaagaggtttggtttgcttcattcctcatgcctgtgcttttaaaaagttagtaatgacaatagaaaactctgatctaaatctcctttagaccctgactctataactgcattctatgctcattttcataagataaaaccagtgtctgaaattcagtttcaagagaaataactccatctctccaacccctgtaagttaaaaaaaaaaaaaaaaaaaaaaaaaacagcaaaaaaaaaactcccttctggatttactttc

SEQ ID NO: 192465 - DNA, 285 bp, Homo sapiens
aaaatccagttgatttcccaactccaggaagtctcttttgcattttccaacttgcaatttaacccaggaacctactgtgtgtactgtctgttccactgattgaacagctttttaccaaaatgtgtctattatgggtgtcattttaactcaattgtaagattcattcagacagcactagatatgtgatgtgtgtatgtgtatgcgtgtgtatgttacacagctactagtcaacagtacttaaatacgtaacataatttccatttactgctgatagcctcgaatagc

SEQ ID NO: 192466 - DNA, 222 bp, Homo sapiens
ctgtgtctttatttccctgaaggccatcgagattatcttacacttaagcctattaagtggaacaaaagagcagattggaggaatagagagagagaggatggtcccatcggcgtaaaaaccagacatcaacgcacacagacagaggaagaggtcggagagaggacagtatcccaagtgtatggggattacttctgaagaccaggattacagatgcggaatata

SEQ ID NO: 192467 - DNA, 926 bp, Homo sapiens
acagctttaaaattcttctggatgacatgagtctagtgtactatttctcctctcaagacaactatttaaagtagatttcaacattctcttgaaggagatggcagttactgaaatatttaaagtagtggattagatttctgttctagaaaactaatttaggcagcaagaaatcattttaaagttccagaaagagaatactataaacttccaggttttcttttccccactaactaactgcaacactctactttttttccctcctctctggagaatttctggtcaaatctttaaggttcagcgtaagctcaacttaaggcttttcagcaccatctgcctcttagatacctctttttgcacacctactataatttatttataggtctccctcactagacaagtattacctgttcttatttgtttttgtagccctagcatgaagcagtgacggcccataaaaaggctgctacgtgaatgaatcaatctgaaaaactggctcatcttttagtgctatagttaaaatggcccaataaggagaattcccaataaagagattccctagcaggtgaatttggtgaattcatcaatatgaatgtaaatatcatggaaatctgaagccattatgcaaaacaaacgtttttatggttggttagagtgagttaggaggaccccaacgtaagtgcaatattatgttttggacaatttgtcttgctcaaaaatattttgtatttttgaatataatactatattcaatgttaatgtaacttgacaatgttaagaactcttttgcaattttcccaaatgcattgctttatctcagaccttctgccactcagaatgtcctatagcctactcacctctaccgcacacaacacaccttccccatcgactttaacttgtccttcaaaactcaacctcggccaggtgtg

SEQ ID NO: 192468 - DNA, 207 bp, Homo sapiens
gcagaaggaccagactctaagaacaaggaggtccctgaaccatcttcctaatttggttctgaatcaaggggcatcccctaacaaaccttccaaggaaagataaggtatccacccttggtttgactggtgcctgagtggagctgctgtgggaaggttccctcgccaagcccatccccatctccccagcacgctggggagggccggaat

SEQ ID NO: 192469 - DNA, 837 bp, Homo sapiens
gagcaggcagagaaaatgcgtcgtctatgaaccagggagtgcatccccaccacacactgaatctgccatgatcttgaacctccagccttcagaactgtgagtgataaatgtctctagtttataaattacccaactgaaggtattttattttagcagctccctactcagagaggctgtggcaggagaatcgcttgaacatgggaggcggaggttgcagtgacctgagatcacaccactgcactccggcctgggcgacacagcaagactccgtctcaaaacaacaacaacaacggttggatcaagaatgaaaggtgcacgaaggcagtgatgaatggaagccccttccaccctgggctctggaactgcacaggccaccttctaaggttgctctcctgtcatcctcccaagtctacacggatataaagaaacacactagaggtctctgatgcgatgggggcatctccagaaatccgaagattcaggttctcaacctctgatctgggtgggggtggggagctgcaattccagaaagcaaaggaagccttggctgtgattcagaccatttcttggtatcaagcgtgtaggggaagaaggatgtggacaagggaaagagaaggaatgaatgcggtcaggacgctggctggagaatgtctgggatggtgacgtgcagagaggagcaggctggctgcgtctctcactgtgcctgggacaggcggtgacagaggaaagggattccacatgagagtcagagacacccaatgaagaaaaaaaagcagcttacagggtgaaaaggacacagacacagacacgcagaagaatgtggccaagggatcgcca

SEQ ID NO: 192470 - DNA, 235 bp, Homo sapiens
tgcaatcccactcctgatcagcacgggagttttaacctgttttaatgggagtttctgacttgagccggttcacccctcattagacaatctggtggtcccctgcacccaggaagtaaactgtattgtagacacctgaatgacatagcaaaccacagcccacaactcctgggctcaagggatcctcccaccttagcctcctgagtagctggaactacaggcacatgccaccataccc

SEQ ID NO: 192471 - DNA, 443 bp, Homo sapiens
acacaacacacacagaggctattcagtatctaaatggggactcatttttgatatgggagtacccacatagggtctaggaattcataccacctcttcctttgcattcctggagacctttgctgctctgtctgctggaggttacacaagttcatcatcacagagtccaggatgtcccacccttggtttttcttcctactcttttcccacttgtcccaagcaatcctgcttatcttgcctattagaactattccccaccaatgcattagggctaaatggaaaaggaagggctggcagcctcccagagactgaaataacctcaagaatggacatttaattctgataatgcctcagaattcatatatgtgccaataagataaaaagaatcaaaaatgatttacacccacttatctccatttgctcacctctcaatcactcctcaacct

SEQ ID NO: 192472 - DNA, 611 bp, Homo sapiens
cttttgctaagttagctgaagacttcagaacagatcctggcctggcagggctatgccatctggctccatgctgagccccaggcccttgacaatttccctcatcctggggctccctgcccttcctcccacgcacccgtggcctccagggaagctcccaagtcccttcccaaaccccctgtacctgcagctcacactccttgtgccctctcctgcagccccattgcagggatcaagggctggccagcagccaggggcagcatgggccagacctctcaggacctgcaggcccctctggtcttctgccattatttgagatctatgcaggccacgtctgttactggtggcactgaccaagctattcacgaggaaggggacgtccttcacgttcagagggaggcctagccaggggcctcctcgccaggccttatcttgctaagctgtagccatatcctggggacctgccaggggcaccgcacatccctgctccgggctgtaacctcctgctgtttgcagagctcacaaggatggttaccacggccaccaggtgcaagaggcgttcttcatattcagaaggattcgagggaactgaccgtcctccctccaccccactg

SEQ ID NO: 192473 - DNA, 201 bp, Homo sapiens
aggaaaggcccatatgggccactctagtccacttagcacctttgtacaatcagaaaattacacctctgcttcaagattttacttcctttagttagagaaatgttgtaatatactgattagattagctcaagacatggtagccttctctgccactgtcattacaaaaatgcacccatgatacctatgatataaatggaaccc

SEQ ID NO: 192474 - DNA, 359 bp, Homo sapiens
ttgtctcagtgaaagacactaccagacaaatctagtcaggtttttgagccagaaaccttgacttcttcctttctcctcctccctttcaattcatcagctctacttagttcctcatcttgaacatctttccagtttgtcacgttctgttcattcccagtcaccaactgcattcaggacactgtcaatgttttcctacattgcttcactagtccactaactggcatctgtccagctctttcctcacaatgcaaccagaagcatcttcctaataagagagatcaaacctgaccacctgaatcaaatatttaatggcttccaattgccttcaagataaacaccctaaatgaacctgccaaccc

SEQ ID NO: 192475 - DNA, 435 bp, Homo sapiens
gttaagtattcagaaagagaataaaaatgattttcctaaagaccaatgcaagattattttcattaattagacctgggggatacattagccaacaagaaataacgcacataatcccaatctgagtcaactacactcagcaactgagccttatcctaggtcctggagtcaggaactgctcccctgaatctcacatcctgatatccaactgcctcctgggcacctccacctagatgtatccatcataagcacctcagacaagtccaaacttgtcttcctttaaaactctgttcctctctctggcccccctgttcagtgaaaggcatcaaccacccaagccaaaaacctggcactctttccatggctccttcctcctctttgactatacccacatacaacctgtcataaatcctgtcttttctaccccctcaaaagtag

SEQ ID NO: 192476 - DNA, 193 bp, Homo sapiens
catttcgaggcagaggaattggaggtggttgagggctatgcctgtatcacaagtgatatatccaaatgaaagcaaatctcagcctggattcaggcatacatagaaatgtgagttagcaggcatgcacaaaaccatcactcagcatgtccaataggcccaatgaagtcctgtcctctttcctgatgggagggta

SEQ ID NO: 192477 - DNA, 582 bp, Homo sapiens
gaatggctgagatgaatgcgtgttggaaggaaattagagagagaacaagaaagaacattcaagtaatggagctgatgctatgggtttagtgtctgtctgccagtttccggttgagtgaagccaaaactaaacccatagccacctggttatttactttccctgtttacatatctcctctattcactagaggctgttttaaaactgttctacgctctttaaactttctattattatgtttaaactttctcagtctgagttgagagagagaatgagcaaacgtttattgagttcttacgaaatgttaagagccagtctaagcacttttaataaatttacttattcaattatcacagtaattgtatgaattgattactctggtggtttgttgttgttgtttgtttgtttgttttttgagataggaacatttgataggaagaaacattcaaactatacctgggagtaaaaacacccctgactgagttccactgtttacacactcttcatccctttaattagtgtctacactacaatccataactaagcattttcatgtttataacgtcaacctaagcctgagtctca

SEQ ID NO: 192478 - DNA, 635 bp, Homo sapiens
cagtttcacagtctgtggtcaaagaaaacattggccaattattccagaatagatgtgcatagctaaagcttattcaaccctttgtaatatcattttattggaaagatgaatctcttcaacagcagaagaaaattagattgcaactagtattcatttctacatcagagccccaggctggagctatattaagccactaaatggtctgcagaaaattgaaggagcatgcactttgatctcaaaggactgcctacgtcacatatgacaggcatttataagagaagagatgtcctcctgggacctaatgctgaacagcagaaacaagatgtgagatcctgaggatgcagagacatttaaaaaacaacacagcccccaagataacattaccaataatgatacttgaaatgactgacaagtaagtttagaagtcttaatagaaattccagcgtttgtgggattttctgcggattgtaagaaaatcccatcctacataggcacagggatgtctgctcttgagtaggaagagtaatagaggttgagaacacatacctaccctctccttaaaatcctcctggctcctcccagtttatcagttccatctttgttttctcagactgcactatccactgacaaagaac

SEQ ID NO: 192479 - DNA, 793 bp, Homo sapiens
ggattacaggcgtgagccatcgcgcctgcccttactttcccattcttaacgcctcccgtttcagacctgtccccttttccccgcatttctgactgtcacggcacatcacaaccagcagacagggcttcccctatttcacaggagaaatagaagccatcagatgggacctccttcaaagtcctgccaccaaacctcagcatgtacctggacccacatgtatcctcttttcctttgggattgaattagagaggtgccgctcgaaacccgctcctgggtgggagtcttggctctatcagttatgcctctattctgtatgtttaacctcgccctcgtaggggcataaaacagcatttaaacaggatcaagctttccattttaaaactccatacactcccttaatttcatctcctcctccacctactgccccatgtctctccctcttcgtggctaaacgtctcaaaaaagtggatacactttctgtcaactcctaaacactcctcacgctcatttggcctctgctcctcccttcctcctcccacttcattggaactacttctgccaaagaggatccctgagtcatcctgactggtaaccccaatggactctactcaatatgcaacatccttcacttcttagcagagtttgaaacagcctgactctcctcttctggcaacattcttttccttggtttggggacgctgtactgttctggttttgcccctccctccgagcaccccctcctgtgttcagccctttatgtcggcattccttgtgtttgtcctggcccattttc

SEQ ID NO: 192480 - DNA, 579 bp, Homo sapiens
ggattacaggcgtgagccatcgcgcctgcccttactttcccattcttaacgcctcccgtttcagacctgtccccttttccccgcatttctgactgtcacggcacatcacaaccagcagacagggcttcccctatttcacaggagaaatagaagccatcagatgggacctccttcaaagtcctgccaccaaacctcagcatgtacctggacccacatgtatcctcttttcctttgggattgaattagagaggtgccgctcgaaacccgctcctgggtgggagtcttggctctatcagttatgcctctattctgtatgtttaacctcgccctcgtaggggcataaaacagcatttaaacaggatcaagctttccattttaaaactccatacactcccttaatttcatctcctcctccacctactgccccatgtctctccctcttcgtggctaaacgtctcaaaaaagtggatacatgtgggtccaggtacatgctgaggttcggtggcaggagtgcgaaggaggtcccagctggatggcttctaattcctcctgtgaaataggggaagccctgtgtgcggg

SEQ ID NO: 192481 - DNA, 578 bp, Homo sapiens
tgcgaacgtggcgctggagagtggcgctgcgagtggcgcggagcatgtgtgcgggcgcacccttcacgcggccctgtcacccgccgcgccctgcccgccgaggccctggcaggtggggggtgggcgctgttcggacgctgcgcgcgggaccacctctgctctcggtgcgtaaattcacagagaaacatgaatggatggcaacagaaaatgatattggaacactgggagtcagcagttttgcacaggaaacgttgggagatattgtttactgtagtctgcctgaagttgggacaaaagaacaaacaagatgagtttggtgctttggaaagtgtgaaagctgctagtgaactctattctcctttatcaggagaagtaacttaaattaatgaagctcttggagaaaatccaggacttgtaaacaaatcttgttatgaagatggttggctgatcaagatgacactaagtaacccttcagaactagatgaacttatgagtgaagaagtatatgagagatagagaaaatctattgaggagtgaaaatggaacccctaaataaactagtgtgaaataacccagca

SEQ ID NO: 192482 - DNA, 401 bp, Homo sapiens
gagattaatttggaaatgcctcgtcaccaatttcaacataagttgtaatcattttaaagacaatttgtagaatatctgtatattcagttatttgaaatatgcagatttcagctatctatccaatatattagatttgctgaagcttttatgacatatttctataccacaaaggttagtattttaaaatttacaaacaatgaacagaaacataatagaggaaatatattccattcattcatggccaaaaatttagaaaggaagcataagagagacagagagagaaagagggagagagacagaacaaaagagagaaatggagagaaagagaaaggaggaagagacagaaatagagaaaaagggagaaaattaaaaataaagcattagaagaaagtaagaaagga

SEQ ID NO: 192483 - DNA, 254 bp, Homo sapiens
gccactcccccaacacacacacacacacacacacacacacacacacacaaaatcagaggactgcagatatgggccggggggtgggtaaagcaaattgaactaaactccaaaaagtgatgcactgaactttaactttcaatagctatgtctgagttaacatgacagattagaattccaaggagccccaaatgcagagcaagactgtacccatctgccaactctttcctacaagtccccaccaagagcatcattag

SEQ ID NO: 192484 - DNA, 388 bp, Homo sapiens
tcaatcctgggttccaggtctgagtctagtagacctcttaattcaacattcattctacagatgtggggcctggaaaacagcagctattcagataaactttcattcaatacactgctcctatctgagtatcttacaaacactcttagataacaaaagttcttggcagtttcctggaaatgggggtctttaagacagttaagtttcagcacagcaaaccacacaaatgtgagctccacaaatgtatacagctgaggggtgcgctggatctatttttgacacaggcagtgatgtgcacaagggaagaagtcagtccagggcgcacatctccactgttcctttgctacgggctttcttggcttctcttctcctgggcccttccaagcaccgc

SEQ ID NO: 192485 - DNA, 323 bp, Homo sapiens
ccaagcaactgcaagtctttagaatttttgccagtattgatgcaggatgctggaataaacacacactttttttttccggtgtaaaacgttgatggtaggccatgtaaggcaaaatgttcccctctacatgtgtttacatttactctaataaaaatctgaatccttatttcagtttgttccttggctcttcttagatgaaggttcaatgatagcagagaagatgaaatgagcatattagggaatgttgtattgcacatctcagattcttctcaaataaatgcataaccttgtggtaaaactgaaactcgccatcctcatttctg

SEQ ID NO: 192486 - DNA, 253 bp, Homo sapiens
gttgtatgtttaacttttggaaaactccacactgtttttctctggtatctgtaacatttgacgttcccgttagcaatgtaccaagattccaatttgtctgcatctttgccaacacttcctttgtttctttctttttttctttttttctttttttttttttttttaacaagaaacatcctaatgagtgggaagtggcatttctttgtggttttgttttgtattttcctaatgactggtgatattcaacatcttt

SEQ ID NO: 192487 - DNA, 329 bp, Homo sapiens
cattagtgacatcttgccggggtttgctgctgccaccctgcctccccatgcacattcccaagctgcactaggtgaggaggctgcttctcagttcagagctgccccaagtggacatctctagcttccttcagacaactctaccatgttgttccaaaaaggttgttatactaaatggatagtattagaggacagaagaagtactaaccctgaggttagacagaaaaattgtgatgagatgaaaaagccctcgaatgagctgatgaaatagcaaaaaacaagataaccatctgccttaaatgaagactgccaccaacctacgacagctggcc

SEQ ID NO: 192488 - DNA, 512 bp, Homo sapiens
tatggcaggctgaataattggccctcaaagacatccccatcctcaaccccagaaccagtgcttgttactttatgtgataagaggaactctgcaggtatgattaagttaaagatctcaagatgggaggattatcctggatggacccaacataaccacaggggtgctcaaaagaggaaggcaggagggtcagattgagaggagatgtgaggacagagcaaagagtgatgaggtacaagtcaaaggatgcaggcagcctctagtggttgaaaaaggcaaggaacagatcctctctagaacctccagaaggaacacagctctgcctgcagccttattttagccccataagaccatttcagatttctgacctccagaacacaagttaataaacttgtaatacagttgtgttgtttggttgggtgtggtggctcacgcctgtaatcccagcactttgggaggccaaggcaggtggatcatttgaggtcaggagttcgagaccatcctgggaaacatga

SEQ ID NO: 192489 - DNA, 374 bp, Homo sapiens
cagggagctgcatcataatcttaggatcaacaacagcttagggtccacggtgaccttctgaacctcgtctgtctgattcatgccttgctagtcagtcgccatcttggatgtgtgcttcacccagctttccttcattggctggcttccaacttattcctggtcagtgtcccgcattgccagtcttcttggattccaggcctatattttgaggcataagccccttttcccaatgttggtgttctgccaatggatagaacttaatccttatttatgccccctagttactcatggagacactgaggatgtttatctgcctttcagacctcctgggccctgaagggaaaaaactctgggttcttctgaagcttttagtg

SEQ ID NO: 192490 - DNA, 509 bp, Homo sapiens
tcgtctattgataggttgggtgggttaggggagagtttctcggcaggcggcgcccgcgcttcttctgcttcttgcctatcaaaagacgagtaacgccttcaatggcttcctaccgctcttaggatagaaaccaaaatcccataaatggtctaggaggccctacatggtctggcctcaacttacatctctagcctcatcttgttccacacacttcctcactctacacgtaaactacagtgaccttctttcattttctagaacattccacactcccttccaccacaggacttttgtggtgctctttccgtcttctggaatattctttttttccccattgtgatggagagaataatagtcgcccaaagatgtccatgccgtaattcctggagcctctgaatatgttaccttacatggcaaaagggactttgcagatgtgattaaagttcttgagatggggtgattattctggattagctagtgggcccaatataatcacaagcgtctttatg

SEQ ID NO: 192491 - DNA, 581 bp, Homo sapiens
ctgttccattgacagaaaaatctcaggcagcacttaaagcagtgacagcaatgaggcaagagcttaatgatagctatcattatcagcatgattatttccatagtcccagatcagtcttaagaggcggcaaacaatcaggtgatatagtttcagggctagataaaggctgtcccctaccctcaaataatacttctactacggttgctggtgctcgaattttcacccccagaaaagaattcctttggctttaggctcagtttgtgaaaatgcaaagtcaagattgatggaattttaaacttatttacatcaagatcacccaaatttgttagatatcttcaaggcaagtttgctaaggaaaggaaagggaggatgtgagggcataaaaacaatcttagggcaaaaatggataaatgaggagccagttttccagtgagacagacccaattatgcaaacaagggagtgggctccagggtcaatattaattcgcaaattagtggccagtaccaatttagcaccatcgctcatctccttctcaaaatcatctatgatatagcggtgatgctgctttatttacagggca

SEQ ID NO: 192492 - DNA, 677 bp, Homo sapiens
tccaaggtgtgtgttagtcctctttcctcagacaccctataaatttatgaagggaagagaaactaattttaaatgattttgcacagtaccaaagcatgtcacaggcaggaaatgagtatttgattgcttgatttagttctatgtccagtgtgtacttgtccagaattacctgatgaaccctaacttgacgagaagaaaggcacattggatatgcacagagcagatccagattctggtacccctgggggtgtgaatgaacagaggtgttcttgccggcctccataatagtgtctctctttggccagcacctcatttttgtaaccaaaaccagtatacaaacaccagcattttacacaaactaaaaaatagctcccaaccatctattcatggcattattaaccaacagtaaattccacttggagattatttcctctaattagatggactgagaagtgatcccaagtcccccagaaagagactacaggcaactgcaacctcccctgtgattagatacaccatcaaggaaatgattcaatcccaagccactgagagctgcctgctctcattaagaaagagcttcaggccgggcgcagtggctcacgctgtaatcccagcactttgggaggccgaggcaggtggatcacaaagtcaggagttcaagaccagcctgaccaaga

SEQ ID NO: 192493 - DNA, 230 bp, Homo sapiens
cttaccgggggccatagatctctcttcatttcagtccctgatacataagacagaacagtcctccaaacacctggccacaggccgagcttttcacgaggtacacgccacgcatatgtatagcctctccagctttccatgaggtacacgccacgcatacagcctctccagctttctacgaggtacatgccatgcatacagcctctccagctttctaccaggtacacacaatg

SEQ ID NO: 192494 - DNA, 489 bp, Homo sapiens
tgacagattgctggtggggagaaggttcctatccaaaaagatgaaaccaaaggaaacgggtagatataaacagcaatctgaagtcagcaagaatcaagcatggaaacaggtgtttgcaagtatccacacagtccccatttcaaaaaagtttgtgaaaagcagactactattaatctcacctaattcaggttaagttagaattctcagctgttggctccacagcctatactcgattaaatcatactgcttcctactaatactagctgccactaattgagcaactattatgcggccaaatcttgacacattttcttttttttttcaggcagggtctcactgtgtcacccaggctgaagtacagtggtgtaatcatagcccactgcaaccttgaactcctgggctcaagtgatcctcttgcctcagtcacccaagtagctacaactatagacctgtgccaccatgcccagcttatttttaaaaaaattttgg

SEQ ID NO: 192495 - DNA, 344 bp, Homo sapiens
catattttatacttgcttttataatttatatttcatttcagttcttaaaaaagcactacacatttaaacaaaattcatccccctaaaaaatccatagagagaatttttaaatgttaggatagaatataaattgaactgtagacttcaaggttttaagacatcatttctatagaactgcatatgattccttaacaatttctagaccctgcactgtccaatacaatagtctagccacatgtggcaactgaaatttaaattggctaaaatgaccaaatgtagaagttcaattcctgagttacaccagccatacttcaactgttcaacagtcctatgtggctagtggc

SEQ ID NO: 192496 - DNA, 431 bp, Homo sapiens
gggcccaggagtggcatgcaaaagaacagaaagttactgtgtttatggccgttagaaccaaaagtgcttctgagagaatgaaatctagcatcctagctttctagaagaagaaattaaagcccagggaggagaggggatttgcctaaggtcctacatagcccatatgtgaaatgtcctcagccttcccaagcagggggactccatggggatggatgggtcatctcccttttgatttgacatagtccttaatcagccatctttctttggtccaattaggtttggtcatggtagtaggattgacttgcttgaaatacaatggctgctttaggagttggtaacttaatatttcctgatctgaactatatatctgtaataaagatgtatcaatgatcttctatcggctatttaaaatttacatatatatatatgat

SEQ ID NO: 192497 - DNA, 776 bp, Homo sapiens
gcaatgtgttctgtcaccatgaagatgaaaagttctcccctcatttttaaacttcagattctatatggaaatacagcaatttaaaaaaaaggtgccaaaaaagaagagtttatgaatacaaaaccattttagaaaaattcgtgaacccaataaatcaaaataaatgattgtcaaacctatttaaagtactgattctagaagtctgaggcatgcatttggagccaatgtttataaatcctggtccctgtttgaaaatggccattgacactcattgttatttaatatgggagccaaagaaacactgtgataactcttctattaacaacctcatgaacgtcttctgaagttgatttccatactgtattgccaatgggtgtcttcaaacatccctatcccatcataaggaagcaggctgtttttagagggttcagttaatagttccaatacagaaggtggagagtgcatctggcagacagaatgtgccataaatcctcactaatggctagaacagcaggtcctccaaatggaggcggaataaggatggaactgccaaggacccatggggccattcagcaagacgcaaaggggaaaagcaagcactgcagctccctaatgagagatggcagcagaggaaaaggccttcctaatgaaaacctgtgccaaggagtaagcatgcctggtagcggccaaattcccatttttgtgcaagaaacaagaataaaccagctgcatcaggaatgtacaaatctaatctgaccagcagaagacaagaggag

SEQ ID NO: 192498 - DNA, 674 bp, Homo sapiens
gtcatttcttcccagattgatctgtagattaaacacaatttcaaaatcccagcaagctcttttgtagttactaacaagctgattctaaaatatataggtaaagacgaactacaatagctagaatgattttaagaaggaacaaaattttaaaaaaatactactactacccgatttcaagacctactacaaagctatagtaatccagaaagtgtgatattgacaaaaggatgggcacatagatcagtggacaaaacggctcagaaaatttacacctatacgtatatattcagctgggtttttggcagaggtagtaaggcaattcaacagagaaaggatggtggttacaacgaatggtgttgaaacaattctacatccatacacaaaacaaaaacaacccaaagtctgaaaataactcaaactttattaaaaaattaactaaaattggattatagacccaaatttaaaacaggaaactgaaatttagaggagaaaatccaacacaaaaagcaggatccataaagaaaaaactgatgtattggaggttgaacttaagttttgctctgtgaaaggcactgttcagagagtataggacaacctacagattagaagaaggtatttgcaagtcacatatccaataaagagtttgtatccagaatattttaagaattcttaaa

SEQ ID NO: 192499 - DNA, 710 bp, Homo sapiens
ggacaatgtgtatatggggttttccccctcaaacttgagaaagaatagaaagttactaagaaaagccacctataacaccatgatagataactattattaacattttgtcaggtatacccctggtctttatgtgtgtattcttaatatcctaaactattaagagtccattctaaacactctcagcctggctctttcttaagaacttaccgaaatgtaatctgcctcaccatcttatttcatataagatgataatagaagtcatctgttaccattgcttcaacttttctactcttctgcttcatttaaatgtgtaaatttgtaaattacagtatcttactctctgactcaaaacctcccagtagcttttcaatataccaaataaaattgaaacctcttactgtggcttatatacctcagaccagcaaagtccactagaaatacaacgttagtcacaaatgggagctacattaagtaatttaaaattttctggtagccacattatgaaaaaaagagaaactggtgaaaatacgttttatgtaacccaaaaactattatttcaacatgtaatcagtataagaaattgttgatgggatagttgtctttttttagactgtctttataatttggtgtgtattttccacttaaagtacatctcaattcagactagctacatttctttttttgtattttttttgagacagagtcttgct

SEQ ID NO: 192500 - DNA, 533 bp, Homo sapiens
aaggaggcatggaagccagagtcaaactaggtgagagatgcttattttaaaatatacaggtagaatgtcttgtttttctttttaaaacattttttcaatattttacatattcaaaagaggtacataatgtatcttctgttctcattcttggccagaaataaaaataagaaattttacacatcacatcataaactctttaagcaaatacaaattgaagtgtgagcaactctgcaggcagaggtgttaacttcagtaaacttcttgctctttctctctgacaaattctgtttagctcacaaagaaatcaatgctttttcacatcactgattttatgaagtttgggaatgtattatcatatagattgacagttgccccactggttccacaccacggcatggacacttacaaagccatcattaatttctcacacttgtacccagtgatggcttcctccataataaacactgtgtccttcagaaccaaatcaataaccttttaggtatgcctttcttgaagaggaagtaacaggaatc

SEQ ID NO: 192501 - DNA, 1127 bp, Homo sapiens
ggaatatcagtttctatcatggggtgataaacagaaactcatcctcaggggctactgagatatatgtcaggtacccctttacaacatgacctcacactggtgtgcttttttcagttatgtctgtttttcacagtttctctatcttcccttataatcagctgtcacttttgccgccgtcttgtgtgcctgcctcctgcaataggtccctaatttgctgcttctaatctgctgtggactgagaaaccagattgccaagcttgctagaattgtgtctaaaataagagtaagtagactgaaagagagctaaggggcttttctgtcagtaaagtgcatggactttgtgatacctgcttgactgcttagcattgttttgtttgcctcttagttctttactaaaaacttgctaaaacaaatacttggttgaatatgtgattgccatatatttgaagttctaattcagtttttatataatgatgtttctaggacttccattaatgaattcaactataagagaaatttgactatcatttttgaataaataattgtgtatatttcagaaaaatgttaaacgtattgttatcattaattgttcttagtacagtacacagatttaaaacttatggcactataaatgtaacttcaactctgttcatcaagacttatgttctagaaatattgttatgagactaaagatggctaatttagtaagaactgggtaacttgaatatttggggaatgagtcattctagatatcccagtttcctgcagagcttgaacctctttcagccctaaaattttttggaataatctctgaaggaaatcttcataaaattgatatgcattactgtcttaaataatatatgaatgtattttaatttgtttggtatcaaaatgatcagcattaacatcacttattataatctgatagactaatcagacattgagagctgtttgtccctgtactaaatggctccattctgctgtactcgttttagttttcatgtctttaacagtcgttctgattcttccatttctattactgcttgcttaagtgtgcctgtagcagtagcccttctccaccttcataatgtgccttctgatctgctttcattttggagaccagacaa

SEQ ID NO: 192502 - DNA, 358 bp, Homo sapiens
taataatctatccttgagtcaaccatttcctccttcccttactccctatatccaagccttcaacaaaccttgtagctcatatctccaaaatatgtcttaagtctctccaatttatctatctctatgactagttccttaacccaagtcattatcacctcttatctatagtggtagcctcctaacagatctcccttgtctctctttaattatctacacagtagcaaaagtaatattttaaaaaattaaaaccaatcatgtcattctctagctagaacactttgcagcactgtccagtagaattttctcaataattggaatattctgaatctgcactatcaaatatagtagccaccagcca

SEQ ID NO: 192503 - DNA, 650 bp, Homo sapiens
tgcttaggagcctgtctgcctcccgctgccatcaacatgctgtccgtggtgcccagctgtctatgctgaggggcacccacaggcctgtacaaagtcacgcttagtcctctggtctccctcctgcgttcattggtgaccaaagtctagagggggctgaagcaccagtcggggaggggagtgctggctactctgcatatgtgcacacctggctgggtcatgacagcacccgcgcttggctacaactttgcactgaagtgggtgccgggagcggggagaggccagggagtgcgagtaggcacttccaagcctgcagggaccgggggtgcttcctggacccccgagagtgcagggatgcctgggtccagagccgtggctgggtggccgcagctgcacctgggagcatggggctcctgcccagccgacttggtagggggcagggctcccgcccattcctggcctgtgttagctccatggagtgcagcagccctggccacacctcccccattgcagctggtgtccccacagtggctgctccagatgggccaccacgtcctcactaattctaacatgtacatagaaatgcaaaagttctataatggagaaagtaattagaacaaagttgatggaagcgtcgcgcatggggatcctct

SEQ ID NO: 192504 - DNA, 422 bp, Homo sapiens
ctcaatgtctcaaaaaaagatgagagaaaacattgtaaaaactaggactttgctttcagatgaactttaaattatttttctacctaaaagaaatggaaactggaaatgggagttaaggtgtgatttgtgtgaaagacatggcagattccaaccagggagggcctccttgaagaaaaggtcctggtcctgcatcaaaatatgctaaatgaatgtatatgttttatttttattatttatttatttgtttgtttttgagacagagtcttgctctgtcacccagactggagtgcagtggcgcgatcttggctcactgcaacctccgcttcccgggttcaaggtattcttctgcttcagcctctggagtagctgggattacaggtgtgtgccatcacgcccggctaatttttgtatttttagtagag

SEQ ID NO: 192505 - DNA, 153 bp, Homo sapiens
tattatggtcatttagctgggagtgggagagaggtaagggaatagtgaagagggctaccaagaattcaggaagtttaagagacagggagcctcctgtataagttagaggagaacaggaaaggcagggctttgaggagtccttaggccatagac

SEQ ID NO: 192506 - DNA, 656 bp, Homo sapiens
caggtcttttcccctcaaaatctggccataaactggccccaaaactggccataaacaaaatctctgcagcactgtgacatgttcatgatggccataatgcccacgctggaaggttgtgggtttaccagaatgagagcaaggaacacctggcccacccagggcgggaaaaccgcttaaaggcattcttaagccgcaaacaacagcatgagtaatctgtgccttaaggacatgctcctgctgcagttaactagcccaacctatttctttaattcggcccatcccttcatttcccataagggatacttttagttaatttaatatctatagaaacaatgctaaggactggcttgctgttaataaatacgtgggtaaatctctgttcggggctctcggctctgaaggctatgagacccctaatttcccacttcaacttcacacctctatatttctgtgtgtgtgtgtgtctttaattcctctagcgctgctgggttagggtctccccgaccgaggtggtctcggcaggccagcattttggttccagccttcagcttctttcaactcccctggaacaatctcatcacagcccctctgggctattagcaccgctggacagcagctcccccttagaagtctgagtctcctcgctgtgagggatc

SEQ ID NO: 192507 - DNA, 579 bp, Homo sapiens
aaaaattggttctttgacaatattaataaaattaataaaaccacagtaatagacatcaagaagaaaaggagagaaaacataaatcatcaatatcagaaataaaagatgagttatcacaacaaatctaaagacagcaaaagaataataagagaatagcaggaacaatttatgccaatacattctataacttatttaaaatagacaaaaagttcaaaaaataacttaccaaaactgactttaatatagatgtgcattatgctaagtgacataagccagacacaaatgaacaatactatatgattccactgatatgaagtatttagaagaggcaaatgcatagaaaaagaaagtagaacagagactgccaaggcctggggtaagggaagaagggtgttactgcttaatgggcacagagtttctacctgggaccatggaaaagttttagaaatagatggtgacaacagttgcatgacattgtgaatatagttaatgtcattacattgtatacttaaaaatggttaaaatgccagaagttgaggcacaagaattgcttgaatttgggaggcagaggctgcagtg

SEQ ID NO: 192508 - DNA, 406 bp, Homo sapiens
tttgaaaatggaaatgacaacatccatttaacagggtttagatatattgaaatgctatacataaagagctcagcacagtgcttggaacatagaagatgctcaaagatgttaactttaaaagaggaggaaaggtaggggagggtggtaattttcatgctcagaattaaaaaaaagtcctaggaaatttatttattaaatgcacaccatgcattcttttgagaaagacagagagagagaaagagactgagagaggggagcttgggtgaaagtgtcctttagcatttgcattgctcttagctggatgaacttgcctgcagccaccacttacaatgcaaattgagtttagagtccttcacactaactacacagcaaaaacctttcagctttaaatagaacactgcaatgt

SEQ ID NO: 192509 - DNA, 512 bp, Homo sapiens
caataacagaggctgcctgtaaggtagaggaagacaaaggtggactgggtgagagcaatgaggaattcatgctaagtcctagttgagggaagggtgagtttggtcggttcctacatcttgagggtttcctaggagaccctgaaaacaacagaagggaactcaggcatgaccatctgaaatagtactttggcaagacatgaccttaatgagcctctctggaacgaggaactctaaggttttatgtactgagatgaaagtaaactccttggtctactttctgtcattccctagaagtcttacgtttttttttttgtttttttttttttgtcttttttttccccaaagaaagaacagctgtctaaatattggagctagccacaatggatgctgtgataaaaactgagttctaacaattgtgtatacaatcaggggaaagccacattttaacagaaaattttcctcactttgtgagtatcatggattgatttcaacaagcaattgtccctaaaacc

SEQ ID NO: 192510 - DNA, 280 bp, Homo sapiens
ttcctcctaagatcttaaacatttcacttatgtttatttctgccactactccacacaataaacatcaatgcattattatccattattctagagcagcaacgttaacctgagtatgccaataaagacaaaggggtcagggaatttccattctctaattaaggaaaacaagaagcccagaagagggtcaacatcatcaggaagccgaggaaatgtttaggttaataatggaaaagcaaaggaagaggttagtgaagtttgaaaaaaatcgggccaacaactg

SEQ ID NO: 192511 - DNA, 241 bp, Homo sapiens
tatcctttaactacttttggttttgctttcaaacaaggataagcaacatgtaagttaatcataaaacaactagtgctcataaccataaaaacaatagtgtttaagtgggagttttagggaatatattgagaaaaattttaaacaaattatattaagagctctacaaattaaggagaatatttacaaataaaatatagaaatttaataggtcaaaagactaattgaaaataggcaaagaaga

SEQ ID NO: 192512 - DNA, 650 bp, Homo sapiens
ggtcattccttgatagctgggttgcatacctatcacgaaccattattttctatgggacatattcctctctttatgtgactcaaaagagagtatccaaactagctaggtatccaaacaagctaaaatagcatttctcaatgtgaatgacaaagaatactattttcaaaagatgaatgttttctttttctttcataattgagatttcatcagttgtgttgaggatcagtacacagacatttcaacttgtacataattctgaacatatgtactgcaaaatctaaaaagccacgtatcattattattctctaaagttattccagtgactttccagcttacaactgaggcaaaattaccttaaaaggctatcaagtaccagtaccttcaaatgttgataagctgtcacatacgtcccaccaattcacaatttaatagcatatacactatatactttaatctttcacagcacattaacaaagttattagaaaaacaggactaccatgaccaaagatgttacagagtgcacacaattctgataggtagagccaggctcaaggagtggtttgcccaaggaaacaattccactaaaaaacaacatgaagagtagaagtaatttaaggccaggtgtggtggctcactcctgtaatcccaa

SEQ ID NO: 192513 - DNA, 325 bp, Homo sapiens
cttcgacggaggcatcaaatactgggcagtatctttccctcttaaccctttcacacgtgttaaagtgtcaaaatgatgaatggtataaattcaaaaggaaaattcttttctactgaaaaggacatccagctcgcacaaacggtggttcagctgaaggcaaggcgtttctggttctcctctgcactcgggcggatcgttaacttcgacggaccattcaagagttaactgtattttcatgtgaaatatacagcaaactgcctctaagtatcataacaaaggcagactaccttggagtaaaatctgggcactttagagctgaaagcgt

SEQ ID NO: 192514 - DNA, 365 bp, Homo sapiens
tgttgctctgaggatcccaaacgacccgaagacaagaagagaaggggtaacatctttttagctgaaggacttatggcccttgattagggccgaagggcttaagatctttttttttttctgcaaagtatctgaaaatgattaaaattattttgacagctgcaagtaattgggaagtaggtgaaaacaggaagttcaggcacagaataacctcactagttccagattccaccaataattcagtgttcatagtaatttcaacatgagtagctgatgtttattattatattacatattcattttcaagcaatagagaataaaactataactatccttttcaagtaagacccattagaatagtagacatt

SEQ ID NO: 192515 - DNA, 440 bp, Homo sapiens
tggagagtgtgttctagctgttgaaacctaggaatcttgttttgtaatagatgctactcctttggtgtataggagactggcaaatgctgaggttttgaggcaggcacatacttggcatattctaggaatgtcatggaaaccagtatggctggagcagagagctggggacagtggtgagagatgaggtctaaactctagcatgagtataataaatgagaggcccatggtgtcaggttcagaaagaagcctgttgttaccttctcctttgcctccctaaattactagtagtaagtataatgtagcatgccatagttcagcctctgtaggttaccaagcagtctggagtctaccacgtgtcaatttaaacttaaattgggaaatgtcttctcgtcagggtagttggattcattttgacactgtactctccttgaaaattttag

SEQ ID NO: 192516 - DNA, 137 bp, Homo sapiens
ccaatatttattattttaatggcatctgtttgactaccacttactaagagatgtgtcctgacgtctcccactctgatagtggatttttccatttcttttcataattcagtgtttgctttatatggaggttattggca

SEQ ID NO: 192517 - DNA, 493 bp, Homo sapiens
agccgagatttccccttcagatgttctcattctattcagcgtagagcagaacctagatctcagcctgttttacaagagtttaggaatctcctctgataggtgcaccctggcatgcatggattttaagcactttggccattattcacctctcatctttccagaaccgtgtaccaaaaggcagcaggataatgattttgctgctactgtcccgtattggaggccagaggcgtgggccctatttatttgttaatttagttttattttttttttcaaaaattgaaatgcagtttccttttcttcatagatataaaaataatacttttgaagtgcaaataaaagaagaatgtagaaagtgagcatttttctccctcactcccctagtcccaccccacacgcctcacaagatcaccagtagtagtcatttggtgcagatcttcatagtctttattctatgtatatgttctccttttctaaaataaaaatggaatcatcc

SEQ ID NO: 192518 - DNA, 634 bp, Homo sapiens
cgctctcgaggatccccttcgacggtgttctggccacggcgagacagcagtgatctcacggtctgtcacatctcatagtcttttacctcccgtatggattcctctctggaggggttctgccccgtgcctttggcatgcagtgtcccttctacacccccttcctccagcaccatctttctgttaagatccgctgacccctctggacctagctcctgcattgactcatccgctttctctaaaggatttccattaagacttctaccacactgccccttcatgcttagtttccaagcggttgaaaagatcaatatatttttctgaggcaaaataagaaattctgagcacgatttcatttatcttccagcttctcactgtttttttcagcctcactgctgtgggcgtccttaaatgtgctttgttccaactgggaaacctgcctcttttcaccactgaagtatggttgagacaaagcactgcctagatatgttcactctattttgtttttaaatatgatttacacagttgttgcattcctgtgtcactaacgagtttttaagcttttgtaatgctttagtgttggctcacacaatcattaggtttgaagaaggaaggaaagggaagaaataaaatgtat

SEQ ID NO: 192519 - DNA, 165 bp, Homo sapiens
atgccaatgaagccaatctgagtcaagggtcatccccagaaaacaattataatctctctgtttggccacacaatacacccgtaacccagtcccaaccaacttgtgtctgtcgcaagagggattaagccacagtgattatggcccagtaaaaacccatcctcagtg

SEQ ID NO: 192520 - DNA, 179 bp, Homo sapiens
tttaagcaaattgagacccagaaggttacccgaaaaatggaggacttagagctgaagattcaaaaggttatttccagattttaaaatatgtaagcccagaagaaaaaagttatttaaggcattataaatacattttgaaatatttagtgacatccctggccgatttgcaaaattagcca

SEQ ID NO: 192521 - DNA, 135 bp, Homo sapiens
tttagccatgtatattacatttcaataaagttttaattttaaaagtatgtcttttctaattggtccagcatgaagctgctttgcagcagaatggaaacctgctaggctttcatttatacttaggccaccacaata

SEQ ID NO: 192522 - DNA, 605 bp, Homo sapiens
tcacctcccagcctatgtgttgtgtaagttctattctgaacagcaaccaggaaaaatgaagctccttttatcccaccaagcctccactcctggggtaaaacactaccctgggcacagcaggctgagaacactggaaccctgaatgccccacctcaaactccctgtcgagagattccaaacctggggcaagctgagaaccaggggttacctactctctcccctgctcaaagagccagaggtgttattctgggagaagagggatgctgttccatgccatccaaattctgccctcctccccatttcagtggcataaaagttaaagttctccctggtggctgaggctgactatgaagaagaaactgcagctggagagaggagtgaggaggaaggtggtggtgatgactttgtttatttggaatgaaatgtagaaaattcctttcctaagggtgttgacaacagagatcctgatggagtgaaaatgagagggtgctggtagttctctgacactagcagcaacaaatgacagcgcaaaacagccggaagttcaacagagaaaaccagagaaagagacagccaagaagaaccttcctggagtcatagtcaat

SEQ ID NO: 192523 - DNA, 282 bp, Homo sapiens
gcccttattctgagatactggatgtgaagtaccaatcttaaattttcttaaggtataggtagactaggtcttctggtattcatgtttttaaattgacaatatcctattccatgactgcatcaacttagaagaatgttattttcttttttgtggataagttgttctgcactacattgcttctttccccttttcttcagagtacttaaatatttacacaggctgacaatataataaaacttccacccccatcatctggttaaaattgtgtattttaaacaatga

SEQ ID NO: 192524 - DNA, 466 bp, Homo sapiens
accgttatagaaggatgttcaggagaaggtggaaaacaatcatctgaagactcagagtaaagagaccacggcgcctggcgcactgtaatcccagcactttgggaggccgaggtgggaggatcactggaggtcaggggttcgagaccagtctggccaccatggtgaaaccccatcgctacaaaagtacaaaaattagctaggcatgatggtgggtgtctgtaatcccagctactcgagaggctgagacagaagaaacacttgaacccaggaggcggaggttgcagtgagctgagatcatgccattgcacttcagcctgggcgagaaagtgagactccatctcaaaaaaaaagaaaagtgtgaatgttggcctttccatacaaacagtgccaggctgaggttgcctgacccttgtcaggtcttgggaacaggtgtccctctgctatagaggtaaatatgatatgtcag

SEQ ID NO: 192525 - DNA, 444 bp, Homo sapiens
gcctctgaatctcaggggatggagtctcatctcccctcgggcagcgactcttgctccctctgactccagatccgttcctccccttgcaagtgacccttggagttcagtggtgtttgaaaggtataggaggaaacctgtacggttgtgctaaagacaaatccatgctgaccttcagtaaaacattgaggtgtttgtatgtttactgttttgcttttattttttaaaggatactgctttcaattgaagggaaaaaaagttgaatagctaagttagtgcttttagtttaaattgcagacatagctgcagagcaggcatgttccagtacaccctcgggaagggcaccctgcggattcttttggtgttgcacaaccttgtcaaaattagataagtttgttaacctttatacatttgtttacctgcaggcttactcttctcttacttata

SEQ ID NO: 192526 - DNA, 451 bp, Homo sapiens
gaggatgagcacagtgcagggaggtgagcatgtggcgactggcctcccttctcgttgattcacttgctcattcactcattcattccacagacatgaacacctgccctgtgctggaagctgccaggtactgggcattcagtgatgaacacttgaacatgggcccagtgcccacagagcttgccatctaatgctagagttccttggagatgctaaatgtgagtgggtatcttggccatgctgctggagagagacccttaataatgctgactttagcctagtaggtcttaggtaggtcagacatcctgggggtgactctgtttcatctcagcttaggattccttcaagactgaagtgggctttatataggctttttttaatggactgatggctgatgtgggcccattttgcatgtcttcctgtgggagcagtcagctccgccgctgctgagtca

SEQ ID NO: 192527 - DNA, 583 bp, Homo sapiens
ttagactcgattaaatgcagtagctgagattctcctgatagtgtttccacgttggtcagttttcccactagcggaaggcctgggggcttccataagctgagaccgaagggccattgaaagctgagtggcccaggggacttggactaaaggactggttctgtccttacctagctgctggggcttcaggctaaatgttgagcccaggggtcaagtgttgaagatgctggaaaaataccttattttgtaaagagtcagatcatgagtatttttagcattgcagaccatagaggccctatccagcaacagctctacctgctgtcagtgcagaaaagcagacagtgaagagtgcctgtggctgcgtttgctctgcagcctgtcactttctggccctgggttagcagctctctccttagtttactcagctattaaatggggaggtcaagagctgctcacccatctcacagtactgtgttttggttttggttttggttttggttttttggtttacgtttttgtttttttgttttttttttacggagtttcactcttgttgcccaggctggagtgcagtggcacgatctca

SEQ ID NO: 192528 - DNA, 204 bp, Homo sapiens
tctttcaaatgttatgtatgtttcaattttttcataacaaaaagttggagaaaacagggccgggcgcggtggctcatgcctgtaatcccagcactttgggaggccgaatgttgggattacaggcgtgagccactacgcccagcctatatttggttttctacaatgaacatgtatgacttttgtgggacagtcatttatcctaac

SEQ ID NO: 192529 - DNA, 578 bp, Homo sapiens
tatattgttaagattcatccctaaattattatgatagttcatttattttgcatgctatatgataccagctgcactaacatgctacagtttacttaatcttctgtagtttgttctttgggttttcaatttgagttactgtgaattgtgttgctgtaaacattttttgtacatgtgcaagtttctcctggtgtatacctagaagtagaatgagtatttcatctaatatgtaaatgtgcaacttttgaaggaaatatccaaacgttttctgaagtagctgttcaaatttgcatttccactagcaatgtgtaggagttgttacaaagccacatattataacacgtggcattgctaggcttttaaatttttgtcagctaattggttccaaaatgctacttcatttttgtcttggcttatgtctccctgatcactaatcatgttgaaatgcccttcatgtgcttagtggccatatgtatttcctctgtgaaattcttgtttatgttatttttcaatggggttaattatgctttttttaaaaaaaatttattgatacataatagatttagggattttggggatac

SEQ ID NO: 192530 - DNA, 600 bp, Homo sapiens
gtcttctacaattggggccaagaaagtgtaatgcaaactaaaaactcaagcatcttctggagaagtagaaaaacagaaaccacaaggtaaataacatgaaaaaactaagacttcctccttacaaaatgccaactgacttacgtttaaaagaagttcaaaagttgcattaattttaaaaatcagaggattaaataatctggtctttaaaatcatacacctttgatgtaagtttgaatcaggaaaataaaaggaagcaataaaaatctagcatatgttgcttctttaagggtctactgtctttaggatatgcatagaagttgcttatgattaatatcacatctagccatgacacagctatattacaaaatataatttccaactgggagcacacacaaggaaactaacttcaactgcaatacgtaaaatgataaagcgtttatatagtctttacagaggcaaagctgttgcaaatgctagaaaatgtgtcatattaacaaacagctttcaatgtatctagtgcatgaaatcaaagagaaggatcaaaattatttccaaacatgccctttctaataaatttatattcttacacaaggattagaa

SEQ ID NO: 192531 - DNA, 358 bp, Homo sapiens
aaccatcacctgtcggcgcgagcactttgaaagtatttcgggaaagtatgtcaggaaatgcacctatttcatggattaggagaccaaggctcagagtgtaaagtgatctgccagggtcacacaagtagtaggcaacagcattgatacagaaccaagtgtggctgatgtcagaggctgggttctatgccacctccccaccccaaacccagagagaactcaggttctccagaggaggaagtggtttgctgcaggctcagcatcactgtgggtgtcgcagttcatacccatttaatcaccaaccaccatcaagtagttattaagtgaccgcagagagaacagcacagtgcttggtggcaag

SEQ ID NO: 192532 - DNA, 476 bp, Homo sapiens
ctggtaggcagagaccatctagttcaactttgtattcctgcttagtagtgtgtctgagtcataccaaccagttcaataagtgttgaattgaattaaatcacctcaaaatcacagttggtggaaagagaaaatggccacataaatgtctgtgggttttagtgaggtggaggtgagctttctttgggcattgtcacaaagaactttaaaagggaaggagaggggtgtggcatctacttgttaaaaataaaaataactgttttacgagaaaatgctgtgggtggagtaggaagaaataaggggaaaggtggaaactgatggaggtgtgccaagtcatgtttggatgacacatcttcctcacaacacaagataatctgaagtgctaagtggattatccacttttatttttttatttatttttgagacaaagtctcactcttgcactccagcctgggcaacaagagtgaaactccatctca

SEQ ID NO: 192533 - DNA, 478 bp, Homo sapiens
ctgagagtaggaagggttagatgtgagctttgaagctggagcagggaagagtgaaactgaagaccttccatcacaacaacttccaggccactggactttaaagcccatgcagttagaattttgataacataattttaggccgggtgtggtggctcatgcctgtaatcctggcactttgggaggccaaggtaggcggatcacccgaggtcaggagttcgagaccagcctgaccaacatggtgaaaccctgcctctactaaaaatacaaaattagccaggtgtggtggcgcatgcccgtaatcccagccacctgggaggctgtggcaggagaaccgctcgaacccgggaggcagaggttgcagtgagccaagatcacaccattgcactccagccttggcaacaagagcgaaactccatctcaaacaaacataaaataataattttggccaggcgtggtggctcatgcctgtaatcccaga

SEQ ID NO: 192534 - DNA, 450 bp, Homo sapiens
tctggtcttagactacaggtatgtaccaccgtgcccagctaattttttgtagagacagcatctcgctatggctggtcttgaactcctgggctcaagtgatgctcctgcctcagcctctcaaagtgttgagattacaagcatgagccaccatgcccagccaagagatggttttaacagtacagcctcaggttgaggacagcattcagaaggtccgatggtttaatacaagaaggaggctggggttaacaatttactctttgttgcagatttttttcagatagctttcagtctcaaaactcactttctacccaaagctatgacagagatagcatgtttagcttccctacctggtcaaggatgccttctttgttctagaaccaaagtaggggctttatgaatggttgtgcatccacttccagtagtaatggctatacattatggagcacttaa

SEQ ID NO: 192535 - DNA, 400 bp, Homo sapiens
aggggacaaaggtgggaacaggaagactagttgtgaaagtattgcagagatacaggccagtagggatggatgttggctggacccagggtggtcacactagagacgctggaaatggtcagaccctaaatatattttgaaagtagagccaatgggatttgttgatagatgggacgaggggtacgaaaggaggaggagccaggggactgctactgcttcacccgagctgcctttaaagagatggccacacagggagtcagggagagctggggcaggggcaatattggggggagatcaccagcttggtttgggacttacctggttggagaggcctattggatatccatgtgcccagccttctacctggcctctgacagtgcttttccacttcctgtttcttctc

SEQ ID NO: 192536 - DNA, 445 bp, Homo sapiens
atccaaactggaagcagatatttgagctgtgaacacattttttcttagaagagtcaattaggagctgggttgaagcttcagtctatgcacttagagtcaggttttaggaccaagagcaagcactgtgggcacctgttgtaagaaaacatctgacagcacgaggtgctaaattgcttcaaaatcctccatagctcgtggggatgctacctttttagtaggagtttgaagcccagaatgcactttatattataaccaacacagttgaaaaataggttccatgttctataagaatggattcattaaactgcatgttctggaaaaaggatgtattagagactttgaatttgaggatcctgtgttatatacatctctgagccatcttatcaggaagaaaagcagctccttaaggtgcctgcctcttcctctaatactatgtacatatttc

SEQ ID NO: 192537 - DNA, 548 bp, Homo sapiens
gcacaaaaatgttgcaacagcaaaataaatagaaacacactagatgtctacctgaaagggacatttaaataagtaatggtatattaaaagtataataaattggccgggcacagtggctcttgcctgtaatcccagcactttgggaggccaaggcgagagaattgcttgaggctagaagttcaagacaagccctgaaaacatagtgagacccccatctctacagaaaatttaaaaattggctgtgtgtgatggcaactgcctgtagtcccagctactcaggaggctgaagtgggaggatcacttgagcttgggaagtggaggctacagtgagctgtggttgtgccactctgcactccagccaggatgacagcaagaccctgtctcaaaaaaaagagaaagaaatagaagcagggatatacttgaaggggtatgtgtgtgttcatgtcggtacattggatgcttggtgctgctcggtaattttgaatgcctcacatgcattatgccattaattctcatacacctgacagatgcagggttcgtccctaagg

SEQ ID NO: 192538 - DNA, 150 bp, Homo sapiens
gagtttatatttttatatttttgaggcttccctaccgtagctctctcctttgaattttccctttgattttctagccactttgtagccttgaataaaacagctttctgcttgagctctatctgccctatgctgctgcaaactgggagtgtc

SEQ ID NO: 192539 - DNA, 627 bp, Homo sapiens
ggtccataagaacgtaacacacagcaacacacaaaaacacacacccatacatcacaacacacatcatatatacacaccacacacaaacaccacacaccacaaaacaccacacacacacatacacacacacacacacacacacacacatatatatatatatgtatttattttagagataggctgtagcccaggctggagagcagtggctcgattgtagctcactgcaccctcaaactcctgggctcctgtctcaccctgtggagtagctaggactagaggcactcaccaccatgcccagctgatttttaaatttttttttttttttttatggagttgtggttgctacaggctggtgaaagttgctccaggctggtcaaacttctggcctcaaatgatcctcctgcttccacctcccagagtattgggattacatacgtgaaccccgtgcatggccttcatgttagttttatacgtatttatttcctccactaaagttaaatgctcctgtggtattttatcctttattgtgctcacatatgaagagctacagttaagtattaagattgaacatttttaagcattttaatgagctttatggtagaatgtgaactgtgtgagtttagacct

SEQ ID NO: 192540 - DNA, 515 bp, Homo sapiens
aggctgaggtcatttggtctaactttccacctaagagtccctgtttacacgcttccaggaatgaggagctcactagcttatacggcagtctatttgttttgcaatagctctggtctctaaatatttctctttcatattgagctaaaaaatctattcccaatcacttctactctctaccctctaacgtgcgttgcttccacatacagatgctgggtaatagagagcacatgcccccgagtcttctttcgtccagaccatcattctgtagctcgctgttccaatagaacagtttccagaccctcaccctcttagtccatgaagggaccaccacactttctcaggacccagatccggatttccagagaataaatcgtgaaactcccagaggctgcctcagtgaggatgtgcaatagatattaggtattttttatcagtgaagacaaaattgactcagaagtaaatggtgaatttttaaaggtcttttcaattcatgattttcatgtgaggcagttaat

SEQ ID NO: 192541 - DNA, 319 bp, Homo sapiens
cctgcctcagcctcccaaagtgctgggattataggcatgatccaccgtgtccagtctgcacatccttttctttatccacttcatgttttctagttaagagcaaccagctaatttcattatatcattactttgaccagaatgttctaaggtatcaaacagatgatctttaaaatgaaggaaattctgtcattcgtgacaacgtgggtggaaccagaggacattatgctaagtaaaatgcgccaagcacagaaggataacactgtatgatctcgcttgtgtgtaatctaaataactgtctcatagaaatgtagttaccgaa

SEQ ID NO: 192542 - DNA, 419 bp, Homo sapiens
atcttcttacaaatatgctgtaatatctctaacttttttaaaatggagaagcctttctcatgtttgttttcctcctgctatacctcctttgctgtgttctcttttacagaactcagaagagctgtctctcactgtctccttcatctagacaaacgcatttcccttcattccgacactcggtaacccacttattctggttttgtctcaaatctaaaaatacgccactgaaacggcttcttcctaaattaccaatgactccatgttgacaaatccaatggtcaactccttgttgacacaaatggccagctcttctgtttgaacgccttcttctcttagcctctgggagagcagtctcttacgggtctactcttactcacagctactccttctccatctcctttgctagttcctccccatct

SEQ ID NO: 192543 - DNA, 544 bp, Homo sapiens
catgatgaatttctggagatcttagacagaagtgttcccaacttcattaagttgccagatttgctgaatagatatttgtgtgtaaaggactcaaaaatactaggaatatatagcagtaggatacactacttggcctaagaaacatgcagtctgttttgtaaagcagaacacaggcacatgaattggcacaggaatggcatttgccatccttttagacagatatggtagcagtataccatatgaatatcaaaagagcacagaataaataaaggaccatggttttgaataaaaggacgttgattttcaagacctgtacagttgactccgagagatttaaagctagggtcagtctttggatggaggatatgcaggcattgcaggtgtgttaataggcaatttaaatatgctgcttatcagtcagtaaaaaaaagttcagaatttagaatatcacagtatttcaaagcagccattcaggcatattatctttgccatcagtttctctgttaaaaaaaatagttttgtcattctgtagtttttaaaagac

SEQ ID NO: 192544 - DNA, 617 bp, Homo sapiens
tacacgatccaatcacgttgtgagttaggcatagttatccccattttacagatgaggaaactaaggctttgagtttaggttggtttggcttcagactctatgacatgcttcctttctgtgcctgatggcttccccatatgaatgtggccatctgggtgtactgcagaggttgtggagaatataagtgcttctggtaactttaaaataaatagtgaagctgtttgcactgcccatccctaaccttctcttctttggaagtcctttcctgcttcccctctacccccaatacaaatattcaacctggagacatgaaattaataatatttccattctagacctgacatcatggaaagagacttcatcctttcactggtttgtatattggcttcagccgctgccaggctcatagactaggaactaagaagtggagggcacagcccctgtgctccaggatccagctggaaacacagagcagtgaaggaagtacaaacccttgcacagaccattcccggacaggaaaggcaggattccttatggatgacctgctggaggtgaccccatctacttgaagactgtgaggaacgatcttggtggagggtggcttcctgatgtagcta

SEQ ID NO: 192545 - DNA, 203 bp, Homo sapiens
cgagcggaccggatgagatagcacggggaaaattatttggcaatagaagggatgtacatgctataacatggattcacttattattatattaactgaaaacagccaattacaaaagattacatagtatatctcatttaccgatgtccagaatagggaaatgtatagggacagaaagtagattagtgtttgcctaggatttggga

SEQ ID NO: 192546 - DNA, 552 bp, Homo sapiens
aatcaataatgtgaaggaagagaataaaaacaaaatctcttagtatgtaggtaaaagagacaggttttaaataagaaagaaaacatatttgaagaacgtatccaaaaatctaacttccatccattgggaggagaaaacagagaaaatggtgaaaagggagaaaaacaaaagaactaatgggggaggaggggaatggtcaatggaagaaacagcattcagactaaaatagcctactgagtagataatacaataatagtaaagctgaactgtttcagagcaagacactgagctaaatggtttacatgcagtatgtattttcatctttgtagcaaccctgtgagttcccaactcataatttctcccacggtacagatgagaaaactgtttagagagactaaaatcacttgcccaagtatagacagctactaattaatggagccatatgcttgatgaaattttagtacacctaagatattctaagaactttctttcttttccagaaagaaaagagcctcatctttaagaaataagaaatacatagaaataaaactc

SEQ ID NO: 192547 - DNA, 504 bp, Homo sapiens
taggtgattacgtgtgtaggtgtgtgcagggaggtctctgtgcctaccataccactaatggttcatttctgggtttttcttatccttaggagacaggtctcttctcctccctgccccagaatcaaatcatccaaattctgtagagaaatgagtgttcacctgatttagactgtgctgagccggcagagaggcagaggggaccaagagaggtccagggttggaaggagaaggagggatttccttcctaccctccgaagtgctagggtcaaggaatagaggggaggatcagaggaggagctgctgctatagagggatagccagaggctgaaaagtctattttcttctttcgtggggctgggttaggtgaggagggtcactaggccaaacctcctaccgagggcagggatcttagccctttcggctccacctgtgtgcgagcttgcagaaagaccggactggcggacccaggctcagcgctgccaaaaattccactcctggtttttg

SEQ ID NO: 192548 - DNA, 246 bp, Homo sapiens
gcacaaacagtcgaggaagaattcttctggtgtatacctaagagtggaacttctgggtgcccaagaatgggcaggctcagcctgaggcggtgtgccaactgctctctgaggactgcaccagtggccactggaacttagggctccctgccattcctgcagcctcaacaatgactggtacggccaggctccccagtgcttgcctggcctgataagggtaggcgtctccagcctaccttcaaggccgtt

SEQ ID NO: 192549 - DNA, 707 bp, Homo sapiens
ccctcaatttcttgcatttcacgtcccgtaaatgtatagattttccttcctcctcctcccaccacatccagtggtgctgttagtgttctgtgccaggacaggggcaggatctcctgccttgaaccgagctctgcagccttcctgccagctgcagtccacatcaggcctacagttggttttcttcccagcttccgctcacactaggatggaatattaccctcttataatggcttgtttatctagcagctctccctcggctccaggtcagaggctttcctccaggcaccactccgcgcctgcctgttcatttgcggtgcccactgttttgtctgcctgcctcaccttgtctgtcggaggtcactgtccctccagggaatgcggtaaccagctgcattttatctagtaaggtggcctctgctcacatgctcttgtgacagattacagcctggcttcccaccagggactcctctgagtgagacaccaaaggctgttgtcagtgtggctgttggtgggagagtcctcagtgtccaaagatacccttagcattttcatgtgtctgtaggaacgctttcatgtgacttctgtgtctcctgatggatctggaaagatttctctcctctcagagacttctaggttgtcttactgacattggaggcaaatggcttatgataaacactggaggatttttgtcgttgttgttgttccac

SEQ ID NO: 192550 - DNA, 337 bp, Homo sapiens
aaactactaatgatacagtaagtctatataaatacatgtgatatatacatatagcacacagcacaaaactttgtgtttataagaaatagaaattgaatgagaaaaatcagaatataatcataaaaatacacactgtaaatgcattttcacttaatgcttttggatgttgaattcctactgagttgaaatggaaatatcatccataggaagaaaaaaatgaggaaaggtaagcaatattatcacagtattatttatcatacacattaggactaaaaatagtcaggaaagaaagagcattatgtcattctctcccagtctttaaccttgtaaaaggttg

SEQ ID NO: 192551 - DNA, 459 bp, Homo sapiens
aaggaagcaatcatgagaatgaggggtactatctggtgtagtgatctggtgagttttagttctttgatacttttttgagaggcctgaagttcctttcctgaggaaggaactcacataaaacagatgtaaatttcaagctttaagcccagaaggatcaatttctatagttatcaaaaataatggtctgtggggcaattgggctggtttcagtctcccctttctacttatcaatccctcaatcatgaggaatctggtctgagtatttctggctgtttcattctgaggatgggtgtcctaggcagtggccacccaggaatcaaaggttaatctaatatagagttttcttctgacactcaatctttctctctccagttccccacttccaccaaagacaatcacagcaggaccactctacctgcaaaataagcttcagttccatatacttggcctgataaccca

SEQ ID NO: 192552 - DNA, 442 bp, Homo sapiens
cctgtcattattgtctttcctatgtccagccctcatactgaggctgtccatcactttggagattttgagaattttaggagttgcgtgccagaaaaccagaacaaacaccaaatacctatatttaacaatatcacaaacagcatacctggtctgtactcacaagatgccaggggcattcccctccaatcgtaacaaacagaaatgtgtctagacattgccaaatgtctcctgagggggcgatggagctggggcaaaactgtccttggcattgagaagcagcaggttgttacaaggattcaatgagcaagttattgtgcaggtagcacttagaacatggttggcacatagtaaatgccatgtaaaggtctacaattattattttcattattgttctctagccctgccttaccttgtggaaaataaatattttgataatatgagg

SEQ ID NO: 192553 - DNA, 258 bp, Homo sapiens
tgcgccctgtggatatcttaagcctttaagggtgagcaaaaaacaataggttcacaaaggaaaatgagaatgggctatgagaaaggtaagaggaaaaccaaggaaagagaacgttttgagacagtagtagtggtcagcaatgtcaaattgctgcagaaattttctaagagtgaaattgggtttagcagctgcaagagcagttcatttaattggtgtagcagaagcccattagattgcagtgtgatgagaaattattgg

SEQ ID NO: 192554 - DNA, 307 bp, Homo sapiens
tccacagcagagcctcacacgtgacaagcgccctgagttagcgaggtgttggtatcattaccggatctgcgtgcagtggattaaaggatgctgtgcacagcgtgtccgcagcagagacttacacgtgacaagcgccctgagttagcgaggtgtcggtatcgttactgcattgcatcctacctcgtgtgtttacctggctgatcctgaaggctgtaggcatctgagtttgcagtccctgttctcaaccgaataggatattgcatttcctctcgtgagctgccgtgggccacagagggtttgcccccca

SEQ ID NO: 192555 - DNA, 554 bp, Homo sapiens
  misc_feature (539)..(539): n is a, c, g, or t
  misc_feature (545)..(545): n is a, c, g, or t
  misc_feature (547)..(547): n is a, c, g, or t
accgactgcatctgtgctctaaacaagtgactattactccataactgatctcaacttttttttttttaaaaaagcagatacaagatattaggcatagttaagaatacaggtgatttctgggacttatcctctgcctttccctctgaactgccttttagccattctttcagtcatccattcacacaccacttcaatgcctcatatttcctgacagtcttattctaaaatgaggggactgtgggatgaacagacctagctctggcctataaggaataatcaatctccctcatcaacatagcttttcccaaagtacgttacatgctataacaccctgtaaggaatcattgcacctcagcactaaaggttctgaggcggcctacaacagagaaacctgtttaatttggattagtcaggcatttctcaaacttctgactacagaactcccctcctcccaagttttaaagttacaccattaactgtccacagcacacggtaagaaaggctagagactgggcatggtagctcacgcctgtaatccncagcancntttggaa

SEQ ID NO: 192556 - DNA, 495 bp, Homo sapiens
tcagggacacagtgtagctcagagcagaactgagacttaaccagcatctgtgcaaagtgcaagcaaccaaacagggtagcttcaaggagctcagtgggagagagggggctgggttctaatctcatgacagccacagacttgacaagtgacctccagccaagcatttctctgccgaggcttcagttctttcatctgtgcagcggacagttcagactagatcagtagttttcaaactatttccaggaaactctctaggggccacagacatagctgggggccgccatgggaacagtggagggacatagttgaaaggagatgagcaggccagctctgctgccccaccctgagtcaaccagagaagctgaactgtgcataaggtacccattactaaaggtttccattgcaaacacagatttgaagtctactgttctaaatggcctctacttcctgctgtcatacgtttttatcaaataaattcattcattcaaccgttca

SEQ ID NO: 192557 - DNA, 314 bp, Homo sapiens
tcgggaagtgtctagcacaatgaaagtccttgtaaacgtctgagtgaacctcttgacctttttaaagggttttgttttgttatttttaatgctagttcttatgtactctctctctctctctctcacacacacacacacacacacacacacacacagttaccctaattctcctttgttaatttcttcactttttctttggagtcaagatggaatggagaattatatggctgaagatatagagaaatttgaggtggagagaccagaatttgcaggcacactccaagttggacattcttctatttggaatgcaggaa

SEQ ID NO: 192558 - DNA, 361 bp, Homo sapiens
gttctagcccgaggacaaaggaatgttgctgatttctagttatttcactgtggtgaaggtcttcagctctaggaaagacagaggaagggattctgggaggttgtagcagtggaaaaagttcttttcttcctctgatcgccctctcagctctttccttctgactgaaaatcatcttcagcacctctcttttaccaccactgccaccacccacccactgcgagtcctattggctataggttgtatgcaggcagtagtagagctatcaaaggatattaagaaagggagtgattattaataaatcatgtaatgtttctgattttagctcttaaaaacagttcttaaattgctgtccacaccccct

SEQ ID NO: 192559 - DNA, 279 bp, Homo sapiens
agtagctaggagcacagggcaagccagcatgcccagctaattttttttaaacttttttttttttggtggggagggggatagagacgggtctcactatgttgcccaggctgtctcaaactcctgttctccaccaatcgtaccttggcctcccaaagtgttaggactacaggtatgagctaccttgcccggcctatttacatttttttgctgccttctttccttccagatccacttgttcatcacatattgttgattttcctttttctagcttcaattttt

SEQ ID NO: 192560 - DNA, 194 bp, Homo sapiens
ctgctttgacttgatctgcacatactacaaacagggaatttatttgtttcctctttagttttgagaactttatcggtggataaagtacttaggctttggataaactgccctctctgtttcctttcagcagatagtgaagagcgaatgatgctcattggtgaacatgatcaagagttggctttcttttttcatct

SEQ ID NO: 192561 - DNA, 479 bp, Homo sapiens
gttctgaaccaattccaaggaactttatggcacaaagaaaaaaaaggggaacttacaaaaagtgaccacactgaagcgtcctggtcacccatccctggttttgaccaccagcctttaaagtggcaagcgggtgataacccatttcttatttccccctcagcatttcctcactgttattcatacatgtggtcatttgtactcatctcacaattgttaaaacctctttcctcccttccaggttttactgaactgttactgcgaagtctgagagatgaggtcatttaagattatttcttatttgtaaattagatcgttcatatttgtacctaatctgatcttttgggtaatattcctagttatgtagactggtctctcagaagagccggatattaaatgcagtactttaaactttacacccaggagaccggatgggtgaggctggttcactcggccaaagtaccattttatctctgcttttt

SEQ ID NO: 192562 - DNA, 546 bp, Homo sapiens
gggccgctctagaggaccccgatggccttcaatttccctaaaagggaggaagatcaactgcaaaataatacaaagtcggactccaactcacagaggttagttgaaactcatttttcctatcactgatctattacttttattaagtttgatcaatctgaacagtcacttggctattaggaagtcatctgaataactgaaaaacgggtggggtttttttgtttttgttttttaatagagacgaggtctggctatgtagcccagctggtctggaactcctgggctcaagccatcctcccactttggcctcccaaagtgctgggattgcaggagtgagccaccacgcccagcctgagaaactgttctactgtcaaatttcatgtcaacttgaaaaaactagattcctgatgacttacatcatctcataatcaatgctcaacgtagatcacacttacaactcagtgtacattaagaacgaggtgtttaccaggctcacagtcagttaacatgttgatgctattcattaacataattccttaagttcagctg

SEQ ID NO: 192563 - DNA, 117 bp, Homo sapiens
ttgatcttggacttcccagctcctagaactctgagaaatgaatttctgtcatttaagctacttagtttatggtattctattatagaagcctgaactgactaagacaaacaaggatca

SEQ ID NO: 192564 - DNA, 342 bp, Homo sapiens
tgcgtaagtaatacaggttgagcaacccaaatctgaaaatttgaaatctgaaatctgaaaggttccaatgagcatttcctttgagtactatgtcagtactcaaaaagttctgaattttggagcaaattgattacagatttttgaattaggaatgttcaactggtaagtgtaagtataatgcaaatattccaaaatcctaaaaaatctggaatccaaaaaacttctgatctcaggcatttttgataagggatattcaactggtattactatacaaacacaccaaccaaaaaagaaagaaaaattctaacagccacaagctattgactgcctatcctgtgccag

SEQ ID NO: 192565 - DNA, 289 bp, Homo sapiens
taatgctagatgacgagttggtgggtgcagcgcaccagcatggcacatgtatacatatgtaactaacctgcacaatgtgcacatgtaccctaaaacttaaagtataattaaaaaaaaaagaaaaagaaaaagaaaattagggcctttaaatacattcaacatctctgatgaaaaaaatgattaataaatatccaacctctcatcataatgaggctgtggaattgttgaaaactgcaatttcatataacttctggacctagtcaaactttttacaaaagtgaccacaaca

SEQ ID NO: 192566 - DNA, 237 bp, Homo sapiens
ttttccactttcagggcataaatggcaggaagatagaagcataaccattcatagatatagttcttttattaataccatcataagcttaatcatcctgtttttgtctgttttagatatttcataaactttagatacttgttaccatgaagcaacattaatggtccaaatacatgcttaggaatacttacaagtgtttgaaaatactggttctgcaaggtttcaaaaaatattccaaat

SEQ ID NO: 192567 - DNA, 406 bp, Homo sapiens
ggagagcacgctttatccaggtggggagaagaggggcttctaaaaaggttcccatggcataacagttgatctgaaggggaaggggatgagttgggagagcttcccaggcagaaacatttgttcattcattcattcaaaaaatgggtgttttattatcatgtatttttatcaattcatccttccaataactctgttaagatgagaaaactgagatccaggttaaaagagccagagccagaagcagatttcaagcttagtgatttctgctttcacagacacaggctttccactttcctcccgctaacgttctgccaatcggaatttaacgtggaattggccattaacttcctgttagagttgggattttagaaacacctgtgtgtgcacacatggcttaattctgcct

SEQ ID NO: 192568 - DNA, 170 bp, Homo sapiens
ctttctagaacctgtttttcacaaggtttgagtctgaactgttaacattctactgatttctgggtgaagggactgactgcaccatcctagcctgtcagagcacttgccccaatacttccactttaagagttttccaccttgtccagaactacagtccactaatcccctca

SEQ ID NO: 192569 - DNA, 417 bp, Homo sapiens
aaatatggtaaataggggttgtttaatgaggtttgttatgcagatttaagtttaagagtaaggtgccttccccactgataacaggtgttaagagtccttctcttcctggtacagggagcgggagataccttttacaaatgtaaatttcctttataaaagaagaactgtccttgcctctgctggttctcaatggcctttagctcaaaataatccttatgccaaaaaggcacattttgcagggaaatattttggtgcctctcaacagccagggcctggtcaactctctggagctgttcctcactcttgcaagcctttctgacccattgggcacctaagtcattgtcctgctttctcctgtggttcattctcagagcagtgctgtgttgagaaaacacagtccaacaatcatccagaggg

SEQ ID NO: 192570 - DNA, 460 bp, Homo sapiens
tcactatcatacttgtttccaaaaggtacaacatataaaattatgttaaataactttttcaatgattttgaatattaagcatagaagaaaatggtcatgaaaagaaatctcaagtaaaaagttacacacaaactaacccaattaacatcttaaaaaaatgttttgcccatactggaaagatttaattggtatctaactggtatgcacatcaatgttcattgtttacagtatctgaagactagaggcaaaaaaaaatgggaataaaatgtgagtgaaggccgggcatggggcctcacgactgtaatcccagcactttgggaggccaaggtgggtggatcacttgaagtcaggagtttaagaccagcctgaccaacatggtgaaaccccatctctactaaaaatacaaaaatcagctgggagtggtggtgtgtgcctgtagtcccagctactcggggggcta

SEQ ID NO: 192571 - DNA, 338 bp, Homo sapiens
ggactatttgttgaaaagattatttctacattgacttgcctttgtactttagtcaaaaatcaatcatatttgtgtgggtttatttctagactctgctctggtcatgtctgccttttttctcataccaccctcccttgattacttcacttttatagtaattattgcagtcaaacagcgtgaggcccccaactttgctgttcctcctaaattgtttctgcctttttagtttgtctttctacgtaaattttagctttttaatatctacaagaaatcctgtgaggatttttattgtgattgcattgaatctatagatcaaattgaggaaaactggcatttta

SEQ ID NO: 192572 - DNA, 365 bp, Homo sapiens
gcaatatggtgaaatctcgcctctactaaaaatacaaaaattagccagacgtagtggtgtgcacctgtaatcccagctactcgcaggataatcagttgatcccaggaggcagaggtttcagtgagccaagatttcaccactacactctagtctgggcaacagagtgagactccatctctttctctttctttctttctctctctctctgtcatatatatacacacacacatatatatagatatagatatatgtacatatatctatttctgtgtgtgtgtgtataaaacccttttgacaagcaggaactcttttgcttttagcatcaaacacaggcagacacatatcaatttccatatcctattaac

SEQ ID NO: 192573 - DNA, 193 bp, Homo sapiens
gttgagaagtagaatagaaactatcctatatgaaatatttttaagttagcacagtaatgttcttgcctttgactagtttaacatatagtattttttctttttgatcatttagataatggaatatgaggtcttctagggaattgatctaaaataactctttattttaacaggttacttttgatccagaagtatt

SEQ ID NO: 192574 - DNA, 353 bp, Homo sapiens
aagagctctgatgttagtgtatgtgaatgttattctacattaaaagaatggctgaacacaacacaatgaatagcatctaataataaaagaagtgcatcttcagataaatgttcttaaaatacagctgtagttatgacattttcctgctcacagataactgttcaaagcaaaaggaaactcccaggcactgaggaaagggtccttctccatctcactgtacacacatctcttccacctcccaccatgtgtcctgggagccaaccacccctccacttgaacacgtactgcatttttctaggctcatgctggtcctttctcctccttccccactccaacatccgcctgttgaaatt

SEQ ID NO: 192575 - DNA, 234 bp, Homo sapiens
gataaacgaaaaatagaacaaatgtcaaatttattcacattctcttaatttgaagctaatgcttagattatgtgaccaacctctaaagaaaatatatctttcaattgcatttcacacaagcaaaaggcaacctttgtggaaccggatcccaatgacgcctagtaagtaactggacttaactggttcttctggtcaaaaggcccaaagtcgatcggcagtatgccagactcccag

SEQ ID NO: 192576 - DNA, 611 bp, Homo sapiens
tttccaaaaaaggtaggtaggagggagggcctggaggaagtaacacaagtttcctttctaccacagccaataagaaacagcattggtgatcactgcttcatctctcaaccaaaggaatcttgttcagggcacttttaggtaatatatagatgttgtcagttcatctattgtaatacaccagaaaaagaaaaccataatatggatgtcttgaattttgccatatgcctctttaagcagtttttacttgggtccattcctccttccctatattttcttaggcttattgggaggggaggtcagggggaggagcaatcactcaagagatccttgtctccttcctctgtaattcctattttaaagctccattcaataattacagtaattctgccacgtggatttttcaactgacttatgaagcatctatccagaaagaaagcagcagggcagaagattatgatcaggaacagtctgaacacactcgagacccataatagcaaataggtaagtggcttacaggtcactcctgcaaggcagacataaccaaccacaaccagtcctttggggtccacgtggggtcccagaatccttccaaaggcaacacacccaccagt

SEQ ID NO: 192577 - DNA, 597 bp, Homo sapiens
caattgagctatctctgaaaactcaatataaattcccatagtgtgctttgtactaatttttgcaaaatttttcaggtaattggaattatcaatcttccactaaaatagcaatttttaagtggcttattttaaatagttgctaaatttgctaaaatcatgtatctaaaacactatgcataatatatgacaaaaataaatgctgggaaaaaaataaaaggatttgtggtaaacaaggctgaccaacctttagtcttaagaaaatatctggctgggcacagtggctcacgcccgtaatccctgcactttgggaggccgaggcgggtggatcatgaggtcaggagatcaagaccatcctggctaacacggtgaaaccccatctctactaaaaaaatttcccagagcggggggacctggggctgttggggccttttcttctgcatttctgcagccatgcccctcaatgtaggggctctgcaggcctggcttccccggggtcgtgagcagattctggatttctctagagcctcactttgattttctgcctgcaaaggaatgggcctgcagacctccaagctcctctgtcttctctggctttga

SEQ ID NO: 192578 - DNA, 157 bp, Homo sapiens
ctgggattttctttggagattcacagaaaatcacattttgatgtgttgatgattttctgagtaaaggagttagtctgaatactgctgggatacttgtatggttggttcctagggccaaaattgaagagccataaatttccatcttttaaatatttta

SEQ ID NO: 192579 - DNA, 414 bp, Homo sapiens
ttaatcctcgtctctcaccagagtaggtgaagaccccgttatttgctgccatggtaccgtgatcctcttccaaatgcttataaatgtggaacagtgtaattaataacaaattacttgttatatgttgcctctctccagtctgttccttcataaagcccaagtagtatgaaaatgcgaatctgatctatcactctttgcttaaaacctttctttggcttcccattgctttaggataaagagcaaggcctctgctgtgtccctgaggtcccaagagatccttccacaacccacctcacccttccctccgttccatgatgactccgctcattccctcagacatgccaggcttttcctgcttcagggcctttgcacatctgttccatccatgtggatgggtctgtctcctctctacat

SEQ ID NO: 192580 - DNA, 475 bp, Homo sapiens
agaaaggacatgattccttccctcaagcagctgacaggctaatgggagagaaaaatgaatagataattacagtgcagtttgtcaagggacagaaataggcaaggtggacacagaagttctgagcacataaaggaggcatgactgacccacactggaatgatgaaggaaagcttcccaggaccacatgacaaatgtgaaaggcagccctctaaggaaagagaagggaggaaaggttaacaaggcagaggaaatgcaatgcttgaagaaggtttgtgcatttagaaaattccaggtggttgagcacgagtgaagcatgaagtcggcgataggagtgcagtgagaagtgaggtaggagaaagaggtgggagtgactttatggatggctttgtgtgtgtctacagggattgcacagtatcctgcagaatagggattctgcatggtgtttgcagagaggttggggaagggagctgtgcct

SEQ ID NO: 192581 - DNA, 430 bp, Homo sapiens
acacaccctcacactcaccctccctacacaggcatcggggcagttctttatatggatgactaacaactaagaaaaaatgaagattagtatgaatggcaggagcaacaggcagtcagaagagatttttctatttaatcttttatgtgtaacactttacagcatgaagacgtattctatcaatatttgtatcataattgacaaattctcaagtgacatagggatttgttcttgattcaccactaaagaaaatttttaaagttaattttttttaattacagaagaattctctttttatcttcacaattgtttcatgatctatttatacattggatgatatttatttaatccagttttgtattagaaatggatagtgatgccaaaagccaccgtgctggctttaaaaataataaaaatagtttttgtattattt

SEQ ID NO: 192582 - DNA, 419 bp, Homo sapiens
cacagatgtatggtaagttctcacttaatgttcaaaataggttcttgaaaactgcatctttaaatgaaacaatgctgctatatgccatttaaacaacagacctagcagcacccttgtgacacaatggccaggctagtctggaactcctggcctcaagtgatctccccaccttggcatcccaatgtgctggcattacaggtgtgagtcactatgcctagcctggctaatgtgtgttttttaaaatttgtttttagagatggggtctccccatgttgcctgtgctgggcttgaactcttgggctcaagtgatctacttcagcctcccaaagtgctgggattacaggcttgagccatcacacctagtcataaggacagaatttttgagatagagcaaagccatatttagaagtgtctataaa

SEQ ID NO: 192583 - DNA, 415 bp, Homo sapiens
agaatgggatgttaccatttggttggacgacaggacaggaggaagcaaacacttagaataggcagttttggaagggagaagtaagtgaagtaatataattactagctaacattctcaccaatcacatgcctattatttccttaaatatcatcaccaaccccaaaaagtaggactccagatgagaaagttaaacccatgggacttaaataactatcctggacacatggttactatacctggaaataaactgaggtctgtgaatccactaccttcatgtgaaccccagtaacgatggaactgacatcagatgacactaagtgacacctggaagcgccatcttcaaatttgaaaagcaatgctctagacaagtaaaacatcaacaacaaatcttcgtccaaccaatgtttatgttttc

SEQ ID NO: 192584 - DNA, 526 bp, Homo sapiens
cggccgcagctacgagaacctgctggggcgcgaggtgcgggagccgcgaggcgtgtcccccgaaggccggcgcccgcccgtcgtcgtgaacctgtccacctctcccagacgctacgccgcactgtccctgtccgagacgtcgctgacggagaagggccgcgcgggcgagggcctgggccgcaactggtacgtgacgcccgagatcaccatcactgacaatgacctgcgcgccaccgagcgcccgagcgccagggcctgggagttgcccgggggccgcacgcggccacctccccacgcggcccccgacggccccacctctggccgccagcggagcctagagcagctggacgagctcatcacggacctggtcatcgactcgcgacccaccgccggccaggcctcagagcccgcggccgactgcctgggcccccaactgcgccgactgctggactcgcggcccgcgggctccggggcccccgcgctggcgccgccacgctcgccccccgcctcggccggcagcgccgag

SEQ ID NO: 192585 - DNA, 152 bp, Homo sapiens
ctccattctttagaggtcagaggaaacgagaaggaaatggcaaaggaggctgcagggtggtcctgggagaatgtggggtcttggcatgtaagtgaagaaaatgtttcaagaaggattaaataatcagctgtcacttctgctgatgtgtctgg

SEQ ID NO: 192586 - DNA, 168 bp, Homo sapiens
acctagcaagtcctcttccattctttgaggtttcccacttgtggctttctggcaaaggcatgttcagctccttttttctgggcttccaagaacctctgaaatcctttgcaattccacctcgctttgctctagcagattcctgccatgggagacataaatgtgtgtcat

SEQ ID NO: 192587 - DNA, 451 bp, Homo sapiens
ttaagtgaaaaagtgctagtggataagtagaaataatgtgcaccacttctaggcctggcccctacaaacctcgggcaggctcctccacacgccttctcctctcccgactgctggcagattcagggcaatttgggagccatatgctgaagaggagcatccaccagcctgagtctctaacaaccacctgctgatggcccccaactcacaccagatgcgacatgaggcagcaatcaactttaactgtcttaagtggctattttggaatttatctgtaaccacagttagcattaactataactaatacagagtgcacctgagcagcttttatttcatgtaatttgcattaactttttaatttcatacatgcaaatttaaaacaaataataagctggtactgggactagggaaaaccttctaaactcacttcctaagacttctttaacactttggg

SEQ ID NO: 192588 - DNA, 694 bp, Homo sapiens
aggaatgaatatagagatgtacaaataaagcaaatacagcaaaatattaatttagaatctaggtggttggtacatgggtgtttactatgtaagtcttaatttttctgattaaaatttttgtaataaaatactgatgcaaatgtggttgagaatggtcatcatgtctacaaagagacactaatgtttaccaatatgcatgctctctgcttgatgcagtcccctggcatgtcagtgggtctctgtgactgagtctggccagtggaacataagtagaaataatgtgcaccacttctaggcctggcccctacaaacctcgggcaggctcctccacacgccttctcctctcccgactgctggcagattcagggcaatttgggagccatatgctgaagaggagcatccaccagcctgagtctctaacaaccacctgctgatggcccccaactcacaccagatgcgacatgaggcagcaatcaactttaactgtcttaagtggctattttggaatttatctgtaaccacagttagcattaactataactaatacagagtgcacctgagcagcttttatttcatgtaatttgcattaactttttaatttcatacatgcaaatttaaaacaaataataagctggtactgggactagggaaaaccttctaaactcacttcctaagacttctttaacactttggg

SEQ ID NO: 192589 - DNA, 297 bp, Homo sapiens
ggtagagagaaagagaagagccagagagtttccatagatccacacctgggacttgaatgcgtgtgagatgtgatcgtgataatcaagactttgtgttttcttaaacatactataatatgtgcatctaaagaacagggtccttcaaagcagttaccttgggagactttggccttgttctgacaatgttgccactactaaaatttataattacggactcttccttcaggactgccttcaaccatatgggaagaggtctcctaactgtagccaaggatgccatttctcagcctaaccact

SEQ ID NO: 192590 - DNA, 733 bp, Homo sapiens
aaggcttatacatttatatatatttattaaaatttaaattatgtcctctaacttagaattgtgaacatgtggatatgtactgagctaattctttggaataaacatttatgagctacaagtatataattttttaacaaaatcagtccaatcttcaaattgacaagtgcatttaaaattttgactttcaggctgaaaatggtgaatgtgaatgttagagtttattaacttgtcgatgaccattagttaaagaccaccaggaacacatgcgtcatttagtaaagttgggtctgttaattgttcaaacaagggaaaacataaaccatggggcctctcaatcagaaggtgttagaacttacaggatataggcttctgttgagcaatttctagagagggtttaaggaagtagggctttactctggaatgtatagcgtcaggaaatggtagtaattctatgattggatgtgttaacttttatctaaaaggaaagaaaaatggatcgaggctaaaactatagctgataaagaaggagcagtcactcatatcagccagaatggagggttgtttggttattcttgtggtttgggcaatgcctttgtttttgtcagcattcaaacatgattatggagtggtcttgtttttaatcttgatccatcagagtcacagggtgactttgtctgatgttggtgttctgttaacaagagaacaccacagcctagctgtgagtgccaggcca

SEQ ID NO: 192591 - DNA, 174 bp, Homo sapiens
atagattctagaacagtgatggaaaggctctcaaacagtgacttatgtctctgtgtaacttacacatttaagtttctgtttctttatagatagaaaaacattattttggccaattaactatcttttttcaagattattatttgtaatataaaataagctataattttgagttca

SEQ ID NO: 192592 - DNA, 435 bp, Homo sapiens
gtgctggctgtgaacgttaaccttgcatctttctgtctatcacccaacaatttgtatctcaactgttcttaggtaatccagattcctccaaaacagaggaacacacatattggcagttctgaaggacaccttctgtaatttagttgtctgtcttgcattcagaagttttgctgagtcacttttcaaagacgttatcaaaggctgggtgcaggtggctcatgcctgtaattccagcactttgggaggcagaggtgggaggataacttgagcccaggagctcaagaccacaggtgatccacccgccttggcctcccaaagtgctaggattacagcaatgagccaccacgccaggccaaggggagcttcttaataacaactagagaaaccctaactcacttggggtatcagctgacatgtaaggatatgtaagcccct

SEQ ID NO: 192593 - DNA, 431 bp, Homo sapiens
ctgcagcctgcccgtttatggctgaagtgagccacctggccaggaggacactagctactttttcattgatgggctttgaagatggtgacagtgacagattcaggtgatggcgtctttctgctggctgctctaaaaagaaggccacttggccccatctccagaataggaaccatgagacagtgacaaatgcccatacaggaagtgagctgcccagcactcaccatctgagccatttaccccatgtttcccaggtagcccctcttcatttcctgcctattcccctggcttgctttatttatttatttatttatagagacagagtcttgttctgttgcccaggctacagtgcggtggcgcaatcatagctcactgcaaccgcagctgcaactccctgggctcaagcgatcctcctgccttagccgcccaagtag

SEQ ID NO: 192594 - DNA, 467 bp, Homo sapiens
ccttgaaaaccttgttggcaaatagctacactagaaaaatgagaaggccaagggagaataagtacttaaggatatccttgccgtggctgctttgtccctctgaagcctgctctgcctgtgtaagctatagcattcttgcggcagtcaggaaggttcagtggatccaggtcactgattaaaagcagcataaaataccagtgctagggcaaagtgcaggctaggtgagtggaaagtcccttgggttccacagggtacagagtaataggcctgtccatatttttcttactgctaaaactttgaggctttgagtgggtttatctgcagctaaaggaacctctgagagggcgcatctatcagagacaattgcaactaaatccgagcttcctttctcatggcatcctcgccaagcctgattagtgtttccaaaagatgaactaaactcaccgtgctggagcctcatggacaaa

SEQ ID NO: 192595 - DNA, 146 bp, Homo sapiens
gagaccacttgagttgtgactctcctgcttatggtgaaattaagaactaaaactaaaacaacaggaaccctttcataacggaaatactgaagtataaaatgaaaccacctcctaaacaactctttttcctttgaaaacaaagctaa

SEQ ID NO: 192596 - DNA, 400 bp, Homo sapiens
ggccacttgtgcaggggccttgggggaactgggagcacagtgcagggtgttcctgctgcatgcaggggaagggagggcaagggaatggagggctgtggccggcgggccttggaggccacactacagagacaggacttagcccagaggccactgaggagctttcagtaacagggaagcagtgtcgagtactgcaggccacgtggctgcatttgagggtggctggtgggaatagggtgcggcagcccatctggcctcggaggcatgagaactgagaacagctgtacggccatacctttatgcatggatggccatagcctcccaaaggtgggacagcctgagtgttcatcaacagacaaatggagaaacagcctgtccataaggcgcggtgccattccaccat

SEQ ID NO: 192597 - DNA, 713 bp, Homo sapiens
agggtttgaaactttaaaattggggtggcttcctcacctttgtctacttaatttggatcttgaaggaagtggtgaagaggggagaagtgagaaaagagaaaaggaggaagaaaaaggagaaaggataaagatcattctagaccttttatgctccccccaaccctggggctggggaaggaagacaaattaaaattacctcaaggaagtctgtttctacaccactctcttcttgccctttaacaccttaaaaccaagatcgccccgaattttcaacatatactgcattccctccctagccaagagggctgttctcctaaaaaacaaaaacaaaactcaagcaaaaaaccctaccaggagagaatcttgagttagtgaccttaagaccttaaggggaaatgggttgagagcctgaatttgcaagtgaaccaatgaaaatcctaatataaagtttttataaccttattcgatgtggttaactaaaatagactccagcctcctcgccacattctagaataggcccacacctttgcttaaatgtctgtgaatttccaaaggcttctagtctcagcgttgccctggctccaagtccctgcttggtggactcagtctcacagtgcttcacctttggcatctgttctctgctttcacctccaggaaagcccaggtatggagttctgccctgctgtggtttcctcaaaattggtcgtttaagg

SEQ ID NO: 192598 - DNA, 484 bp, Homo sapiens
caatgaatatttcttttaaaatatttttatgtacattgtatttccttaggataaattcctagaacttgagtcattgaatcaaaaagaatccagactttcaaggtctttgataaattggctaaattgttcttcagaaaaagtgtgccaattttctgttctacctgcagggtgtgagacagttcttagggggggagaagtcaaaacaattgtattgtctatattttgacaaattcattattaagagaaagctagagaagcaaatcacaagctctgaattcacacatcacaattctaaatgtttgttgttctaatcctcaatttcaagttcttgttaatgcatccaccatttgaatatttactttttcaaaatataggaatgtgttaatttaccaaagatcacaatcggttctttgctttttgcttattttttgagacagagtcccactccagcctgggcaaaagaacaaaactccgtctcaaaaaa

SEQ ID NO: 192599 - DNA, 603 bp, Homo sapiens
tagaggaaatactgttaagaaaatcatggccgggcgcggtggctcacgcctgtaatctcagcactttgggaggcggaggcgggcagatcacaaggtcaggagatcgagaccatcctggctaacacagtgaaactccgtctctactaaaaatacaaaaaattagccgggcgtggtggcgggtgcctgtagtcccagctactcaggaggctgaggcaggagaatgacgtgaacccttgaggcagagcttgcagtgagtggagatcgtgccactgcactccagcctgggcgacagagcgagactccgtctcaaaaaaaaataaaaaatcataagagaaaatacatttactataccttaagtggatgtagatcatcataaagatcttcatcgtcattgtcttcacaccgacgaagaagaggaggggttggtcttgctgtctcgggtggcagagacagaagaggtgcaaggggaggcaggaaagatttattgacaaaaatcgtgtataagtggacctgtgtggttcaaacttgttgttattcatggatcagctgtagatgctaaaggcaaaataaatcaggttaacggggagtgggaggttgtaattg

SEQ ID NO: 192600 - DNA, 280 bp, Homo sapiens
ttgaactagatcgatgtttcctaatcttctaccattcatatgccttcaagatagctaccacatctgagaaccatatgacacatttaattaacaagcatttaaaaataattttagctttatccttgtagctatggaactacaagtttgatgagatcattcttttttctatatacattaaaatgttacctattaaaattaaaaaccttaatccatgtaccatctatgaccatctcacgattatagcacacctttatacatatcatagactttatgattacac

SEQ ID NO: 192601 - DNA, 200 bp, Homo sapiens
tgacagtgcatgacaggagaaaaggctttaaggccaacctgagctgggtataattggcaagtctcaacttctttgagccacaatgctgtcatctgtaaaaagggaataatgacacttactctgcagaattggcccgaaccagacagctttgactattgactacgttgttagtgttaatatagaaggccccactgctgtgt

SEQ ID NO: 192602 - DNA, 843 bp, Homo sapiens
gtggggctttgccagcaggcagtggaggtggcacgcctcccgaggaggggtgggtttggggctgatggaagaaaaagcacatgtcctgagtagttgctcccagctgggaaaggggtaactgaagccccaggaaatgcacggaatcctgggggcatgtgggcgcctcagacttgagccagcaacacccttgacaccccttctctgtgcagagagggatgagtgccgagctcacccgtgcagaaatggagggtcctgcaggaacctcccaggggcctatgtctgccggtgccctgcaggcttcgttggagtccactgtgagacagaggtggacgcctgcgactccagcccctgccagcatggaggccggtgtgagagcggcggcggggcctacctgtgcgtctgcccagagagcttcttcggctaccactgcgagacagtgagtgacccctgcttctccagcccctgtgggggccgtggctattgcctggccagcaacggctcccacagctgcacctgcaaagtgggctacacgggcgaggactgcgccaaagagctcttcccaccgacggccctcaagatggagagagtggaggagagtggggtctctatctcctggaacccgcccaatggtccagccgccaggcagatgcttgatggctacgcggtcacctacgtctcctccgacggctcctaccgccgcacagactttgtggacaggacccgctcctcgcaccagctccaggccctggcggccggcagggcctacaacatctccgtcttctcagtgaagcgaaacagtaacaacaagaatgacatcagcaggcctgccgtgctgctggcccg

SEQ ID NO: 192603 - DNA, 603 bp, Homo sapiens
  misc_feature (14)..(14): n is a, c, g, or t
gtaacttggtttgncaactgataaaaataaagaattggggccaggcccggtggctcacgcctataatcccagcgttttgggaggctgaggcgggtgggtcacgaggtcaggagatcgagcccatcctggctaacatggtttctactaaaaatacaaaaaattagccaggcatggtggcacgctacacagctactcaggaggctggggcaggagaatcgcttgaacccgcgagggggaagttgcagtgagccaaaatcgcaccactgcactccagcccgggcgacagagagacagactccatccaaaacaaaacaaaacaaaaagcagctttcagaaaagacagtatgtgaaaacacaatctcggtatcacagataggctgggcacagtggctcaggcctataatcccagcacactgggaggccgaggcaggcggatcacttgaaccggggaggcagaggttgcggtgagccacgattgcaccatctcactccagcctgagaactatcttcaggttacagaagtttgtaaaagggaacttcttcccctctcctgctgtcaggccgaatgtcagctatcactgggatttctcttttttgtcttgt

SEQ ID NO: 192604 - DNA, 296 bp, Homo sapiens
acctggtacagagttggagtatgtgcgcagggtcaggacagcatctcacatgtgagggccgctcagcacaaagtatcacagcccaaaggtgtgaaaacagtatccattatagggatcgtgttgggggtcaaaagtaggatgttggggtccaagcagggtgagaaagaggtccctatggtaaagcaagcagggaggctcagcacagagtactagagttgaaacatggtgagaaaggtgtccttgtggagaagctgtgtgtgtcatgtcagagcctgagaggaaggaaaaagctgtga

SEQ ID NO: 192605 - DNA, 129 bp, Homo sapiens
ttatttgcaaagctttgtgctaatcactggggatacaaaagctattaagagtggcagggtctttgcccctctgcaactgagtctagtgggaatacaaacaggtaagtagtgcctaaaatacagtgtgat

SEQ ID NO: 192606 - DNA, 581 bp, Homo sapiens
tcttttaagaagacacataaggcatgattgattgtttctagttcaagagaaaagcacaaaaaagtttgagtggacataactacacttaaaaatagagatttttaaaacacactttaaaaaattcgaagtatactatacatatgacatttactatttgtactatttgaaattgtacaattcaatagtaaaaaatccatttatattctttttttccacccttcatctctctctccctactacccttcctggcttcttgtaaccacaattctactctctctctttgtgagatctactcttttagctgccacatatgagtgagatcatgtctttctgtgcttggattatttcatttagcataatgtcctccagttccatccctgttgctgcaaatgacaagatttcattcttttctatggccgaatactatttcattgtgtatgtgtatatacaccacattttctttatccattcatgtattaaatggaattgacgtaggatgattccatatttggactgttgtgaatagtgctgcaataaacatgggagtgcagatataccttcagtgtattgattttctttct

SEQ ID NO: 192607 - DNA, 209 bp, Homo sapiens
tgaaactcatataagaaccagtttgtctaaataggccaatatctattgaagaaattgaatcaataataaacaactttccaaagcagaaagcatcaagcccagatgagtttactggtgaattttgccaaatatttaaggaagaaattatatgaaatttctatcatctccttcagaagacagaagcagagggaatacttccaagctcattc

SEQ ID NO: 192608 - DNA, 299 bp, Homo sapiens
tggtaaagagatataggaaaagactagaaaagtaaactattttaaggagtttgtcattgaagtgaaaaaaaaatgagggagaagagcagttcagtggagtatcaggatttgggattgtgttagatttaagacagagaggaaaggccaggcagacagggagaggttgaacgttcaaaagagaatggaagtcatggtagggatatcttatggagcacatttctagagaaaaaatgaaaatagagtacaagtggagctgttcacaatgaaaaggaaaagggttcttattctaagatgggatg

SEQ ID NO: 192609 - DNA, 103 bp, Homo sapiens
tcctcacacaatgccctatgtgcctgccctcaagtgctggttcaattcttggtggtcacgtccttcagtcagaagaaaagatctagaaatctaaaaatgaaat

SEQ ID NO: 192610 - DNA, 807 bp, Homo sapiens
aagaccaaagggaaaaggcattccacttgttaaatgtttattatttgagcttagcagccaactataataagggagagaggaagctgtctgcaagctgcatgcagatttagctactcaaattccatgaatgtaaaatagaacattgaggctaaacccttaaaatttactaggcagtagcttgagggaggaggtagttggtaataaaagcttgtagccaccaatatttgagtcagtgatttgaaagcagcccaagtcaacaaagaactaaaattcccaacacatgaaaattattgcttccccttattctaggaatcacagtagaccaggggaaagagacaaatatcttctctcctttatctcctttgaatttgatctgagtataatagcttttagttttccacgaagccaaaatatcatctaataaactgctggtgggtgggatgactacaagcaaaacgtttcttcgcttatcttgtgcttcactggatgtctttttgccgagcctcagtgactaatcacactgtgctttattcttcactttcccactgaatgcgtccatcattccttttactataataatgatgcggtgtctcaggtttattatctataggaatgtgctttaagatgagtacaggaggccgggcgcggtggctgaagcctgtaatcccagcactttgggaggccgaggtgggaggatcacctgaagtcgggagttcaagaccagcctgaccaacatggagaaaccccgtctctactaaaaatacaaaattagctgggcatggtggcacatgcctgtattcccggcta

SEQ ID NO: 192611 - DNA, 475 bp, Homo sapiens
taaccatcccctaaatttattatggaaatcttgaaacatacacagaagaaaatatgataatagattctttttttcacatcatccagctgcattaactctcaatgttttggcaatctctcgttttcttcctctgtacagtagcacacttttttattttggctggaggatttaaaagcaaatcctcatcctcatgtctttcgtgtctaagtaattctagctgcatctctgactgataaggacttttattttcagtataaatatccaataaagtcagcaattccttaataatcacctaatacctggtccattttgatggaaggaagcattcttgataatactacttaagagttttaggaactagtcaaatattgttcataataaatttagggtcaattaactggtatggttaccccactcttagtagataataaaaaggtaacttcttggttttgaattgtagtgtaggggttttttt

SEQ ID NO: 192612 - DNA, 461 bp, Homo sapiens
ggagatgaaaggaaactctactctttggtgtataaactttgtatcctcgaattttgtaccaagggtacatattacctactccaaaagaattcaaataaaatttaattttaatggagtaaatccaaacctttgatattaactgctgtatttcctgatgatgaatttgcagattatatataaacaactatgagaaattctaaaatgttctactgttcagaagagaatctactgcaaaatgagatgggatataggcacagttttctatttgtcttcttacatctgaatacaccattccattcttctgacaggaagtaaaaccattcatccattcaatcaacaaatattgagaatttactaaggactacgacctggggatacagcagtgaacaagatagccaaagtccctggcctcagagaacttactgtcagatgtaaataatttgtaaaatgggcataaaata

SEQ ID NO: 192613 - DNA, 518 bp, Homo sapiens
caggtgctgacaacacagcttcaggtccaccacaggcagaggagctataggtgaaacctctgggtaaagcctttagtaacttctcttgtccattaaaagggggttgaagaataaacaatgaaagggcttatgttgtctctggaaccacaaggagaaataaaaatcccaggcctatgttctatgtggatgtggggtcaaaatttactgtgtggtatgggaatcacatgctgaaaaattaaaagctgggacagaaccattgaaacctatagaatctcagcaaaagcaaatgcaatacatttttatgatccagggtaatggaaccccacagaaaaagaaaggatctgctgaagatgggctcagaaataagcaacaataaaaatcaagtccttgcatataaatgatacgccatgaaggagagtcaccagttgccataaggagaattagtacccccaagaaatactgctgagaagaactgctactctttttttgagagtgaaatgaggaaattttcagggaaa

SEQ ID NO: 192614 - DNA, 129 bp, Homo sapiens
agactcccaaggacagagatggtgatggacaaagcatcatccggagaagccaccagtagccaaagggtgctctgagccagaagccagaattctacctggggatgacttggtcccgtgactgaacgaggg

SEQ ID NO: 192615 - DNA, 463 bp, Homo sapiens
gggggggggtcggggaggaaaacaggctggttaatagctgcaaaattgcagctaggtaagaggaataagttctaatgctctatagcaggagtccctaatccccagaccatagactggtattggtctgtggcctgttaggaactaggcagcacagcaggtgagcagtgggcaagtgagtgaagcttcatcttatttacagccaccccacattgctcacattactgcctgagctgtgcctcctgtcagatcaatggcagcaataaattctcataggagcgtcaactctattatgaactgtgcatgcgaggggatctaggttgcgtggtccttatgagagtctaatgcctgatgatttgtcactgtctcccagcaccctcagacagggccaactagttgcaggaaaacaagctcagggctcccactgattctacatcatagtgagttgtataattatttcattata

SEQ ID NO: 192616 - DNA, 680 bp, Homo sapiens
gaagaacccaaaagttgatccaaggtagactttcagataatgtgacagaagcaagccagtctcaaaacaagttgagattctgagaccatttccatgccatggtgaactgtgctaactggtttatgaaagcacaggagcagaggaacagggaacagggcagatgccacacaatttctaaaaggtcacttgaatgccaaagacattttagatttgattgcttatggtctcacaatttcaaaaccattttaaggcctccttggtacttcagcgatgtggggtgagcatcaaggccatgattaagtttggttcaaaccctcccttctacccgactctgttcccttgtctcttctgaccccctcctgccgtatggatggctccccttcagccaaaggggatcctcctttttgatacttgatctgtggagctttaggtttttaaatgttgcaaatgatttgaaaggcattgctatggttcgttcaagtcctgtgcttattaactttttacccctatggttagtttctcaggaacatgtggagtgtaacaaacaagaaaagtgacgcctttatcatgtttagataaacaatctactgttgtcctaacactctgcttttccaaatggattgttttatttgtgaagacaaaaagttactcccatttttcagctgagggaactggggttc

SEQ ID NO: 192617 - DNA, 469 bp, Homo sapiens
cttggtcaaaccttctctggtatcccagctgggatactggggtgctctcattacagcccaatgaggggggaagtccaggtcttcacttggcctgtgctagcatgcatagggacaagtcataggtttttcatgatgtttacctagagtagagcagttaccatctaagagttttctgcctttctaggctgccccttccttggtccttggttaaagagagcaggctttggtagagctttttgtcagcacatgttactgtttccgggttgctggctccttcagctcaaaacctgagatataagaggcaaaaagaaaacccagggccgggcacagtggctcacatctgtaatcctagcacttcgggaggccaaggtgggtggatcacttgaagtcaggagtttgagaccaatctggccaacatggcaaaaccttctctctactaaaaaactaaaaaaaaatactgggcatggtg

SEQ ID NO: 192618 - DNA, 674 bp, Homo sapiens
tttaagtgttaatatctcctcagttttgatgctctagggaagggattgacaaactggctcactggccaaatcctttttgctgattattttggtaaataaagttttattgggacacaactatacccgttttttgtaagccatttatctgtggctgcattcacactacagtggcagggttgagtagttgtgacagagccatatgaccctcaaaacccaaaatatttatgatctggccctttatagaagtttgctgacccctgcttgggggtaaaatcagggaatctgttttgacaatcattagaaataaatgaatgcacacatgccctgaaatgagggctgagggagttaataagaacaaggaatagggagcctcaaaaccccaaccgcaccctagaggaaggaggagctcaaatcaataacccaacctgtcaccttaagaaactagggaaagatgagcaaagtgaacccaagcaagcagaagaaggaatcaataaaggtcagagcagaaatgaattagggaccagaaaaacaatagagaaaatcaccaaaaccaataattagttctttgtaaacacacctttatctaagctgatcaagaaaaaagaaagagaagacattatttaaattaggaatgaaaggggagacattaccaccaaacttacacaaataaaaag

SEQ ID NO: 192619 - DNA, 728 bp, Homo sapiens
cactgcaacctctgcctcctggttcaagcgattctcctgcctcagcctcctgagtagctggaattacaggcatgcgccaccatgcccggctaattttgcatttttagtagagacagggtttcaccatgttggtcaggctggtcttgaactcccgacctcaggtcgtctgcccgcctcggcctcccaaagtgctggtattacaggcgtgagccaccatacctggctcatttctctatttttgtgcatacctttgcaattaattttggttatgatttcctatggtagattggaagttgctctcatatttgccctctgttagagtaagctgtggggttgttgatcactgtgtggttacacccaggctgtggcagagattcaggtcacattagccagcctgctgccatttgagttgagtcaagatactgattctagagttgggcttaattaagtctttaaaattttttgttttgtttgggattttctattctccttaactgcattggtaccagatccaacgttgaccttatattttgaaattttggtcagtttgtttatatggtgattttgcttatacagtgttagggttttttgatttttggtaattgttttttgtcaaaatagtaagaatacataaagaatcagacagtactacaaggcttataattagaaaaaaaacactactttatttctgcttgtttgtttttaaccacttttgcaattttttttcc

SEQ ID NO: 192620 - DNA, 313 bp, Homo sapiens
tgtgacagtttcccccacaagtaacaggaagaattaactttgttttatgttagggctttatccaaagatgtcaatacaatactcatcctatcagagaaatgtgttacaaaaatgcaagttatcaccctctctacttttctctgtgtcacttaaacacacctaaagttcctggcactcaaaccagatgtacacaggcttcttttcctcagaaagcttttttggggtattgcagtgtctttccagctttagcttcctttgatgaggtcagttgtctcttcctggctatcacagaggctgtcatgctgacatgata

SEQ ID NO: 192621 - DNA, 204 bp, Homo sapiens
ttttggcaatgagactaagataatagtaatattgtagtaattatgggaactggttatacattcaagctgaaagctgaaggcagtgcaagagtttggggatttgtatttaagacttaaccatcgctaggatttttacttagaatgtaaacgttttcatggctggaaaaacagaccagtactatttgaaatgaaataccagagcct

SEQ ID NO: 192622 - DNA, 430 bp, Homo sapiens
ccgaaaactgtttggtttgaaaaatctagaacattgtagaagagagatatatttatataattagcatcaccaattaagaatgaattgactttagcaaaaatcaatgtaattatctagataattcaggctaattaaagaccttcccaaatccttagatcttcattagctgcatgcttctggtaaaagcagatttttggggtgtcacattagctttatattttgcatcagtcttgctctattctgctgccgtagacctggcttcaaatgatagtgcccacttgataaacagatgttgttcaggagaaaataaaataggaaatataaaatattctgtgtcgaattgaaagcatgagggtcctcatgttcttagaatcttcttagaaatacagtataaaatctttatatacagatacacattgacaacaataga

SEQ ID NO: 192623 - DNA, 369 bp, Homo sapiens
  misc_feature (52)..(52): n is a, c, g, or t
agagcggaccagcaggctgggcccagattaagatgtcatgtccacaaaaatnaaaaaattagccaggtgtggtggcacatgcctgtagtcccagctacctgggaggctgagcaggagtatcgatggggcccaggaggttgaatttatattgagctgagattgccccactgcactccagcctgggtgacagagcgagactgtctcaaaaaaaaaagaaaaaaagaaaaagaaatggagaacctggctgtgtttgggggcaacaaaggggacactgaggagccaactcctccctgaatagcggtgtgtttcttcctcctggatgccagctgcagcaggaatggtttgaatagatctaaatacttctctatg

SEQ ID NO: 192624 - DNA, 605 bp, Homo sapiens
tgcgggtgatctagaggatcccaagatggcaaaacgtcccgcgcgcctaaagcttagtttttaagcatcggaaacatcagtccagttttgctgggaagactacgtaaacatctgagaaagtatgaagccatgaatgatgaggctattctattttagaatggagcagtcatggctgggcttaatacaatgtgattttcttgacaagttactctgcccagaccatcatgcttgatctctggttaattacttacaagctgcccacatgcctaaggagcaaagagtcatctgattgccaggctcttaattaaagtgatccaaacagcacacttcataaggaagctcccgactccactttcagcagtactggaagtttccagtattggctgtttcttgtcagtgtgacactggcttcttgttctctgaactttctgtattgacatgaaggaaccatcccagatttttaaaaaatgaccctgatcaattagttacatgtagaagtcagctacctactcactcagtatgactaagatgacctcaaaaggggtgtctcagcttgaagcaaaataggctaaagagcacttacttctaccccatagttgtcccat

SEQ ID NO: 192625 - DNA, 141 bp, Homo sapiens
tgcccctacccagtcttcacctgaggtttacccaagcagggagaagggattaacagagaaaggtaaaaataatttcacttcaaatttgatgagactaaagaaatttctgagtccactgattcaatttctctttcataaacc

SEQ ID NO: 192626 - DNA, 142 bp, Homo sapiens
tcaaataagcaaactcttctctttgtctcatgcagaaaacttttgctctttcctgtaaccctcttttctcaacaactttaagatttctggggtctcacattctgccccaagtacatctaaaactttgtatttccccaaataa

SEQ ID NO: 192627 - DNA, 372 bp, Homo sapiens
ctgaggctgagatggatgcactgacagaagtaggctttagaagctgggcagtaacaaacattgctgagcaaaagaagtaatgttctaacccaatgcaaagaagccaagaaccatgataaaacattataggagctgttaaccagaataacccgtttaaaaaggaacataaacaatgtgatggagctgaaaaacacaatgtgaaattcacaatgcaaccacaaatatcaatagctgaagagactaagcagaggaaagaatctcagagcttgaagactatcttgctgaaataagacaggcagacaaggtgagagaaaaaagaatgaaaaggaatgaacaaaacctctgagaactatgggattacataaaaatacc

SEQ ID NO: 192628 - DNA, 159 bp, Homo sapiens
tgtgggtctcatattctgaatcagagacattggtacatctcagaaggaagtagaaaaattcttaaattggactgtgaagtcagcctaattaagaaatgtagatatattggctgggtgcagtggcttatgcttgtaatcccagcactatgagaggctgag

SEQ ID NO: 192629 - DNA, 314 bp, Homo sapiens
gtctaattgggatcccctgcaacagaggggtcagaaaaggctggaagagaaaggagggctattctgaatgaggaaggcaggatcctattacagaggcaatttgcccataagtgaaatttcacgtctaacaaatatacttccctattccaaattcactcgattaaaactcaactacatcatctaactgtactcagtgaagtagagtaactcttgggatataattttgagtgttctcattataattgctaaatcataaaatgagtcaattcacactgggtctgtagagcattaatatctaataatgaagttctacc

SEQ ID NO: 192630 - DNA, 185 bp, Homo sapiens
tgagattgtgggtggtttctagatttgtgccatagttagtaagtcttcaccattttaaagctgtggaaagattttcttgtggtttcttctagggcttttatttgttacattttaattttttcatatacttggtatttaaccaggcataaggtatgagttatagattcaactgtgattttttttct

SEQ ID NO: 192631 - DNA, 440 bp, Homo sapiens
aggcacggctctgcctgctgtcgcagcacctctttataatatttaaacaaggctgctcacatttctttgatgtgctcatcagaaataggtcatttctcctcattaattcagttgaggcttttttgctggactggagggaagtgaatggagtgttggtatgggagaatcctggatctcaaaatgtctaagagccacctgtagtggtgaaaagggaaagcagtgtcgttcattcattgccttccttttgagcctgcccttccaccaggtaacaagtgattcctgggcagggactcattgcactttagtcctgcatacgttcctcttgccagaagtagagggaaatgaagccagaaagaaatgggtctgctcacaccagacctctagcatcaggcagcatcaagcaccctgctggtccgtgagagcacagggaatggctgagt

SEQ ID NO: 192632 - DNA, 681 bp, Homo sapiens
cccttataactaatgttatagaatgaatgttcagagtcacaccagtgttaggcaggttaaagcctatactcatctatttcaagcagcacaaactaggatgttgctaattcaaaaactgtgaagttttaaaaatctactttaggataggaggattttggaaattaagtcaggggcggggaaaaggaaaaccaagaggcaagaatctcaaaattctgctgattagattggactttttaaagaacaccaaatctaaagcagtatcaaaatagcgttgaaaataccagaaatgttaactgcccatttagaacaatcattcttttagcaatatcaactctgcaagcaatgcagagttaatgcaaaagaccaaaacttacagatcaaagtaggggatagtgtttttcagtcaaaatatttttcttcttatattgaaatataatgtgaaatcagttttttcaagacatgtctttctaaaattctccattaaatatacctttaacacatctgtactggaacactgttaaacttactatgcaaaggacaacttgcatttaaatgaacacttcaagtaaattctgtctatgagagaaacaataaatgatcctaggagaaaatcagacttcccatttagggttactcatgctgacagtatatgttaacaaacaatggcaatgtatattattt

SEQ ID NO: 192633 - DNA, 577 bp, Homo sapiens
ccgttctcctgtttggcttttccctggatgtgactggggcttctgggaagctgaggtaaaaaaaagtgagcccttagagaggcttctttccaaccaagagtaggccaagagattgacacttgtcagtcagaccagttgtctgaacccagtcctggtccctgccttcagcactacccaaatggagagtggatgaggccaccatctatttcacagggatacgaaagcccatttcctgacattaaccccacccagccagtgaaactactggtgagaggaaaggagagtccagaggacagggctttccagactcttactactttcccccacttcttgttctctcaccagtgtctcattggaaaccctaaagacctgtcacagagacgggctcggctgaggagataaggaccccaagtccccagcaactatttttcacttgatccctccacccagaagataaggttttgtcctaattcagtcccattcttatgagagagcccagccatcccccaatcttcagtctcagctgcattccaggctttcctctccctagctgcctagaggccaaaagggaggagaa

SEQ ID NO: 192634 - DNA, 236 bp, Homo sapiens
caagcaccaccagcacctgcaaaaagtatacctgtgaaaaaggaaacaaaagccccagcagctgaaaaattagagcccaaagctgaacaagctccaacagtaaaaagaacagaaacagaaaaaaagccaccacctattaaggatagcaaatctttaacagctgagcctcaaaaggctgtccttcccacaaaactggagaaatcgcccaaaccagaatcaacctgtcctctctgcaa

SEQ ID NO: 192635 - DNA, 543 bp, Homo sapiens
gtccgggatattgtcctgaattactattttcatttaaaatgttctactttctgttctcctttctctttctcgactccagttatcagtcaggtgttgtgtcttcttgatcgagtctttttgtcctattttactccgctctccatctcttagtctttcctaccggcatccttttcttgacttatgaaacatcttcatctctgatttccaagaatattaatactcactttttagaaacattgttttctgtatctagctttccttgttgtttcctctttcctcccttccttacttttcttgtctctttctcactccctctcttcccttcccttttctttgtcttttggtattttctctcatattgacatttccttcttaaaagtccttggctaatagttcatattaaagacttaggcactgaaagagctacttggaactgtctgccagcttgttaacctgcagtttccttgttgggtgatctgacacaggtgaccttctcactaggggatttcactggtatgttgattttcaccatgttctcctatt

SEQ ID NO: 192636 - DNA, 563 bp, Homo sapiens
gtgggtgcatgaacaatcaggtaagggaatcagggaagagaggatgccaagaagcaggatctgcagctccctgtgctgtttcatcccacacatcagctgctcccgacaatgcccatcctctctcgctgctgtatctcccagtttgtgttaggtgtgccttcttggtacttctgatgtgaaattccctgtttacttgtatgcctccccaatcagactggaaattcctcaaagaagggccttattcacccttgtgtccccagcatatggcataattcccagcacatagcaggtgcttaagaaatgtttaagaatgaataagggatgatttattcacatacaagctggatgggttccacttcctgcctctttattttcttatattatatgaatgtttataaagcattaggtgtgggctggggtttaaatggaaagctaaagcatggtcctcactatcacagcttccaggctcttgagggagacttgctatccacaatgaactgccacacagagcagaccacgtgtgcaaagtgtcattttgtggggagagcacagaggatggagag

SEQ ID NO: 192637 - DNA, 145 bp, Homo sapiens
aaataaatgtttatatttcaacaaaatgaagggaaatacttgtagagcttaggcaatgcttggtatactttgtgttttccccacagacaaaaaacctcgtaaatggcctatgttggttcttcggaattggtggcaagaggacaga

SEQ ID NO: 192638 - DNA, 776 bp, Homo sapiens
gatgaaatgatgaaatgatgagatgagataaaatgagatgaaatggtgagatgagatgaaatatgatgagatgaaatgacataatgaatgaaatgatgaaatggaataatgaaatggaaatgatgagataaaatgagatgaaatgagatgtaatgatggaatgagatgagatgaaatgagatgaaatgatagatgagataaaatgatatgaaatgatgagatgaatgatgagatgatgagatgaatgatgaaatgaaatgatgagatgagatgatgaaatgaaatggtgagatgaaatgatgagatgaaatgaaatagtgaaatgaaattgaaataaaatcgaaatgagagatgaaatgactgagatgatgaaataaaatgatgaaatgatgagatgtgatgagatgaaatgatgagatgagatgagatgacaaaaaaaaaaaaaaaaaacaaaaaaaaacccttgtgggcgcggcccggggccccctaggaaaaacggtttctcgaagacgacacagcagagtggggcgcgcgcggggcccaaagagggaaacaggacacaggggcacacaagagaggtccccagaggggaaaccgcggggcacaagagaatcagcgatggggaaatcagacacaagtaaaaaagagcccgccgcgggggaaacacaagagggcgtttgagaaacaaagcacaaatgcgggacaaagaggcgagataccggggactacaaacaagcggagagccacagggagacccacagataaaagtaacgccg

SEQ ID NO: 192639 - DNA, 612 bp, Homo sapiens
gatgaaatgatgaaatgatgagatgagataaaatgagatgaaatggtgagatgagatgaaatatgatgagatgaaatgacataatgaatgaaatgatgaaatggaataatgaaatggaaatgatgagctgagatgcaatgagttgaaatgagatgaaatgatgaaatgatgagatgaaatgatgagatgagatgtgatgaaatgatgacatgaaatgatgacataaaatgagatgaaatgagatgtaatgatggaatgagatgagatgaaatgagatgaaatgatagatgagataaaatgatatgaaatgatgagatgaatgatgagatgatgagatgaatgatgaaatgaaatgatgagatgagatgatgaaatgaaatggtgagatgaaatgatgagatgaaatgaaatagtgaaatgaaattgaaataaaatcgaaatgagagatgaaatgactgagatgatgaaataaaatgatgaaatgatgagatgtgatgagatgaaatgatgagatgagatgagatgacatgaaataatgaaatgaaattgaaatgagataagatacgagatgagatgaaatgatgagatgaaatgatgaaatgatgagataag

SEQ ID NO: 192640 - DNA, 288 bp, Homo sapiens
aacctaagtgtccattaacatttgaatggattagaaaacatgatatatacacataatgaatggaatactatttagccattaaaagaaggaaatttggtcatttatggaagcatccatgagactggagaacatctgttaagtgaaataagccagatacagaaagacaaacatgacatgttcacacatatgtggaagctaataaagttgattccgtagaagtaggaagcagaataatggttcctagagatgtgataggggagaagggagagggagatagccaaaggttgg

SEQ ID NO: 192641 - DNA, 321 bp, Homo sapiens
ctccgtggactgcagtgtttaaaagacagtcatcacccaaagtgctttttataacaagaaaggactctgaacgttgtcaggtgagtagcactgcctgtgtccccatggccagggcgtgtgcagagcctgggtggacgcaggcaggttagctatcccagccctatgcatcactcctgcatcacacctagcgccccgtgtgtgacccgggatcccaccgttctccagggtcgagggagaacacttcaagagaggcgactaaatctccaccaagcacattatatcaaatacgcctcaggaaaaccctttatggaaacctactat

SEQ ID NO: 192642 - DNA, 293 bp, Homo sapiens
ggttctgatcttgggcgaggagaacatagtgagcctttgccatagggcaccgttgagcctccaggcaattcctcgattgaagcaccgtgactagattcagctgcccaggctcctttctccctaggaccctcatctctatttcctggattccagccttggatgccatccaaaggctgagactcgcctttccccaacttccctatccagccatgaggctgccaggagaccttgccctctgctgaaacctccagcctccttcagaacctgacttcactctggggaacagtccccat

SEQ ID NO: 192643 - DNA, 315 bp, Homo sapiens
gtatatgagaatcagaattcagataatttgtcttaaaaattcatattcaatgtaaaaattttatatttagaaaatgaaactgtacccattgtttatataacttaaactgccaaaataaagcaccacaaaaactttttatcacgttggtttttgtatcaggctgggctttgcagcagatggaggagctagggcaagcttgtccaacctgtgggcccgagggtcacatgcagcccaggatggttttgaatgctgcccaacacaaattcatacactttcttaaagtatcatgagtttttttttttttttaagctcatc

SEQ ID NO: 192644 - DNA, 322 bp, Homo sapiens
ttttacctggtttatggacagtccaaacagtgttctcactctctttccttggcaaatgttagaactgatggctttatttttttctccctcccttcatcttcagggattttttttttctcttctacattactcagcctttttgtctgtgaacatcctgtggaagatttcatttatcttaggttctttggccaggctgctcatcatcttttttttccacataaaacatatttacctaatgagagaacttaagatggataaccagagcctctgtactctctcacaagcctagaaatttgacactttctcaattctgacagttcat

SEQ ID NO: 192645 - DNA, 147 bp, Homo sapiens
tcttccagcctcatttgtttgctatgcattctgtaagaatcctctgggttcttaccttagtttgtaatcatgcacagacagccctggccttacttggttctaatatgcacagattccagtttccagagttaagtaacaccagttccc

SEQ ID NO: 192646 - DNA, 491 bp, Homo sapiens
cctacattgggcaggaggtttgacaaaattatctctaggatcactttcaacactagaaacctagatttctggaaagacagaagagccttttttcttttcttaatttgtcattaatgtctcagcaaagaagagcatttattttaatatgatcatcggacttgaaaggcttctacagagagctatgggtacatgtgatatgaagaataagctgagatccatatgcacttgaaaaaccaagaaaattaagagggttcttttttttttctttttttttgagatggagtttcactcttgttgcccaggctggagtgcaatggcatgatctcggctcactgcaacctccaccttccaaattcaagtgattatcctgcctcagcctccccagtagctgggattacaggtgcccgccaccaagcctggctaattttgtatttttagtagagacagggtttctccatgttggtcaggctgggttcgaactcctgacctca

SEQ ID NO: 192647 - DNA, 298 bp, Homo sapiens
gtcctaggaagatgcagaccttatagaaaattttagatttaaatgcagaagaatctaataagctattttaagaatgtaagtaaagatagcttccttcaaggcttgggaatgctgtaatgcagaaatatgcatcaatgcaaaatgatgacagtgccctttctccacatcagattatcagagattcctaacatttggatgggagaatgtcctgagtcctctgagaatatgttggaagctactgaccttttccctgacagtgtttataataacaaataaacattccgcagatcacgagaac

SEQ ID NO: 192648 - DNA, 154 bp, Homo sapiens
ccataggcctaaattttagttgtgaccaatttttcattagtgtttctatatttttcatctccttttacccccacagagttttactagaatgataagtactgcttctaagaatacttgaggtgcccaagaggacttacgtaactgttttacatgc

SEQ ID NO: 192649 - DNA, 592 bp, Homo sapiens
tcagcaaattctagtttacagaaaattctgtggtttctttttgactatttgctgaaatgccaacattattattttaaaaaatatgcctgataggtgatggcactagtgttacctggatagtttttgaatgaatggagtatgtaaggaaagtttcacatcttttcatatcaactctaatttatcttcatgctctgctctcttactttggatttttctagcgatttccagtgtgcatgctcaagagttattttaaagtagacgcaagtgtttctcatgccacagacattttgttaaaaacctaacttgaaatatacaagtgagttcaccaaactcataaaaatgtccttaaaatgataaaatggagaactttggggtcccaacaaagaggaattaaggcctggatcatgattacctctgttttccatgtgactttgaaagcagcagggctggagccaagttggccctgctccctcctagggacagcagggttgatgtccacctccatttccatttgcttctgtccagccggcaggccttggcggcccctcctggctctggagctttacatactttcttattctatccgcatcta

SEQ ID NO: 192650 - DNA, 331 bp, Homo sapiens
gctgggatacagacacgtgctcccatgtgtggctaattttttaaatttttggtagagatggggtctccctttgttgcccaggcttatcttgaactgctgtgctcacgtgatcttcctgcctcagccatgcgccaccatgcccagctgcaaattttgtgttatcaatgatcatgtgtactcagtacccttaatttacctgatgaggaatggtgatggcatgcaccaacgttttgggagagtggcgctcacatctccactatctccagaagtccttactccctgtgacttcttccaagccacttgagataaacaccacatggcagcctctcca

SEQ ID NO: 192651 - DNA, 361 bp, Homo sapiens
ctagctatacagtgtcctagtatggtgattaaaaagagtggaataaaaagactattagtgatttgtccaggagatagtaagagaaggctaaagggaaatataacttccttggtttattcatttagtaagtatttattagacatttatgatgttcactgaagtctacaaatgtttcagaagggtctcgtctgaacaaaatctttaaaatgaaaggaggactagccaattggagggaggaaagataccataagagtattttgcaaaggaaattaattacatgcgtaatggtacagagttaagacaagcatgcttaattattgaagaataagagaagcgtagcgtggttggaaaaggagtatga

SEQ ID NO: 192652 - DNA, 135 bp, Homo sapiens
taatctgtggttggttagatccaaagatgcagaacccttggatacagagggccaacttgtctcaattttagaaaaagagaagccaccgtctatggttataagcaactttaaaaactttagcctgtaattccagca

SEQ ID NO: 192653 - DNA, 256 bp, Homo sapiens
tcaagattgtgccactgcactctagcctgggcgacagagcgagactccgtctcatagcaaaacagaacaaaacaaaacaaaaaacaaatgcatatcttgattcttgaagttcaatttaagggaagctgttctacatatatatttctgcatgtgaaagttatttatgccactacattagtgtagtgtgggaagtaaaatttttcaaaataaaaagttattcatgctaagggtattcgttttaacattatgatagtga

SEQ ID NO: 192654 - DNA, 355 bp, Homo sapiens
caattagaagaaaatactgttgaaatagaggctttaaaatgtttacctgcttccctttggctttcaaggatcttgaatcacctgggtccctctttgcttacccaactttattatctaattcttttcaataagagaacttttgtttcagtaagaacccgaatgtcatggctaaataactgaggctcatgcatgcctttgtctgtgctctgttgatgttaatgaccttgccaagattaccttctcctccctctttacatacctaaatcccaaccacttttaaaaagccaagccatcttactttactaaagtctaataaaattatcccaatcctttccaaacagtagaggatatacca

SEQ ID NO: 192655 - DNA, 395 bp, Homo sapiens
ccttccttcttgtagtccagaaaaagatgaggtattagatgaaaatcttttgcctgcaactagagctgctagaaagaagagattccatagtaaatatggaaataatattattaaattatttttaattacattagttaaattttaattaagcataattttgttcatggatatgtattctgctacaatgttacagacatccactgaactcattttttattgtgtcatttacatttatttcttgatttccttgaatcttgattattctatcaattattgagatgtatattaaattatcccactatgtggatttacctatttcttcttatagtactgtccattttccttatactgtctatgttattagatgtatacaaataaaaagttagattttcctt

SEQ ID NO: 192656 - DNA, 348 bp, Homo sapiens
atccgtgatcatctctccccaggcctgctgttcctcgaggaaggaagttgtaatgggcagagttctaggacagcccccaagagaaccactcccttatatctgctccctgtatcatctcttcttgagtgtgtgcagagcttgtgatttggccaaggggaaggaattttgcaaatgtgattatggtcacacttgctttgttaagcacatttgctcagctgactttgagttcatccaaagcaggatgatcttaggtgggccagacctaatcaggtgagtcttttaaaggtgaagtttcagagattcaacccttagcctccaaggagacaaaaatggccatgctgtgaactg

SEQ ID NO: 192657 - DNA, 589 bp, Homo sapiens
tgctgggattacaggcgtgagccactgcacccggcctggcctcaaatacttctactgatccttcttgctgatagaatccatgcacaacagcttttacgccaaccatgttctagaattgatggcttgggatcttgtccacttgttttcagtaggctcagtagtgacattgttgaatctgcccacattgcctgcaggtctgtgtctcagagctgagtcggggttgaagagcaccagttctggctctgagtttttacttaggaatgccagctgtttgctgccacactaacagccaactccgaaaatggcagcctccctatgtgaaggaccacttttagggatcctcagataatctgctgttcacaggaggacgtctttagggtggtgaattgtttggggatagtactgaatcggggggacatcactgcggcctcatcccccaagatgaaggacaggctcttgcactgcagagtgtgaatactcctgtttgcataccatgtgctcggggtcagagctctgcagcctgactgcccctttgctcttgtgtatttcctagatcaaactctaagccccgctgccacttttggtaaga

SEQ ID NO: 192658 - DNA, 667 bp, Homo sapiens
gtatgagtaggaattatccaggtgaagagttgggaacggcgttccagacaaagggaacagcatgtgcaaaggtccagagacaagagaaccacagtgctttctggagactgattgtcctgaaatactattttacttcacagacttccatatctcttcaggaccttgagcactgccctgtctttttgcagctcccaggagaccttatctgtcattttcctggtcatctttgctgaagctcctgctgtttgttccatattaattgtacacaaaggatctcatgatcctcttagggccatcatgggccaagggctcagattttgtccatggaaggctctgctatgggaggaaggtgacctttgttttagttctaactctatcattagctccctgtgtgtccttggagaagtcactgccctctctgggcctccttgagaggaggagaatagacagataggacctggctcactgtcactcttccctcagttacttttgttgtaattcttgggggttgcaacatgcactgttagctcgcacatgcctgatgtgtagcatgtgtgcaaaaagcatttgctgtgtgaatgagcaacgtccacatgcgtgctccttctgtccgttttttgtcctgctcttctctagtgatcttgtcctcattccgtacatgactccc

SEQ ID NO: 192659 - DNA, 482 bp, Homo sapiens
tgattgcattgtatttaacaaattctctaagctacactttctagctagttgtcatgacagtgtcagctattcacaatgtagagactaagtgtcttggatgatttgagaagagctactaattataaactgacattttgatataaatgatttttgaggtcagttcgataatgctatcaataagtatggttttaaaataggttgattgttccaagagacttacagtgatcaaaacaactgattcagatggagaactactgagaattctcttataactgaagtctgacctgttcttaaaatctactcattggtctagggggtcgaactgattaggaagtcattttggcatttgacaaaaatactttagtacataccctaacatatataagtacaaagcaaactttcttagtactttgcattactcacccgctgaatccatgttaacattttaactctcctgggtcaaatgcatagattcttactgt

SEQ ID NO: 192660 - DNA, 257 bp, Homo sapiens
cctaagaagcacctttcctctcctcacccagggctttttacactgaatttcctggagaaattgcttcatcacagtccaaattactcttagactcatctttagctggtgttgtggaggttatgtaagtaatatacgtggccaagctttggaaatgagaatgtgctctacgcatttgaatgtttggcagagccaaccttcccagaactcatgcccccgcactgaaagacaccgggctttcttaattttcatctgaacca

SEQ ID NO: 192661 - DNA, 262 bp, Homo sapiens
agggtttcccactaaatagaagttgtttgtatttttgctttttaattttttttattttgagataattgtggatttacatgccattgtgagaaataatacaaaaaggataacatatgtccacgcaaaaacctgtacatgagtgttcatagtagcattatttgtaatagccaaaaagtacaaacaactgaaatgtccatcagatgatgaatgggtcaataaaatgtggtgtattcatacaatggagtatttggcaataaaaaaa

SEQ ID NO: 192662 - DNA, 595 bp, Homo sapiens
gaatcaaatcactacacagaaactctgattgaaatctctcattcctgaaatcaccttttctgctgaaacaatattacgtgaaaacagaattctattccacatgctgtcccagcagccacgtgccaatattgctctccctccgtcagtatcgtcttctccctcagctcttctcactgatgccccaaggctggaaactgatgaaaacaaaatcttgtttctcagggcttgagggataaccttgctgagtccttcagcacaggggttcaccagtgcattggaaggggccgtcagaacatcctccacaggctggtcaaatcacacagaaggttctggacatccaggggagggcttacaggatgctggaaaccagagaaaatgccacagggctcctgcttctctcttgtttacttgaaattaacctccaggccactagccagctccttctgcggcctattagtgatagccctgagactgtcttcctcctgagggagttgggccaccaagaatgtgtgggaaactgcgaagacctgaacacttaagactcaagagtgatcctgttgggttggagttgtcagagcccagatgcctgagagag

SEQ ID NO: 192663 - DNA, 548 bp, Homo sapiens
ctataccaaaactagatcctgttgttgattgcacacatttctcacatgaggcattcttacttctcttgctctgcattacctgcacacatagaaatcccagcccagaacactgcacagtttgccttttcttctgttcaggcagcgagtgctgcttgaggaaatcacagctaggcagacaagtatgacagacatactctccgtaacctcagcttatcttttgtcagcagcttttgctagtttgtcactgcatggcccaaacctttatcactgtcctcaatgatcatggccatctgttgttcctctcattgttagcaaatagccttgctttcttttttgactcacatttctattgaactgcctgctaattgtcaacatcccacctatcctgacttccaggaggtaggagagaatgaagcatccttcttcctttagaagcctgatgccttcatcagagatttgaccccatccttccccccttctctctcctctagttccaactcccttgtctattaattgcttcctctgtttttagtctccactctgacccc

SEQ ID NO: 192664 - DNA, 643 bp, Homo sapiens
ctatagggtagaatcagtctctctgaagaaagataagggatgtggatcaagccaggcgcagtggctcacgcctgcagcaatcccaacactttgggaggacgaggcaggcggattacctgaggtcaggagtttgagaccagcttggccaacatggtgaaaccccatctctactaaaaacacacaaatcaggccgggcgcagtggctcacgcctataatcccagcactttgggaggccgaagcaggtggatcatttgaggtcaggctggtcttggactcttgacctcaggtgatccgcccacctctgcctcccaaagtgctaggattacaggcatgagccaccacgcccggcctaagatggtaaattttatgtgtaggttttttaccacaattaaaaacaaatgcattctttttttaagaaagaaaaaatactgtgcatcatttggtcattactctatctagaaatgacatcctcctttttataatttgtaacttgatactaatacaatgtaaatattttgttggtaggggaaacttgtggaatttattaacatgaatattaagcacaaaaatcagtttattatttagtatcatgaatagtgcaaggtgaaaacattaatcttgttagcaacatgtaataattta

SEQ ID NO: 192665 - DNA, 524 bp, Homo sapiens
tcactgcaacctccgcctcttgggttcaagtgattctcctgcctcagcttcccaagtagctgggaccactaccaggcgtgcaccaccatacccggctattttttgtatttttagtagagatggggtttcaccatgttggccaggctggtcttggactcttgacctcaggtgatccgcccacctctgcctcccaaagtgctaggattacaggcatgagccaccacgcccggcctaagatggtaaattttatgtgtaggttttttaccacaattaaaaacaaatgcattctttttttaagaaagaaaaaatactgtgcatcatttggtcattactctatctagaaatgacatcctcctttttataatttgtaacttgatactaatacaatgtaaatattttgttggtaggggaaacttgtggaatttattaacatgaatattaagcacaaaaatcagtttattatttagtatcatgaatagtgcaaggtgaaaacattaatcttgttagcaacatgtaataattta

SEQ ID NO: 192666 - DNA, 274 bp, Homo sapiens
accaagtccaaggctctcccatgctgcctcccatggatgtgcctgtgttcctgcatgtgtgtgtgtgtgtgcatgcacgtgtttcatcagctggagccagcaggcaaagtggacacacgccggggctggggattttacacgttccttcctgggcaccatggtgcctggtaaggcacattccacactagtccatatcacagtcagccatactgcaaacagcaccgggcctggccccaggcaaaggctgcaagaatggttcgaaggccattttctt

SEQ ID NO: 192667 - DNA, 541 bp, Homo sapiens
tgtatgtaaaaggtttatacttcgtaaagataatttgtaataacaaaggcaagatcttattttttttcagtacctcttaagaatctcagttttagaactgaatccaatggagaaaccatcttcgcatcaacaactatctcttcagattggataaagaaaatgtggtacatatacaccatggaacactatgccgccataaaaaagaatgagactatgtctttagcaagaacatggatggagctggaggccattatcctttccttagcaagttaatgcaggaagagaaaatcaaataccacttattctcacttataagtggcagctaaacagtgagaatgcatggacacgaagaagggaacagcaggcactggggcctccttgagggtgaaggtttggaggaggaaaatgagtggaaaaaatcattactgggtaccgggcttaatgcctgggcgatgaaataatctatacaacaaacccctgtgacacgagtttacctatgtaacaaacctgcacacacacccctgaacctaaaataaaagtt

SEQ ID NO: 192668 - DNA, 632 bp, Homo sapiens
tatgatgagagggaggcccatgggcattctcataattacaattttaagaatacatgcaagagaatttaggtttgcagtgacatttttagttctgctttatatagagtcactataggtccttattaaattaagaaccagagaagggtcatgcctgatacggaagtcttttctgtagttcacaacgagtctaatacacaggttcaagtatttctccttattactactgcacagttacacatcattctgtgggttttatttctttttcttttaatatctgtgatcaggaaaagaaagaaacacttcagaaatgaaagattagtttcctaaatcataaagatgagctttgtaatcattttcctttaagcaaggaattaagggataataaaagccctaattaaggaccttgttagcttaactagattttcatatgcaaaacacagttatgaagtgctgctacagaatgaatggagatgcctcctgtccacaacaaacccaaagggaagcattcttgccagggcttttcttttgcttcttctgtctttctgtccatgaggggtcattctgtttctgcatgagcaccaattctcttcaccctggccatgattccttcttctcattttggttgtccagtc

SEQ ID NO: 192669 - DNA, 236 bp, Homo sapiens
ctccttatagattagtgtccttaattttgagagatgtctacatgtaattcagtgtttgtcttcatcttttctctaagagtttttggtccaccttaagtgttatggggctcaggaaaccaggtgggaaagactaggaggtggggctcacttactttgttagaatagttgcagaaggccaggtgcggtggcttaaacctgtaatcccagcactttgggaggccgaggtagccagatca

SEQ ID NO: 192670 - DNA, 341 bp, Homo sapiens
tgtattttttcccacaataaaaaaattactcaagaagaaacagaaaacctaaatggtcccataattattacagaagttggattcattgtttaaaatctatagggggacaggcaggaagctacaaaaacaaggaaggccaggccagatgcggtggctcatgcctgtaatcccagcactttgtgaggccgaggcaggcagatcacctgaggtcaggagttcaagaccagactggccaacatggcgaaacaccgtctctactaaaaatacaaaacttagctggacgtggtggtgcatgcctgcagtcccagctactcgggaggctgaggcaggagaatcgcttg

SEQ ID NO: 192671 - DNA, 343 bp, Homo sapiens
tgcagccacagccattcatgtacgcattctttgctcttgagctgcgagggaagggttgagtaagcctaaaatatttactatctggctctttgcagaaaagtttgctgactcctgaatgtaaaagagcatcaatttggattcctcaaatttggaatctgggattacttaagctcgctatatgccattcttatggaataagaagctcaaaataattgcttgctctgaatgtgaaaaggaaattatataaaaaatgaaaatatctttgttttgtctttaattctgtatctaatagttgcttattatttaatccatccttaataattaaaagatttttatgtttatg

SEQ ID NO: 192672 - DNA, 536 bp, Homo sapiens
cctttcgaaaggttctctgtttgcttttgcgttttgcctctggaaccattcgacatccgtggctgatgcgcgcacccgagaggaggccgaagcgtgttccccgcctagggtctgggagaggctgggcctggattggggtcccctcccttctggcctcctgatgggtgaacgccagagcagcctcggttcctgtacagcggagggcatgccgcggccagagacagcccgggcggcttccacactgtgtgcgacacttttggtgctacggtgtgattgttatattaaacatcacattaaaaaaataaccaaagcagtccctggtttgtcccccaggattctcctcccagccaactcggcccggcccctatacctacagtggtcagacaccgagattgcctttacgcccaattttcaccgcctaattttattgtctcgattcaagccagccgagtcccggggtcctggctctgtcttgggttctggctcgccgggccctgacccaggtcgcaggtttcgggggcctcctgggcggccgc

SEQ ID NO: 192673 - DNA, 146 bp, Homo sapiens
cctgctcctcctctacagggacatttcatccagctccttctctacagggacattccacccagctcctcctctacagggacattccacccagctcctcctctacagacacattgcactggctatacactgtttgtggaggtagcact

SEQ ID NO: 192674 - DNA, 333 bp, Homo sapiens
gtaaaaaaggacgaaggctcagcttggttcatagacttgtctgcagaaatgattctgccctccgtgggttattttccctccattccactggcctgtaacagctatcttcctagccaaaagccatgtatgtctgctaatgctcccgctccttcctcctcctctctttctcctcctatattgaataattgtttctatggtagtttaattagccaactatgaatgtattcaggcatctcatggaggaagaatcactttgtttactttttggaaactgaatgggccgcattttgtttctattttgggatatttatgggtattttctgtttctagatt

SEQ ID NO: 192675 - DNA, 349 bp, Homo sapiens
tctactaaaaatacaaacattagcccggcgtcgtggcgggcgcctgtaatcccagctatcccggaggctgaagcaggagaatcgcttgaacccgggaggcggaggctgcagtgactcgagatcgcgccactacactctagcctgggcgacagagcgagactccaagaaaagaaaaaagctccaactgctaacccaagaggagtggctgaaacgccatcgcataaaattctcggtcacctgacttctgtcacaacgctccttcaaatacaccccagcatttctctttccttgggttcctaaatctggtttttgttaacaccactgaggacaaagccactcgcgatgttta

SEQ ID NO: 192676 - DNA, 131 bp, Homo sapiens
ccaaagatactgatagtgcttcttccctactcccaaaatcaaggcaaatgacacacatgaaaaaccttgagtaaattttctgccaaagattttcagctgcagaccaccaacccagcttccccttggccgaa

SEQ ID NO: 192677 - DNA, 871 bp, Homo sapiens
gctcacccctacaatcccaggactttaggaggcttaggtggaatgactgcttgagcccaggagttcaagaccaacctggccaacacagccagatgcagaaaggaaggaaggaaggaaggaaggaaggaaggaaggaaggaaggaaggaacgaaggaacgaaggaacgaaggaacgaaggaagggctatacaaatgtaggagaattaagctatatgtgtgggggagtgtgctctgccattaattagacattaccttagaaaacctactctacctctctaacatgcctcagagggttggtgtgatgattaaatgggaacatgtaaagtagcacactcatttgccaatcgagaccttcacagaatctcaggaataaaagtgaccttcgagtgcatgtaatccaactcattccacccaaggagattctgaagttcaattcccagtgttcatacaagcctctaggtgtcacttccaagaatcatctttggagagtccttaaaactgcttctctattaattagaactgccttcaaaagcagcaaaagacaactgtccctgacccaataagagatctgaaaacagacagaagacaacaaagcaaagacaaattcttctttttggagttctcctacaatataaacagctctacttcctatgatgcttctcataacatctacattcagatccctctccgtatcatggatgttctcctccagcttcctctcaaagagttgctcttagaattaaaataaactaccaaatggaacagaattcttatcttctttggttccaaatacttttttcttttcttttctttttttccctttctttttttttttttttttttgtgaaatggagtctcactcaggctggag

SEQ ID NO: 192678 - DNA, 290 bp, Homo sapiens
ggaagtagtagcttgagtggtatcaggtgccagaaagaagaccaagggaaaaacctctgatgaccatggggatagtgtaaattgagtagcaagaggaaggaggactgcagaagttcaagaatgatgagaactgaggaaacgaagataaacacagagataaacacagacaacttcactgcagcgaaagagaagatggtgttacacaggtaagcaggatcaagaaatggcttttttgttgttgctgttgtttgtttttttttttttttttggatccggagtctcgctctgta

SEQ ID NO: 192679 - DNA, 249 bp, Homo sapiens
attgctttacttctaaacatttcgaaaagattagctgtatgtgtagctctgggttcagcttcacctcttagagatttctcaaccactaggacctagacaggttttcccttatgactgaaagtctcgtagaaaagtgacaactcgggctcccctaacacacatctcagtggtagggagctgtcttcctgggaaaacataatccagggctatcaaacaaaaggaaaatattgtcttactgatcagtgtgtt

SEQ ID NO: 192680 - DNA, 348 bp, Homo sapiens
ttcattcttcattctacaaacaggcgtgctcacttgccttcttcccccaaactaacttgtgaacaatctctttaaaatactttctattttctcatctgagtataagtcttccaatccttcgacactgtaactcatacatcatctccatcatgatgccttccatcatcttctctctctttacgtctacagcatttcaagaccgtattttttatgttattatgtttttattttttggcatggtacatattggactgtatgccttgtttttggaattttttcctccttagttcttgttataaagacgagaagcagagactaagttttattcatatatatttttctatatag

SEQ ID NO: 192681 - DNA, 501 bp, Homo sapiens
tttgctatcaaactgactatagttgctgaatacctcacatttaagtattaatagaaaaggagtcaggaaatagagcagacaaaattctcctggttcttctcagtccttggacaagagaaaacactttaatgcctattccttaaaacatggcgctgcttaatattaaaaatttgggacttctgattctgggaggacggagtatcacactttcccctattcctctaattaagtacaactaaaatgcctgatattatatgtaaagtaaacataagaagacaccgagaggtggagagaagagaccaacaggctaaaacctagagacctcaggacttcaggaatgaggcagtggcaagttcctgggttttctttttcttttctttttctttttttgagacatggtctcggctctgtcgcccaggctggagtgcagtggcatggtctcagctcactgaaacctctgcctcctggattcaaataattctcgtgcctcagcctcctgag

SEQ ID NO: 192682 - DNA, 245 bp, Homo sapiens
aaatttgaaaagaacagaaaagttttttcagagaaagcaatatctacagaaaaacttaaagggtaagtaggaacaaataaacagaagaggataggatagaggtatgggagactggagaagaggcaggggaattcaaacttgagagaaacacatgggcttaggtctgtgtgagcacacttccaaggaagaaggccttaagatgaatctaaaagcaaaagcagaagccaaataatatagtgtgatat

SEQ ID NO: 192683 - DNA, 956 bp, Homo sapiens
acctcaagtagcagatcagcctcaagtaggagatcagcctcaagtaggggaatgtaaagccaccagccaggcacaggccgaaggccacaactttcccttgctccttggagaccccagggcaggaggccaggtgatggggcttttagtgtcatcctctcaacccagaatggctcattctctctctgcttgcaccggcacccagaaggcaagctgcggtcactgttttcctttattcctccgccctctcgcttcctttcttatttttaaagaaaatagtcccctcctaataggagaccagctgcggcggtctctggccgcccagcgtgctcagcaaagcatgcgggtccttggaaccccttttccgggaaggcggctgccaccaggcaaattctcaaactgcctagctgcgagtgaggggcctgtagtggggcctccgaatgcaatagccgaggaggaggggaagggatcccgctttacaaactctcagacacatgttactactcaaactaagcagcagacgcggtggccgctgcagtcttttcggcaactaggccgcttagccccagctgtgctcggtttctggggtccctgtcctgctctgtcactccccacgcctgggctaaggaccaccaaggaggtccggaaggggatttcgaacttccaagtggcccaggagaagtgaacgcttctccttctttttcaagcctcccgcccagccctgccggctcggcctgggcgctgtggaccggtaacagcagttcgggaggctgaggcgggtggatcacttgaggtcaggagtttgagacccacctgacctacatggtgaacctcacctctacctaaaaatacaaaaattagccgggcgttgtggcggacgcctgtagtcccagctactcgggaggctgaggtgggaggctcgcttgagccccggacttctggtgctgtagtgcgctact

SEQ ID NO: 192684 - DNA, 985 bp, Homo sapiens
acctcaagtagcagatcagcctcaagtaggagatcagcctcaagtaggggaatgtaaagccaccagccaggcacaggccgaaggccacaactttcccttgctccttggagaccccagggcaggaggccaggtgatggggcttttagtgtcatcctctcaacccagaatggctcattctctctctgcttgcaccggcacccagaaggcaagctgcggtcactgttttcctttattcctccgccctctcgcttcctttcttatttttaaagaaaatagtcccctcctaataggagaccagctgcggcggtctctggccgcccagcgtgctcagcaaagcatgcgggtccttggaaccccttttccgggaaggcggctgccaccaggcaaattctcaaactgcctagctgcgagtgaggggcctgtagtggggcctccgaatgcaatagccgaggaggaggggaagggatcccgctttacaaactctcagacacatgttactactcaaactaagcagcagacgcggtggccgctgcagtcttttcggcaactaggccgcttagccccagctgtgctcggtttctggggtccctgtcctgctctgtcactccccacgcctgggctaaggaccaccaaggaggtccggaaggggatttcgaacttccaagtggcccaggagaagtgaacgcttctccttctttttcaagcctcccgcccagccctgccggctcggcctgggcgctgtggaccggtaacagcagttccaccaggatgcaggccggactaagctcctggggaaaacccgttgcaataattgtttttcacacacaacttccaacccttcccccatttccgcctccaattcggagacttgcaaagcccaagaaagggaaaagcaactctatctttgatcttctcatccaaagttaaaataataacgacaatgatgatgtagggagaaagaaccaaatagagaggctaaccccac

SEQ ID NO: 192685 - DNA, 196 bp, Homo sapiens
ctttcctaaatctaacaatccaaccttgccagagttcctcctccactcacatgggtgacatccctaaccccattaaatgtgatatgtttccacattggtgtcaattattctgcccaaccaaaatgaccttctcctagttccatgcttgtctaaatctcacctctttcggtggtggctcacgcctgttatcccagca

SEQ ID NO: 192686 - DNA, 234 bp, Homo sapiens
gcccttctcacacctccccctcattcttatcgtctcttccttccctcacccctctgtggtcaactcccatatccttctccctttacagccttgccaaacccagccttgggtcactcccactgtccacctgcttagcccttacgcccaggctgcccatgggcagaactgcacacccaccctggggctgctgcacagcgtgggccccactcagggcttgtggctgttcctctctct

SEQ ID NO: 192687 - DNA, 638 bp, Homo sapiens
  misc_feature (597)..(597): n is a, c, g, or t
gtctcaaaaagaaaaaagaaagaaagaaaacgaaataccccataaaacattcaaactatattggaaatatataaaataccggagaagcccttgttttgatataagtaggtctgagtcattgaccagtcttttggaaacgtcagttcaagtgggcaatcgttaaaaacagacacgtgtaggtcctggtcactttgttttgacttcaaacaaaattcacactcaggcactagtttttctttgggtatcttgactcaaatccctctttgactttcttgcataaatcacacccacaatcctataattcatcacctattattttcaatttatttaaacttaaagacagttgtgaagcaatctgatgtagaacagttctagatttttaggattttccctgaatagtttatctttcacatctaattcaacatgtcagcaaatctttttgtgtattacttccaaagcatttaacgtcatttgcaaggaaacaattctttatgcactcacatttcatcagtttatgtaatatttaatttaattatatgacctcatgatctgcccaccttggccttccgtgctggaattacaggcatgagtcaccgnacctggactcctttttttgtttttctttgatttcctttttt

SEQ ID NO: 192688 - DNA, 723 bp, Homo sapiens
gtctcaaaaagaaaaaagaaagaaagaaaacgaaataccccataaaacattcaaactatattggaaatatataaaataccggagaagcccttgttttgatataagtaggtctgagtcattgaccagtcttttggaaacgtcagttcaagtgggcaatcgttaaaaacagacacgtgtaggtcctggtcactttgttttgacttcaaacaaaattcacactcaggcactagtttttctttgggtatcttgactcaaatccctctttgactttcttgcataaatcacacccacaatcctataattcatcacctattattttcaatttatttaaacttaaagacagttgtgaagcaatctgatgtagaacagttctagatttttaggattttccctgaatagtttatctttcacatctaattcaacatgtcagcaaatctttttgtgtattacttccaaagcatttaacgtcatttgcaaggaaacaattctttatgcactcacatttcatcagtttatgtaatatttaatttaattatatgattacaatgacagtacacctggcataaacaggctagggacacacccaatcaactcttggtaaaccgacaactcaacccagagcagaggtagctgagttcttgcttttctagaccaggggtcagcaaactatggccctgtgggcctgtttttatacatcctgtgggttaaaaatgccttttaggg

SEQ ID NO: 192689 - DNA, 570 bp, Homo sapiens
  misc_feature (518)..(518): n is a, c, g, or t
  misc_feature (535)..(535): n is a, c, g, or t
aacatgaggacacatgggccatgcccagagtttggtgaagactagcaatttggtactgagcaaagtttctcatctacaaaagaagtgcactggctctttgtagctttaaagttttttgaccttatgaattagcccttttctgcttcccttttgctatttgtgccaaaccttttggaggaagaagagtgaatgtgtctcatcatattctctcctagcagctggggtgtgaacatatggcaggtggcagccacacagccgcttctttactcagtgccaagtagctgggtgagcaaacatggcagctgaggttctcagcatttttcttccccctcccaaagatttcatttgataagatttacaataaccatataaataggtccttgattagtcagatttagtgaataaaattttatgccatgaaaatacaaaaatggctgattctattaatgcattgctattagaatctcctgggtccgggcgtggtggcttacacatgtaatcccagcactttggtgacngagcgagacttcgtcanaaaacataattaaattaacttagctaatgtctcaa

SEQ ID NO: 192690 - DNA, 330 bp, Homo sapiens
acaacagctacagtgtcactaggtgaatcttgaatttttcagctccattataatcttatgggagcactgtcatctatgtggtccttcattgacccaaacatcattttgtagtgcatgactgtgttgggtttttttaggccatctagtctgttgaaactactcaactctgctattgtagcgtgaagtatgagtaagtacaattatttatggacacagtcatgttaatttcatatcattttcacgtgtcatgaggtattcatttgattttggggagctccattccctaaatatcattaggtattcatttgattttagggggtctccgctccg

SEQ ID NO: 192691 - DNA, 329 bp, Homo sapiens
gttccctggccagtaaataggcagagcctcagatctcttgctgagcttttacaaggtaaaccagcataaaaacacccccctctcctcagtgaggatatgaaagaatttgtgtgtgcttggaggtgggaggttcctgtaatattacaaaactaatactacaaggagtgcatctggacggatacagtaacctctttattgatttccttcatccatccctgctctcctccaaactgttttccatggggcagccaggaacttcaaatgtaatttctgatcatatttaaattccttcctttgccttcctcactagttttttctccctgactctc

SEQ ID NO: 192692 - DNA, 457 bp, Homo sapiens
ctcagggaagcttcacgtaagtgtcttccttcactcatgtgttcgctcaggaaatacgtatttactggcacctgctgggtgccaaggggaactggaggatctgctggccactgcctttgctctcatggcacttgtgggggagacgggcaggcatggtgcaatcaggacacccgtgtggagtcgcaactgcagatgttttgggaagccgaccaggtgctgcgggttgtgtagcagggtctggacttagactgggggccatcaaagaagcatctccagggagggttgtttgggctgagactggaaagctgagtggcagctcatgagcaggaggctcacgagagcagaagattggagggacggccggcaagcagcgtttgttcagctcctccaacttttacccttccacgtgtttgctccacagatgcccagcatggctgtgctgattgctggttggttt

SEQ ID NO: 192693 - DNA, 179 bp, Homo sapiens
ccagggcggggggcagaaattcttagggggtgagaaactcttattctttttttgtataacgctcagatacatgtaaaagatatacaattgatctaggttttaaattttcatagaatggtgttcaaatacttgtacacaggtgttcatagcaaaactactcacaatcgctaaaaaggtgg

SEQ ID NO: 192694 - DNA, 765 bp, Homo sapiens
tgggattacaggcatgagccgccaagcccggcctctcactacatttaagtgacgccatggctcatgcctgtaatcctagcactttgggaggccaaggcaggtggatcacctgatgtcaggagttcgaaacgagcctggccaacatggggaaaccccgtctctagtaaaaatacaaaaattagtcaggtgtggtggtacaagcctgtaggcccagctacttggaagactgaggcaggagaatcactttaagcgggaggcagaggttgcagtgagccaatctcaaaaaagaaagaaaaaaaaaaagaaaaacatatgatgctggggcatctcggcctcaatacctgcatgagcacagtcatgtccaggccagggctgctggtcgaggtccggccccatctcttccagcagaaagggagtaagcttgcagggaggctgggggacaagatcccaggatctcagcctctgctcatggatcagctctgagaccccgagtgagctgggggtgctctgtgcgcattggtttccccagctgtcaagtaaagggattggatgaggaagtcttgtcaaggtggaatgatctcagatttggggcagcagtgaatgatcccgttccctgggcccatgccagtggcctggcctcggctcaacacagccccaacactctggaatggggatgagggggcagtcagctcttgctcctagtaagagagatgcaacagggctctgtggctgagctgggtgccttgcctcacacctgtaatccca

SEQ ID NO: 192695 - DNA, 480 bp, Homo sapiens
taagccaaataaatcaataacctggtgcctaacactcagaaggattaaatgctgtcactgagaccttggatttagaaataaaggacggaattctacctatgcacacagtccatgcatatgaatgtcaaccgcagagtttcctagacgattatcaagtggaagcagtaaaagtgtactccctaaaaagaaatatcatgggctgggcgcggtggctcattcctgtaattccagcactttgagaggccaagacaggcagatcacttgaggtcaggagttcgagacaagcctggtcaacatggcaaaaccctatctctacaaaaaatacaaaaattagccaggcatgctggtgtgtacctgtaatcccagctactcgggatgctgaggcttgagaatcacttgagctcaggaggtgggggttgcagtgagcagagatcacaccactgtactccaacgtggatgacagagtgagaccctgtctca

SEQ ID NO: 192696 - DNA, 171 bp, Homo sapiens
ataatccaacagtgtccaggtttgattctgcttctacaaacacagagacctaagctctcactcctgtagttatactcacaattccacagtgtggcttttgaatctcatgattgcaaagctggcatcatgccacaggtaccattctgcaatgcgaccttctcactcccctgt

SEQ ID NO: 192697 - DNA, 440 bp, Homo sapiens
acatttgcaaatcaatgaatgtcttttgttttcttaattgttagctgcttggaaatttagaaaagtcaggtaaacttgttatcttgtaagtattgttcagaccacagttgcatctctaacttccattctgcttcttaaatgcatgaagattcacattggctgactgctttgtgtgctcttcattgtaaaatattggacattttcttctaaattcattttttttttttttttaatgactgcatggcctggaaccttactttgttatgtgtttttcaagtttgttcagattattcactctcaaaagaatgcttttctgtgaattacattttaagttattcagaaatcctgaaaggcatcatttggcagctcatctgttttcactaaattgtaagtttgtcggcacaaatctgtctctaatggaaaggctagatttgctttat

SEQ ID NO: 192698 - DNA, 491 bp, Homo sapiens
gggttagggtaaaacccttggaatgcacataacatttcggggggttcctctcaaggagtgttatattcccctgtctagtgatttctgaccccggggcaaagccggccggcaatgtatgtatagttttcatctcacacaagagaaagaaatatatcaactatatgttgagctgtagttaatgatatgcatactgaaatgggtagggtcataatattggcaacttcttttggaaacgtatccagttaatagaaatgaggagcttctgttaccagcaagctgcagtagacatcagagggtgaaaggagagaaggatttgaagttcacaggacaatcctggaaggaaggaatgaggaggagagagacaggaaccaggagcaggggctccaggatgatgctgagaggctgtcgctgtgaggtgcagtcccaaatgccagcgtgagcagagttttccgttgtgaaggaaagaccaggtttcatataaaagcagattg

SEQ ID NO: 192699 - DNA, 296 bp, Homo sapiens
caggaaaaaaaatgtctttacttgggaaactacattaagaagatcttgggttaaaaggtgggaccctaatgccttgatttggctggtaagacatcagagggtgaaaggagagaaggatttgaagttcacaggacaatcctggaaggaaggaatgaggaggagagagacaggaaccaggagcaggggctccaggatgatgctgagaggctgtcgctgtgaggtgcagtcccaaatgccagcgtgagcagagttttccgttgtgaaggaaagaccaggtttcatataaaagcagattg

SEQ ID NO: 192700 - DNA, 369 bp, Homo sapiens
  misc_feature (135)..(137): n is a, c, g, or t
gcatggaaatgttattgagaagacactttgatgctgcatgagaagggagagaactgtaacaacgttcatgaactactgagggagaatgggatttactagtctagttcgagcatgtgtaagtacaataacaagagnnnatatagccaggtgtagtggcgggtgactgtaatcccagcactctgggaggctgaggtgggaggatcgcttgaggtcaggaatttgatatcagcctgggcaacgaggttgagaccttgtctctactaaaaataaacaaaacataagataagtacacacataagtcagatcatgtgtctatttccctaaaccctctaatggcttcccaacttggaccataaaaataaaaatcct

SEQ ID NO: 192701 - DNA, 515 bp, Homo sapiens
taactaatgtttactgagagtttaaccacagctttaatacttttggtatttaatcctcacaataaccgtgtgaaatagacacttttacacaccctccttcaaggaagttgagtcacagaagaggtaacttgcccaggggcacacagctggtaagtagattggaatccaagtaaatctacatttagagccgaccttatcactaggccttcatctctctcacacttaacacccattccagaaactcccgtcagctatcagttataccattgggttgatgactagcttagagtcttgaataagaaggcagcacagataaaaatacacctgccttagtaatcagtctgtgggcttacgtttgtctctctgaaaaggaggcagtggaactcatcagtgcaatcccgtcttgcctagaatcctttcactggtcgactcaatcctagtttggtggattctcagctgaaatggaatagaggataaaaggaagagtaaaaagaacaggaccttcattcccccag

SEQ ID NO: 192702 - DNA, 432 bp, Homo sapiens
agtatacattggtttggcctgaaaaggtgggacaactaaaagtgggggcttacaagtcataagtgggttttaggaattctttagctgacagttggttgagtgttaagctactgtctaaagacgaaatcagtagaaagaagtacctgaggctgggcctggtggttcatgcctgtaatcccagcactttgggaggccagtgtgagaggaccacttgaacccaggagtttcagaccagcctgggcaacatagggagaccctatctctacagaaaatttaaaaaattagtcatggtggtacatgcctgtggtacatgccactacttgggaggctgaagtgggaggattacttgagcctgagaggttgaagctgcagttagccacgattatgctactggactccaccctgggcaacagagcaagaccctgtctcaaa

SEQ ID NO: 192703 - DNA, 463 bp, Homo sapiens
ctgtgtcgtagtcccttttgtaccttttatgtcactattcaggaataacataggcaatgctgtatcttttcaataggtgatattttcagccagtcaggacctatttgggttttgagctaaactcagaatcatcaaggccacatctcatataaaggaaaagaaggaagtcagaatcacaggtatctctgcttccagcctcctgatatccccaaatgcctgtttgcctattgtgcttccggactctgactcagaactgcgtatgacttgttttcacaaatccgctcctctccctgatggaaagcaatacatatgtgtgtgcatcacggttccattatgaaatggctccatgtagttctaggcagaaaaaaggccagtggctgactaggtggtggggttaggggacatactcttttgtttagtttactttggcaatccatgtgtattgacttcttagaacagagca

SEQ ID NO: 192704 - DNA, 198 bp, Homo sapiens
  misc_feature (15)..(15): n is a, c, g, or t
cgtacttattacgtntcctaggtgaagtaagtaagacaatatggtataaattggggatggtgaagggacataaagaaaagttagtttctaaactggacttgaattaatgttgacagccgtagaatgtaataagtaatgtatatatataatgtgaagcaaccactaaaaatgccatgcatatatgcaaaaactctagag

SEQ ID NO: 192705 - DNA, 393 bp, Homo sapiens
tagtgaaatgcttgaaagagctgcgtatcttttacacttacagcagtatgattttctgttgtacccattatatggtacctgcagctagttcagataaagagggcatttaactgtcaagggaacctgagaggagactctagtaatctggaaagtctgttggatctttgagggattttgggatggtgagagtggggctaggatctctggctaggttggagccagcctgcatttgtatctgtatcttggaagcaaacttagaatgcagagacagatgtggcatggacgctgtcagctctagccaaccactaaatcctaaggtgggagagatgcaggctttggctaggtgctaagctgctgtagccggttgaatgtagaggtcactatcttttccga

SEQ ID NO: 192706 - DNA, 326 bp, Homo sapiens
tctcctctgctcaagcttttagaccagtgagtttgatttgaatcatcctctcaaggctggaagagccccattattgaagttttgttaatgttcttttgtggggatgggccggggcactcaccccttgtcttctgtgcccttctgcatggaccatatctttcccattcgtgcattcctattcgtgcatttttcatgcagttttttttctgatataataataatctaaaggtaaatggatcctcaacctctgactcatattaaactgcagaacttttagtgaggtaattaggagtgtaatatttaaatgcatttgataagtcacatga

SEQ ID NO: 192707 - DNA, 446 bp, Homo sapiens
cccccgtggcgcgagcacttctctagccctgtcctttgggtcagtcctgtccttccactaaaccttgctcaggactggtctcaggttccctttgttgctccacagtgccctggagataggggaggtcggagggtgctccctgactccccaacctgggctgtgtctccctgacaggcctggctctgagacaggggttggccccgggcaggcaattctccagctggcttgtgagatcctggggacgggattcagacactctggaagctgaggccaggaaggtctgtcacctcgttcttctggacctctcctcccgcacatgtcaccccacaccggctccctctcccagtctcagccacaacctcttggtcctcagtggcctgagccaggatccacactcctccccgtcactctcccgtctcacacacaaacacatggtgcgtctccag

SEQ ID NO: 192708 - DNA, 366 bp, Homo sapiens
cccactcctgatcacataatgaaagtctcctccttaatcccagcattttgggaggccgagatgggtcgattgcttgagaccaggagttcaagaccagcctgggcaatagagtgaaaccccatctgtacaaaaaatgcaaaaatcagctgagtgtggtggcacatgcctgtattcccagctactcaggaagtgaggcgggaggctggcttgagcccaggaggcagaggctgcagtgaactgagactgagccattgtactccagcctggacaacagagcaagacccccatccaaaaaaaaaaagtctccttccaacaaatcataataatgacaattttcctttattaatcactagctacaccctagga

SEQ ID NO: 192709 - DNA, 185 bp, Homo sapiens
ggataccacgaacaatgttaatatatgaatcaaagagtaaacacaacagatattttacaaacctgagtaaaagacagctgagacaaaggtataaaccatagaattcaatttacacaaagctcacaaagtggcaaaattaacctatcattaggctagcagttttctctgggtaggatagtgactgg

SEQ ID NO: 192710 - DNA, 255 bp, Homo sapiens
aagtgtgtcctctcaccccagcctctatgacacagaacctgggctctttaccactcagttccatcttgcctcagaaccagaactattaaatctgttcaagcaatcagtgctttcagagagggacatgagtagattataaagactgcgtaagtacacactcactttccagcattcctagttttttggattgctcaaggagagagagttgcccgaaaaatacacacacaactcctctctttgtcagcaaaaagcagg

SEQ ID NO: 192711 - DNA, 417 bp, Homo sapiens
cgggctgccagaggacccgacggctcaacggaactttgtaggctaaaggtattttctgtaaataatgtgttcagatcaattagcatccctaatgaaatatatacagcaaccctaaatgacataaactgaagtgtgcaaaagcagaggaatgtagattttctgggagaaatttaataaatttactttggaaccatatcaaaacttttaccttctatgagcaacatctaaaatcatgtcaaatagaatgacattagatatattgtctttaattgggttattctgtattgaaaggctctggaagaataaacttctataaatatacttttaaagtatctaatagagtggcttgtgccaacatttacattagggacaattaaaaaataagaaagttccgtcgaagccgtcgggtaccgagct

SEQ ID NO: 192712 - DNA, 671 bp, Homo sapiens
ttcttggtattgacttgtcatgtttatctcacccattttcctattcaagctaaagacctcccttttttcagcaaagagacttttctacattggaattagttgttcagggactgggatagttcttgtaaacaagtaggtcccaacaggagagctgtccaccattctaagacttcttagacacttttacattcagggaagaattttgagctcccttttcagattagaaagatttgggttgccaatgtttgactggcattttggtctcaaagtcagcaatgtttactgttgttggtcagatacaataggttcctagcataacataggaacctgttatcttgatggaacccaatatcttccttatttcattgctaactacctttcatatttttcatctgtttttatagcttctcctaacataacaccatgtagatcgtatgtcccatccatttcaagatacttacagtttcccttaaatgatataccctactggatgtggttttgtctctttctgacatttactaaaatttcattctcttctcactctaactacctggccaaaacctaaattccttcaagtctcagattaaaaatcttctcctctctgtaatcttaccacaactcccatccctagtattccctccagctcataccctggtatcctcctgggccca

SEQ ID NO: 192713 - DNA, 345 bp, Homo sapiens
aaactcctgggctcagatgatcctcctgccttggctacccaaagtgttggaatttcaggcatgagccactctgcctggctcttgtataggatttttgccattaatgcataacctcaatctactcatgagaaaacatcagacccaaattgagggacatttctcaaaataatcagccagagtgtttctcaaacatgtcaaggttatgaaaaacaagaatggtttaggaagtattacagattgggtgagactaacactgaatgcagtgtagaatcctcagttggattctggccataaaaagggtattactggtaaaattggcaaaatagggcctataattagttaatg

SEQ ID NO: 192714 - DNA, 291 bp, Homo sapiens
ttggacatattttgtcaagacttccctgaggctgtcattggtgcatcctcaaccttggcaaaataaactttctaaattaactgagacctgtctcaagtttagggggttcacagtggggggggcaattcagtctgggagagaaggctttaatccgagtgaagagccctttgcactactagcctgcgaggaggctgaactgtcttcctgccttgacttaacacagccgttaccatagaaattacagcgccactcttcagaggtctaccctgtgtgcacacatggacaagaggt

SEQ ID NO: 192715 - DNA, 441 bp, Homo sapiens
tgcccatttaacaggcacagaaaactgaggctcaggtgaaatgcattgcaccaagtcccacgtggtttcaagggaaatgactctagaatcttaaccaccatgctatatagggtaggcccatctgtggccgccagagtccccagaaagagcggtcacagctaaaaggcagcagccaacagctgttcatggctggcttggtgatgtgaggagagatgtgcagcaataattaaaggaggccctggttttctttctgttttctttttgtttttttgagatacagtcttgttctgttgcccaggctgcagtgcagagacacaatctcggctcactgcaacctccgcctccagggtttaagtgattctcctgcctcagcctccccaatagctgggattacaggcacgcaccaccatgcctggctaatttttgtatttttttaaagta

SEQ ID NO: 192716 - DNA, 752 bp, Homo sapiens
agtaggatgtcaaaacagcctcattaagaacaatgtgctatgaagaaagggagattaaatagtaattgtcagtaggtgatttagcttcacacactttcttggaatgttaccagcagtccccaaaattttagcaactcctatctctactttctgatcaaaagaaatacaaaaaagatatcagctatgtattaaaaattaacttatcgttacattcccaatagatcattatattaaaacctctaaaggctatttagatggagtgaggcatctttgcattactgagccataagataatatggtttccagtaacttgtgggatgaaggggaacagaatgttgcatggagagacagaagagttccttatttgccccactgaactcaacttgtaatcatttcctctcatcaccatctcccctgactccctttaaccttaaatttacagctgagctctcatttaatcttaagtgaaagagcatttaagaaaagaaaataggctgggagcagtagcttgcccctgtaatcccagcactttagggggtcaaagcgggaggactgcttgaagccaggagttcgagaccagcctgggcagcaaagcaaggccctgtgtcaacaaaagatgtttttaaaaaacagaattagcctagcatagtagagaattgcttgaggccaagaggttgaggctgcagtgagctatgatggcactagggcatttcagtcttggtgacagagcaagaccctgtctctgcaaaata

SEQ ID NO: 192717 - DNA, 340 bp, Homo sapiens
cacgcctgactaatttttggtattttttgtagaaatggggtttcatcatgttgcccagggtggtctcaaactcctgagctcaattgatctgcctgccttggcctcccaaattgctgggattacaggcataacccaccttccccccagccagaatcagtttattcttgctgtttgtttgtaacaacaaacataaacatcagagagactgataatctatacaactatagatatagcacagtgagccttgactacaactgcatgctgctaaagacagctcaatttatgctaatctgggctgtaggtagacttggcaattcactcgtaccccaaaggagcaacc

SEQ ID NO: 192718 - DNA, 463 bp, Homo sapiens
gagaatgggtgtcctgctagcagccaccacttcccactgattcttcctcctcctgcagtgtcatccttcctgcagcccaccctctccctcagcagaaacctggagtatgtcttcagaggaaaagagaatattccactgcctacatgtttccatcctgcctggtgcctctaagtcagatccagggctcacccagaggccacgcttccagcctccagcactcctaactctgttcctcttccctgccactgtgggccaagctcaccaaggatcctcgggccaacattctgattccccaccctctcctgacagcagccactctcctggtggcatgagtggaggctggctctgcctgttttggggctttgtatcatgatatctggcttcttttgctctgaggctcatccgctgctgtgtggctcgttgctgtgcagtggcactcggtgtgaatacaccacgctttatg

SEQ ID NO: 192719 - DNA, 448 bp, Homo sapiens
catatcgtttcctggaaccctctcaatgagccttgcaggaggagtatcataccccttgcttagagacagcgcatatgagattcatagaagtcaagtgagatatcaaagtcacgttgctagtaagtgatgggctgggatttaaatctaggtctttggactccaagagttatactgttaaccactacaatacactccctccacctcccatcccagaaaaagttggatcagggatagggttcacttcaggagccagggtcagagctgggcctgtagtcacatataaaagataggacacaaacacaattagcagcagtgttggtttaataaaccgccgtagggtgctccaagaggccccctcctggcagatcccactggtggtcaggaggcagaggcatgagctgggtgttgagggatgaggggaagagttaaggcccagggtgtgaagggc

SEQ ID NO: 192720 - DNA, 148 bp, Homo sapiens
gttggggcatttgtgatctgtggagaaggcagagatagttaatgagtaggcacatttgctaacctccttggacaggaataagttcatctcctgcttcttatttcctcatctctttttccttaccattttttcctcgtccaattctccc

SEQ ID NO: 192721 - DNA, 435 bp, Homo sapiens
tagttgttgtgagggcttcatgacatgtggctcttgcccgatgtgcagtggccaagtgtgaccaataaccaaaaccagaatggcccccagggaccatttaccactccaccttctcttttgcatagggggaagttactttcccaggatcacacagccagacaagggattcaaagtcaggactattaattcaagtccagagttctgttccctcccccactgctgtgttctccaaagcctgagcaggagatcatgctgttcctaactagtgaatgtcatacttccggtcgaacacaccacccctgtcatatggcagctggtcacccagcagggagggaccctgcctcccactcacccctactgctggacataggaaccccaggtccacccatcctttttcgaggcccacacttcccaaagctatgccagttctttgat

SEQ ID NO: 192722 - DNA, 288 bp, Homo sapiens
cgcagctctgggcgccacgcagactgctgtgcccactggggctgggctcaccaggaagtaggatcagcagaaacgcgggcgctcacaactggtgccaggttcggtttccttaggcctctacccgcagggccccgtccctaccgtgcctggtgggtgcttcctcacctgctgctctccccacaacggggctgctcttttgcccaggggctctggggcggtcccggccacccagagcgcgaggtcgcaggtcccagtactcatgccggaggccctgacgtgctgggggtg

SEQ ID NO: 192723 - DNA, 191 bp, Homo sapiens
atcttatcttgagtattatttgttagctctctttttagcagtgaactttttatacttggtggtacgaaactaccctagtgatgcattgcatttatcacatgtattaccgtgatggtggtaatcttaaccacactttattaagtgcttctgtgccaagtacttccgagtctcacttactcttcacacagcct

SEQ ID NO: 192724 - DNA, 592 bp, Homo sapiens
gtcacctcaattccctgagctttagttctcatctgtaaagcaggcagccatccttaacctgcctacagactcggtggaccacctgacatttgagatcattctaatttgagaactatgctctggtattggcaggatatagatttaagtagcagatggacatttgcatactcttgcatttgattcttaaattatccatctcggtgtttaaatgtatagaattgcctgtgctcttcccttcgctagctcccagtgtcctccatgtttctcccacgggcctcccagctggttggactactggatgcctgccctgcgtgacccagagagaagctgagggtcagcagtcggcatcctgattcccagcagagagtgacaagtgcacctttctggaaaggccgagccacttcttaaaaagtttattatggggaggaaaaaaaaaaaactaagcaggaatggacaagaaattacatttataatcctacaacccaaacacagctatttatgtttttctgtggttcctctcaatctttatctatttgtatacaatcattgtacttgtataatttcctgctctacttttttccccaattaacat

SEQ ID NO: 192725 - DNA, 312 bp, Homo sapiens
aggttctgaggaaacataaaggaaggattctcccaattccacaaaaactcgatttagtcaaaaaaatatacttattgactttcctaaaaaattaaaaagaaaaacaactaaatacacagccaactagcatcttcatttttagaactcaaaaattaattggaatatacctagggagaaattttctggaatttcattttctgggatattttttaaaattgctagtcctcattcctttgtcattttatatttcattttccatcttagttaatattgctgtttttatttcctcattctctgttattgtatcagtta

SEQ ID NO: 192726 - DNA, 397 bp, Homo sapiens
tagttccacttatgtaaagtttctggaaagctgtataaatttactaaaacactacactggtacacttaaaataggtaaattttgtggtatttaaattatacccaaacaaagctttttttttttaaaatgggagcatattctaaatattgtttgtactgtgcttttttctactcaaaactataactcaaagagagtttcatattagcacaggagatggccctcattttttagtggttataatggttcgctgtatgattgtgtccaaatttaagtaactcaaatagccatgaacgaaaagatctcatttctccattcagaccaaagaccttgtaggcatacagtttctgcgttcagttttaaaagctacaaattagttccttgcctcaaaatctcttaa

SEQ ID NO: 192727 - DNA, 352 bp, Homo sapiens
tgtgtgtgtgtgtgtgtgttgtgtgtgtgtgtgtgttgggaggaagggggaggaaggaggagggcattctctggtggaggagaaacagcctgagcttctccccttcccatgtctttcacagcagctcatacactgttttctcgccttgcaatgcccaactttctacctaatgacctaccctcccctaaggccctgctcaactcaccttcactgagaaatcttctctggccttcagcccttttcttaaagcccaaggtctctgaagctgcacttgattggttggatactgtattagaccattcccacgctgctaataaaaacatacctgagactgggtaatttataaaggaaa

SEQ ID NO: 192728 - DNA, 421 bp, Homo sapiens
ttttcatatattagattgacctgtatttattttttcttctactgtctctatcctgatttggtgtaaaggttataaaagaatttctaggtgaatttggaagtaatctatattttaaaaattctctaatactgcttacataatgataatcaagtccttaatgtttgctaaaattttattggacatccatctgggctttgctatatttcactgagggaagcttttgatactccaattcaattttgttatttattgttgattttattcagtcttgctttttctgctttggtcagttttgataatgtgcagtattctagaaaactgaaaaatgtgttatctatttttatttgactggcgtatggttatccttagtattctcccataattttttaaaatctaaactgttgtatagcccctgttcatc

SEQ ID NO: 192729 - DNA, 345 bp, Homo sapiens
agcagctggcaaggatgaagagcaactggaactctcatactctgctggtggaatggcaactggtgcgtcactgtggaaaatcaatcagcagtttctcctaaagcaaaatatttgaatgtctaatactcagccagtctgctcctgtgtctctatccaagagaaatgagggcctatggccatcagacgtgagccagaacattcataaagcacgactcataatatcttggaatagtctgaacataatcccagctgggcacagtggggtgcaaagttatggttaactgcgttttcttgtcaattaaatattaatgaaaataccttccttatctttttatgtaacttttc

SEQ ID NO: 192730 - DNA, 487 bp, Homo sapiens
ccttggtccttgcatgcgtgtgtatatgacaataactgctccggggaaatctaatggactctcttatggagagacttgggatgcagactcgcccagctttaccacttctcagttacagagtcttgggctagttcttaatttctagtccaggttctccttctaaaatatagatcatgaactaacaagagtttttgaaggaattgaatgaaaaaaatgtataggtaaagtgttaagtgttgttcatgctaacagttaacagttggtattattattcaggcagctgaaggttatccacctctacttcagcccacacagaaagacctgaatgaccttagacaaattatctgagcctcaacttcctcgtctgtacagatggatcactgatatgatacatgctacaacatagatgaaccctgaacacatgatgcccagtgattattactagaaatgcaagttgggaacccacattatattgaaaaacaaaaca

SEQ ID NO: 192731 - DNA, 711 bp, Homo sapiens
ttccaccaaagataaccatgtgctagaaggcatggactctccttattcatgttaatatcacagtaactagtgcagtgcctggggcatatggatattcaacaaatagtagtgaaaataaactttatgcttatattgcacagctttcactttcattgatatgtctgatcattgattttcttctcagttcagttaacactgagcaaagctttatagaagagattcctaaattagtcttgaagcagattgtaggtggtgatggtggttgtatatgtatgtggaagaaagtttaagggaagcatggccaagagaacagcaagtactaaaacatgggggtgggaggaaaagcatgttgggaaacgttgaatattgctggagtgtatggtagaatgaaaaaggcaagaaatgagattagaaaacagcatacgggttttatataccacaacaaagggtttgcagtttatcttttggataatgggattttgaagaattttcagtggaaaatacattaattgagaatagaatatgtttttgcaaatttataagagacagactgagagtaaaaaattcaattgaaagtgcagtgtgttttaaaatattcagcaataaagcctcgtgtttctgttgattagctatgtaggactttaaatggatcttcaccattatcaagcagtttttactttctaaactttattttgagggaaaagaacctag

SEQ ID NO: 192732 - DNA, 228 bp, Homo sapiens
ccatttcttattatccatttttattgccactgccccatttgaggtcctcataatctttacttagtctttggtcttttaggaaggaattctctatctggtctctctgctcctaatctctttcctttctaatttgttctttataatacgatagtttacttttgatttctttctctcattttcaattatcagtattgaacagtcccatagccaggtgtggtggtgtgtgct

SEQ ID NO: 192733 - DNA, 458 bp, Homo sapiens
cgggaggtggaggttgtagtgagctgagatcacaccagggcactccagcctgggcaacagagtgagactccgtctcagggggataaaaaaacaaaaaacaccgagaatagtgtctgggacagagaatgttccataaatgttagctagtgcttgtagtaagaaaaggggagcagccgggcacggtggctcacgcctgtaatcccagccctttgggaggttgaggcgagtgcatcacctgaggtcaggagttcgagaccagcctggccaacatggtgaaacccccgtctctactaaaaatacaaaaattagccgggcgtggtggcaggcacctgtaatcccagctactcaggaggctgaggcaggagaattgcttaaacccaggaggcagaggttgcagcgagccaagattgcaccactgtactccagcctgggcgacagagcgagactctgtctcaaaa

SEQ ID NO: 192734 - DNA, 554 bp, Homo sapiens
tgggcgacaagtaaaactccgtctcaaaaaaagaaaacgcttttcttctttgggatgtgaaaggccccatataagtatattttgaagagttactttaataagccaaatagtagacatttcaagccctgagttgttggggtaagaggagagcatccctagcacttcaggaggccgtggcaggagaattgcctgagcccaggaatttgagaccagcctgggcaacatagtgagaccccatctctacaaaacattaaaaaattagccaagcgaggccgggcacggtggctcacgcctgtaatctcagcactctgggaggccgaggcgggtgaatcatgaggtcaggggatcgagaccatcctggctaacacggtgaaaccccgtgtctactaaaaaaatacaaaaaattagccgggcgtggtgacgggcacctgtagtcccggctgcttgggaggctgaggcaagagaatggcgtgaacccgggaggtggagcttgcagtgagccgagatcgcgccactgcactccagcctgggcgacagagcgagactccttctca

SEQ ID NO: 192735 - DNA, 285 bp, Homo sapiens
gccacattttcttaatccagtctatcattgatggacatttgggttggttccaagtctttgctattgtgaatagtgctgcaatcattgagaaaaccagtttattttcgttgggaaaatgttttttgacttagcccgccttttaccattcccttgaaacattttttacttttacgtcttttacttaactccaattacagaggcacttcttgaaaaagtggatggaacagagtggggtggatggagcagagggggggagtatttagaaggcagaattgttagaacctc

SEQ ID NO: 192736 - DNA, 396 bp, Homo sapiens
ataacttgctcattactataaaggtggtaccaagccattcataagggatctgcctctatgacccaaacacctctcattagaccccacctgcaacattgcgaatcaaatttcaacatgaggtttgaagggtcagatattcaaactgtagcattccacgcttgactctccatgcctcacatccttctcacattgcaaaatacaatcattctatcccaatggtcccgaaagtcttaacttgttctagcatctactcaaaagtcccaaatccaaaatctcatctgagactcaaggcaagttccttccacctatgagcctgtgaaatcaaaagcaattcatctacttataatatgcaatgtttgtataggcattaggtaaacattctcgttcacaaagaca

SEQ ID NO: 192737 - DNA, 1180 bp, Homo sapiens
ataaattacatttagcaaatcacccattttaagtatccaatcatgagttttgataactatatagtcttctagcaactatcacattcataatacaaaacatttccatcacccccaaattcccacatacccctgtgcagtcaatcccttcctcctaccataggccattagcaaacactgatttactttctgtcacaatagtttgccttttctagaattacctatcaatggagtctggcatcagtgattattcacatggctgggtatatgacttttttctcttgcctaatgttttggagattcatgcatattgttgcatgtatcaggttagttcttcctaatttattattgaacggtcttccattttttagatataccacagtttatccattcacattactgttggaaatttgggtttccagttttcagctaatgtgaataaagttgctctgaacagtgaattacaagtcttcatgtgaacatgttttcatttccagtggggaaatactcaggaatagttttgctgagtaagatggtaattatatgtttaacattgtaagaaactgtcaaattgtttaccagagtggctctaccattttgtattctactagcaaggtatccagttgctgtcagaacatgtattcattctttatactttgttacagattgtcttaaataacaaaatgttttttaaagaaagtaagagaaatacatttgcctgtgtacatgtgtcttttacatttgcccacatatttgccatcttcatacccatgtattttgtttcttcctgaagatctgtagatcttagtttccacctggtgtcattctctttcagttcaaggactttcacatatgcttgtagtgcactcctgctggtggcgaattttcttttcttttttttttttttaatatggaacacttcacgaatttgcatgtcatccttgcgcaggggccatgctaatcttctctgtattgttccaattttagtatatgtatgtgctatttatctaaaataatctttttttgcctttgttttagaaatacaattttgcttgatgtcaaatttaaagttatagggttttttaagctttatattgatgttccattttctatcagcccccattgcttctaatgaatggtgaacagccatttgtattgttacttcatatacagttgacccctg

SEQ ID NO: 192738 - DNA, 182 bp, Homo sapiens
ttcaacttttacgaacaaaggtcttactttttgtaagtttgtaaattattatttatattttcctttctccctcttccctctttctttgctttccctttttccgtccttcagtatgtttatgtcttgcttccactagactataaattccttgagggtagaaactaggtctgttcgttccattt

SEQ ID NO: 192739 - DNA, 627 bp, Homo sapiens
tgattaaagtattacagataaataaacagaaagactgtggacagaacatggcaaaggactgcacagagctcctgagggattcctgagagcaaagtgaagtcagaggtagggccacaaaaggaagtgaggcaggcatagaagcctagactggatttgagaaggatggaaagctctggaataggtatgtacggaaatgcatacagataagagaaaaggctgaagaacaggtatgggaagccagatgatatgggacttgatgaaatgccctgcagaaattaccagcttgctctcaagactctgcactgctgtacttgcctactcctgctcatctacccacatcatgtcctggtcatccaaatgaaagcaacacagagcaccaggtaagtttcccatcttttacttaatggaaaggctgagctgaaggtacattcactgtgtgtgtcagtaggagataagatctggtgggtggtgagaattggaaaggctgcagatctgttgggtgttcctcacaagttaggtggccagaaaccaaaatggtaaagtcaggtaggaaagagtacatgtttttatacgtggagagaaataccactgcccatcaaagaatgatggaaagaaagggcctgtgaa

SEQ ID NO: 192740 - DNA, 277 bp, Homo sapiens
tgtatttttgtagaggtgggtttcaccatgttggctaggcttttctcaaattcctgtcctcaagtgatccgcccgcctcagcgtcccaaagttctgggattataggcatgagccactgtgcccagccagtaccaattttattataaagtagtacctatacatcttcaaagtctttaaagaatagaaaagaaccactttctaggacacttcaaataaggacatttttgtctggactccgttcttttgacgcctgtctccattagactcctccaacagg

SEQ ID NO: 192741 - DNA, 443 bp, Homo sapiens
gggaccaaggaagccagaggtctgggtcagcccaaagcctccaaatagctccaaccaaagctcttaacatatgatctgggcaagagttcatttgaagaatggggcccatagttaaaagaagtccgaagaccataaggtaaatggcacagaatttagtactagagaactgaagtttaagccctagcttaatttttactggctaagtgatatttaactacatatttatctgtaaaatagagctaatgatccttatttcacagagcaactataaggattatgagataacataagcaaagggatagctattattatttctgttattatttagatttcaacaagcagtcaacagaagtgatagctattattaagagtgatattatggaccttggagcaggaaagcaactggtaacttgacagctgttacctgccctagctgacacctg

SEQ ID NO: 192742 - DNA, 472 bp, Homo sapiens
taaacatttagtgacagagtggaatgagaaggtactgaagcaagggctgatgccttctgggtagatgggtagagatctcctgcagcctggatatcttcaaaataagtaggttataggtcaagttagagaaaaaataatactctttctttgaacaccacgaagagaaaagcgctggatctagatgtgtctgtgaagccaggcttgtcctgggaaagtgagaagagctgagcaggagccctggcaatggagggtgggtgagatgtggtccccacggagagaccgctagggtcagggcttggtacagtgaggctggcagggcccttcggaaggcaagggaagatggccaaggacacaaggctgaagcaacccatctgagccaaagatctgtttaggtccttctgaatctcagcagccttgccaaggaaggcatgattacccatgggtatcagagacactggaggctggcagctgg

SEQ ID NO: 192743 - DNA, 660 bp, Homo sapiens
tctaaggaaacataccacagagtcgaacagttgaaacagctatttcttgactttcctatcatactttccaatttttcctactctgtcactgactgcacctttttagtcttttttacttttttttccacttgaccttatcagttcccatagttttaagaagcatctaaattttgatgttccaaaacttgtagttttgatcacttttctgagctgcaaactgatttctctgactttctgtttgatatcatcatttagatattttattagaaagtcatattcagtattttcaaaacagaactctaagtttttcctcattttataaaacttcattctttactcagacttcctcatttcagtaaatgtacataatgcctatatacttgcttttgtcaaatatctgaaagccttctttgattcctgattccaaagacttctttgagcccccctctctgatacctttcctttctcaacccttactttgtgagggtgtttagtacttcagttggatttccttatacaatatatcccaaagatatatatctttctcttctacttctcccaccctgtccaaggcactgtcattttgactctggtcctttttagaagcttccttgtgtagttttcccattttcagttttaattttcttcagacattctcca

SEQ ID NO: 192744 - DNA, 591 bp, Homo sapiens
ctggtcctgcagtatccgcagtgccactgcagagcaggacctctataccttcagcagaagtcctggttctagaagggagcaatgtgcaagacccttagacaaggaggaataaaaaaagatggggtcaggagatggcagttcaaagaaatagtgaaagtaccttgtgaaaaagaactagaaattttgaaacataaatagactaaaacaagaacacatagttgtgaaaaaaactgattggaaatctagcaaataaagtatagtcattaggaaataatgaatagatgtgataaattctaaattggacacaggattactaaattagaagagaagtctgaggaatgtactcagatttctaaaaggtatgtcagacactgctgtaagttttatacacacccacacaatctcaatcaataaatctctctctctctctctctcatttactcctaaggcaaggcagtcctactcatttaataaatatatattgtgcctactatatactagtgactctgttatttatctattgctatatatcaattgcttcaaaattagtggcttaaaacaacctacatgtattatctcacacgttttctg

SEQ ID NO: 192745 - DNA, 490 bp, Homo sapiens
tggggccaggcatcaggctcttggcagaggagagggtccactcacacaaacagagggcagtggggcgagaggaagcagactgagtctagatgctttggaagatcagagaaatccccctaaaatccttctcaggagaaaacaggagactcagaattactgcaggaggcctcagacaagcaaagtaccttgaaatgttttgtttttatagccttcaaatgttaacacacaaacactgtttcaaaagtatctagaaatggtgatgagattggtggccaaagcgcagggatacagtaagatctcgtttcaaaaaaaggactaatctgtcaccctgggtgaagtcactgcatgtgcaaaaccttggtcatggggtgggcgcatggtggcaaggtccgggaggaagctgacaagaaagaatagaaaatgggccgggcgcggtggctcacgcctgtaatcccagcactttcggaggccgaggcgggtggatcatgag

SEQ ID NO: 192746 - DNA, 231 bp, Homo sapiens
taaaatagatccattaaattagagaaagacttttctccaattattaataaatacaaacttaccaatacagtggtgctgaaaaaagtgcccattatccatgctttccgataaagcaaatgataaccaaatagcatgttgtataagcagccatcatttataataaaacaagagtctgcctcatccatttccaaagagaaaaatttccgactgattgggataaccaaacttaca

SEQ ID NO: 192747 - DNA, 123 bp, Homo sapiens
cacaaacttattggtgatataaaaagagtaaatgaaaaaaatcttccacaattgctattctaactagttccttttcttttttccctgctgggatccaattcatatctatatggatgaacttca

SEQ ID NO: 192748 - DNA, 149 bp, Homo sapiens
catgagaattgaaataacggggatagtgaacacctggggtggaaagaaactggtgccccagtaaggggagtggagggaggagtgcccgttggtgctcttgactgtgaggtgggtctctaggaagttaacagctgagggagaactgtgtg

SEQ ID NO: 192749 - DNA, 620 bp, Homo sapiens
agcctctgccgcccatgccgggagcgctggctccactccaaagccactctgtgcagaaggcgctgcccagtcccgggagccgctaccagagacagggcaggtccaggtggttggcttgaagatgtggggagggaatgtgacaggggaagcaaaggtggtatcatattttcttgttttttcacgtttcctgcatcctgaagttgatatctgtgcatctgatgtgatatttgctgtttctaatttttcaaatttgcttttgtaggggaggacttttcctgaagatgtatttatggtgtcagttaggtggggcactttggctttgattctgggtgcatgcagtagtgtagtttctgtatgactttcagctgtaaatatcatcagtggtatctgtcatttcctcagtgctttaggatgcagttactagtggagatttgctagggaataggatgccatgtgggccaatgttcggacccaagtgttggcagtggtgggctgagtttgcctgtccttgggcccagggtgatgttgctggcaccagtgttagcaagcccaatcaggccagttattgggtctccaggtggctcacttgggtgccaccacacgcggctaattttctgtat

SEQ ID NO: 192750 - DNA, 1979 bp, Homo sapiens
  misc_feature (790)..(790): n is a, c, g, or t
  misc_feature (1110)..(1111): n is a, c, g, or t
  misc_feature (1609)..(1609): n is a, c, g, or t
gaggacaccggtcatgagagtggcctgattatggccaatcttacataatgtgtgagatcttgatattaccccatccttgagagtcctctataaagctacagggacttgggagcacctttaattacagacaacccatgttcctgtggattatgatttattagattgcacatgcctaaataaagacatcctctgcagtcttttgacaattctataagcatcttctgactccgcaattagacagctaagagatctgtgttacttccctcacatatataaataattttaaataaaaatcatggcgtgaataatttctttcctctaccgatttgaagctatccatttggaagaccactctgaagagatgaaataagtcttctgccaaagattacttattaatttacaaggaaaaggggaagttttgttcctctccgtgaatttgattgaaaatcgagggctttctcgaatagttttggcatccagggtcatttttcattaaaaagagaaaagtcatgtcaaatatgaatttccgcagattattcagcactagaccctgggagattctgtaaagaggggttttgttatactcaacttttccgggtaaaacaaacacaaatactcctcctccaaggggcgggggcggtgcctaggtgatgcaccaatcacagcgcgccctaccctatataagccccgaggccgcccgggtgtttcatgcttttcgctggttattacatcttgcgtttctctgttgttatgtctgaaaccgtgcctgcagcttctgccagtgctggtntagccgctatggagaaacttccaaccaagaagcgagggaggaagccggctggcttgataagtgcaagtcgcaaagtgccgaacctctctgtgtccaagttgatcaccgaggccctttcagtgtcacaggaacgagtaggtatgtctttggttgcgctcaagaaggcattggccgctgctggctacgacgtagagaagaataacagccgcatcaaactgtccctcaagagcttagtgaacaagggaatcctggtgcaaaccaggggtactggtgcttccggttcctttaagcttagtaagaaggtgattcctaaatctacnngaagcaaggctaaaaagtcagtttctgccaagaccaagaagctggttttatccagggactccaagtcaccaaagactgctaaaaccaataagagagccaagaagccgagagcgacaactcctaaaactgttaggagcgggagaaaggctaaaggagccaagggtaagcaacagcagaagagcccagtgaaggcaagggcttcgaagtcaaaattgacccaacatcatgaagttaatgttagaaaggccacatctaagaagtaaagagctttccgggaggccaatttggaaagaacccaaaggctcttttaagagccacccacattattttaagatggcgtaacactggaaacaagtttctgtgacagttatctataggtttaagttgtgatgcagctgagttgaaaaggcttgagattggagaattaattcaggccaggcttcaagaccatcctgggcaacatagccagactaccatctataccaggggtcctcattnccccggccaccgaccggtaaccggtccctgtccatggcacgttatgaattgagccgcacagctgaggggtgagcgaacattaaccaactgagctccaccgcctgtcaggttagctgcagcattagatagattctcataagctcaaactgtattgtgaatggcacatgcaagggatctaggtttcaggctccttgtgacaatctaatgcctgatgatctgaggttggagcagttttagtccggaaatcattgctcccagcccctgcaccccctggtccgtggtataattgtcttacacaaacggtctcttgtgtcaaaaaggttggagactactggttttacaaaaaagtaaattagtcaagcatggttgg

SEQ ID NO: 192751 - DNA, 554 bp, Homo sapiens
gaggacaccggtcatgagagtggcctgattatggccaatcttacataatgtgtgagatcttgatattaccccatccttgagagtcctctataaagctacagggacttgggagcacctttaattacagacaacccatgttcctgtggattatgatttattagattgcacatgcctaaataaagacatcctctgcagtcttttgacaattctataagcatcttctgactccgcaattagacagctaagagatctgtgttacttccctcacatatataaataattttaaataaaaagaaaacctagtaaatacttttcttgacatgggttttggcaaataatttatggccaagttcctaatagcaattgcaaaaaaaaaaaaaaaaaaattggacaattgagacctatttaaggtaaggggcttcggtgcaataaaataatttcccattagattcaacaaacagtaccagacggggagaaatttttggcaaactatacttccaacaagggcctattatccagaacctacaaaaaatttacccaatcaccatagggga

SEQ ID NO: 192752 - DNA, 576 bp, Homo sapiens
tctaacctgccactgctaggaatttaagcaaaaagcccatagagatagactgaactagtgtgtaaggacctatggtagcagatgtcaaaaaaaaaaaaaaaagaagaagaaaataaaaaccacctgcagtcatttgcaacagccagtgtgaaatttgctacatagttgtatctgtgtatctatctttctaccctacaggttgccaaacattttctgtaaaggactgggtagtaaatattttaggccttgcaggccatacatggtctctgtctcctcctcctcttgtttccgctgctgcttcaagattcttttaactatagaaaaattatttctcgctagtaagctgtataaatatcagttttcccacctggttctagcctcaaaagtggagcaattctgtacatactttgaaagcaatgtttaaaaatttatttaatttaattaattaaaaaattaattggttactttttagagacagggtcactctctgttgctcaggctggagcacagtggcatgagctgagattgtatcactgcactccagcctgggtgacaaagtgaaattccgtctcaaaa

SEQ ID NO: 192753 - DNA, 659 bp, Homo sapiens
ttggcttaatgagttttcagtatttcaggtacacaggaaacatgaccatgtaaacctctaggcagattaagaaacattgccaccatcttagtgtctttcataattaatatcggaagtgataaacggtcacttctgccctcttctgtaggtaacacagaccaaccgtggtacaatataggaaggcagtgcataaggatgtgaatgccaggagtgaatgccatcttggaggctggctaccgcagtcatgcattgatcgttttcaaatactactggttcacttatgcagcctgcacaaatattgatgtatttaagcaaacaatgtaaataaaagtcacaactgataatcacttatatcagaaaattctggagatactgggaagctgccaagatcattatggtgaataccatttttccaaaatcatattttttttttgcctaaaatcttgaattttatcattggcaacaaactcaatttttttttctttcctccctccctccctatttctcttttttcctttcctttccccttcccctttccctttccttgtttttcttgaagttacagattccctttgttcattttcaagaaaggtttgtcaaatacccaagtccgaataaccggtttgtcactcatcttagtaaaatttgtgttccaggaa

SEQ ID NO: 192754 - DNA, 1510 bp, Homo sapiens
aaatttattattatctaaatattcattttaaatgttaattttagtgtacttctttgattattttctttagagaaatttctgatttcagaaccaagtttattagcattcactgtatacattagcaccattaaaactagctagacccaagaagcagtattgaatgggtaccccttctttactttcctctgattcactctactctggtgctcacagctaagtaagtatgtacagcaatggcctgtcatttggtcgattatcttttgtgctctgaaatgtctttgttttttcatctgctctcaatacctctatgctctgatcctttgtatataagggtaaccatatttgttctttcctgtgaaataataattcttttccttccattcagagtagctgcctgactcatacaatgaataaagtcacatagactcaaagagtggagatggaggtcggatgtggtggctcgtgcctgtaatcccaacactttgggaggctgaggtgggaggatcgcttgagcttgagcacaggagtttgagatcagtctgggcaacgtagtgagatctcatctctgccaaaaaataaaaattagctgggtgtggtggtgcatggctgtagtctcatgtagtcccagctacttgggaggctgaggtggggggtcacacatactttttgttgttactgcttcatcattggttctgatcactcagtgttctttcccttacaccagatcataatacagtattctgactaggcaacttagctcagtttattatgaatagccttaattaatttggtaaattactatgaatgaacatttcattcattctgctaggtctaggttttgccagctgttccattcaagggacactatggcacgggttggcaaactttttctgtaaagggctaggtagtctctctattcaactctgctgttgtagcatgaaaacatccatagacaatatggatacaaatgagcatgattatgttctgataaaacctgatttacaaaaacaggtagtaggttggatttggcccaggggccatagcatgctgacccctgctctacagtatacatacacaaagactttcaaacaaagatgtatacaataaaacaaccattcagagttatttgattcacagtgtgtataatataataaaaataatacagctgtatttgagtcagcactgaaaagtctcttgtgatctgtgtcttacgtgcatgaattgcagaatattcatacgaataccatgaatatatttatatttcccaatgagctaaatgcagtgctgacagttataatattgatgggcgagatgggaagaatttagtactccctaaaagcaaagcactgtagaagtctgtttcacaagctattcgttaactgggtggactaattggagaaggtatttaaatactaataactcctcagatgtgaagccagaaaatttgaattactctaaatgctagcctaagtccaagtataataggatcagtaaatgtcgctaacgacta

SEQ ID NO: 192755 - DNA, 253 bp, Homo sapiens
gaattcccgagagctgcctcctgctttctgcctgcccctctcattggtgagggatgcactgtttataaggcagctgtttctcagctgaaggcttctcccttggcctcccctgaaatctcattctcattgatttctgtttatttgtcctatcttacccagccctcctcaatcttggctgcagttagaatcacccagagattttttttttttttttggagaatgtgcaggccactccctcagaagccgggacttt

SEQ ID NO: 192756 - DNA, 278 bp, Homo sapiens
gaggtccccctactaacaagacactgacactcttagaaagccctatttgtattcatccaaatctgtttctctggaatcccacaatcaccggttagagttccttcctctgcaaccacacgaagtcctaattctccagcctaatgacagcccttcacatagacaaggcagcatcatgtggctcctaagttacttttttttgttgttccttggaataaatgtccacagttcctttaactgttttccatataacatggtttctaaacctgtcatcattccta

SEQ ID NO: 192757 - DNA, 491 bp, Homo sapiens
atcacaggtgcacaccactgtgcttggctaatttttgtatttttagtagaggtgggaggagaggaattcctctcctcccatctcagcccccaaaagtcctgggattatagacataagccaccacacctggccggtgtcatttttatttcagtggacattaagttgattggaaagggaataggactgagcaatagtcatttaattttcagtgactaattttctggctcctctaatttcagtattgtttggacatcatttgtgttaggtattggtagcttctacatcagtagtgcttactttcttatttatttgtttgtttgattgtttttttgagacagagtctccctctcttgcccagggtggagtgcagtggtgcgatctctgctcactgtagcctccacctcccaggttcaagcaattctcctgcctcagcctcccaagtagctgcaactacaggtgcccaccatcacgcctggctaatttttgtgttt

SEQ ID NO: 192758 - DNA, 527 bp, Homo sapiens
tgtggacaacgtatactaacagaaccagtgtcatttttatttttattttatagagatgaggtcttgccatgttgcccaggctagtttggaactcctgaggtcaggtgatcctcccatctcagcccccaaaagtcctgggattatagacataagccaccacacctggccggtgtcatttttatttcagtggacattaagttgattggaaagggaataggactgagcaatagtcatttaattttcagtgactaattttctggctcctctaatttcagtattgtttggacatcatttgtgttaggtattggtagcttctacatcagtagtgcttactttcttatttatttgtttgtttgattgtttttttgagacagagtctccctctcttgcccagggtggagtgcagtggtgcgatctctgctcactgtagcctccacctcccaggttcaagcaattctcctgcctcagcctcccaagtagctgcaactacaggtgcccaccatcacgcctggctaatttttgtgttt

SEQ ID NO: 192759 - DNA, 413 bp, Homo sapiens
aagcctggcattccatggagcagtttgaaaactactagcatagctggagagaaaaacaagtgcattttaaaactgatcaaataacaccaattcctcacttatatctctgaattttgcttgaataataatttaaaaatactctcaaggcttttacagccttgagaaatagtacactaaccagtaatgccaaagcacaacaaaaatgaatgttcatagggtttattgttgttcttggtatctaagatgggcacaactactaaaggtcttttctgtcagaactgttaaaggtcttttacgttaggcctctggcagaatgaaaagaaaagatgaaaaaatcctgtcacataaccaaacaaatggagccaaaattctggagcttttgtaaggtcattataattttcagcagaaacttc

SEQ ID NO: 192760 - DNA, 263 bp, Homo sapiens
tctgggcacagcatgaaagcatcaagcttgagagactgcaggccttaacaaactagaagtgctagaacgatggttctaaaccaggtcttttctcacacagcaagcacagcaatagagatttattttatcttattttttagacagagtctcgctctgttgctcaggctcgagtgcaacggcacgatctcggcttactgcaacctccgccttccgggttcaagggattctcctgcctcagcctcccaagtagctgggattacagg

SEQ ID NO: 192761 - DNA, 570 bp, Homo sapiens
ctcctgcaagactcaagccaaacacacatttctctggcttgaagttaaatcattatatgaaataactaaaaaagataaaatcttaccaaaacattgcctttgctttaagtgatgcttttaacaaacaaaagaaaaagctcatgataaagggatcaactcagaacatagataatacaagatttagtggtcttctgcgcagaataagagaaatactgtgttagttctcaataatcaacaagcaattaaaacaattctgaaaatacttgaaatctggacagatacagatgtattttttattgaaattttaccctaaggcacaacattacattttcctgccctgcaactctagtggtttagatgctagatatcaatactggcacatgaagcttgatagctggacatgttagcagaggaaaaggaaaatgtgacaaaaagatcctacttgaagacgcataaaatctgttgttcacctagacaagtatgttaacaccaacaagtctcaactatgatttacactgtaatctctgctcaattaccatagaaaatcttaaattagctaagctctagccc

SEQ ID NO: 192762 - DNA, 285 bp, Homo sapiens
agttgccattcactgagaaggtagagattgtgtcaaacaaaattaggatgggaaatagatcaggaattcagtttggggaatgttatgttagagatgataagtgaggagttggatatttgagtctggggttcagaggagaagtctggtctagagatattaattggagttattggcatatgagatatacaaaccatgaaatcaccaatggtgtaagagtagttagaaaagaggagaaccccaaggattgagttttggagtattccactgtttggtagtgagagagag

SEQ ID NO: 192763 - DNA, 491 bp, Homo sapiens
ttagttaaaaaaagcccaggaaaatttcaccagaaagtccttctctaccaccacaatgctcctgctcattcctctcatggaacagggcaattttacaagagtttcaatgggaaatcattagcatccaccttacagtcctgatttagctccttttgacttttttgtttcctgatcttaaaaaaatctttaaagggcacccatttttctttaatgatataaaaaagactgcattgacatggttaaattcccagagccctcagagttctttagggatggattaaatggctggtatcgttgtttacaaaagtatcttgaatttgatagagcttatgttgagaaataatttttaatcttttaattccatttttccatgaactttttgaagtccccgtatacatactttttcatggtgagaacacttataatctactgtcagcaattttcaaatataaaatatattattaactgtagtcaccatgatatacagtaga

SEQ ID NO: 192764 - DNA, 202 bp, Homo sapiens
atgttggcctggctggtctcatacttctgacttcaggtgatccacccatctcagccacccaaagtgctgggattacaggcgtcagccactgcacctgacccatatctaagagtttttaagtgtgaaaaggaacaggtgagcttaatttgattgttacagaaagtattttgccagattgttaatcttcagtatacttagtagc

SEQ ID NO: 192765 - DNA, 403 bp, Homo sapiens
gccagcagtggaaagctcaaatatttttcttttagctgtttaatccagtgcttcctagtgtgtgtgtgtgtgcacgcgcacaagtggcatttaatccagtgcttcctagtgtgtgtgtgtgcacaagtggcatttaatccagtgcttcctagtgtgtgtgtgtgtgcgcgcgcacaagtggcatttaatccagtgcttcctagtgtgtgtgtgtgcacaagtggcatttaatccagtgcttcctagtgtgtgtgtgtgtgcacaagtggcatttaatccagtgcttcctagtgtgtgtgtgtgtgtgtgcacaagtggcatttaatccagtgcttcctagtgtgtgtgtgtgtgtgtgtgcacaagtggcatttaatccagtgcttcctagtgtgtgtgtgtg

SEQ ID NO: 192766 - DNA, 446 bp, Homo sapiens
agctttgtaataagaacctgttaaaagcggcgcgaggatctgcacaccatcagacctggtgcatcgacgccggtgctgggctggtgggggccagttgctcatgtactgaggcccccctccctcagttctgcatcggggtcgagatgtgtacagcagcccctgccgtggccaggaagcagctgtgtcggggcagaatgtggtgggctcaggcccagggcacaggggcggcctcccagccttccctgcacttgccctgcagttccagggcacctggtacatggtcggggtggtgtcagatgaccaggacttcctggactccaaggacaccatgaagatggctgtggtcttagtgacccccttggggaatggtgacctggccctcaagtttggataccccacgtaagtgaccacacgagcccatcagactcagcctcagaggatggcca

SEQ ID NO: 192767 - DNA, 167 bp, Homo sapiens
agaacacatttttttaacataggtcatggtatcagaataagaatgctttttgaatgtttgcagtctgtaattttgatgattgaggaaactggattttgaaatgctttattcagtctgtaaacttaatttttttttaagaataaaatgaaatgtcttttaatttgtta

SEQ ID NO: 192768 - DNA, 250 bp, Homo sapiens
tgacatttgagctgttttcagtttgtaccattatgaacaaagctgctgtgaacatttccttagcctttttttctgttcccatggaaccgattggcagtattttgatgattatgtgtaaaaggaaattagttaagacttcaggcctctgtacctcagccattagtgtctagtcccacatttgggtatctttgtagaatccaaaataagcctttaatgaatggcatgatgttttggctttgatagtttgtgc

SEQ ID NO: 192769 - DNA, 191 bp, Homo sapiens
tcctttattcttcaataaatcccctctacaagaaaaagtgcttgtatttcagtgattctgtaaggcacaacaacatggctagaaagcttacagcacagttatttgaatatggcatgcttctaggagagaaatgctacgatataaaacagagaattaggtctctgagtctttttttttttttttttgagatg

SEQ ID NO: 192770 - DNA, 622 bp, Homo sapiens
atggagtttcgctcttgtcacccaggctggagtgcaatggtgcaatctcggctcactgcaacctccgcctcctgggttcaagcgattctcctgcctcagcctcctgagtagctgaaactacaggatgctttcattggatttggaggaaatgtgatcaggcaacaagtcaaggataacgccaaatggtatatcactgattttgtagagctgctgggagaaccggaagaataacatccattgtcatacagctccaaacaacttcagatgaatttttacaagttacacagattgatactgtttgcttacaattgcctattacaacttgctatagaaagttggtacagatgatctgcactgtcaagtaaactacagttaggaatcctcaaagattggtttgtttgtttttaactgtagttccagtattatatgatcactatcgatttcctggagagttttgtaatctgaattctttatgtatattcctagctatatttcatacaaagtgttttaagagtggagagtcaattaaacacctttactcttaggaatatagattcggcagccttcagtgaatattggtttttttccctttggtatgtcaataaaagtttatccatgtgtc

SEQ ID NO: 192771 - DNA, 517 bp, Homo sapiens
ctcaaaaaactaaaggctaggtataagtaactgattcatcacagagatgactaattcatcagaacagctgtctgttctaaaatatgtcacatcaaatattcattgaataaaatattgaagtctcaactgctaacctagagagagccaagcagcttttaaaaaatcaggatagaagtgtacttttcatttccacattggacctgtgattctctgagtacctgtgtgggtctctggtaaataccagaattcacttaattttccatattgttaggaggctcaaagccaaaggcgtagagacattaggcataagcatatgtatcttattaagcatctgtatgttatgttgtggggtttggcaaccaagaagatgacagttacttacaactgttctagaaaaggcaaccactgaaacattcattgaaatcacaaaggacacttgcttgagattcattgtgttcttcacatttgctatttttaactccatgattcactgttcttttgagcagggaggggaaca

SEQ ID NO: 192772 - DNA, 314 bp, Homo sapiens
aagagatgaagagactgaggttcccagtgtctgaggagctcagagaaggcctgggcagataccttcctcatctcacagcttgctcttcctagatgctcaaaacaggttctgggtgagctaccttagtaagaccatgaatgggaccgcaagggaccctcaggtgctcccagggtcttgtaaggaaggtgacagggaagcacccactccccaccatcaccaggccacagaacaccagccattctgcagctgctgagccacagggcaggcctgcaccgcatgctcccagggcaaaggccaaggtccacagggagctg

SEQ ID NO: 192773 - DNA, 153 bp, Homo sapiens
aatagcatttgaggccttcatcagatttttagagtattttaaatgtatagtttattaagtacaacccaggtagtttatttttaaaaaattaaatgtggccaggcgcaatgacttatgcgggtaatctcagcactccaagaggccaaggtgggt

SEQ ID NO: 192774 - DNA, 414 bp, Homo sapiens
tattttgattagagtgggctttacacacccccacaaagtgaaaattacgagtcaatctattctgcccaatctgaacccaagcatgggtggcacacgacacaaatcggagaggaattcagaactgcctcttggattgaaagacctccttgacctggccctgacactaaagaaaaccccacatgtacccaaccatgagcctggctttcatctcaacaaaatgtcttagttccaacctgtttatcaaatcatctctccagttacctgcaaacatgtgggaaaaaagaaccaacaattttgaatggaaaggacttggaaatgatatagattagtgggtgttccaaggaggtctgtactagccaagtgggcagaattccatcagagatgtgaggaaggggactataggaaagtgtccag

SEQ ID NO: 192775 - DNA, 136 bp, Homo sapiens
cggaaaaggagggggagcggctggtcagctgcgccctgcgggtcgagaatgtcatcagcagggatggcggcgctttgagtgctgagcgcggccccgaccgggaccccctacccttgacccaccctcgcaggccgag

SEQ ID NO: 192776 - DNA, 302 bp, Homo sapiens
caaaataagagttgcccgcccaagtttggaaactatttcctgcttttttaaagcaggaaacaggagtccttcacctcacccccttcttctcctaaataaaacaggtacgtgttctccattttaacgtccattatcgtggtgactaaatgacctgcctgcatctgcttgggtggtatttgattgtttgcttgtatcatgagacggagttttgctcttgttgcccaggctggagtgcaatggtgcgagctcagctcactgcaacctctgcctccgggttcaagagattctccagcctcagcctc

SEQ ID NO: 192777 - DNA, 162 bp, Homo sapiens
gtttccatggatttattcattctttctaggttttcaggtttgtgagtgtctagttgtttataatcgtttctagtgatcttctgtattactgttgtatccattgtaatgtctgttcttttatatctgatttgtttatttagatttctattctatttgtggtta

SEQ ID NO: 192778 - DNA, 361 bp, Homo sapiens
gaatggagggaggaagaaggaaggaagaaaggaatgaaggaaggaaggaaggaaaagaaagagaaagaaagaaagaaaagaaagaaagagaaagaaaaaagaaaaggctcaacatcactaatcatcaaagaaatgcaaatcaaaaccacaatgatatctcaccccaatcagaattacttttatcaaaaagacagggaatagcagggtgctggcaaggatatggaggacggggtaccctcatacattgttggtggcaatgtaaattagtacagtcactacagagaactgtatggaagttcctcaaaaaactaagaacagaactaccatatgagccagcaattcgactactgggtatatatcc

SEQ ID NO: 192779 - DNA, 155 bp, Homo sapiens
atcattgagccggtcctatcatattctaactgtattagaaatagtggctcattccttcacgcaacagaaattttggatctagcctaatctaggttgtgtattcctttaaatgctgagtttacagaggcgaaagaagaaatgggtggtaagacaag

SEQ ID NO: 192780 - DNA, 225 bp, Homo sapiens
aagacgagaatttggtgccacaggcctcccggtaggagacagaataacatcgtgtgtgtcatgttttagccaccaaaatctatcaagggcaaggacatgatggcttttattcttcctgctgcttctttctgctcaaccacagtttcaatcagaaccaattcaagtgaacactgcaactgctgactatcccccaacattctttttgatttagtgtcttcggatcca

SEQ ID NO: 192781 - DNA, 415 bp, Homo sapiens
gggtaggaactgggctctgggactcaagacaaaatccaaggctccactggacacttggagatacagaatctgttcaaacaccctgtcctcacctccttccctctttccccttttagcttccagtcttccagtctccttctctcaagcatgcacttgcttcctccacatcctccacctgccacgtgcttcctgccacgtgcctgtgcgccggctgtccctccagcaacacgctctcttggacttgctgcctgtacatctgcatgcaagacatccaaagatgcagccacagatgcagtgaagaattggcgcactggctctaattcttcactggcttctcacaccttcctccctggcttggcctctttcctaacagtgttctctgctcctacctctgggcctttgtctctgctcagtc

SEQ ID NO: 192782 - DNA, 232 bp, Homo sapiens
ctgctccccggttgtgggagacagaggaaaatgaacagatgagcaagataatgttagcctgggctgagagctgtgaaagaaataaacaggacgagggagagatggcctggagaagacacattaggttaggcttttctgaagagataacatacgagctgagaccaggaggagaagcagccagcatgggttgaatgggggaccgtgtggaacaggcaaggggaggaacgcaagt

SEQ ID NO: 192783 - DNA, 488 bp, Homo sapiens
agccttaaggtcggaaggagtttgtgtgtgtgctgagagcatagagcagggtggctgcagggtggcgattgaggcggttaacagaaatttggagagggagggaggaccagatcatgtggcgccctgtaagccacagtaaggagttggaacattcaaagacactgggccacaagtggtggctcatgcctgtaatcccaccactttgggaggccgaggtgggaggaccacttgagcccaggagtttgagaacagcctggccaacatggcgaaaccccatctctacaaagaaaatacaaaagttagccgggttgtggtggcatgcacctgtagtcccatctacttgggaggctgaggtgggaggactgcttgagcccgggaggcagaggttgcaatgagccaggatcacatcactgcactccagcctgggtgatcgagtgagaccttgtctcaaaaagaacaaaaatgccttggccgaacccgggtaccga

SEQ ID NO: 192784 - DNA, 960 bp, Homo sapiens
catgcccacacacccctctccccctttttaaaatatggaatgaataacagctgtttgtatgctgatggaatgctctggtagagggaaagctgatgatgcagaagataggaggggaactgctgggtgatgttctttggctagggagcaggaagatgttatctcatgcacaaacggaagccgtgggcttaggagctcaatctttagccatagtattggtgaaaggcaggatgtgtggcacaaaggtggaggcagacagatgtgggtgggaaaaattgcagaagttttcttttgattttgtccagtttagtgcagtaggaagcaaaagcattggctgaaagtgaaggtggagtaagcagtgttggaggcttgagcagaggagaaagggtgcagttgtctttcagaacgggagagtgaatggagtaggaagcatcaggacctgcttgaggtttgtgggtaggtgtataatgtgagactgggtagcatgattctctgtttttctccacccatattcacattaaggtaataacttcgattatgtgaagagttgaatttaacaggggttaggattttgttgtgaaattagaagagaaactagagagttaaaggtctatgcaaagggtggaattacagggaaaaagaccttagaatctaagctgcgtagagagaaaggagggtgtggggagagtggaaagctgatggaagcactggattatgggtcctccggatggaaaaggtaagatggccgaggacagaattctagattttgtcaatatttaatggtaaaagaattagcaaaggagatggataaagagaagtcttagcgttgagcaaaaaagcttaggaaaaagggaaagataggtcacaatatgcagaatcctgtggataagtattctaccacgactctttttttttgcttcttggagcgattcttcacgcttacatccacctttgggtaggggc

SEQ ID NO: 192785 - DNA, 847 bp, Homo sapiens
catgcccacacacccctctccccctttttaaaatatggaatgaataacagctgtttgtatgctgatggaatgctctggtagagggaaagctgatgatgcagaagataggaggggaactgctgggtgatgttctttggctagggagcaggaagatgttatctcatgcacaaacggaagccgtgggcttaggagctcaatctttagccatagtattggtgaaaggcaggatgtgtggcacaaaggtggaggcagacagatgtgggtgggaaaaattgcagaagttttcttttgattttgtccagtttagtgcagtaggaagcaaaagcattggctgaaagtgaaggtggagtaagcagtgttggaggcttgagcagaggagaaagggtgcagttgtctttcagaacgggagagtgaatggagtaggaagcatcaggacctgcttgaggtttgtgggtaggtgtataatgtgagactgggtagcatgattctctgtttttctccacccatattcacattaaggtaataacttcgattatgtgaagagttgaatttaacaggggttaggattttgttgtgaaattagaagagaaactagagagttaaaggtctatgcaaagggtggaattacagggaaaaagaccttagaatctaagctgcgtagagagaaaggagggtgtggggagagtggaaagctgatggaagcactggattatgggtcctccggatggaaaaggtaagatggccgaggacagaattctagattttgtcaatatttaatggtaaaagaattagcaaaggagatggataaagagaatctgagtgtagaaaatgaccgggatcctctagg

SEQ ID NO: 192786 - DNA, 464 bp, Homo sapiens
tcacttgagcctatggggttgaggccacagtgagctgcgattgtgccactacactccggcctgggtgacagagcgagaccccttctcaaaacaaaacaaaaccaaaaaaagtaggtggattcaagttatattttggtgatagagttgataagactttctgatatatgaaatatggggtgtgaaggggaaagagaaataaaaaataggactcagtttctgactagaaaacgggcagttagtgataccccttatggagatgagaaatggggtatggtgaaattgaattaagtgttaaggtatatataccttaaggtgaaatatacaaatggaatgtcaagtaggtagttgaatagtctggactagtctggcaggagatagaagtttgggtattatcagtataaatatccatggaaacatgtgccacctagtggaaaaagagacagttaagaaggctcaggaatccc

SEQ ID NO: 192787 - DNA, 313 bp, Homo sapiens
acacactcttatacttgacacttagtgctaacagacggtgtgacttccccatgtgagatcccttaagagctaggcagtgtcagattttcctgatgggcgcaagatgcagtcttgctctctctcaggctaaatagcttggggtattcccacaaaagaccatgcatacccattctgacacttttgttttctattcctgctatcttggaagcccatctctgctcatctacgttatttgaactctttagagcccagctcaaatgccctctcctgtatgactctcctctcccaaggcaggcattattaatctgatggg

SEQ ID NO: 192788 - DNA, 170 bp, Homo sapiens
agtccccgtaccgccgggaacctcgctcgccttcccctcgagccccccgctgggtcgcgcggcgccagccgctcaacggtgcttcagagcagcctcctccacaacattcccctcggcccggccgttcgggcctactggagaccgcggcttgggcctagtctggcggccgc

SEQ ID NO: 192789 - DNA, 331 bp, Homo sapiens
aagcaatggggagcagccagaaatacagacgaagcttcaattgttacccaccattcacctcctgctctgtggcccagttcctaacaggccacagaccagtacatgtccatggcccaggggtcagggacccctgctgtggcacattgctaatagaggactgtagcagccatgtgccctgacctttccttttttttttttttttttgagatgccagaaacccagaatttttttttttttttttaaaaaaaggttttgtttttttcccccagttgggggtggggaggggaattttggtttaacaaataaggggccccgggcccaaaatccgaaa

SEQ ID NO: 192790 - DNA, 565 bp, Homo sapiens
gtccaaatacagaacaaaggaaataatatgtccaagaaacatttttctttgcttaatactaaaagcctcttgatctgtttcctatatcctagtcacaactgaattttaagaaagtcgaggtcatgttggtaactccatgtcaatactgctttgtgtactaactgcaagatcaggaatcgtccctcattacttccatcttggctttcaaaagagcctactgtaattttttcttctgaaatagtatgaaataacttttttcctgaaagaaaatctcctttctatggttctttcttctgaaacaaggctttccttctctgagcttccagctagaataatttcctctgacatactctgatctaggaggattgtagtgtggtcacaatgcctcagctgatttcagttaattttcttgagctgaatcaaatgaatgtcttaacaagttgtcctttaaaaggatagacgtgcttttatacaaaacttgcatttaaatgaaaccactagacttcttcatacaatgtaatgaagtcttggtattccagcgatttggcacctaaatgcataggca

SEQ ID NO: 192791 - DNA, 335 bp, Homo sapiens
aaagttggcactgctgaaaagaagaatgactattcacattaataactgccttcttaaatttgtaatgaagaatgagaagcgggctaaggtacaagaggtaatgtttatttcactttgaagcttataggtagttacatgggtatcacaaaaagaacagatataatgaatcatcttgccttttacctgactcttaagacacctgcaacatatcccttggatgttccgccttgtcacactcataaccgaggggaaaaagaagacaaaggtgaatgctcatctcaatttccattttttccccaacgtttgtaaatcttctctctaatatagaggtccac

SEQ ID NO: 192792 - DNA, 490 bp, Homo sapiens
atagccactcaaagccttcagcccatataacatgaagtgacaactgagctctgcacataatgctcaagctctataataaccaacactctcagcacaagggtagacaagaaaagaaaaatctcctgctggccaggaagaccacaaggaggctttctgacttggcctgtgcttttgatttttaaaacattttttaaaagaggcctctctgggctgggcgcggtggctcatgcctgtaatcccagcactttgggaggccgaggcaggcggatcacgaggtcagaagatcaagaccatcctggctaacacagtgaaaccccgtctctactaaaaattcaaaaaattagccgggaatggtggtgggcgcctgtagtcccagttactcgggaggctgaggcaggagaatggcgtaaacccgggagacggagcttgcagtgagctgagattgcgccactgcactccagcctgggtgacagagtgagactccgtctca

SEQ ID NO: 192793 - DNA, 360 bp, Homo sapiens
cactgtagtttccttgctgctgctgctgcttagtctccatgggctttcttctctcctttttccttgtggatggtccttggggttctggtggtactgcctctgtctttgtgtgttacacaccgtcactgggacgtctcactctcccacgtctttggttaacagccgtgagaagctcattctcaaacctacgtctagatcccagagactacctgctggttggagtgtttttcttggttgactggtaaaggctcagactcggcctgtctgtattcttcttcaccttcccccactttttccccaaaaatattccccttccttggtgcctgtctgtctcaggcaaaggtaccctcatgccagctc

SEQ ID NO: 192794 - DNA, 805 bp, Homo sapiens
ctgctttgatagctggttgtttaaatgtgtaatgtgctaacgtttcaaaaatgaaattgagaaggaattataaaccttttgtgagaaatactttggcagactggactttttgttttgatttcctcactctataatggagataacaggactacatcacttcaactgaaaactgccatgaaaaacctgattaaggatcctagatccctctaatatcctgcctaatgctttataactgttgattttatgaaggatgcttcgtttcaaaattatttatttaatccctatctttttctgtttttacagtactatacaaatctcagtataaacatttttcttttagttgtgttttacaatgaaattatgagcattattaataataatagaacattgatttgaatgtattgtttattgctgtcattggacatggagagaaggatgactcttcagctgtttgtattagattcatttgagagtggcgtccatgtatggttatagctcttagttatcttttgttaaaccaccagaatatgtgtgcaaaaggataaatattaaatgattatgaagtcctgaaagttataaaattatttattgcaaactacgatttattgttgactatatgcttccactcttctgccattgaccaaaagttattaaaattagcttgttgttatcctctcagcctttctaaccggtataagttgttccatgatatgagcagtgtctcacagtgaatcgttccaggagcttcatggccattcccaaaagatcacatttctcacatctctgaggttggggattctaatta

SEQ ID NO: 192795 - DNA, 575 bp, Homo sapiens
tccaccagccgccttatttaaatctagagatctattgggctttttgatcactttcattattataattttgcatatgagaagttggggtctccaagtgcaaactaggttaagtcacagtggtatctgaagaagtttattaaatccaaacactgtcctagcctgcgtggctaaaatcaagaaggggacaagtcctactttagctgggaaatgcatcggtttctagaatgtgtaaacattcttgctattttattaagcaggtcatcacatcctagaaaacagcattcgctgaccattctcctcctccacccaccaaggacaggagggctaacccaggcagagaacctacgctgagaactcaccaccagaaaaaaatatctgcttttaaaagcacagtgcacaatagtactttttaaaagctaaaagagctaagtttaaagttaaagacacatatgttctttgacacagatctcctaaaagtctgacaaaattaaaagtaccagcacataaaaatagatgcccaagaatgtttattgaaaaaagctgaaaacccatgactatctcaataggacaatgac

SEQ ID NO: 192796 - DNA, 384 bp, Homo sapiens
gatcacgaggtcaggagatcgagaccatcctggctaacacggtgaaaccccgtctctactaaaaatataaaaaattagccgggcatggtggcgggcacctgtaatctcagctactcaggaggctgaggcaggagaatcgcttgaacctgggaggcagaggttgcagtgagccgagatcgtgccactgcactccagtctgggtgacagagcaagactccgtctcacaaaaaagaaaaaaaaaatctccctgccatcttcaactgggaacttctcagtaactaggctcctggcaagtttcccagctccctgtccccttctctgaccaccttccagctcttctcctgttgctcagcctatctccacctgtcccattactcgcctcgc

SEQ ID NO: 192797 - DNA, 651 bp, Homo sapiens
  misc_feature (9)..(9): n is a, c, g, or t
  misc_feature (14)..(14): n is a, c, g, or t
  misc_feature (40)..(40): n is a, c, g, or t
  misc_feature (59)..(59): n is a, c, g, or t
  misc_feature (88)..(88): n is a, c, g, or t
ttaaatttngaggnttgctttcgctggccaaacgtacgtnttagtacgggttaccacanatttattcattcctccaaattaattacancataatagactatatatatcaaatatgaagatacatttatagcaattgtatatcacagagagacagtatgaagagagacatagatatccttcattttagaatgttatcttggtatgtttaaaaggaaaagcttaagatgtgttgcaattgtagtatgagtttcaggtatgtacatgttatgtgtgtgtgacagacacacacaaacacatttcaaacatgttttatgtttaagctcaatattcaaacacagaaatataacatcaattcttaatatgttttatgtaagtactgcagcagcattattaaatattgtatttctatggtgattgaaaattagtaggcagggaatttttgtaatggttcttaataatttttgtaatagtaaataattactttttgtttagtatagttttataatctatatatgaataaagttgatatttttattcatataaaaatgtgatttactctcatgtacttatctacattctaaaaccataagttatcaattttagttcttggccaaggcacttttactgaataaaaataatcagctaatttta

SEQ ID NO: 192798 - DNA, 363 bp, Homo sapiens
cttacttgttacagttattggtgtattctgactttccatttctttatggttcatttttggcagattgtatgcttctaggaatttgtccattttatgtaagttaccctttttttctggtgtgcagatgttcataatattctattacaattatttgtagaattgataggaatgtcgtcacttttatttctgaaattactaatttgagtcttctctctttttcccttagtcagcttaaccaaatatgtgccaattttatcttttcagaagacctactttgggtcacattggctttctctgttattttcctattctgtgttttatttatcttcactttaatctttattctttccttctgtcagcttt

SEQ ID NO: 192799 - DNA, 265 bp, Homo sapiens
cggaggtacacccctctcattttcggcagcagggtgagaggatttttattatcttacttagacacttgaatttatttttttattttgagacggaatttcggtcttgtcacccaggctggagtgcaatggtgtgatcgctggtccctgggttcaagtgattctccaacctcagcctcccaagtagctaggattacaggcgcccatcaccacacctggctaatttttgtatttttagtagagacggggtttcaccatgttggccatg

SEQ ID NO: 192800 - DNA, 458 bp, Homo sapiens
ccagggcctggcagccacgagtctcctttctgtctctgtggatgtgtctgttctggacattgtatatgagtggaatcatgcactctgtggctttcgtgtctggcttccttcactcagcgtgacgttttccaggctcatctgtggggtggcaagcggcagagctgcaattcctttccgtggctgagtgatcctggtcaaatgtggcactgccaaagtcagccactcggatgctggtgttcttcactgacttctcctcacagctcttgtgctcattgtagagggtttcaaactcagaattcacgaacaggatgttctctggtttcaagtctgtatgggtcagctgattctcatgcagaaatctaagggcgtggcagagctggtaggccatgtgccggacatgtggtagggggtaaggctggaagttattctccttcaggaactcaaaggtgttcttgccc

SEQ ID NO: 192801 - DNA, 316 bp, Homo sapiens
tcattcataattttcttacagtgtagcaatttttgaagaaccatatgctgcactatttaataaaaatctgcatttttgacaaacccctcattcccaggtatttaatttgcaaatgctacattgataacactgatatatggaatggattgcttctctaaaatgtctgtggaaagcaacagtgcaaagacattatattttcatttctttttgggggagtgttactgtaatattagacatccgacctgagaagtttggaggtactattgccatgaaccatttcttccgtaattcaaaagtatctttgaagtgactctga

SEQ ID NO: 192802 - DNA, 431 bp, Homo sapiens
  misc_feature (423)..(423): n is a, c, g, or t
cgtaccccaccactcctatagatcagtattaataagtaagtttaacatgtgaaagaagtgttcttgcttacaaaagaaagcagagggctaactggtaaatgcggtgggagtgctagagctggaaatgcatcatttgcaaccaaaacaaagcaggttaaaatggcatcatcaggcagtaagtttgttgttgttgttgttgttgctgttgttgttgttgttgtttttgagacagagtctatctctgtcacccaggctggagtgtagtagcatgagttcggctcactgcaacctctgcctcccgggttcaagcaattctcctgtctcggcatcctgagtagctgggattgcagttgtgagccaccatgtatggcttgcattgttttattttttacatttaaatcactgatctataggagtggtggnggatcctc

SEQ ID NO: 192803 - DNA, 532 bp, Homo sapiens
ccccaggcacctatgggaccagccccgggcattcctccctggggggcgagggtgcccacacctcaggctggtgccttccccccaggcacctatgggaccagccccgggcattcctccctggggggcgagggtgcccacagctcaggctggtgcattcccccaggcacctatgggaccagccccgggccctcttccctgtgggacgaggggcacccacacctcaagctggtgccttcccccaggcacctatgggaccagccccgggcattcctccctggggggcgaggggtgcccacagctcaggccggtgccttccccccaggcgcctgcaggacaagccctgggcactcctccctcgggaccaggctcccaccccaggaaggccacccagccccgagggagcccaacgcccactgcgctgccctagcccaggtcccttcctcaggcccaactttgaccccgtgtccttgaagatgcaggagacctcacaaggcccaagaggtggctcaaaatagattaagtgcttcacatg

SEQ ID NO: 192804 - DNA, 503 bp, Homo sapiens
tagagacaggatctcactctgttggccaggctggagtgcagtggtatgatcatagctcactgcacctctgagctcctggagtcaagcaatcctcctacctcagcctccaaagtagctaggactgcaggtacgtgccaccatgcccagctaatttaaaaaaaaaaaaaaaacttttttttttttaagagatggtgtcctgctgtattgcccaggctggtctcgaactcctggactgaagggatcctcccaccttagcttcctgaagcacttaagattacaggcacgagacaccacatccaaccttactataattttaatgctctaaactcagagtatgtgtataaagacttctcaacagttttcattctagaaattattcaagaaactatgtatttgacctggtttcttggatcaaaaatagccaaaatgagaagaaaagcttcctaatgaaatagtcctgaacataagttaataactaggtttaaagagtctcactagggact

SEQ ID NO: 192805 - DNA, 159 bp, Homo sapiens
tagaatccctcccatgtttctggtttgggtaactgggagaatggctagccattcacctaaaggatatgatgtgtaaggagacgcaaattcttctcagatcttactgagtttaagttgcctgaaggaacaccagttaacaatgtccaggaggctgttgga

SEQ ID NO: 192806 - DNA, 324 bp, Homo sapiens
ccagatggataattgacagtcctgatgagtcatatggaactatcaacaattatttttattaactattttaaaaataaaggtagcatttattgataaagatggtaatctagaacatatatgctatgatataatgtataatatgatgtaatatgatatttttatagttataaaatcttatagacttgatgttatttaactggcctcttcagaagggtgtttatgttttcataactgtcgatagattgtattgggccagctattctctcttacctgtcttaagacttctagtactaagattgttcctcaagactggggaaaccatga

SEQ ID NO: 192807 - DNA, 185 bp, Homo sapiens
tactcgggaggctgaggcaggggaatcacttgaacccgggaggcagaggttgcagtgagctgagaatgtgccactgcactccagcctgggcaaaaagagcaaaactccgtctaaaaacaaaacaaaaaacaaacaaaccaaaaaacccccaactatcatctggaggcaacagctggctgtccaga

SEQ ID NO: 192808 - DNA, 224 bp, Homo sapiens
gctttcagtgacacaaaaccggctctgtgaggaaaaagctaaagagacccagttattatctttaagtatatgaaaggttttagagaaaggaattgagtaaaagaaaacaagtttgaatgacagcaggcgagatttcagccaggcccaggaatttcttgacaatcaggttaatagaatactggaattggtcactcagggagttccaactgccctttcctggaaaa

SEQ ID NO: 192809 - DNA, 315 bp, Homo sapiens
cttaattcccagccctggtttggaacttctgatggtctcaaggggttgtaggaaattctaaaaacaactctccaaaaaatccattgtgatagcaaccttttcctccctctggctggttattggaggggcccatgtctataaattcaaacaatagggcatgccaagtccccaaagtcttcactcctggagctaaaataataatcaagacttgtttttggcaggattttctggataccacttagcttctcttgggcatgaaaggatgggcagtccctgccaaatgtaaccaccataccgaaaagttggccaaggttg

SEQ ID NO: 192810 - DNA, 741 bp, Homo sapiens
caagtgggttgtataccaggcatgtagggatggtttaacatatgcaagtcaataaatgtgaacatcacataaacagaatcaaaaacaaaaatcacatgattatcttaatacatgcagaaaaagcattagacaaaatccaacatctttttatgattaaaactctcagaaaaattggcatacaagggacatacctcaatgtaataaaagccatctctgacaaacccacaattaacataatactgaaagggaaaaagttgaaagcattccctctgagaactggaacaagacaaggatgctcactctcactcctcttcaacatagtactggaagttctagacagagcaattagacaagagaaagaaataaagggcatccaaatgggtaaagaggaaggaggaagtcaaactgttgctgtttgcttatgatatgattgtttacctagaaaactctaaagactcctccagaatgctcctagaactgacaaaagcattcagcaaagtttccagatacaaaattaatgtacagaaatcagtaggtcttctatacaccaacagtaaccaaggtgagaataaaatcaagaactcaaccccttttacaatagctgcaaaaaagtaaaatacttaggaatatacctacccaaggaggtaaaagacttctacaagggaaactacaaaatactgctgaaaaaaatcatagatgacataaacaaatggaaacacatctaatgctcatggatgagta

SEQ ID NO: 192811 - DNA, 369 bp, Homo sapiens
tagaagtgcgtcccaatcatactaccgtcatggatcaattgcctgctgcaggagcgtggcggtgtgctccaggagaaggtgcccgagatcgtgagcgtcctgcgctccaagcttcaggaggcccaggaagagcacgtcctgccgaacgaccagcacagcgtgtacctcctggccacccagcactgcgcagccgtggtgtccagcctcctgggcagccccttgcacttggacaggtacccagctcagactccaggcttaggggtccctctggaatgatgctccccctcctccccagtgccctgggctgatgtttccctttgagtggccactcttcctctgtccatgccaggaaacctctgaccccagaga

SEQ ID NO: 192812 - DNA, 418 bp, Homo sapiens
cctccacagtccactcttgtaatccagctcttgtaatctcacatgccctcttcttccttcatggtccctgagcctttaaggagggtgcttgatactgtatagctttagcagcagtgccttggtcatggaaaacagatcgggcccagtgggattccaaacaagggagattcacaggcttttaaatcgtcttcagtcttcagaatgcagtggctttggttctgtcagaataggcaaaacaatgtgagatatataacatcgatcactcggatagtagaattctgtgcacacagagattacaggcatgtgccaccacgcctggctaatttttttgtacttttagtagagacagggtttcaccatcttgggcagactggtctcaaactcctgccctcaagtgatccacctgcctcagcctccc

SEQ ID NO: 192813 - DNA, 579 bp, Homo sapiens
gtgagacctactttcctgaaattggcaccattctgggatagtgattaaattaccataattattgtaaggtctaacgaccttagaattagtggctgagggtcctgagggtggcatttatatggagaaacactggtagttgtcagcattttgacgagtcccagacccgatcatgcaaactgctggaattacaggtgtgagccatcacgcccacccgacaatattgaattattgaatatctgtttgaaaccattggctttcacattttcccaaggtttgctttaaaaatgaagttaatctttttcaagacagattgcacaagtgatctatctgataatgaagcaaatactgagcttatcttaggaggacattaataacctttgtgtttagcctcatcaaatttaacagtaatgcaagctattatacagctaagtaaaacctacttttctgaaattggcaccattctgggatagtgattaaattaccataattattgtaaggtctaacaaccttagaattagtggctgagggtcctgagggtggcatttatatggagaaacactggtagttgtcgcgcatttt

SEQ ID NO: 192814 - DNA, 557 bp, Homo sapiens
ttctggcttatagtaaccacataaatataatgatggccagacataattttgagaactttgattggttaaaagccattaaaaccagattgctagtatatgctttgagtccaaaccttagcatttccaaacaatcatttttttctaaaataagtaaacctagtctattgatgtatagtgaccatacagaagaatatttaaatacctactcatatttgcaaaagagcagcattcttttttcaactgtttttctttttggctcttggtgtggtaaagttaaattctgggaaatggtttactaaagggaagtttaaccacagatgtttgtaattccaacttaagtttcccatcaaagtcttaatgaaattcagctgccagcagttcggctctgaatctgagtctttttatcatgagaaacttgggggaaacaacattctgaagctgaatggtaatgggaaaatttccatattcagcccaaatcctctccataaagaaaaaaatacataaacaaattctgttaaaagcgggaggagagacgggtgaatataatttgagtaata

SEQ ID NO: 192815 - DNA, 483 bp, Homo sapiens
accaccttatttcttcctctcaataatctttttaggtggtagtccttatctctgtaggagtataatctgagactaaaagtagttaagtaatttgtataaggtcatagcctacttcataagaggaaaaacttggattcagattctagtttctgacttcaaagctttccccttctactacttagtggttcttctctcctgtggcagaaatgtagtgtatctttggatgtagataatggcattaaaaggggtagtaatcatgggaggttgctgttggccattggtatggtatagatttccaaacattgatactagcctttgaatcttggcaaaaatatatacctgcctatgtttatgaattttgaaatgcttgtcaggacaaatttttttttcccccaagatggagtctctgttgcccaggctggagtgcagtggcacaatctcggcttactgcagcctccacctcccgggttcaagtgattctca

SEQ ID NO: 192816 - DNA, 266 bp, Homo sapiens
gaacttgtggagtttctctaatgacatggcaaaaagctaagaaaacagcagaagatcaaattcttgccactttcaaaataaaagagctacctggctctcactggatgagagggactgaagacttgaatttctctcttttcccactaacccctctcctgtgttccttactaacatttccagttgcccagtggcattttctcttgagtgtgccactgctacattaagctcagtatgtcccagtcagaactcatcacctcttccacaca

SEQ ID NO: 192817 - DNA, 132 bp, Homo sapiens
aaatttattaatttttgtttatctgaaaatgtctattttgcatttatttttgaatgatagttttgtggatgtagaattgtgagttgaaaagtttttttgtttcttttagcattttaaagatgccattctgtt

SEQ ID NO: 192818 - DNA, 454 bp, Homo sapiens
cagcctcccgagtagccaggattacaggtgcgtgccaccacacccagctaatttttgtatttttagtagagatgaggtttcaccatattggccaggccggtctcgaactcctgacctcaggtgatccgcctacctcggcctcccaaagtgctgggattacagacatgagccaccgtgcccggccttttctagatttttataaaagtagaattacagaatattactctttgtgtctgtcttattttgctgaacatgtttttgagattcatccatgttgcaagtaattcattccttacattcattactgagtagtattccgtcagttggatatatcacaatttatctactcacctcttgatagatacttgggttgtctgtagatttttggctattacaaagacagaagttgaagttaacattgtttctcagcttggcttgttgaaaataatgtctt

SEQ ID NO: 192819 - DNA, 418 bp, Homo sapiens
gaatactaggagctcactgctgcacttcccaaagctgctggcccctggaagcccttgagctcgcaaactccctactccccttgtgctttcctcctgtgttggctagtggccatgatgtgaagtgctctttcgtgactgtcactaactcctgtggttggcaggcaggtgtctttcggcaccagggtgtgtaccatacccactgggctcccttctcaggctcagccttggccctgcccctgctgtccacgctggactcatccttcctgggaccatccccacatgcatggctgcagcccccatcgatgactcccacatccacatctcctggcccagtctctctcccgagctccagatctgtctctccaaatgcctcatagacagaaccacctggagtctcagaggcacctgaaattcagaa

SEQ ID NO: 192820 - DNA, 691 bp, Homo sapiens
gttaacttacaccagagtaaacatatttgaataaatttaataagtacatgaaaccatttaaggatatcatatccaaatctcagcttatcttcaagtttcaaggtgatataagtctgttccggaatccttacatcattcacaaaagtctacaaggaaacaaaaaaagatgttaggttacgtatgaggtattaattcttacatttcagataagcaaattctcaaatctgagagttaaaagcacatatcatacggtggctaatacagcctgagtattataagatgtgccatgcagcctgtaagctgataaatgattttatactaagccttttatctctcttactggtaacacacaaagaaccttacccctgctaaggaaattctgcatattataagtcatatataaatatttggattgagctttaccaataagcttgcaaataaagttgaggctaaaacttaaagaatttacatgcattcatccaatcatttattagaatcatttagctaccaactgttggtgagtactcaccacatgccaggctggatgctaggtgctggagatggtgtggtggacacagtgtggtccctgcctttggtcctgctcttgtatgtttctgtgcataaagtctcccactttcagaggaggcaatgggattcttcagcttctggctgctgtctgaggtttagactc

SEQ ID NO: 192821 - DNA, 316 bp, Homo sapiens
aagcacctgtcagcaggggtaccaatgctcagaaaatgtttatgtcatgaaaaagagcgggtgaattccaggagatctgtctgcagtggggaggattcctctgaccacatggaactgcatgtctggatggaggcctcaagattagagtgtgggtgctgtcaggttcacaccatggacaagtgcagcacaggccaggtgcaaagcagtaagacccagtggggtctgtgtcagccccaagaactcaaactttgtcaagaagaggcagcacttgtcagctctaggcaatgactgccacatgcgaatataggcccagtgt

SEQ ID NO: 192822 - DNA, 536 bp, Homo sapiens
ataactgttaacagcagaagagccatttttgtataaatgtgtacataccaggtattgacattcgtggacctctagtatgattatgagacttggagtatttcagacttctagacaaaggaaagaaaaggtatgtttccttatacttaaaaggtgttttagcttgtcttcatctgatagcatttttcgtatatatatgtgtgtgtgtgtgtatatatatatatatattaggctccacatcatgattccataatgttttctatttatagatgtaatcatagcatttcagttgtcaggaaacatattgagaaaaaattttgatagtcttacctgtaaaggtgaaaacatttcctccattgtcactgtattttttttgttttcgtttttttgagacagaatcttgccctgttccccaggctggaggacagtggtgcaatcacaactcactgcagcctcagcctcccaggctcaagcaatcctcacacctcagcctcctgagtagctgggactacgggcgtgtgccaccacgggtggctaat

SEQ ID NO: 192823 - DNA, 386 bp, Homo sapiens
cctatgagacgacttacagctttggcctagtgacaatctttctatagctcctcaacatagaaaccagtgatcctgccacttgtccatactcccagctgccaatggcctgagggtcaaaaagtgagcagtcactccttctgcaagtccctctccatcccatcccctgcatgggccattcactttgaaggccctctgcccacactccaccactaccatggagggacagcctcctcccttgcctgcactccagagggttatttactgattgcccaacaactctagaccagctctagtctaactaagctaacaaacttccgtgctatgtgctaggctgaaccacaccttctccaataagatctgaaccccttcccagcttatcctccctt

SEQ ID NO: 192824 - DNA, 678 bp, Homo sapiens
gcagtaaggacttcaactgaccttcctcagactgaggactgttcaagttactgagtagggcaaaaagttaaaacagtctttctgttttatagttattatgaatgtactggactctaaaagggacttgtgtgtataatgccacccagtacaaggaatgcatcccaggaagtgaccaacctgatgtgtgctataacccgttagaactacttgatctccgttggaaaacaggagagtatgtaactctaggaatcgatggaactggactggcaggaagacctgggttgtgaacatgacagtgagaactctcactagtgaatgaggttctcaaagggggaaatgaggagcgaggccatttctcttactgtctcctgtctctgaagagaaggaggaagtaaaaagttgaaaaacaacaggaatgaagtcagtggcaaggccagccagtgccactgatgaccaggcctgaggttaaaaggttaaccccccactctaaccacatctgctcttaatctatcacaaccgtttcatgtggaaccccttagagttgtaagcccttaaaagggccaggaactctggctttggcgagctcggttcttgagacatgagtctgccgaagctcccggctgttgagacgtgagtctgccgaggctcccggccaaataaagccaaatccttccttca

SEQ ID NO: 192825 - DNA, 183 bp, Homo sapiens
tttgttgacataattttcattgaaggtaacaaaagtactaagtgcatggaacatatcttttcatataatattggcttagcatgtagaatattaagtgacaatagtgctgctttgaaaacacttaaatgagctctgtatttgtgggatggaagtgaatttcctcgtgggataagttgtagtgat

SEQ ID NO: 192826 - DNA, 445 bp, Homo sapiens
actccctattacattggtcaatttcatttctctgtgccacctatgattttcctgatttatttattcacttttcattgtctgtcttccccactaaaataaaaacttcttgagaaggggcttcatcgatctgcctctgttctatcccaggccctcaaaacaaggaccagatattcaacaaatatttattgaatgcgtacatgaattaaaactctaattggttgtatgctggtggtttattattttcatggaggaaatgacttgtaggctgtgacactcagcttttgtctctgatgctttgttgccctgttctgtcaccgagggctgtcgtcattgctctggccattttgtgctctttgaatttctaatcatcacactcaacccagaaggcagccttacctttcagcactcttcagctgaatgagtgcaagttggaggcagggtcatt

SEQ ID NO: 192827 - DNA, 177 bp, Homo sapiens
caagactctgtctctaaaataaaataaaacaacaacaacaacaaaaacccctccaagctcctctggttagtgctgttaaatagtaaccaccgtctggggaactgcatgtcctgtcagataccccttagtggtctaagacagtagactacaaagaacatgtgttagtccagtgggctg

SEQ ID NO: 192828 - DNA, 232 bp, Homo sapiens
tgttgaagtaatgctgaagctcttacaagaaacgaccataccagccgggcacagtggttcatgcctgtgatcccagaacttcgggaggctgagacaggtggattatggattcttaatttactacagtttagtttatgttagttggttttattacttcccaggaaatgcaagaaccgtacatttagctctttacctccttcttgtcctttgccctattgatggtatattttct

SEQ ID NO: 192829 - DNA, 324 bp, Homo sapiens
atcctctgcttcagcctctggaaagacaggccattcacttcttagcatataccagctctgcacccaccttgtaacttaccctaagtcacttcaactctctggcttccatttcctcatcacgtggggatggaaagaatcccaaggtggtggtagacttagccaagtgcttgtctgatacctgatctgattatctcagaggtccttcaaactcaaactcaaacccaaacccggtggatggtccctccagtgtctcccatctcagcagacggcaacaccatcccctctatgcatacaggccagaaggctgggaggcatctttgccat

SEQ ID NO: 192830 - DNA, 210 bp, Homo sapiens
gtcagacgtaaagggggcggccattattcaccatccatttacacatctgtagctgtgtggtaatgcagaccaagtgttgtcacatcttccatgtcactccttttggagttaaatttccttcttcctggaagatgggttgttttaatttttttccatgagagtttgtgactggtaaattttctttatttgtttgaaatgtctttatttttg

SEQ ID NO: 192831 - DNA, 257 bp, Homo sapiens
atatgaactggtttcacaaatattaacacatctaatccccatgatactactactattattcactccatttaaaaatcaaatcagaaggccgggcgcagtggctcacgcctgtaatcccagcacttcgatagagggctgcgggacagaggaccattacaactagatcaaggagcccagaaaacctccagtagtggacaacaggttttcaccatagcctacgttaacccatttttgagccaagcttcaaccctcagcct

SEQ ID NO: 192832 - DNA, 522 bp, Homo sapiens
cccctttcttattgtacctgaagtttgtttctgttacttgcaaccaggagaaatccaactcatacagtcctgaaaagattagaaaagaagaatctaaacaggatacaaagctcaatgatgaaaatgactctgaaaggaaagtgagatgggttctgttaggttatggactcataaaatgaattggcagatgatcagagcatcaaattactcttaccaaatgctttagagaaggctatttagttgaatggtttataaaagtcagtaaatttatagtgctcctgaggtttaataatggctcagttgggtagagacctgagttagtgaaggcttggttatgggcagaccagtttcaagaccacaggtcacctaactccttacacccacaagtggccaacatatgctccaataatggggcagccagagagtatatacatgtgtttgcaaactgtctccactctggaatatgaactaagtcaatattcccctaataaagcactgaggtagcatcttatactgggcata

SEQ ID NO: 192833 - DNA, 494 bp, Homo sapiens
gacaagtgttttgtctaagagctggtttaaaggctaggataggctttcacctttattgcttcagcataaagttggttactgaatagactggcttgagattagaattatgcagttgtttgtaagatcaaagcactggtagtggtaaagataacgtgtatcttttagaaaattgcccaagctgattagaacaagtttaggagttgggtacattaggttcaagtgctgcaatctgtatgtactaaatagctttactttgtgtatgtgtacttataatgtgtaggaaattgaacgttcatatttctacacacaatctaaatgttttaagaaaagagattttagtaagatattttctcttatcttaatgtggaccaagcctcttatttttaatttatattttgttttacaacagacaggtccatcacatgtgcttgaactcttggacatctgaattttgcacactgtgtgcacacgtaagaatgcttatgggagaaaaa

SEQ ID NO: 192834 - DNA, 350 bp, Homo sapiens
tggaggctgtggggtagactcgatttccttgctttttccagcctcaatggctgctgcattcctggccttagctctgtatccctctggcctctgccgtggtagctgcgtggcctgctctgaccctgacctcctggaaggaccctgtgattacattggacccacctgtgtaatccagaatccttgcaaaacccccatctcaaaatctttcacctcttcacatgcacacagtggctttgccccgtggagccacatgctctcaggttccaggaatgagtctgtgggcatctctgggggccactgttcagcctgaatgtgttctgaggcttagtattttgtctctttgagttcta

SEQ ID NO: 192835 - DNA, 451 bp, Homo sapiens
catcacacctgccagtggtgttggtgttaaggcaatctaaaacaccgagatgtctagggatcctttccaattcttgaactttaagagtccctgggctccctcttcattcccctggatggaggaaattaaagtacagggtgctttgagtacaggagataagacacatgtacaaataattgcaacataaaaagggtagactcagtctccattgtcagaagaggaaattgggaaatataacttagggcagagattccctaaaaccaaacaaggataatactggtccttgatgaggttttcactgtttcagaatgagatgagaataaaaaggactatgaaatgtgtttttatactggcctttatacaatttttatttcctactatttgaagtgaaaatatccttttaaaaataaaaggtggtgaaagtagatggtagagtttttttgtttaatct

SEQ ID NO: 192836 - DNA, 492 bp, Homo sapiens
gccttcttggttgccctctcccagtgtggagcctccttcctacaaatgagctggggctccatgttcccagcctgccgggcctgagatatagcctctattctatgcttgggggcaggtggaagaaaggagcccctggcctgtctgccacactcagctggaatttagcctctgccatgtggagctgggagggttgagaagtgctgagaacctggccctcctgggcaaacaccctaacccttgacggggagctgggggagagggagcccttcttcttggccacacctgcccccagtgctaggcggggggagaggggtgctggaggtgggagggcaggagtgtcatggctcaggtgccaacaggcttgccattattcccaggccttggcaggttttcttgtgtaaacctttgtttgctgtgtgccctgggcaccatgcccagaggctttcagtgcttgcttttgaataatcgtcatcagttgtgctgtttcactgg

SEQ ID NO: 192837 - DNA, 579 bp, Homo sapiens
cagatgaaatttgttaagaaaaagtatccatagaattttaactttaatctgctttatgcagatttttggcttgaatctggggtaagaactgttagccctgttgtacagatgaggctgctggtgcctggcaagttcccgcagccagcaaacccttttatcttttttttttttttttctagacagagtctcgctctgtcgctcaggctggagtgcagtggcattgatcatagctcactgcagccgtcacactccggggcccagcggatttctccgtgtctcagcctccccgagttagctggaactacgggctcagtgccaccagtgctcagccaatttaaaaaattatttagagatgtggtctcacttggttccccaggcgtgttcttgatctccagggctcaagcgatccttctgcccgggccccccaaagtgcggggataagggcatgagtcaccacccaaagccttcacttccaattttaatgtcaaataatttatcttttggagagggagtctccctctgtagcccagtctagagtgcgggggcccaatctcagctcactgagggtcccgagctcga

SEQ ID NO: 192838 - DNA, 125 bp, Homo sapiens
tggagctctgagaagactgggacaacatgcaagtggcaagctgaaggaaatatattacccacattaagggaattgcagaggagggtctcaaagcagaaaagtaccttgccccctctagcattgca

SEQ ID NO: 192839 - DNA, 514 bp, Homo sapiens
aatctactttctgtccttatggatttgcctgttctggacatttcatataaatagaatcatacagtgtgtggccttttgtgactggcttctttcatttagccttatcttttcaaggtccgttcatattgtagcatgaatccattggtccttttatgacggagtaatagtgtattatttggatatgccacattatgtttatttattagcagttgatggatgttaggtttgtttccatttttggccattgcaaatgatgctgctatgagcatttgtatgttaatttttgtgtgaacttatgttttcatttttgttggatatatagccaaaagtggaacctgagttatatggtaactatgtttgactttttgagaaactaacaaattgttctccacagttgttgcaccatttgacgtttccatcggcagtgtataggttctaatttccccacattcttgcttaacacttcttgtccatttttttttaaatcttagttgttctggtgggtgtgaagtgg

SEQ ID NO: 192840 - DNA, 605 bp, Homo sapiens
tagttgagattacaggcgcccaccaccacgccaggctaatgtttgtatttttagtagagagagggtttcatcatgttggccaggctggtctcaaactcctgacctcaggtgatccgcccacctcggcctcccaaagtgctgagattacaggcgtgagccactgtgcctggcctggtctcaacatattctaaaccaaatttgctgtcttcccctaagccagcatctcctctggcttgcgtggaatcttttgaaagcaccatctctttctcaaggaaaacttaacgtgtctgggtgaatttctccttcctcctgctttgtcccactgcctgctggagtctggttgtctgtgtcctttttctgctaccgcccagacccaattcctcaccttcttgcaactggactattgagagaggctcccaacatgggccatgacccgcctctcccagcctctttccagctcatgcctgcaggggatggacctccctggagccactctcttcctctgccaccttctgtgacttcccactgcctccttgatgctgctccaactcctcactctcaagccttccaggccccatagtgtgatcttgggcttcctttccagc

SEQ ID NO: 192841 - DNA, 463 bp, Homo sapiens
taaagacgaccttgaggagtatagaagatcagccttctgcctttaaccctttccatgtgtataaggcgtttagtgaaaacatgctagatcagtcagccatcacaaaatggaactggaattgggcaaagttgctgccaaattatctgagactggataagatgaccttcagtgtgctgctcaaaaacaggtgggaaatgaagaaggatgaaacactagaagaggaagaaaaagcaatactggagcacttaaaacaaatttgcaccccacagaactcttctgcctcagataacatagaggaacagtaatctgcagaaaacagcaacagctttattttaggaaacaatcccatgtaatggagtaggattttttaccatagtcagaatgaacctcatatgtgctgtgaagcatgaaaccaatgactgagtaatctctgtactgaaaaggaatacagcacataaaggat

SEQ ID NO: 192842 - DNA, 354 bp, Homo sapiens
ttgtcttacctttgaagtttccttaagttactctgaatagcatctccctctgccacgtttcctgtctctcgcataatgagatactttctaattagcatatcacaaatattcctgattttctttacaagtcccgatacatttttaagtgtttcttttaaagcatatcaggatttttcacactctataaagaggtaggggaattcaagcaatgtgtcaactcaattctccaattttttcttctttttcttcttttttttttttttttgttttttgttttttgtttgttttgttttgttttaagccagctggcagcatggaatagtgggaaggtcacagcactgaaagccagaagtc

SEQ ID NO: 192843 - DNA, 407 bp, Homo sapiens
attagacgggtgtggtggcgcatgcctgtcgtcccagctactcaggaggtggaggcaggagaatcacttgaaccttggaggcggaggctgcagtgagccgggagtgcgccacggcacttcagcctgggcgacagagcgagactctgtctcaaaagagaaaagtgtaagtgagattgtggtgcatgttctgttttttagccctttattcattacgtgaacatctttgcatcacattaacctaccttacttttcatgactaaaaaatatttcattcactgaatgttccaccacgtattaaaccaaaaacctcatttttggacctttagctttaattctttgctgtgcaaacatttggcttcaatattggggtatatttgtaattatttatttaacagcttcttttaaaa

SEQ ID NO: 192844 - DNA, 320 bp, Homo sapiens
cttttatgaatgaggaaactgaggcataactttaccaaaatgacaaagctatgtctaagaaattgggtatcaaactcagctttaaccccaaactccttaaaaaaaaaaaaaactgctttgtaatcctatcatcaatttggtatcttcagtgtctctactggcacttttccctcagaatacagtatgaacattctcaagcccttttagtagtaaagaaatcctcccacaattttacatcagatctttattttttgcttacagtgaggttatttgaaagttagtgttctgtactcagtctccaatttctcagcttccatttt

SEQ ID NO: 192845 - DNA, 356 bp, Homo sapiens
acagtagcaaaattagtacaataaatgctgtgtatccacctaaaaaaaatctaaaatgttctctaaaaaaaggtgaaagttttagaattatggtattcctacccaagaacagttctagtgtcaatgaagagattcataaggcctatgtttattactgaaaatgtatccagaggaaaactggtttcctttaaggtttttatgagaacttaatttgatttaaaaatgtctatattcaaacaatacccttttaaggcccatctaaactccaaagagttagaaaaatcaccatggaatgtttaatttttagtgcagttttctgccactatcggaactggacatctagtatgtagatgatg

SEQ ID NO: 192846 - DNA, 248 bp, Homo sapiens
gagacttgaactttaatagtctgtccagcttgacaaccctgtatatgaataaaacaaaatataaaggttctaagaaaaaatgaggctataattccatttcaatgtaggccttgtgagaatacagaattaatttaaaagcagtgaagcactgctcctttccttcgtctaaatcaggggttggcaaattatggcctctggctacatccggcccatccctgtttttgtaaataaagttccgttgaagccgt

SEQ ID NO: 192847 - DNA, 536 bp, Homo sapiens
caatattgtatttgattcaatatttatgagacaggttctcgctctgccactcaggctgaagtgcagtagcatgaccacagctcactgcagcctcaaactcccaggcccaagcaatcctcctgcctcagagacagggtatcgatatgttgccagggctggtgaactcctgggctcaagcaatccccccagcttggcctcccgagtagctgggattacaggcatgcaccaccatgcccagctaatttttgtgtttttagtagagacggggtttcaccacattggccaggatggtcttgatctcctgacctcatgatccgcccacctcggcctcccaaagtgctgggattacaggcgtgagccaccacacctggccaataaaaattatttttaaggaatttgcacacagaccatcaaagacctactcattgcttatctgacagaataaaaaacagtatcttgtttaatttttgtgtattctgtgaagttaagaagttttcgatgttcaccagttatttgtgggtgtatgaattatctgt

SEQ ID NO: 192848 - DNA, 202 bp, Homo sapiens
tcgagctcggtcccaatgttaaagctgtgaaaaatgatgaaaacctgaactagacactaacagagggtgaggaactaagtagaaagttacaatccatttttagaatggagtattgacaggactttatgactaaataggtgtaggtggtgtgagaggaggaggaatcaagaataactcccaatttttaacttgaacaaataca

SEQ ID NO: 192849 - DNA, 388 bp, Homo sapiens
cgagtttgatgcctcttcctttaccctccttcatgtccttggtaaccaagataactagaagattggattgtgaaatcaaattcatatgaattaaatatcactctgtatcaaactttattattaacttcaaggatacaattaaaaacaaactcaggtaaacaagaagtgcaggaccactgcccacagatttcctcaggttctatcttgctgcattaggatttgctctaaaccagattaacatgtggtctctaagtcatgtaagtagctccatcacttaggtcaaaaaacttgtttcacttatgagacatctaatttatactcagatagttatgtaacttgcattactctttatagtgatctatgccccctaaattcacgtttccaggtt

SEQ ID NO: 192850 - DNA, 464 bp, Homo sapiens
tgcataacaaaccaccccaaaacttagtggcgaaaagcaacaatgttctttttatttctcacttttctgtggattggtagggtggttattctgagctgggtagtccaggatggcctcactagggcctaagctgggatagctaggcctctctctacttggtgtttcttccgtcaggaggagagcttagtcttcttcacttggtggactcaaggatctaagaaggtaagagctgaagctgcaatgcttcttgaggcctaggttcagaaatcacatgtcattttttgctatattctattggtcaaaacaaatgacaaaggccaacctgaatacaaagggtgaaaaatcagaccacctcttgatgggaggagctatgaagaatctgtggccatttttaaactaccaattacctatctactattgtctctcacagtggaatataagattcctaacagcaaggtctttgg

SEQ ID NO: 192851 - DNA, 231 bp, Homo sapiens
tttcaaactttctaaccaattacaatcacaaagaactcaggacaacaatcagtgagcaaaatgaaactgctggagtgaagcagccctcggcaggtttcactcttgtagctctgctacgcaatgtgcagctgggactctgcttcaataagtaaataaaaatacattataaaatacaaacatacacaatggatcccacttgctgtcttgttcccagtaaaggggtatgtagga

SEQ ID NO: 192852 - DNA, 346 bp, Homo sapiens
ataaattaagctacacatcgtagaaaaataaataatcactccaaaagatcccacctccacagggaggcttgaaaagatgctattacaccacagcccacagatgaaagtgtgaactcaaaagtatctgagacaggtctccatccatttagaaagtttattttgccgtgtgggttcactttcacactgctataaagaaatagccgagactgggtagtttacaaaggaaaatggttgaactgactcacagttccatatggcaggggaggcctcaggaaacttaaaatcatggcggaaggcaagagggaagcaggcaccttcttcacaaggcagcaggacagcgagtgtg

SEQ ID NO: 192853 - DNA, 288 bp, Homo sapiens
ctttcattattttgaagatgttgcttcactacctcctcacttgcattatttctaacaataaatttactggtatctttatctctgctcctctgtatataacatattcttcttttttctttttatcgctatgtattagtctgttttgtgttactatgaaggtatacctgagactgggcaatgtataaagaacagagtttgactcatggttctgcagacggtacaagcatggcaccaacatctgtttggcttctgatcaggacctcaggaggctttactcatggcggaagg

SEQ ID NO: 192854 - DNA, 620 bp, Homo sapiens
tcactctgggttagtttttcttaccctaaaatttcacatacatcgaatcatacaatatatactcatttttgtatgtcagttagcataatgtttttgagattcatccatggtgttgcatgtataatttctttttattgcaaagtggtattctgttgaatggatataccttaatttgtttatctgatcacccattggtggatatttgggttatcccagtatttaactattaagaataaagctattatgagcattttgagtaaatgtcttcgtggacacacagtcatttctctttggtaaatacctaggtgtgatattgctgagtcacatatatgttaagtgtatactttaggagaaactaccaaactgtttttccaaaacattttgaccattttatgcctccactagcagcacatgagagctttggttgctgcctgcccatcctccctgatacttggtattggcggcctttctaactttctagctattctcagatggtaggttgtggttttatttgaaatttcccactaagaatggtggacatcttttcatatacctactggaaatttggatatcttggtttgtgaagtgtctgttcaagtcttttgcctagattatcagat

SEQ ID NO: 192855 - DNA, 554 bp, Homo sapiens
ataggcaaattatatgaaacgtccagagacagaaaatagattcgtggttgcctagggaatgattactacaaggtttctttctgggatgatgaaaatgttccaaaattaaattacagtaatggttatacactctgtaaatatgaaaaaaaaatcactcactgaattgtatgctttaaatgagtgaacttcgcagtatgaaattatatctcaataaagttacttttaaaaagtaaagaggtctacttattttcaaaaagctaaaacattctaccaaaagagaaattcagcccaccaggcagccttcaaatcttacttttggtttgtttaaacaaaggaaagattcaaccacagcattaatgtcgttcccaagaaagcacaagcggccaggtgcagtggctcacgcctataatcccaacactttgggaggccgaagcgggtggatcctaaggtcaggatctggccttagactggcctggcctacatagtgaaacctcatctctactataaaaatacaaaaattagccgggtatggtggcccgtgcctgtagtcccag

SEQ ID NO: 192856 - DNA, 234 bp, Homo sapiens
gagactaagttaggtcaaggcagagaagggatgcattggttcagcagtgcaggggatgctggcaacctggaaaagaggaccttcagtggagtggcaagggcagagtcaggtgcagagtaaagggcagaattagcagaataaactctgagagaagtggaagtaaaacaatagcagaaataaggtcaaaccatatttgcaaatatttttactcttgagctgtaatttttttttttt

SEQ ID NO: 192857 - DNA, 466 bp, Homo sapiens
cacactcctatatgatcagtgacagataaagacagcattacgaggctctacaaatgaggttcactgtctcagtgacctcctaaggccagaaacaggacgagagacaagtacaagtcacaaaaatgtttgtttcacaggctgagctcccatgcgtgaaaaggatcctgcagttctttctaagcctttactgcaaaccacagcacaattcaaagtgttgcagaactttgagaaatacaagcatttctagaaagcaacactggaacaagcatgcctgtaagagcagggtgcctcctgccaaacatttgacaaacccagcttgctcactgttggcaaaaggcgccctgcccagcactacctgcccattcgtggccagatggtcaagaaacccgttttccccattctccaattgttacacaagaccatgtgaaaacattactgatctataggagtggtgggggatcctcta

SEQ ID NO: 192858 - DNA, 343 bp, Homo sapiens
attgtgctggagaggaggactgatgcttagacccagtggatctaaatctctgaagaaagggcctggaaatccttgttttcaagctcccaggtatttctgtacacagctgggaccagggaaagaactcaagccctcatctagataatgccttcatcacagggccgcaccaccccctgcctgactctatggtgtcaccagcccttctggtagaaggtcctccctggcacggagctgcatctgtctccattagcatttaaccctgggtcctggttctctttccagcagccaagagaatgaagctttacacttggcctggaattcctgtctgtgtgactttttgatg

SEQ ID NO: 192859 - DNA, 432 bp, Homo sapiens
aaagggatggtgcctgaccattcatgaaggatgcaccccctaatcacctccctccaggccccacctccaacactggggaccacagttgaacatgtgaggacagagatccaaaccatatcatgccctaaatttcattcagttatttactcattcaatatggatacatgccaactatgggccaagtgctatagcagtgtactacaggctagtgatttctaccaatggtgaagtgagcacatcaatttctgaacttttcaaaggacttctcattcttgattataaaaattttaaaactcactgattattaagttcacagtattcagaagcaaatggatttggggaaaagtattaatgcaccttgctactattcaccattcatcctccctatggctcccatacatttccacaaagccacagagaaatttgcagttg

SEQ ID NO: 192860 - DNA, 374 bp, Homo sapiens
gaagtagcactatccgtagaaaataatgttctaggcaagagtccattaatagtctcgggagataaacagttttaactgccaagagggagaactcacctggagaatttaatgaatttgtaaggactaccatacagttagctagtaataattttatgtgattcatacaattgtgcaccattctgagatcagtgtacttcgtgttcttaacactatctgtaccattagagagcatcagaaaagcttaaaacccatagtcaaggcattcttaaaatagggtctgtgatcataaaaattctttctctcgaagtacttgcaaatgaactggaaaggtgtgtgcccccaaaataaaactaactgtggattaatattaaact

SEQ ID NO: 192861 - DNA, 590 bp, Homo sapiens
ggctcctggatctttgagcatcacctggggacttttcagatatgtaaagtattaggccccacactggaccttctgaatcagaaactctgggaatgcgacccagcaatatgtacttttaaaacccttccagattattctaatgcacattaaagtttgagagccactgctataagggataagagaacttagagagatggtctttactctttaagagattaccatctattttcccttgcccacctgtcagtgtctgaattcaaactggaatttctgatagctaagagctgacagcagtataatgattttgttttaccatgtctgctagattcagaaatgcctcctgcagctctctgtgggattcttttctttttattattttaatgagagtcaatcactcatttataaaacctcttacagaaattaaagtatgtttcagatgacagttacacttttttatttctccaggggtctgatttgcaaagaattcttatggaactggattgtttgtttatgtaggcagtcatttgccatgtggtgatcttgaaaacagactaaataaatggtttgaatggtgatgtcatggatagtgg

SEQ ID NO: 192862 - DNA, 469 bp, Homo sapiens
ctgggatctgctctcaaaattctactttataactgaatataaaaagtttatggctggcatatgtatactatacatgagtcaacacgtgggttagatgtaggccactgataggtacctaagttacaaaataattctttaatgagtaaaactactggagaggtgaacacttttacagtgtctctggctttaaaaaataagattggcatgatagctaaagcaggggttctaattgcataacttaattaacaccgagacttactctgaaaaggatctgcaaaatgttactactatggagatcctatgcgaagcctcttacatgagaaagatcggccaagaaagtagcgtccactctattaaaattttttttagccactaaagattcctattaggtaaagtaaggagaacaaacattttagcaggatgtgcagaacaaagcccctcccatcccacaatgattgatgccccatca

SEQ ID NO: 192863 - DNA, 938 bp, Homo sapiens
tttgaggctatgcaaataaagactctaccaagggtcatctgcaggaggaccagtgattgttacagggcactggaataacagcaagttgagtactgcttctgtcctccagcttcttccagttaccaagtagcctgaagctaggaaacgcacatgacccaaagcaaagaacactaaggagggagcgaagactcagatagggctggtttccatcctgttgacattgctgttccttgagatattgtaagtcccagacatgaaaaatcagtcttgagggaaggtcagacataaatgtatatctcattcatatgacagaagctgggcatgattgggtggcaccgctggaatttcaaaaatgtcacttagatggattaaccttgaatgctgcagggattaagcaacaaggttgatagtccaggtatttggtcctggatgccaggtagtgggtgtaggggagagagtcaagaagtcaactgaagctagagtgagtagtggaaatgagaaggaagcctaagagactgttagctcagtgctcccctcctgcaggccctgcctgcatgggtcagacctccgtgagcattcttttctctgcataggcccgatgtggtgtaggaaggtagctgggtctccgttcccggttagcctcggggaagtcaggcttgccaagtccgttgtcagttgccctcaggtccggcgcaggctgcccacaagtgacgtgggtatactggccttgctcctcctgctccgtctcaccggtggtagaagtagttgaagttggagacgatgacgggcacaggcagggcaatggtgaggaccccagcgatggcacacagcgagcccacgatctttccccccacagtcatggggtacatgtccccgtaacactaccgtggtcatgtgtaaccacagcccacagaatccttgccgggatgctgggaaaa

SEQ ID NO: 192864 - DNA, 208 bp, Homo sapiens
agcacctcctctaactctagaatttattctgttctagaactccacactttccaatttcacaatcttctcaaagatttttcatttctgctcctatcattacctcccaaacaaatgaccatgcaaaaacctactgtaaaatacaacaatcttcttaccagcctctttcctccagagctgaatgctggagagtaacaaaatttaagaggta

SEQ ID NO: 192865 - DNA, 526 bp, Homo sapiens
agtcttccaggaaaaaaattgtaatttaatgtattctaattcatggagaaaattttgaatagagtaaaaaggacctggaaatggagaagagtgctaaggagaatggtataaattcagtaagctgtgtcctccaaatagcacttagcacatcgttgattgaataacagtgacagaactgctagtatactgaggagataatgtgctaggtgtttgggaatcacctatttcaaggttcaggccttgattttattgtaaaatatttcatgtggtcgtgggatagcaaatacattcctttttttatgacaactctagcacctagagatacatgggtaagagtttcgtagttgattagcaaatatcagctataggtagagagttggaatttactgtttctgccttttgttgaagtgttaatactaagttttttctgaagccagtgttttctcaaaggattgtctttccttttcagatacagtaatttctgagtttttctgaatttttgctctttaacttctactcgtgttta

SEQ ID NO: 192866 - DNA, 468 bp, Homo sapiens
attcctcctttatgctctaaactgcaccgtaactgctataaagtaagactgtgacatttttgggtttgaggtctcccagtccatgaactctcctcttgtatgtatgagaaacacttaaaattctaacttgatctaattttatgtttgacaaaacatggggggaaaaatttacaaagctatacccttaggagttcatcataattaattatgcctcaataaaaataaaggaagaaagaaaacagaacaagtggaaaatcccagtccattatcccaattaagccccaggtttgcattttatctagccctcacgaagtactccactatcatgaggtcagagctcatcatcagaaatccccctcggagtgctgtagtgtctgtcctattcaaggcagcgttaggtctgaccacagtattttcagaacatacaactaatccatcaatttcttaagccttttaaaattcactgaa

SEQ ID NO: 192867 - DNA, 236 bp, Homo sapiens
aacaaaggcatcacgggcaaactaatgtggtcagtttaaggatggagctcatttcaaaatgccaaatatagattcacctgccaaacttgagaatttggccttaactttgtaagattaatacaataaacaaacttgactgctgttagcaaaagccagcctccaaagcagactgtataaccactgacagtattttttcacaacagaagttttatattgcatttaatcagcactctgcc

SEQ ID NO: 192868 - DNA, 287 bp, Homo sapiens
gccatgttgttaaacaacaataataaaatatgcatatgtatatatgtgtgtgcatgcatacatatgtctgtgtacatatgtatatatatacacacacatacttacagttttaaatactagaatcacacagtgaggaaataaattcaggctatgcaaaatgcattgaactaaaatagcctgggggaacagttgatttgtgttttgtcatctccaactcactctggggaatgtcttcaccaggtggaatggcagatacaggctcttcctctctccggcttccctcatgc

SEQ ID NO: 192869 - DNA, 499 bp, Homo sapiens
ttcttgaagatgtacaagccagtctccctgaacgatagttttccatttaaaaaatgaaataaacgtagtggagagcagaggaaggcatacaataaagagagagcccacacctaatgccactaatccaaggggcagggacccacacctcaaggcctcacccctgaggttctgaagtagtgtgtgtgggtgcagcccagatatcaggaatttaaacatctctgcagaacattctaatgtgtatccagggttgagaaccacagctcaagagccttgttactcacagtgtgtaccaagggccagaagcattaacctcatctaggagcttgtcagaaacagattctcagtccacccatcttactgaatgagaatcccattccctgctcctcatcccatccctatctgcacccccaccccaacctcaagtgttattttcctttctggggaaaaattctcatcagaaacgaaagcagatcataggaaaggagcaggggaccacagg

SEQ ID NO: 192870 - DNA, 203 bp, Homo sapiens
atgttgcaataaaatccctatacataatcttttttattttttgaaacggagtctcactgtgtcactcagactggagtgcagagcgaaactccgttcctccacccccgagcaaaaaaaaggtataaaatggctcacatgtccatcgacaaatcaatgggaaaacaaactctggtacataaatataatggaatattattcagcca

SEQ ID NO: 192871 - DNA, 119 bp, Homo sapiens
tagcaagaaacttgttaccagactatataaaagacacagcgtaataagacatgaccttgcagagccttggagccaatctgtgatgtttttccttcctataacccttgccaattatctgc

SEQ ID NO: 192872 - DNA, 488 bp, Homo sapiens
tatattcttttcttctgtaagccaagactcattaaattttcaaattcctaaataagttaaacaactgtccttttttaacagtaaagagtgatacagaaataaactggaaaaacaacccatatttaatctttctcattcatatttttgtcctatagacagtttgtctctgatagacaagaatagtggcagaatcagtagaattttctgaggcatagcatataaatataagaaatgcagaactcaaagtcattcattagggatctgtttttacatatttattcattatttaaatggcatatgaaaatattttcccttgatcttttacagtttgattgattagagtgccataagcacatatcacgttttaaatgatgggcttgagaccacctgtacagctaagaatggcaaagatagaagcacagtcaaggtctttgaggaatatttgattgattctatcattttatactaattattctggatccttgaga

SEQ ID NO: 192873 - DNA, 573 bp, Homo sapiens
ccactcaacttgctggaattaccagcggaagccactgtgcccagcccagactcccttttacctagtatatcatgtctaatttctaacaaaaaattaaaaaaacattgtaagaggaaaaaaagaaaccctaaaacaaacaagcaaacaaaaaacccaaaacaacaaaaagtttcaagaaacagagctagctgacagaactatattcagatatggcaggtatattagaattatcagattggtaattttaaacaactatgactaatatggtaagagtgataatggaaaaaatagacaatttgcaagaacagatcagtaatataagcagagaaatggaaagtctaagaaagaatcaaataaaaattctagaggtcaagaaactaacaaaaatgaagcatggtgttgaagcctcattagcagactggatgtgggtgaggaaagaatctggagcttcagtatatttcaagagaaacttccaaaaatgaaagcaaagggaaaaagactgaataaaaaaggaacagaatatccaagaacagtgggacaactataaaagatgtaagtatgcatagtggaacc

SEQ ID NO: 192874 - DNA, 602 bp, Homo sapiens
aactttatcttgtctcagtgatgccaaaaaccagttatcatctgattctaaagctttaataaccttaatatagactaagttatgtgccccaaagtgaatgtttctctgagtccctatttttgagactctcttgctatctctatcaaccaagaagtctcaaatacaggcagctccaccaaagctgtgttcaatagaaaatgtttaacaaacgaattctttctacccacatttcctgaaagcaaaagattgagaggtaaaactacaatcacaggacctacattatttgcctataaaattagttgaagtttgttttttaaaggtacaattatttgttggcaaggcttcagtgaactagatattctcatacattgccaaatggagagaatacaaattgtaacagcctttctgacaagcaatttggcaataaatatcaagtctttatgttcataactctttaacccatcatttttatggctcatgactaagtacactgatgaggaataaagaaaagtttcatatagaaagatatcacaactgaaatatccagcaatagaaaaatgtttaaaatattatggtaaattcataaactggaatataatata

SEQ ID NO: 192875 - DNA, 179 bp, Homo sapiens
acatacaggttctctagggaacagaaagctttcaggaaaatggaaattcacatgtgcattaatgactttataattaaaatgaaggtcaggcctttcctctttaacactcatcttccctgcactgagatttgcagacctctggagaaccctaaccttgtttcctgcagcctccttagaac

SEQ ID NO: 192876 - DNA, 421 bp, Homo sapiens
ctcgctgaaatttatctccttcccagaggtccctgcactttgggatgccctccgtctgagccaacatacaaccccattctacttcccttctaagaacattgctgtctcaggataaaacattctctgatctagaatctgatgtattaaccgtccatttgccgttcccctcccatcttttttctaatcttgtatggtcacccctatgaaagaaagcccttgtcatcacctgatgtaaggacttcgagactcgggtgatccgcccatctcggcctcccaaagtgctgggattacaggcgtgagccacggctcccggcttgagttagatcttttaaaagtaggaattcagggactacagccacctcagtcgaattgcctaccacttaactattttcactccctacacaaaactgatcttcccctg

SEQ ID NO: 192877 - DNA, 252 bp, Homo sapiens
gtgtgttccctttgtttgagccccatggtacgggtcaaatggggcaggaagtgttagtaggaggacgggcagagtggccatctggccacagatggcggtttctgtgcaaaacacatcaaggcagccttggaaatgtgagtgaaagcaccttcaaagttctggtcacagccttgggactaagcaaagccaccaaaagtacataaaagacaatgaccatcacccagtgccggtgatgctagaaggaaagggaat

SEQ ID NO: 192878 - DNA, 729 bp, Homo sapiens
tacagtaagcatctgctacaacttaaaaacaagcaaaaataaatgttacagtgttagaagtcaagacaactagttactttttttttaaggtaatgcttggaagggggaacagggtgggcttggacagctggtaacattatttcttgacccaggtgtttacataggtctgttccatttgtgaaagtccatcgtgcattaaactgaagattagtgcactttgtatgttatacttcaataaaaaatttagagtatgttataaatttagtcgaatgaatgaaaataatgatgttctacagtattcatttagtgaattgaaagctattactcagcaccttttacttgccagaccccgtagcaaagtatataaagagaacagctcagccagagctcctcttgtggaaacaatctacttaaactcccttaagccttaaagttacgaggatgtaaaacagtctgggagaagaggctgctaaggtaatatcttgaatattacatgccaggcaaggttccccgttagaggcattatctacgcaaactgtcagtattttgcaatgagaaaagtgagccccagagattacatgatttgccacagcgaatacgtgcccaagtccacctgctgccagggctcatctgccctccactgtgccaccctgacagcagtgcttgcacagtgacccaacagctgtaatagcagacctgggaacctctgatctctaacagtcccctgca

SEQ ID NO: 192879 - DNA, 322 bp, Homo sapiens
tacagtaagcatctgctacaacttaaaaacaagcaaaaataaatgttacagtgttagaagtcaagacaactagttactttttttttaaggtaatgcttggaagggggaacagggtgggcttggacagctggtaacattatttcttgacccaggtgtttacataggtctgttccatttgtgaaagtccatcgtgcattaaactgaagattagtgcactttgtatgttatacttcaataaaaaatttagagtatgttataaatttagtcgaatgaatgaaaataatgatgttctacagggatctggcctctgccggataagccc

SEQ ID NO: 192880 - DNA, 557 bp, Homo sapiens
ttcatagacaggctttgtctgtgaaagccctgcagtagggtgtggtgctagagtgcatcagaagcccaggacagttgcagccagcatggcatcgccagagcctggggcccactgtggcaggtgaagcactggagtgggcaagaagcctgaggcagatgcaagtggaaagacactaaggtgctctaacagctggatgcagctgaagccagtgcagtgctgccagaagcctagggcccactacagcaggtatggcactggggcagaccaaagcctgggacagctgtggccagcatggcacttccagaatctcagggcaactgtggccataagagtggtgccagaagcctgaggtccacaacagcaagcacagtactgggacagctgaagccaagggccactaatgctgcctgctgctgagggtgacctgaagcccaagacaactgataccaacccagtggcgatacataccagagatcgagtttgccatacgagcctgaagcctggggctttatggtccctcctggcaccagggcaagtttagaggctcagtcaccagt

SEQ ID NO: 192881 - DNA, 194 bp, Homo sapiens
ccctatgaggcataattataacaagctccatctgcctacgacaaacagacctaaaatcgctcattgcatactcttcaatcagccacatagccctcgtagtaacagccctgtctaatcccaaagcccaggatcttcaccactctattaactggcatcatctcctctaatctttacgccaattcctagcagcaccc

SEQ ID NO: 192882 - DNA, 203 bp, Homo sapiens
gaaaaaaggaattagagaataaaacacagaggggacaaacagaaaagaaataataaaacagtagacctaaacccaatgtgtcaataattaaatgtataaagccagctgtgcgtggtggctcatgcctataatcccagctctgtgggaggccgaggccgacggatcacaaggtcaggagatcgagaccatcctggctaacacag

SEQ ID NO: 192883 - DNA, 392 bp, Homo sapiens
ggaaaagtctggcaatttctctaaagtaaacatgtacctactctatgactgagcaatgccacttctaggaatccacctgagagaaatgaaaggatgtgtgtccatatttagacttagatgcaaacttcataacagccttattcataaatcaaaatagaaacaacccaaatattcatcaacagaggatgggataaaccagttgtgggacatggagacagctgtgcaatggaatctattcagtactcaaaagaaacaaacccggctgggcgtggtggctcatgccagtaatcatagcactttgggaggccgaagtggggggaccatttgagcccaggagttcgagaccagccttgacaacatggtgaaatcccatctccacaaaaaatacaaaa

SEQ ID NO: 192884 - DNA, 298 bp, Homo sapiens
aatgccatcacatcactggaagactgtccttgtgcagtgaggccacctgtgggcagagccacaggaccagctgagtcatgagtccagatgggatcagtctgaaaaacatctaaaaaaaaaaaactccccagtcttaggttctacaacagtgatacctatagaagcaattggggaagttataaatcttgggacctctggccacatgactcctgagcagtaagaaattatagaaactatgcctacattttagcagaacttgggcctctcccataatcctaatcttgtggcctttcattag

SEQ ID NO: 192885 - DNA, 437 bp, Homo sapiens
ctgaggttttgggtcccaaccagtgagagggaggagcaggtcttggggagaacgggggctcagtcttgatgtgttaagcccccaggagacgtcatggtttcaggggatttgacagtttggagctcagggagaggctagggctggtggtgtccacgagtctccagctccctgatggtgtttaaagctgagaggctgcatggcgtcactgacggagtgggcttcatggagaagcggaccagggtctaggcttggaccaccaccatttccccctgcggaaatccagagacctccagcattcgctaaatctgacggtgggagacagaccccagggagagaggctcagagggtggatgctgcacaggccttcctgaggagagccaggtgccggagcaaggagacaaattggacccagcctgtggtctccaggatgccatcgt

SEQ ID NO: 192886 - DNA, 399 bp, Homo sapiens
caggctggcagtacataagttacagatatgctctgaataaggtttgctttctctatttgggttattctgctcagcttctctttctgaggtcttttagcatccagcatatctataaaggaaggtggggtcctaaagggctctaggaaggggcaataaattgaaaagcattgtggagtcagagggaaaaaaaggttgtagaaaaaaggaacatttcctctagagtatgaaaaatgattttgtggtgcagctgataatgtgctcgcagggacaatttttttgttttttttttttccagacagagtctcgctctgtggcccaggctggagtacgggggcatgatctcagctcactgcaacctccgtatcctaggctcaagcaattctcctgcctcagccttcc

SEQ ID NO: 192887 - DNA, 539 bp, Homo sapiens
caactttgagaaattgctcaaagccttataattttttcttcagaaaaatgctaatgagcacattttggagacatgattacatatataatgttatcagaggcactcaggagcctctccaaggatttcaggttaagattcctattctaacctaattcaaaaccagccttccacattggggtgtccagctccttctgttgcagggccctggtgatcctggaagtagttggttaactagggatggtaggtccctgatggaatagcatcaaggagaggaagggcatggagcatagagaaaatggaattgggccataatctttgcatttcccactgaagcttatatatctgcagtcttcactttaatcaaaatagcttaatttaggaaagaaagagcccactgtttttgctttataaaatcctgattttattgcttcctgaaaatttttttaaaggagaaatacaaaccatatgttacaagggccttcatttgacagtttaactggggtcatgctaggactgtatagatattgctgattatgata
